United States Patent 10,329,575 (REGULATORY SEQUENCE FOR PLANTS) - sequence listing, part 4

SEQ ID NO: 3245 - DNA, 3000 bp, Unknown
  misc_feature (1)..( 3000): cDNA_ID_1820013_gDNA_ID_1620634_Annot_ID_47319 3000 nt of promoter + ATG
ggaggaagaagctagggttagccacagttatcgtcttctgttctctctgtttcctcttcggtttctatggctccactctactttctcaggtgtggaaactctctgatcttttactctgtactctttagatgtgattggagtctttagcttggttttgtgactaatcgagggttctatgtttgggatcagaatgtgcctcgtgttaaacccaggttgagaatgttggatatggttgagaatggggaagaagaagctagctcgatgcctcatggtgttactggagaagaatctattggatcgattccttttcaggtctgattttgttgctaattttttgacttttaagatgtttggattggcaaattaggtgaaatcgattagttagggcaagattgtgcatttgattatctaattgaactttgtttttttgttcatgtgtggtgaccatgagtgtgagtgagagtattgtgttttttagcaattagtcaactagtgaaatttagtacttcatctttatggattatttggtttaaaattggcaggtacttagttggagacctagggctatatattttccgaattttgcaactgcagaacaatgccaagctattattgagagagcaaaggttaatctgaaaccttctgctttggctctccggaaaggagaaactgctgagaacactaagggcactagaacaaggtctttctttctttctagtttcatgtttcgaacattcatcagtagcctcagtgtttttgcctggtgtgttgttgttatacagctcaggaacttttatcagtgcttcagaagagagtactggtgctctggattttgttgaaaggaaaatcgcaagagctacgatgatcccaaggtcccatggagaggtatgattctctacttcccaaatctatgtgaatcgtaaaactaaggcatgttgaaagtggcaaacgtaggcttgatggcctttggtttagtgcttatcacccctttaattgtacgagatttgatgtttttggcagtcattcaatattttacggtatgaacttggccaaaagtatgattcccactatgatgttttcaacccaacagaatatggaccacaatcaagccaaagggtaaaatccttaaatctgtcatatttatagctttctttagaacccgagacctcatttgaatttacgcagattgcctccttcctgttgtacttatctgatgttgaagaaggcggtgaaaccatgttcccatttgaggtcagtttataatatattatttgcttacttattatacagaccctttcgttagttttgattccatttaaacgctttctatttaacagaacggttctaatatgggcatcggatacgattacaagcaatgtattgggttgaaagtaaagcctcggaaaggagatggtcttcttttttattccgtgtttccaaatggaacgattgatcaggtaaacaaagtttgaacacatttcatttcttctcttgactcctattccttggattagttcatgctaataggagctctttgctgtggttccaatgcttctgcagacttcgcttcacgggagctgcccggtgaccaaaggagagaaatgggtggcaaccaaatggatcagagaccaagaccaggaagaataagttaggtttttttccatatatctatctcagtctcacagcttctatcttttgactaaaaatctgctgctggatccctcgtgtacagttcttcgctgaaacagtgtaactatttagctttcttataatgcgaatgatacaaaaattaaaacctgataatgaaaacttggttcgaaatatcatttgaacaatagaagtttcttgttgtttgatatttcagtaaaagaaatataagaacttataagattaacacagaagtgatgacaagtgtggatcgatttgggtgttctgattacttggtattgagtatttactgctcgtttgagtccgtcaagtctcttgttaatttgcaatgtgtactaattttttcccttataacttaacaaaatgtgttgtatgattgtatttgtatctattaaatggaaaattattttgtccatgttatatatataaaaaatgtatctgagcttacacaccagggaccatctttttattcgagtttttgtggacacatgagtcatgagtgataccgataataatttttgtttttttttgtgtgtgtgacatcatctacgtttagtttggtttagaatcttcgaaaaattgccgacagaaaataagagaatcttctcttccaatgatctacgttctttttgactaaatatataaaaataaaagagttcataaaaagtggctaaaagtcggaacttgggacacgaacgcaacacgtggcttctactaaaggttagcgtcactgaattaagttttacgtgtcagaagtgatgacgtcgacactaaccaatgtgaacaggacgtgtaaacaaccctagaacactacagaacagaaacagtttggggatgtttggtttttgaaccgtccacctttgacggtcacgcgctcttcagccttcaggcactctttcctccgcctaacatagaaattggaaaggttattttctccaataatttggcttggcttttgagtttattgagtgattagctaataataaataataatcaatttgttggcttatatataatcaatgtgctaagtaacactatagctttcacaaaaacttcggttattaggaaagatctcgacaattctgtatctagaaaaggcatgattaattaatttattaagaacaaaactaatttatgaagaacgattgcaatggtacgagacgcgagtagaaaaacctttatactcgcgaaatatacaaattgtgtgtttcattatttattggcatttaaactttttaaaaaaacagagctctgtttcttcttctccaccgccgttatatataaaacccttccctgaacccccaaaactctcggagccatcacacgacaatg

SEQ ID NO: 3246 - DNA, 3000 bp, Unknown
  misc_feature (1)..( 3000): cDNA_ID_1820001_gDNA_ID_1620634_Annot_ID_47323 3000 nt of promoter + ATG
gcctaaattttggaaaatatgcatgacagacattcgaaacttcagatccaaatcaaaccgaaattgaaatttgtcaaatatctaaaccgaattgaacacgagcggtttttgagaatatgaaattgggcagagcaattcaaactcaaaaattcaacaattccagaagaactttctcagaaaagtttcgacggaagaaaaagcaaaacgatgaacgtcactcttttggtcgcagacgccgtttggtcgaacattgaatcaaccggttcaggtacttcaccattttactacttctctctttccttttccttgtttacgacattttattccgttgaattttccatctttttctgcagtaaccgaagaacagctctcaatgtcagttctctcttatacatagctgggattctttatttttcccgaaaatatttattgatttttcttcagtcgtttggtatgattagggtttatcgatttaattttgcaaatacagcttgcagctgttgtttggtaagaatcttgagaaagccaccagaataatcgacaagagaggcgtcaagaaaatatctggcttacccagtggaagatccatctttcaggtttcaacagttctctctggttaataaaagcaatcatatttgattatctaagaagatttgtttttttgtttgggttttcaggttgtgggggaatctcagaagagagaagagtatctctgcttcccaggagattactgtggatgttattctttcttctatgatgttgtaagcagaggagagcaccaatgtgtaagattcttaatcagaatgcttccttttctgtttagagattttgtatcaatgttactgacttgttatattctacttttctcttttggctagtgtaaacatcaattggctgcgaggttggcttcttctttgggtacatacaacgaaatcgaggtttctgatgaccatcttgccttgatgctctcaaagatctgaagctttcaatacaactacatgtcttaggcttataagtgccagtaacctgggaatgatctgtgtctttgagaattatatggatcaagattcttcacatgtttgatgaacaatgttgcttcaccttttatgtttaacttgctgtatataagtcttgaactgctatattttcaacttcttaattcagtggaagaaaactatgaactttgtaaaagtagtattcatgcataaaacttttagtgactcgtatacaaagattaattaatcaaaaaagcgtagaatggaaacaaactcaatgatcaaagaaaggaacaagtggatttagagttagtgtgaagaagggcggggaatggggtggacagagaatttcatgttgtggttgcattcgttgtggtctccactggcgaagtagtaagtctgaaccttacggagaagcaacttgaagcctcttgatgatgaacctcctcgtgcaaccagcttcttgcctctggccacattgcatctcttgaagctcttcatgtctgggagcaagtagacgtcgttcttcttcttgttacggtgcttcgtcttggattgggtttgatcatcgttgttgtacttgaaaacaagaacatcgctgacgtagaatggggcatgctttgctgtccattctgtgtaaccgtatccgtttttccatacagtaaccgcaatctttcttccagccggtattggagccgtgtggttgtgtgtagagccagtgatgctggagtggtttgagccagagctgtgattgttgtgtgtagaaccaacgatgcttgagtgatttgagccagagctgtgattcttgtgtgtagaaccaagtatgcttgagtggtttgagccagagctgtgattgttatgtgtagagccagtgctgcttgagtggtttgagccagtgctgcttgagtggtttgagccagagctgtaaccgttgtgtctagagccattgccgcttgaatggttcgagccagtagaggtgtgaccgttgtgtgtagagccagtggcacttgaatgattcgagccagagctgtgaccgttgtgtgtagaaccagtgccgcttgaatggtttgagccagagctgcttccccaaccccagtttgtatctgttccgtcggagctccatccccaaccccagcttgaaccacccgagttggagtctgaaccacctgaacccgagccagaagaaccgccagagttgccggatctccatccccaacccccgttcgaaccggactggccagaaccccaactccagctccatgcttcagcactcccggagaacacgaacgcagtaaccatgaggacgacgagtaacttacgtccacaataaagaaccatcatcgtgtcttcttcttcgttttttttctctctcttttttttttatggcttttgtgagctcttcagagtttagagtttcggtatttatagagtaatgagagtcggttcccattatttagtgaatataattttatttgtttttttagtaacagtaataggatttttttctttttcttggatcaaatagtaataggattttaaaagtggataaatctagctttagttattattgtttgaattttgatgagtcttttttttttttttttttgcatatacgattaacattgcttaaggatattgtatatatctttaacacacaaaaaaaaagatatagtatacatagttttgtttgatattctttttattttcgcacaaaaaaaaaaaaaaaatcttatttatactataatgaatctaaacatctgtccacctttaatccaagtacctctcccaactactgcgactaaatgacccatttgcctaaatgtagtcctttaccttactgaaaatagcgaggacaaatcagtcattcaccgccctaaaacacgctttgacatgtatttatccatttactgttattttatctgtaagaaatccaaataaactcatttctgtaaattaggaaacttctgagaaagtgacgaaagcgaagaaggtttcggaagtaaat

SEQ ID NO: 3247 - DNA, 3000 bp, Unknown; identical to SEQ ID NO: 3241
  misc_feature (1)..( 3000): cDNA_ID_1819997_gDNA_ID_1620634_Annot_ID_47324 3000 nt of promoter + ATG

SEQ ID NO: 3248 - DNA, 3000 bp, Unknown; identical to SEQ ID NO: 3240
  misc_feature (1)..( 3000): cDNA_ID_1820040_gDNA_ID_1620634_Annot_ID_162801 3000 nt of promoter + ATG

SEQ ID NO: 3249 - DNA, 3000 bp, Unknown; identical to SEQ ID NO: 3243
  misc_feature (1)..( 3000): cDNA_ID_2992361_gDNA_ID_1620634_Annot_ID_47332 3000 nt of promoter + ATG

SEQ ID NO: 3250 - DNA, 3000 bp, Unknown
  misc_feature (1)..( 3000): cDNA_ID_1820382_gDNA_ID_1620635_Annot_ID_47338 3000 nt of promoter + ATG
aacaaatatttatgaacgtggtgacaaaataaaaactattatttttttgtttgttgctattccaccataatgaatacatagtaccatcaatggaagtataagactatactccatggagtagaaaaaggaaaaattcaaggctctttggcttcttctttcttctctgcacttgaatcaggttctcattgtttatacactaaaaaaaccttttttgcttactcggtgttgaaaaactgcttctctgtttttaactttggaaagaaaaaagtagaagcttttctcagaatgggttggtcgttgagaatgtggattgtgagtatactcgtgcttacacagctcgttaatggagctctctgttggggagacgctggtcattacgctgtctgcaaaatagctcaggttaaaatttccttaacttactttctaaagcgtagctctaaatttatcttagtaaatgatctatgtgagtatagatctgagagatttcgtacttgagtgagtgttgtaagatacttgaatatcaatttaatactctattgttaagactgagaggaaaaaagggaggctttttgttttgttttgttttactgtttcattgaatctactaaaaactcttctttggacctttgtgtgatatcttgattaataccatttttcaatctttagagttattttgaggaagatactgtagttgctgtgaagaaacttctgcctgaatctgcaaatggtgagctagcagctgtttgctcatggcctgatgaaatcaaaaagctcccgcaatggcgatggactagtgctttgcattttgctgatacgcctgattacaaatgcaactatgagtactctcgtgggtcttttattgatcttttctttcaaatttcactcatgtttctgtttgacgttggtataaaagtatatgtgctttgttgtctttctgtgaaggggactgtcctaaagactggtgtgtgacaggggcaatcttcaattacactaaccaactaatgtctacttctgaaaactcacagagtatagtccactgtgagttagagttctagtgaattctgatacttttgtgtgtgagttatatgaagcatcataatagtgtgacttggtgtttttttttgctttgcagataacttaacagaggctctcatgttcttatcacattatatgggagatatccatcaggttaattgatccctttttgcaagtttagactaatcatattagacaccaagtgatgttctgaattatatgcatttgagactactctgattattgcagctgagattaatgtataggaaacaacataatatatatgcctaatccttattgtggatttggatgttttcacagcctttacatgaaggttttattggagatctaggtggtaacaagataaaagttcactggtacaatcaggaaactaatttgcaccgtgtaagcgttttgttgtcgattatattgatgctaaaacgttaaatttcttctgattgtcttgaaagatctaaactttggaagttaccaagataaagaaaatgttttcttcaatagttctagtaatccaacttgtcaatccctttgaatatgaaggtgtgggatgatatgataattgagtctgctctagaaacatactacaattcaagccttccacgcatgattcatgaacttcaagccaaactcaaggtacaatcttactttctttaatcagcttcagcaagttatagtcatatccaagataaaactctactcacatttgtaactgccatcttcatatagaacggctggtcaaacgatgtaccttcatgggagtcatgtcaacttaaccaaacggcctgcccaaatccgtaagcatacataaattgctcatataaattttcctttccattgattttaattgcaagatttcgcggttgaagatctgtaaaagttgctgatcattaacagagtaaaatggttttagttatcatatcttttttcttatatatcactattgttgattctgtatgttcttgttgtgttaaggtatgcttctgaaagcattgatcttgcctgcaagtatgcttacaggaacgccaccgcagggactactttaggaggtatacttactctctgaggtttacaagatcaatagtcactctgaaacaaaatcttctttagctttctaatatgcaacaatgctttaaagttctttttctctcatatgtctttctacagattactatttcgtctctcggttaccggtggtagagaagagacttgcacaaggcggaattcgcttggcagggactcttaaccgaatattttctgcaaaacggaagcttgctagagcatgaaaaaagatccaggagaatcacttgaacatccatgaacactcttatgtattaataatgtgtaatggtagtagttaaggttatggtttggtattgttcctgcgttttaactataataagtatgaaacgaaaactgtacgtctacaagaaaacatagcatttgacttgaaaaatcaaacttaactaaaccaaaaccaagatgtttgaatttgaatcgaaaaatgaactaaaactagcataaaatcttacttgttttatcattcataaacctgaaaaaaatagaacctaagtgaaactatagtttgagtgcaaaaacaaaaatctgatcattcaaatcgaaaaaccgtaagccaaaaaattcgcatcaagaaaaacacatttcaatgaaattacaaagtttgatcacgattcatgatgatagatatcttggagtctgacatccaaaagaagagaaggaaacagagccaaggtcaacttgccggacaccagaatcagttaattagattcattggtaaaaaaacccggcaagtcatccttggctcaacctcattctctattcttccatgcaagaccctctgatacaactagagactctcatcatcgtaatcatcattatcatgttttctctacctttcttttcttgtcttgtgatcttgtcatactcgtg

SEQ ID NO: 3251 - DNA, 3000 bp, Unknown
  misc_feature (1)..( 3000): cDNA_ID_1820101_gDNA_ID_1620635_Annot_ID_47341 3000 nt of promoter + ATG
tcaattgcagggagaggtgtagtagcagtcatcttagccaaaaagcctgatgatcgtcctgccccagacaattcttacattttcacagattatgagattggaactcacattttacaatacatacgtactaccaggtctctctatcttgatgccaaaacactctgttacatacttatataagttcatatacatttctggaatatatacattattgatccgtcaaaccaacagatctcccactgtgagaattagtgcggccacaacactaaccggccagcctgcaacgcctaaggttgctgcattctcatctagagggcctaactcggtttcaccagccattctcaaggttataaagcctcttatctatatttactttaaaagttgaatcctttttgtgtaaacttgttagagtatgcacatagttggtactcatagagtatcatcaacaattttttattattaattttaatgcttgtttattgtttgagattttttatgatactcataataatctctttccagtggtaagaccagtattggtatcatcaaaaaacaaaatttatttgtaaaatcgaaattacatgctagcatcggctactggagcgatagtcgagagcaaataatttttttttctctcattttccacaaaaacgcgttttttcgactaattacaagccgccacgtcattagagactggtatcagaaattatcactccagtgatacttctcaagtccaaatcagttgctttgtctattaatttaatatttttaggcttatgatacccacaaaaaatctcctatgtacatggtcttatatatctggtcatgtttttactttgtagcctgatatagcagcaccgggtgttagcatactcgcggcagtgagtccgcttgatcctggtgcgttcaacggatttaaacttcattcagggacatcgatgtcgactcctgttgtttctggaatcatagttctcctaaaatctctacaccctaagtggtctcctgctgcaatgagatcagctttggtcacaacaggttcttgcttcttcttattcttctttttcataaacaaaccatcacgaaccaatcgatctgtttcttttgtagcttggagaacaagtccatctggagaacccatttttgctcaaggatcaaacaagaagcttgcagatccatttgactatggaggaggacttgtaaaccctgaaaaagctgctaaaccaggacttgtctacgatatggggatcaaagattacatcaattatatgtgttctgcgggttacaacgactcctcaatctctcgtgtgctcggtaaaaagactaaatgcccaattcctaagccatcaatgcttgatatcaacttaccttcaatcacaattccaaatcttgagaaagaagtcacactcacaagaactgtaaccaatgttggacccatcaagtcagtctatagagccgtgatcgagtctcctctgggtataactctcaccgtgaacccgaccatactcgtgtttaagtctgcagcaaagagagtactcactttctcggttaaggctaaaacgagtcataaagtcaacagtggctacttctttggaagcttaacatggactgatggtgttcatgatgttacaatccctgtctcagtgaagacaacgatttcgatgtaataaaaagagccatatatatgatgctcattgtgtttgttcttatgtaactactcttgcaactctaagttcaaagtgtcaaatcaagattcaagatcatcatcataataaaatatcaaatcacaaacttagaatctcttacacaaacatacaaatagagataacagtaatctttcctcatctattcatcacaaccatatattatccatataataaaaactactaaaaccgaatcgagacaaaaggatcctcatgatctcataatctatagctataacataacatagcaaatatataatcatcataatgactatatattattaagatcaagaatcaagatgtgatcttaattatatcttaacaataagcaatacactccttcttacaatccatagtgaaagtcttaaaaggcttaacaatgattaatgtttgccattttaatctcccttgaccgagttttttcatgttgagtctatatactttaataactaatttatagccaaattaacataatgtggcgaatcatgtaatgtacgtgaaaacgtaattctgttttaagcaaaatttgcacatatacattacgattgtttgatttatcatataatttttgattctgtattttgttaaatagttagttatatattaagcaaagattgcacacattacgattctttgattgccatataattagtttcatcgtactacctttggaatattccactatctatcaaagagattcaactatccgtggtcaccattttataatctataaagtataaagtgtgtaaaaaaaacaaattcaaaacgatatacacattaaaaaaaaatccggaattggtttgctgtcctgtgatcctatatttcggtgtagagtcttctatatttcaaaagttcagaatataatcattctatactaaattgagtaattcagtcaatcatgatctaccaacttcttaattacagttacctaacctactcatttagttagaaattattgatatcctcttatagtcttatactcatttgaattataattaggtaatatatataattaggtacactattcgtatatctataataagaaagacgacaattgtaagagttaaaactgagccaaaaagttatggtgggaatatcagtaacgctacacgagagataaaaccggtctgattcggaattaccataataagttgaataaaccaataattgaatccgaaccaaattcgaatctaaccccaaattttattgcttaagacgaattatttactatttatatgtatataaaaaagcttctataccacacagtcacacatgcacacacttctcacttcagacaatg

SEQ ID NO: 3252 - DNA, 3000 bp, Unknown
  misc_feature (1)..( 3000): cDNA_ID_3074273_gDNA_ID_1620635_Annot_ID_162875 3000 nt of promoter + ATG
ttgtatagtttgattgattgtttctgtagtttatttctgggtttagttagttgtgttgcaatttctgaccttttgtttgaaatgggattatgattggtaggttcaactgataaggatccaaatgagagtgcctgagtatggttggactactcagaaggtgtttcatcttatgaactttgtcgtcaatggaggtgattattgtgtgtttctattgaccaattgatagggtttttgtgtttgtcagcacctttgggattatgttttgttgaatttctctgttgtgtgtgtgcagttcgtgcggttctgtttggatttcacatgcaagtatttcttgttcatcccaaggtgagagtgttctcaacttagttctggtttttgcatgtttgatttggaaatggtggattttgaaagctgcatctttttaagtatctaatgtttctgtgaggtaatgcaggctctttgctgggtactattggatcttcctggccttctctttttctcggcatacacgctgcttgtgctgttctgggcagagatatatcaccaggtacctaaaaagaaatttttgatgtgtgttgactgtcttttaaacctgccaacaagctctgagtatatattttgttgccactaatgagcaggctagaagcttacctacagataagctgcggataacctatatttctgtcaacgtggctgtatatttggctcaggttcatatctgatttttagcttcttttttttttaattcccgtttatgttgtagttgctgagtttcctgagatccatttatatacatcttttgcaattattggtgtttcgaaactgtagattgtgcgtgtttcctaccttgtccttctttcattaactctgtaaccattctttgctaccaagaatctgtgtgaccttagtcactagacattttaggtgaatcaaaagatgtagaataagtttgacatgtatttgatgtctctatcagattggtatctgggcatacatctgggtacatgataacagcactgtggagttagttggaaagatatttatcgcaggtaggttctttgtctggtcaagcaagtttgctaaaacctttactgcttaatctataatattccctctcttatctaaaatctatattgacctattcttttggttaatcttcttcttctagttgtgtctttcatcgccgcattaggcttcttgctgtatggaggaaggtctgtgtttttgttattttcatatgtctcatcatcaaaatgtctgcaagttcttcattggctttactgggccgtcttttcttatgtgtttttttttatgccatagattgtttttcatgctaagaaggttccctatcgagtcaaaaggaagaaggaagaaactccacgaggtacttagattcatatatctgtatgtgaataatttgtcttatatagttccataaaactttgaacccaaacatttctaccttcaaatattcgtctcttttcattgcaggttggatctgtgacagctatatgcttcacctgcttcctcataagatgcgttgtggtaagctcaaaattaaatctttagcttccgtcattgttttagttatcctgtgatgtgttatttaatgtattccatgcaaacatcaggtggctgtatcagcttttgacaaggatttaacacttgatgttcttgatcatccggttctgaacttaatctactatatggtaagtaacactacatcttcattctttctctttcttattctcattcattaactcgaaaaaaaaaaaactacaggtggtagaagtacttccatcggcactagtcctcttcattctccgaaagctacctccaaagagagtatcagctcaataccatccgatccagtagaaacctttgtcactgaaccatctcacacggtgagtatgatgctgtttaagagaagagtaaagattaaaaaaaaaattggggcaaaaaatgaaaggtgaagaagaaatcggtgtggaatctgcgtgagtttttggaatgcacgttcatataaatgattttacagcttttagttgttgtagcccgccgtgacttttggtttggtagtttatgtctgttaaaattataaattgctcttctgctactttgaaaaatctggtcagtagtacaagaggtttaacatttgttgcgtcgatggttgattgttatgttatgtttggtaaaaaataaacgaatgctcttctccagtttcctttatgcttttgtcaactgttacatcttcttctcctaatgatttgtatatacttaagcttttccataaaactaagtcccagtgaagaaagaaactacgtaaaccgagaaaaccaagcaaaaagagggtttacacaacataaaatgattaaattgagaatcatttgcattacctcggtattacatgggctggaaataacttattgggccttggacctgattttccaaaaatggtcgctcacattaatatttatatgtgattttacagtgacaactccacaaatcagccctaactctgtttttgttttcttcgacgactgaggtcttttctctctcgctctcgtcttcctcttgattctcttcttcttttctggagtttcgctgcttttttagcctgtaaaaatgacgaaaattttgtatgaatttgtgtgctgatatgctcgaatccacatgttacgcttgtgttgaataatcatatcatttggttatcgaatcaattctagttccaatttacaaaaatctatcaaactctttacgttttctggagtatgttgagcttgaaactagtgacatagatgaaacattaaaaaaacatggaattgttaagtttgtgaaaattggattcgtctttgtgattctttattctttgtctttgctgtgatatataaagattttgtatagaacaacaatttgggagatggagacactgaaattgctgtatttgggattattggcagataaaagattcatacaagaaaaaagcaaatttcgccactg

SEQ ID NO: 3253 - DNA, 3000 bp, Unknown
  misc_feature (1)..( 3000): cDNA_ID_2156487_gDNA_ID_1620635_Annot_ID_47343 3000 nt of promoter + ATG
tattctccttagtaattgcatattgtgctacgaggtagataccacaaaatacaaagtaaaagcgtcctattgaatatttagagatcatacaatttggtgatagagtatgacggttgtattttatcattatcttaggaggagccaattgataagagcaagcactggggtgatttagaggaagaggaagaagaagaggaggaggaagaagaggaacaagaagaggagatggatgaagaggaactagaagacggcactgaatctgttgatacactgtcaaggtattgttatcattatgcatttatgaggtgtatactatttatttgtttccttatcagtataatctaagtataaagctgatttgtgattttccccttctttcagcactcctactggtatagagacaccggatgcaattgaacttcgtaaggatcagagaaaggaacctgatagggctctataccaggtttgaaacctaattttgatgatcttacacgccttgtaggcttttctattagtttgatataaaccaataattcactgtttctggtcgttaatgcctttttttttttgacttgtgaaggtactcgaggaaaagggagagagtgttgctcctggaacattgctgggaacctcacacacatacgttattaagactggtactcaagaaaagacgggagccaaaagggtaagcagtctgttgttacatgctcagagatttgttgttttgcttgatgacaagtgggctaacgtatgcaattgtgtcaaattgagcaggttgatttgctgagagggcagaagacagacagagtggatgtcagcttacagccagaagagctggatgctatggaaaatgttttacctgccaagtatgaggaggcaagagaagaggagaaattgcgcaataagccagtggacttgagtgacatggtcgtcgaggtaatgactttctttatatttatatctctatttttttcaacactattgatatgaatgcggatgaataatcaaacgtttacttggtggaatgtttaacagcatgtgcagcagaatagtaggaagaggaaaatgcatgacaaggaagggaagaagaagaaagatttcaaattctgaggtgttctggaagagacacggaaaaggattctggattctggacatgagagagatagggagagattcttgttccagagttattagtctttgagtcagagatcttgagttttagtcttaatgcttatgagattctatactatgttgttatctgaaggcttaagtaaaactttgtttttggaatttgaacaaattcaaagcctgagacttggaacaaaaaaagtggggaaaaaaggctttgttttgtaagcgacgtcttgtttttcaaattgtccgagtactttcagcgtttatggtttttaaaagattgatcattcggtctacagaataaaccgtcgatgtgatctatttcagtgcaccttgttatctttaagcgaggcaaaaatatgtacattttcacgacattcgctcctgaaaccaaattatgttcatatgttactgtcatatgcatagtgtgaactaattcataggcatgatccttgggttgttcaatccctgcatgtgatgaaaaaaacttaacatactgtggattttttcaatgatgtattctattacttttccaatattaggcgacaaatgattcgaccacacctcattccgggagagtaatgaaacagcgacaaatggccaattatgccactcattgtcctaccgggctaccaccattcttcacctttctttcaacattatcatgagcatgatgactcgtagagtcgtagggttcctaaatcgcctttcttcacctttctttcaacattatctatttatcttcttttcaaatctcgcttattaatcattatacataggcctctacatggtagacacatttagaaacaacaagaagtctctccaaatatgaatggttattcagcctacaagcgatgtcagaatttttttaacacgtagttaaaagtttaactttgctagacaaatgaaatctaagattaatataaacataagaaagtatatatgcttgaaatgagacaaatttagctttaccacttaaaggttttaagctaagtggattccgcttctacaatgattaatgtttgtcattttggtttctgtttacaatgagtttcacatacatactaattaaactactaagtactagccattataaaacatgctgaaaaacgagtcacatatggttcatcgtaccataacacctttggattcccactactaaagagattcaactatgggtggtcactatctattttatctataaagtgtgaaatcctatttttcattcaaatcttaataattataacaaaagtaccattacgagaggattggttttagtttggtaagttttttttgaaccaaccaaaattgaatacaatgtacttcagtgataaaaccaaatattaacccgaaagaaaaactgaaacaaagtgagattgttttgagtttgacactactctcaattattaaaccgaaccaaaccaaatccgagccgaaattcgaatttaacccaaaagttcatcccaaatggtggtggagtcatgaaacgtgaattgaaagatgaataatagatgaattatttactatatatacaaccatagaggcttctatgccaccacacacttctcacttaagaaaatgaataactctttacaaagttctaaacttgtgcttctattggctattgctttggtcctatttcttaacacggagctggattttcttacagctgctggagccttagacagtgatagcaaagtattcaactaaaaatacctttctctatttgcaaaaatctctaagagttaacggattttaaattttgttggtactcttgtttcgcggattttataggtttatatagtgtatcttggcgaaagagaacacgatgatcctgaacttgtcacagcttctcatcaccagatg

SEQ ID NO: 3254 - DNA, 3000 bp, Unknown
  misc_feature (1)..( 3000): cDNA_ID_1820089_gDNA_ID_1620635_Annot_ID_47344 3000 nt of promoter + ATG
tgtgtgtaaatataggaatgcagattcagccacaagaattcagaaaaatctaggtgctccagaaaggagcaaatgaaaaataaaaggttataccacaagtattcaaggaaatccaccacacagcacaccaccacttattgtcttttaaatgtgtagtaagcactaaacatatatgtatacggggaacagaaactaacagacatatactgattcaagacttgcataccattgggttaatgcgagtcagaataatattcttctcttgcaaccttatcagagggcgaacaagaggctgatggttgtcagacaaggcaggaacaatttcagattgcacctttatcacctccccgttttcaacaacctggtcactttcaatatattgcttcaatagatttttgtcatcttgataacgcttcatctcagccactataacggcaaggcgttgagggtccatctcgttgtttattctccgctgaaacccgtcaatcttatcctcaaatgagcgcatggtattcgccactacaagggtttcatcaagatcaaagacaatacccagacatctaagattcaacataacaagacaggaatcgtaaattccaggagcaacactaaatgcccagaaacaaggacggtcattcttgatattttccgagtacatagcaaccaaatggagctcttctccacccaagagcattactgctgtctgcaagaagcaaaaatccaaaactcacaaatatgaggacaatttgtaacataacaaacaacacaagattcaaacccccactctactaaaagtttctaaagccccaaacttgatgcagctctgacattaaggaagttaaataatgacacaaaatcctatttatcattaagtgtttttgagttttagttgataaaatctaagtctgagtaaggcttaaaggttcgtaaggtttagataccttgttgtccctgagacaggacgagtagaataaactgagtgactcctgagctggagaaggtgaagcttctaatttgaaacaaaggccacaagatgaaattgtagtaagtattgcaagaggaggacacctctcgccagattgagaaaagtggcttattctgattcccatcttggctagctccattacttccctctgtttcttcttcctctgcttcatcacatcatcttgttgctgattcaattcccttgaagggtatatctccaattctccaagtcttccatcaccatgaaacacttctactctattattactatacatactttcttttctccttctccttcttaaagtttacagatcaatggatgtctattgtctcatctcaaaattggttcatcaaaatctaaactttttgttgtcccttggccagaattgatagattgatcaccagtccacactagtttatgaattggatccgagtttttttctttagcaagaatcaggaaaacaaaaggaagatttttgataaatgggtaaataagagaaagaatgaaaatttagtgtttgttccttaagattttgttccctttgaatatagatctgtaaaataccgatgatgaatccacaaaaaaaaaccctagtttctttcttcttccttggttgatgatgagtttgtttgtgtatctgggaaaagtttattaggttttgtggcgttctaaaaatcgagagaaaccctagatccagataacgaagagtcaagattgtgaatacggcattatgcctttgtccttggtttttttaagggaaaacaaaacacgaagggccccttcattttctttaaccgttcttttttttatttatgtcttattttaaaaacaattaatactatttttaaaaattaataaaagcctgaaatagtttttatcagctcaaaacctgtcaaattctgtttttttttcgattcataccgtacttgtaatgtacttttatacttgtgtttctgatctcatgttttgatttttacagtgtcaaggattcatataccacaagatatttatagttcatctaattctttttttttagaagattatttattcaaaagacatgatatttttgacatatacttgtctctttatttgtgaaatattttttatctaccaagcatgaatattttttcacatatatctttcccctactcttttcaatcttttccttataaaataatagtttagtaaataaaaaatgatttattttgttttctaaaatacacaactacgtaaagataatttttttttatagacagtatttttttccttgtttaaaaataaccgttacgtacaaaagccgttacaaaattctttcctaatgtcttttttttccgtgttctttcctaatgtcttatgaaaacaattttgaaactaaaaaggcacaatgtatattgttctaattgcataataaacaaccgataacatacaccgggagtcgtgctcacattaataaaatctcaaagtgaataaaaattacctcaattcatgtaaaaactaaatttttacgaataataaactaaaacatttaaattttattaaaagttttgttgttagtcagagaattttatttaaatctcaaatacccacatatatacaattttgatacttataactttcttcaaaatttcaagacattgtgtaaactgtaattttataattttaaaagttcaatagaacatttttacgaataatgtagagttaactcgtgccaacatttatagtagtgtttgaatattgttccatacatttcctttgaaattttctattagttactagtagatggtcttctacaaaacaattcttacactcgaagaaaaatataaagtgttgggcctattggcagatatattcgtcttctacttatatgggccttatgccaaaccggaaatagaatcagagagaatttcagcaaaccgactcttgttcatatacgtatatcctcgatttccgtcgttcttccttctcctctcaatctctcttttcacatcaccgattcagagagaacaccgaatatg

SEQ ID NO: 3255 - DNA, 3000 bp, Unknown
  misc_feature (1)..( 3000): cDNA_ID_1820085_gDNA_ID_1620635_Annot_ID_47345 3000 nt of promoter + ATG
tacagtttcagaaagggaatatcccaaactgattcattaaacagtttactccaaaacctaagcaccacagatttcatatatagacagaaaaaaaaaattaagagtcctctccggttacacctacaagtccaggctccatggttatcacagatgttctcctgcaagaagcatatataggtataaggaaacttaattgacatggttatcacagacgtttctatccctcttgatataattcccctatgtaccagtaccacacccacaaatcacagaaacatatagttaactacagtacattactagaattatcacaaacctgcaaatattttctcttctgcgaccaatgtcttggaacaggaactgtattccggtacgacttcaaaaacactaacagctttggatctgctgaagtcgcgtcccagacctgaaaattgtaaaacagaacttatgaatatacaatagatatctacacaacgagataaaccttggtactatgaacacaatagagaagcatccatacctcaacaacatcaggcctagcggaaacctgcttcagctcagcaatcttcattctccgttgaagctgaggaaacagaaattcagaatattcagaatctaaagaatgcaataaaacaaattgagaggtaataataaggtttgagctatacctttttcttcttattagagatgcctttctctttgttctgattatcctgctcgtcgtcgtctgaatcagaatcagagttaaccttctttttgacatcttctttctcctcagactcatctttcgtaccgtcttcttcagaggcaagaggttcgcggaagttgaacttctcgaagatttccttaaactcatcgttaaaaccatcttcaaattcagcttgctctggaacatactctatcacaatctgctcacaaacctatcaaagagaaacatataccaaaaatcatcagcaaacgataaacaatcacaaaccctaagaaaaaccctagaacacctctccatgaatcgagtacgagaagatgagcacaaagttaacctgtggctggggatctgtattctctttggattcagaagcagcagaaacgtccgatgcatctacatcggcttgggatgctttgttgttcttcttctgcttccgtctgcggcggcgacggtcaatctcacgagatttcttagaggaagcggaggtgtttccgttggagacatcaccgttagaaacgacgctatgaacgagtgcgacggttgaatcggcggtcatattcggtgttctctctgaatcggtgatgtgaaaagagagattgagaggagaaggaagaacgacggaaatcgaggatatacgtatatgaacaagagtcggtttgctgaaattctctctgattctatttccggtttggcataaggcccatataagtagaagacgaatatatctgccaataggcccaacactttatatttttcttcgagtgtaagaattgttttgtagaagaccatctactagtaactaatagaaaatttcaaaggaaatgtatggaacaatattcaaacactactataaatgttggcacgagttaactctacattattcgtaaaaatgttctattgaacttttaaaattataaaattacagtttacacaatgtcttgaaattttgaagaaagttataagtatcaaaattgtatatatgtgggtatttgagatttaaataaaattctctgactaacaacaaaacttttaataaaatttaaatgttttagtttattattcgtaaaaatttagtttttacatgaattgaggtaatttttattcactttgagattttattaatgtgagcacgactcccggtgtatgttatcggttgtttattatgcaattagaacaatatacattgtgcctttttagtttcaaaattgttttcataagacattaggaaagaacacggaaaaaaaagacattaggaaagaattttgtaacggcttttgtacgtaacggttatttttaaacaaggaaaaaaatactgtctataaaaaaaaattatctttacgtagttgtgtattttagaaaacaaaataaatcattttttatttactaaactattattttataaggaaaagattgaaaagagtaggggaaagatatatgtgaaaaaatattcatgcttggtagataaaaaatatttcacaaataaagagacaagtatatgtcaaaaatatcatgtcttttgaataaataatcttctaaaaaaaaagaattagatgaactataaatatcttgtggtatatgaatccttgacactgtaaaaatcaaaacatgagatcagaaacacaagtataaaagtacattacaagtacggtatgaatcgaaaaaaaaacagaatttgacaggttttgagctgataaaaactatttcaggcttttattaatttttaaaaatagtattaattgtttttaaaataagacataaataaaaaaaagaacggttaaagaaaatgaaggggcccttcgtgttttgttttcccttaaaaaaaccaaggacaaaggcataatgccgtattcacaatcttgactcttcgttatctggatctagggtttctctcgatttttagaacgccacaaaacctaataaacttttcccagatacacaaacaaactcatcatcaaccaaggaagaagaaagaaactagggtttttttttgtggattcatcatcggtattttacagatctatattcaaagggaacaaaatcttaaggaacaaacactaaattttcattctttctcttatttacccatttatcaaaaatcttccttttgttttcctgattcttgctaaagaaaaaaactcggatccaattcataaactagtgtggactggtgatcaatctatcaattctggccaagggacaacaaaaagtttagattttgatgaaccaattttgagatgagacaatagacatccattgatctgtaaactttaagaaggagaaggagaaaagaaagt

SEQ ID NO: 3256 - DNA, 3000 bp, Unknown
  misc_feature (1)..( 3000): cDNA_ID_1820081_gDNA_ID_1620635_Annot_ID_47346 3000 nt of promoter + ATG
aaaaaggtttacattaaaaatgaaaaccatattaacactatataaaaacttagcctattactagcttaactttttagccacaacattagtcaattgaggaatattttttttgcaaaaaggttagtctatagaaatttgatttttgaaggtcgttttcgttggaagacataaagcttcttggttgggtgaatttaaaaaatattcaacgtatttttggagaacagcttgcagacgacaacatccttcaagttgccacttgaatcctcctcaaattggctgcttaattagcatacctcaaaatatatatcaattaaaaaagaacgtcacttgttagtctttttcacgaaataatatattactatttttgtcgttatatataagttggtggttggcattttgtcttatggtccacgttaatttcgtgagaagcctttagcgtgtttcttttgagttttttctttcatttgtcagctcgaaaacaggcggaaattaaaccaaattattattacgtgttccttaatatcgtgttttgtttgtttacaagatatcgtatatgtgatcaacttattcttgctaacttgtaataatctgttctagttatactacccactttatatcattgcattgaagcgatgatgaatatgtcttacatgagcttatgatatagattatatatatccggtatctaactaaccattttgaataaatttccttactgatgtggtgggcaaaaagtttacgagtcggattggttggatccgtgttgggttatattacattatatcatattcgcattttaaaaaaaatttattggttaggcgtaaattaacttttgatatatgatataatcgcatagttattcaaatggtatagtccaaactttccttccaatacagcacaaccatttaccatgttcacatacaagtatacgcatcacatactttacgtgatgatttagagatatttagatattagtctgattttaagttcaaagacacgataaaccaaatagttatattacatcattgagacttgtaaagatttcatgaactaattctaatcatgagagtaaatagactttaaattgaaaagtactctaatgagaagagtaaataaacttaagtgaaatatttcatatatatactgtaactctaaatcctcagggaatcaggaatttataactcatatttgagtcctattaaaataaggtgttggattttgattatatatttttatttgttgttatgattgaattttgatttatgcaacacaaatatatatataaagagaacgactttgtattgcttagtaaattgtcgtggacaaattggattttaatcaggcgatattaacacttcaactgccgatcatccatatcaaaacctaaatcaaggtatgtccgttcaaaactaccactgttctacatttagtatttaaacctaaacattttttttttttaaacctaaacttgttcttaaccaagatgcacgtagtatcttgtgaatggttaattaacttaatttagtaggacgtaacaaagttataggacattactagaagtctagaacatagttctttcgtgatcattaaaacttcgatccaaatttttttgacacaatgtgtattaatttagattgttcgattcagatttaggtctaactttcttaggtaaaaaagctggaatttgtaaatatccccaagcttcaatgaatctagacattaattcgacagataagatttgcgtaaaatactatagaagatttagatgtatttcatattttcacttatctaggtttcataattaaccaatcagcgaattggtataaattaaagtttggattgccaaataccaaacatgtttgtatttatccatccaaatatgaaatcaaatataatcctatttttgaaagataaacaattctgttcacaaaaaaaaatcagaaagaaagataaaaacatagtatatgtgagacacagaaaaggatctaacacaacaaaaagaaaattaccaaaacgtatcaaagatttagacttaaattagggcttaaacatggattaagaatagaaccaattataatataagttaggagtgaggaaagtcgtaatcgaatacagctacacacgagcgtagcgtgcttgaaagagacaccaaatcctgttttagtggggaactttcttactttcactttttcccctcttttttttttcctatttaagaacaattatttggggtttttactctttttattttccctcatgttttttgattttatcagtctcttccagcagccctccaggtgtaactggtcacacattcgcttggcttacctttaaccaggtgtttctccttcttcatagattttagggatgccaattttcaatactacgttttaagttcctataccgtaatttatggttttattcgcatataacagtggcatttccgtttttttcccacaaagtcagattctcttcaaattaaaatttttacataactacttttcgtattaaataaatattttagaacgaaaaagatcatttagatttatctcttttaatttttattcataaaaactagttaaaaaattaaaatagcatatgattattattgagataacaaaattctgtcgagaaaaatccaccgaacatatattttagcagcccgtttcaaaacctttacaattaaattgattaaattaaacaccatagaaagaaagagacgtcaaagaaaggatctcttctgagttctctgactcaatttctgagctctctataaatataagctctcttcttcacacttttaatgcaactctcaatatcactattaaatatctttctcttttcacttcttcactttcctcgattcctgagttttcgatccttttgttctctaaccaccggtttcctctttaaccggtctctggataatcatcataatcattaggatcatcaagataaggaatctttttgagtatatctctacaccaaatcgaatctatg

SEQ ID NO: 3257 - DNA, 3000 bp, Unknown
  misc_feature (1)..( 3000): cDNA_ID_1820069_gDNA_ID_1620635_Annot_ID_47349 3000 nt of promoter + ATG
tgtttagaaacgacgataattaataaagaaaagtgtgaataagatcaaaattgtaagtgaataaaaaaaggatatgagattgatagaacaaaaacttctccgacgttagcgaggaagagatcggcggtttcgggaacggcgaaacgatggagatcaaacggagaacaataggcgaggtttgttaaagctaaatctgacgccggtgtggtcttcactgtcatcttcatgacaaaagaataggaagaatcagccatgattgttttttggtttccttcgttacaaagattattggtttatttgtggagtaagctagaattgtatatatttatagtaagtctactacaaaatattcccgacaattgaaaaagggaaataagtcatctgacaaatagtataacgacacgtacacaaatgttatggcaagtaaaatcgtgaaattgaaaactttctttacttaaatacggttttcccgggtaataagtaatttactactaattagttacaacggtcaaggatgtttgtgaaaactttctcctcattctctgattggctagactctttgtcactctttcttatttggaaattttgtgccgttcaaatattattggatctaatgaaaggaaattctacatttgtttttcttttgataagaatgaaaattctacatattaagaaaacaaaaaattcaatggaatttaggaacttgagctttttggatgctctaactttcatcacgggacgagtcccactaatatctactctccaatctctattgcaaaaactatcaaaagaaaaagaaaaaaaaaagtttatggaccaatcctttgagttggctactctgaaaagtaatactccctcatatgtttagataccaaaaaattgaggagttccaagtgttagcctttgatgggggttgagatacgtcaagcggaagttgcaagaacatcctcagtaggaggctgcattggtttttgagaacgtggtggtggtggtggtggttgtggctttggcggtggtggtggaggtctctttggtttcaccttattgactatctcagcttcaacatcaaactgcatgatgacaaaaaaatacagccacacgggttcagagaagtagagtgtatttccaaacgcatcaaattattgaggttgaagcaaggaaacaaaccttgtaaccacagcctgctacacatgcgtgaaagcattcctgaatttaaaaacagagttacatgtacaacaattagatacggttcagtccatttctcttttttgaagaaaaagattcattgtgtgaattacctcagagtatttggcatctccaggagaacgatctataacagcagtccatggtctgtcttttagcacaggatctttgtagcaaatttcactgcagtctcctacacctatagagagtacactactattacaccaattcattaacttggaaacttaaacctgaaaagcagaagatactcttcatgaacatgtaatttcgttatgtaggagacaagcttggtttttatgatgttccatagtgaggacaaatctaaccgctcatcatttcatcaacagtttcgttacagattacaaagaattaaaaagaaatgcttacaatcttcccatgagtcactatcggcatcacatccctttttgcagaatactctccctacacagattcaggaattacattagtgctatggaaaaaatgtcatacaacaacatggaggataaacactgatgctaaagctgaaaaaaaacccagattgctatggaaaaaatgtcataccaagcataagttcagctagcttttgtgcccatgaatgaaattcagagatcagagaatgaaaagctttcatcagaaagacagaaacagccaaaccaagccctttaactagcttaagcatacatatatgtcaatagttcatagaagcaacatggatacagaagcatctttgataccgttactttgactctctccctttaaatttctttcagttcataaactacaacttattatcttccactttctcctactaatttaaccattttcttaattacatgatagaaaagctctaagaactctgcataatctcccttacttgtaatcaatataaatgttgccgattcttcaatctacattattcaattacgagtcaagatggatgttcttaaatacttgcaactacaactataagttgtctctggaccaatctaaccaaagaagcgattcttgaccaaaatgtttagtataatcgtaatgaagtagagtgcaccaacaaataattagggtttatgaatcaagaaatcaatcaacaatccaatttacagatcccaatttcaattccaaacaacaacaaaaagaagaaacactcggaagactaaattgacttttgaatcaagaaatcaatcaccaatccaaatcagaacccaatctatcagctccaacaacagattcttatcatcatcatcgaaaactaaaccatcaaaaaacaacggaccacgaacatcaaaactcaaaaacgaatccgattcacacaaattaagagtccagatattacatacatggaagctgcgtaaatgctgagtacttattcgtgcatttgctcccacacggcggcgtccattgctgcggtatcatctctctctcccttcctccgccttcactctccgtctctctctctcttcttccgaaaatatcgctgacgccacaaaaatgtagccggagacttttctttatatagtaagggtgtttccgtcatttaacaatccaagctctctaacaaccaaaccgatcctttttataatcccatttaatcaaaccggttattgatacaaaccggttatttccataaacttaagccgacttctctctctcgagcctttataaactcacaatctcacaaagccgtctcattctctgcgtcctgtctctctctttgtctccgagagctcgagtagtgaagtttgctgtgctctaatcttcagagagtgagaataaatg

SEQ ID NO: 3258 - DNA, 3000 bp, Unknown
  misc_feature (1)..( 3000): cDNA_ID_1820056_gDNA_ID_1620635_Annot_ID_47353 3000 nt of promoter + ATG
taattaacatcagtgtatactataattactactctagccaacaagataaattcattttgacatcagccaaaagataaaaatttggttaaaaactattggattagcttttagtatttaatattttatgtactgattaaatacgaatttagaaatctaggatataagtgagggtgtataataagggaggggtggaccattaatagcgatgtgcaattaaaaattatgattaagaatctaggaaatttgtagattgcttagttatttttatggcgatcgtcgtgtcaatgtcatggattttgaaactttaaattaatctcttaaattagcacctacctttgaattttatagaatctttttattttatatgtttaattttatagaatctaactagcttattttgagattaaattgtttagttacttttataacagtataaatgtataatgaggacctaagaatgtagtcctgtaatgttcttgctattctacttaatctcatcaccaatcaaccatcaaaagaagctagtactaataaaacctgcaggtattcgaataataattaagctcaaacactatactaatttatggaggattatatattcaatgaattaggaacctcatgatggacattattgactgatataatgtgtatactaattgtgagtatttaaaaaccatacaaagcatttatatgtccacatatattggacacacatgcaatcaatgttcaatatgctccacacacagaaataaaaatactctttctgatcatatgatacatcatacatatactaaaaaaatctaaaatgaactataaccacaagcatatataataacaatgaaatggtaatgtttcttcatttttatttgttcaaattcttattcggttgttttttcttaccctacgagaatccgtgaggtcaaagggaaacagtgattttttttttgtattttgttttttaaattgatgaactgtaaaactctctctctagaaaaatatataagtagtagtatgaattttctctcactaaaagcattaatggacctttcgataatcataaatgcaatgcaccctctctatgcatttcgcaataactccttttccttctgccacatcctcttcctcacctctttctcttcttccctttctcctaagttcctcctccaccaaattctccatttatttcgttaactatcctccatttgttttcttctgaagagtgatatattctacctttctctggttaaagaaactccctgaatccaccggttatgtcttgaccggctataagcctataaactgatgccctaagacacctttttaggtttctcaataattctccgcatctatcttttcttctccacaagtaagagaaccagaaaaccagagaagaagccgagctagctagggtttcattgtgtgcacaaaagtaagatctctctctctaaccaatacttgtgtaatttgtctttgtttctttgagcaaatattgcatgtttgttcatattagccggatccgttttatattttttcatgatctacattttatctttattttgtttgtaaattaatgagttttttttttttttttctgtttttgtcacgatctaaaaaacaagcgttacaaagaagaagaaaaacctttttggagttagaagtgtaaaaggggtttcagtttgacgaattttccttagtagttgtgtaaaaaaaggccattgacttaatgtcaactctatatatctacacatttttttattaattagtttttgtttttttcccacttcatttacctttagtcaatgaatttttactgaaaacgttttttcaaggtcaatttcactgagttaaaaaaaaaagttttatttttaaccaaaaattacgttttttcctaggcttcggtaacctgtgaattcctctatctcactagcttttatgtagaagagagagaaggcaacattaaattcgatctaaaacttcaagaaaccaaaacaacacttcaaaaaaaaaaagagatctgttctatagagttttaatcttttctttcgactcgagtttggctcaacaaagtttatatcgatttggcactctaaaatgtaagtagaaccaaatgaatcttgtattttatgtacgttaataaaaaattagggtttcctagacgacaatctcgtcatccgtttcttctttgtctacctctgcgttttcttgtagatccgatgatgtgctcagtcttgtgactttcaagattgattttatcgttattgtttgaagatatgtggtttgattattttctcaacacattgtgtccttttagcgctttacttcagtttctctctaattttcataatattattattgaacattatgcttaattattcatccgaatattcgtgtcccattttttaaattgaatttcaggataacttgtattttatatgcaacgaggttatgtcacgtagtgggtgcatttatattcataccctttttgataagatgaatgcatatgcttatataagcgtataggtataaataaccatcaaaaatagagaaaaagaccaatattttgcttttcggttacttatgaaatgtgaaaaagaccatataaatatatctattaaagggaagtatagtttcataaaatcttgaggattacattccataaaccaagattaccttccgtttttgctttgatcctcttcttatcaaatatataaacatgaccatttgatctttcattttggatagtgggatatacaggcagaagaaaatcgagataaatcaactaaatgatttggataatcatcttgaagatttgaaggaaaatccaagagcttcaaaaactccaaaaattgataggcatccatcatcatcatgtatcatccaaacatgttcgaatctcatcatcatatgttcgatatgacgccgaaaaactccgaaaacgatttgggtatcaccgggagccacgaagaggatttcgagactaagtccggcgcagaagtcacc

SEQ ID NO: 3259 - DNA, 3000 bp, Unknown
  misc_feature (1)..( 3000): cDNA_ID_1838524_gDNA_ID_1620635_Annot_ID_47355 3000 nt of promoter + ATG
tgatagagatgtgatgagaaagagaactgtgagctcgtttagtcaaaaaagaagtttcaaaacgtcttttaatttgatttgtcaccatataataattatgaattatttatctatttccataaaaatatattatagacatattttagatgttattctagatggaaaatgcgaaaagagtagagttgggtttaatacaaatgttcgaactaaaacttagtggtaccagcagcttttaattggtaggtctatctaatctttaaggaattctccatatatatttcgatattcttatagtagaattattgtcattgtgaccaaaaaaaaaacgaatacaaatgaaggataatatatattttcattcaatctgttaaaacgagttaatttcagtaatatgaagatttaagaattataaattattcatatacatatttgaaatcgtgtaacacatgccataagatattgttttgtaacaaggtgagttaggtaggcggcttgaccgtgtatgagtgttggagacgtgttgatgatacttgcttgatatatccggaattttgtagacataaaaacgtgtgtgcgtcaataagggcttgttcggacacttttagttgttatataaggttcataaaatcatagtattattccgtttaaaattacgacaaaaggaacaaaagaatgaaacgaacaaaaactgatgaattcatcaaagaatctaatgaaagaaacgtagaacgtgtattataaacaaaaatttcaatcatttcgattttgaccgtccatgtggcttcatcatcactttccacctcaaatttcgtcagaactagacaaatctttagcattccgaaaacggccaagccatgacataattttgtagaccaccgcagcgcaaactacgggttcttgttgtatagagacagcaagagtttgctgtagttgaactcaacagccatcaaaatacgttcgctccattctcttattgatctctggattctatgtgttgtacatgactgtgtgaagattattaagtatccaacactatgatctcggaatcgaagcaatggttcttctctccttgtatcgagctccataagcgtgttgaagtcattaaccaactgagaaacccacaaaattcaacaagatcttttataaccagaattcaagagctaaggaacttttcattagtggtccatattggagttgtgtgctctcaaactctagttgatgaattaatcaggtggctactacgtacagagccaagagcaaaatcttagtcacctgtgacaaatatgataacatcgtctcttttttggaattcaagatgtgagctcttgtccaagttttgtataacgtcaccttcaaatccatgttcactgttccaacaagaccagtttcagagtaaaaaatatatacaagcacaattttgttttagcatcaacaaagttgaggcctgaaaataaagtactcgagcatttgaagattgacttttgacttgtgctacgtaggatccatatatatgtggaatataaaggtattcgacgatataccacgtttaaaccgggaatagaaccgaatccaaatttgaatatagaccagaccggatcaaacgaaaaaggaattccttgagcataaacttttttttcttttttcattttaaaagttcgaatatatgctcattgacattgtaacttgtaagtatgtaacacaatgagacattattttaaatttgaaaaactgtatgtagatctcattgtctttaccgtaatccacataaatgatgactcctttctacacacgcaagcccttctgatgatcactcttcaagatcctatagttgaaacccggaactcgattctcgccggaaacctccaccgccgagcacatactcggaaaaaacttgccaccgccaccacgagtctgccgcttcttctttctccatttagttttagagaaccaagaacccaaccgtgatgatgaccgatctctttgtttaaatgtatttttgttttcttccgaattgcctctccgtggatcgaattggggatgacatgtagagaagtttttgaagtagtcgatttctttacgtacaagcgatccgatggttcctcgtgttcctatggcgattggagcagccattgatagagagtttttatgaacagcttttctttttgtttctcttgatcaagtggtaacgaagtgttattaagatccttgaagctaaagtagtagaaaatgtattatctttttatatgataggtgatggcttttgttggttggtcatcccatttctttatctattttcttccttttactgtatttaagattatttatgttcaaatataatctcactgttaacttttatatttttctaataaaaaagactactaggatcggtccatcaacattttagacgtaatatgtatagataaatgcatattattttggacattttaacaaagacatgtcgaagattgaggattttaagcgaatatagaagtagagatgttgttccaaaatgaacagccgaacaacgcaaatacaatgacacaaggttgttagagaaatgacaaaatatgattcggttgataaattacataaaactatttttaaattagactacaatattcgaacaacctacattttctttttggctacacccaactttttatttaaatccattatacagtaatctgacctttctctaacatttaaatcatgatgggctaattcaactatttttccttctatcatgccgtagattatttttcacttagattagtatgtttctccttttaccataaagtcagggaacataataatttcgatcaatcccacaaacaaactagagacggccaacaaaccggaattaaccaccaaaccaaccaaatttatcactgaaccaagtttctcaaatgggcccaatacaaagattcagttcggcccaaatagtagattggcgctataacgataacgattcttagggcatttaccacagcatcaacaatg

SEQ ID NO: 3260 - DNA, 3000 bp, Unknown
  misc_feature (1)..( 3000): cDNA_ID_1820048_gDNA_ID_1620635_Annot_ID_47357 3000 nt of promoter + ATG
ctatacatattacgtctaaaatgttgatggaccgatcctagtagtcttttttattagaaaaatataaaagttaacagtgagattatatttgaacataaataatcttaaatacagtaaaaggaagaaaatagataaagaaatgggatgaccaaccaacaaaagccatcacctatcatataaaaagataatacattttctactactttagcttcaaggatcttaataacacttcgttaccacttgatcaagagaaacaaaaagaaaagctgttcataaaaactctctatcaatggctgctccaatcgccataggaacacgaggaaccatcggatcgcttgtacgtaaagaaatcgactacttcaaaaacttctctacatgtcatccccaattcgatccacggagaggcaattcggaagaaaacaaaaatacatttaaacaaagagatcggtcatcatcacggttgggttcttggttctctaaaactaaatggagaaagaagaagcggcagactcgtggtggcggtggcaagttttttccgagtatgtgctcggcggtggaggtttccggcgagaatcgagttccgggtttcaactataggatcttgaagagtgatcatcagaagggcttgcgtgtgtagaaaggagtcatcatttatgtggattacggtaaagacaatgagatctacatacagtttttcaaatttaaaataatgtctcattgtgttacatacttacaagttacaatgtcaatgagcatatattcgaacttttaaaatgaaaaaagaaaaaaaagtttatgctcaaggaattcctttttcgtttgatccggtctggtctatattcaaatttggattcggttctattcccggtttaaacgtggtatatcgtcgaatacctttatattccacatatatatggatcctacgtagcacaagtcaaaagtcaatcttcaaatgctcgagtactttattttcaggcctcaactttgttgatgctaaaacaaaattgtgcttgtatatattttttactctgaaactggtcttgttggaacagtgaacatggatttgaaggtgacgttatacaaaacttggacaagagctcacatcttgaattccaaaaaagagacgatgttatcatatttgtcacaggtgactaagattttgctcttggctctgtacgtagtagccacctgattaattcatcaactagagtttgagagcacacaactccaatatggaccactaatgaaaagttccttagctcttgaattctggttataaaagatcttgttgaattttgtgggtttctcagttggttaatgacttcaacacgcttatggagctcgatacaaggagagaagaaccattgcttcgattccgagatcatagtgttggatacttaataatcttcacacagtcatgtacaacacatagaatccagagatcaataagagaatggagcgaacgtattttgatggctgttgagttcaactacagcaaactcttgctgtctctatacaacaagaacccgtagtttgcgctgcggtggtctacaaaattatgtcatggcttggccgttttcggaatgctaaagatttgtctagttctgacgaaatttgaggtggaaagtgatgatgaagccacatggacggtcaaaatcgaaatgattgaaatttttgtttataatacacgttctacgtttctttcattagattctttgatgaattcatcagtttttgttcgtttcattcttttgttccttttgtcgtaattttaaacggaataatactatgattttatgaaccttatataacaactaaaagtgtccgaacaagcccttattgacgcacacacgtttttatgtctacaaaattccggatatatcaagcaagtatcatcaacacgtctccaacactcatacacggtcaagccgcctacctaactcaccttgttacaaaacaatatcttatggcatgtgttacacgatttcaaatatgtatatgaataatttataattcttaaatcttcatattactgaaattaactcgttttaacagattgaatgaaaatatatattatccttcatttgtattcgttttttttttggtcacaatgacaataattctactataagaatatcgaaatatatatggagaattccttaaagattagatagacctaccaattaaaagctgctggtaccactaagttttagttcgaacatttgtattaaacccaactctactcttttcgcattttccatctagaataacatctaaaatatgtctataatatatttttatggaaatagataaataattcataattattatatggtgacaaatcaaattaaaagacgttttgaaacttcttttttgactaaacgagctcacagttctctttctcatcacatctctatcattagaaaaaaatattgttaataatgtacatgtttttttttctttttttggggtcaaatttggattcactcaaaatagttaaaacatagaatcccatgtatcaaaaaagaaaaaaataacacctaaccctataaataaaagattttatacaataaagatcttatgtttttttatcagagaaaaacatgtcttgtttttataattctgacttcttagtaacaaatcatgcatatatgaaattcaacaaatttgaacccaaaaatagagaggtgaaatattaaatgaccaaaacaaatgataaaataattcagaggacgtgtgagggaacaagccagaagctacactatcgaaaagatcgcatcaatctcaaccgttggatctttccttcatcatcatctctctctctctctttctcttccatctgacctgtgatgtgagtttgcagatattcaaacaactcaatcctcattccctttgtttcgcctctctggatttcgaagagctgagagattagggtttctcgattttcgagattagagtctaatccccaccaccagcatagctgatatcctggaggagaga

SEQ ID NO: 3261 - DNA, 3000 bp, Unknown; identical to SEQ ID NO: 3258
  misc_feature (1)..( 3000): cDNA_ID_1820056_gDNA_ID_1620635_Annot_ID_162870 3000 nt of promoter + ATG

SEQ ID NO: 3262 - DNA, 3000 bp, Unknown
  misc_feature (1)..( 3000): cDNA_ID_3091265_gDNA_ID_1620635_Annot_ID_162866 3000 nt of promoter + ATG
taagataccttttgaacataagatctcacatcccttgttaactttcggaaaagctgcatgtagagaagatgttaggtcagtaagagataaaaaaaacactgatactcaacaatccccaagagtgtataattgtgtgccgggaacaaaccattctaaatagccctccaagtaaaggaccagcaagatccagccttttgttaccataatgatccctatcatcttctggccttcggccaagtgcacaaagcagcagccggtgtatgatatacctacggatcatagcataatatgagcaacacagaaacatgttaagtctataaacattacaagtgagttaaatacctacccaaaatagtaagctttctttgtctcgcaatgctccccaattcctacatgaggaagcatttctttctgaaggatatctctagcatacctgcaatgataatattgcaatcgcaaacctccagtgtgaacatctcaatagttgacatcttagatcataatgtccaacttaattggtttagattatcacatactttatccttttttccttggttacaccaacagttgcaccacgttttccaatatagtcaagtgcaacctgaagtaatatgaaagttatcaagtgattgcaagatcaattcctcaagcataataaaatgtcattaaccaagtgaaaaaaaagtggataccagctgattttgaataacgaaagcttcttccaaggaaggcctgagcaactccatcatctgggtatcggcaaaatcatagcagatgtgttccaatatgtccttatcggcaacaaatcccagtgcacgaaatactatgataataggaatttctgttctgatgtatggaagagtacatcgaatatactgtccagatgaaccctgcatccatttgcaacatagaatgtaatttatttaccattatctagaatttaaagaataaatttcgaggaaggatatagtagagttaagactaattagctttctcttaccccttttgcactagcacgagcaagcatacgcacaaacattgtgcttggaggcctattttggttttcagccatagaacggacttcaccaacataagcatacttatttggctgccttttcttgaacacataaacatgattcgtactcatcttctcctgagcaatcagaaccttttcactgccattaataatgaagtatccaccctgatcataaggacattctccaagctctgtcaggtctttctccgagttctgaaacaaggtacagtaactagaccggagcatgatgggaacctagcaaataatcaaacaagaagaaaacatttctactatcagaacagtagagtacatggaaacacctaaataaatgtgacacaatgaactgagttcggacacctttccaatgaaaactttagtaaaatcctgtgtctccgtaacttcttcaccatcatgccctttcttaataactctcttagtaacatcgacatacaaaggcgcagagtatgtgagatttctcaaccttgcagccttagggaacagggtggcagtctctccatcagactctgtcatcataggtttactcagataaatctgtccaaagctaatcttgtagattgtctgcaggaaaacagctatatcagacatacagaaaaacagatagcaaaacagctatatctcagctcacacaaagtcaaaaatgatttgagcttcaaccgataataaagaccactgaaaggacactttgaaaaaagcgaagagctcaagcattaaatggaaagataatctcggaaaatcaatgagcttagctactcgacaaaggcagaccctaattgcaacaaaacttaaaaactgatttaagctttaaccaatattcaaaaccactgaaaatacacctcaaaaaagcgaagagctcaagcatcgaatacaaagataatcatgggaaatcattgagataagcttctcagataagggctaacaatagactgtctgcaggaaaacagaccaaagggacagcaaaaaaagataccaaactcatttttatagtgccaaaactgatttgagtttcaaccaatactataaatcctcctcgaaagagatgagctcaagcattaactcaaagataatctcgggacattaataagattaccagctcaaagtcaatatccggacatcaatagtcaaaatcattttttgactcttgaacagcatatagctcaagcattgaataacaagacaatctcgggacatcaataagattcaggtaaaccctaatcgcacccaaacggtagaagctcaaatcgaaacactttaaaaccgccacaaacacgataaacccgcacataatttcgaattcccatagaaaccctagaaaaaaacaaaaacgaggaaacaacctccgcaaaatcggactgatggccaggattatgctgagattcaggtcggatctcgatatcagcagactcatcaacgatttcttgcatagtattttgaataaactcatcaaacgaatccagctgttgacgaacgagacctttctcttcgaaataagcagatataacagcccacgcgtcctcctgggtaatctcctcatcgtcatcgtcttctacatattgaggttcaggttcgtattcgttgtactccatttattctcactctctgaagattagagcacagcaaacttcactactcgagctctcggagacaaagagagagacaggacgcagagaatgagacggctttgtgagattgtgagtttataaaggctcgagagagagaagtcggcttaagtttatggaaataaccggtttgtatcaataaccggtttgattaaatgggattataaaaaggatcggtttggttgttagagagcttggattgttaaatgacggaaacacccttactatataaagaaaagtctccggctacatttttgtggcgtcagcgatattttcggaagaagagagagagagacggagagtgaaggcggaggaagggagagagag

SEQ ID NO: 3263 - DNA, 3000 bp, Unknown; identical to SEQ ID NO: 3257
  misc_feature (1)..( 3000): cDNA_ID_1820069_gDNA_ID_1620635_Annot_ID_162865 3000 nt of promoter + ATG

SEQ ID NO: 3264 - DNA, 3000 bp, Unknown; identical to SEQ ID NO: 3256
  misc_feature (1)..( 3000): cDNA_ID_3091277_gDNA_ID_1620635_Annot_ID_162859 3000 nt of promoter + ATG

SEQ ID NO: 3265 - DNA, 3000 bp, Unknown; identical to SEQ ID NO: 3255
  misc_feature (1)..( 3000): cDNA_ID_2156491_gDNA_ID_1620635_Annot_ID_162858 3000 nt of promoter + ATG

SEQ ID NO: 3266 - DNA, 3000 bp, Unknown; identical to SEQ ID NO: 3254
  misc_feature (1)..( 3000): cDNA_ID_3070958_gDNA_ID_1620635_Annot_ID_162857 3000 nt of promoter + ATG

SEQ ID NO: 3267 - DNA, 3000 bp, Unknown
  misc_feature (1)..( 3000): cDNA_ID_2156487_gDNA_ID_1620635_Annot_ID_162856 3000 nt of promoter + ATG
ttacccacatctgaaaattcctggtttgaatgctcctattccaattggagctagctttggttttcatgctggcggctgggggaaacctccagttgacgaagtaagcatttttttttatctacattcttcttttttattatttctatgccatctactaacttttatttttttcccgttcttatcgtttgtgttacatagtatgggcgtccattgtatggagatgtttttggtgtccagcaacaagatcagcctaactacgaggtaactgttttcatctctctctgttattctccttagtaattgcatattgtgctacgaggtagataccacaaaatacaaagtaaaagcgtcctattgaatatttagagatcatacaatttggtgatagagtatgacggttgtattttatcattatcttaggaggagccaattgataagagcaagcactggggtgatttagaggaagaggaagaagaagaggaggaggaagaagaggaacaagaagaggagatggatgaagaggaactagaagacggcactgaatctgttgatacactgtcaaggtattgttatcattatgcatttatgaggtgtatactatttatttgtttccttatcagtataatctaagtataaagctgatttgtgattttccccttctttcagcactcctactggtatagagacaccggatgcaattgaacttcgtaaggatcagagaaaggaacctgatagggctctataccaggtttgaaacctaattttgatgatcttacacgccttgtaggcttttctattagtttgatataaaccaataattcactgtttctggtcgttaatgcctttttttttttgacttgtgaaggtactcgaggaaaagggagagagtgttgctcctggaacattgctgggaacctcacacacatacgttattaagactggtactcaagaaaagacgggagccaaaagggtaagcagtctgttgttacatgctcagagatttgttgttttgcttgatgacaagtgggctaacgtatgcaattgtgtcaaattgagcaggttgatttgctgagagggcagaagacagacagagtggatgtcagcttacagccagaagagctggatgctatggaaaatgttttacctgccaagtatgaggaggcaagagaagaggagaaattgcgcaataagccagtggacttgagtgacatggtcgtcgaggtaatgactttctttatatttatatctctatttttttcaacactattgatatgaatgcggatgaataatcaaacgtttacttggtggaatgtttaacagcatgtgcagcagaatagtaggaagaggaaaatgcatgacaaggaagggaagaagaagaaagatttcaaattctgaggtgttctggaagagacacggaaaaggattctggattctggacatgagagagatagggagagattcttgttccagagttattagtctttgagtcagagatcttgagttttagtcttaatgcttatgagattctatactatgttgttatctgaaggcttaagtaaaactttgtttttggaatttgaacaaattcaaagcctgagacttggaacaaaaaaagtggggaaaaaaggctttgttttgtaagcgacgtcttgtttttcaaattgtccgagtactttcagcgtttatggtttttaaaagattgatcattcggtctacagaataaaccgtcgatgtgatctatttcagtgcaccttgttatctttaagcgaggcaaaaatatgtacattttcacgacattcgctcctgaaaccaaattatgttcatatgttactgtcatatgcatagtgtgaactaattcataggcatgatccttgggttgttcaatccctgcatgtgatgaaaaaaacttaacatactgtggattttttcaatgatgtattctattacttttccaatattaggcgacaaatgattcgaccacacctcattccgggagagtaatgaaacagcgacaaatggccaattatgccactcattgtcctaccgggctaccaccattcttcacctttctttcaacattatcatgagcatgatgactcgtagagtcgtagggttcctaaatcgcctttcttcacctttctttcaacattatctatttatcttcttttcaaatctcgcttattaatcattatacataggcctctacatggtagacacatttagaaacaacaagaagtctctccaaatatgaatggttattcagcctacaagcgatgtcagaatttttttaacacgtagttaaaagtttaactttgctagacaaatgaaatctaagattaatataaacataagaaagtatatatgcttgaaatgagacaaatttagctttaccacttaaaggttttaagctaagtggattccgcttctacaatgattaatgtttgtcattttggtttctgtttacaatgagtttcacatacatactaattaaactactaagtactagccattataaaacatgctgaaaaacgagtcacatatggttcatcgtaccataacacctttggattcccactactaaagagattcaactatgggtggtcactatctattttatctataaagtgtgaaatcctatttttcattcaaatcttaataattataacaaaagtaccattacgagaggattggttttagtttggtaagttttttttgaaccaaccaaaattgaatacaatgtacttcagtgataaaaccaaatattaacccgaaagaaaaactgaaacaaagtgagattgttttgagtttgacactactctcaattattaaaccgaaccaaaccaaatccgagccgaaattcgaatttaacccaaaagttcatcccaaatggtggtggagtcatgaaacgtgaattgaaagatgaataatagatgaattatttactatatatacaaccatagaggcttctatgccaccacacacttctcacttaagaaaatg

SEQ ID NO: 3268 - DNA, 3000 bp, Unknown; identical to SEQ ID NO: 3251
  misc_feature (1)..( 3000): cDNA_ID_1820101_gDNA_ID_1620635_Annot_ID_162854 3000 nt of promoter + ATG

SEQ ID NO: 3269 - DNA, 3000 bp, Unknown
  misc_feature (1)..( 3000): cDNA_ID_3070966_gDNA_ID_1620635_Annot_ID_162849 3000 nt of promoter + ATG
tttactaaccgggggaccgtatatatacggacagctcatatgaattaaagttttatgggtgagtgatcctaaaaagaaaaagaagatgtaaagtttatgtactgaaaacacacatatatagatagactcattattgtaattaattattacatgatatccgttgacttggatggaatgcatcctaatgattcatctattaccttcaatgaggttgaagtatatatgctcaacgacaaaatgaatctgatcaacatcccgaacgattgtttctcctcccaaattatagctgtcaccataatgaacttattcatagtaattctgtagccacaccgacaatatatttcgatgtaaaaatctttgatccatcatatttgtcctaaaattatttctaatttatttcttatttttatttgttatctaaatatacctaatctcatagctctattaatattttgacgttaaatcattgtataataaataaattgatgtacgtaacatgttcaaatatatacatttattttcagtagacttttagacacacaatttatatgattagagtcgaatgcataaaatctcaaacgcgaaaaataagcggttaaacttttaaacacaaaataatataaaaattgagcggttaaatcccaattgcggcggttgaatagtaccgatcaaaccaaagattttggaatttgacggaacaaataaaccgtggagcattggtcaataacaacactctttactctttcttccgtttgctcgaaccatctagtctaagagaaagaaaaaatactaaagagaaagaagaagaggacttgaatacggaagcttgagagaatgaaagcgatcgtgatctcggagccaggtaagccggaggttctgcaactccgtgatgtggcagacccagaagttaaagacgatgaggttctcatcagagttctcgctactgctttgaatcgtgcagatactctccaaagacttggcctttataatccaccacctggctcaagcccttaccttggtctcgaatgttctgggaccattgaatccgtcggtaaaggcgtctctcgatggaaagtcggagaccaggtagatatatattcctgtgatttcgtttctggaaattagggactaatcctcaattttggttttagggtttggtgtctctgtgttaagttatccgagcttggatttaggatacagaacatttgaatacactgctcagtgctcacactcatgttcttaatgatttaggattcataacatctgaatttgaatgacttggtttctgtctagttgcaattcgtttacatttgtttagctgttgaggcttcttatatttttgtgttggattggatttagttttactctaggcttaagcaagtaaattacttttgaagtataaagttattgtcttggattacttctgactgtctttgtctcaggtgtgtgctcttctttctggaggaggttatgcagagaaagtttctgttcctgctggacaaattttcccaattcccgctggtatctctctaaaggatgcagcggctttccctgaagtggcatgcactgtttggtctactgtcttcatgatgggccgtctctctgttggtgaatcattcttggtatttcaacttctcttctctttttatgtataaaaacagtttctatggtctggtaaaagccaatccttttacggtcaattctagaggcttttatctattactttgctttgcatttgtcttctctcttgggctgttttgttttctttcttgtctatgtccttgctaatgtttgatagtatctgaaattttagattcatggaggttcaagtgggattgggacatttgctattcagatagctaaacatctgggagtgagagtatttgtcacagctggttggtctgagcttcaatatattgataacctttatgtacttttttccgaaattgttcaaattttcttttaactaacagggagtgatgaaaagctagctgcgtgcaaagaactcggggctgatgtttgtataaattacaaaaccgaggattttgttgcaaaggtaaaagcggaaaccgatgggaaaggagtggatgttatcttggactgcattggggcaccgtatttgcagaaaaatctcgacagcttaaactttgatggaaggttatgtattatcggtttaatgggaggagccaatgcagaaataaaactaagtagtctgcttccaaagcgtctcactgtcttaggtacttaacacaatcaatcaatcatctctcaaaatcaatactgagagtctgagacctattgataattcttgatctgttttgttcctacaggagctgcattaagaccaagaagccctgaaaacaaagcagttgttgtaagggaagtcgagaagaatgtctggccagcgatagaagcagggaaggtaaaaccagtgatttacaagtatttaccattgtcacaagcagcagaaggtcatagccttatggagagtagcaaccatattggtaagattctccttgagacttgattctctgcaaagggagaaatgttcagagacaagagtcatggtcaataatcaataaaatctggtcgattctgttcatagatatctctttacaagagttctgtttgttggcttttatgtatctctgatttggtcaaaaagacactgtaactatggaacatatatagtatcaaataagctgttgtataccaaacattgatttcgaagtagaatatgattttgtaagaagtttttatttattttgggcttaaaaagtgtatttatttttgttaattgtttgatttaataaggatttttaccacctgaggcaaagaccatgaatatcaaaggcaacaacagttttgacttctctcgttttcatcggtccgtttgtacttcttctgataaaaacaaaaattttgcaaaatctaacaacaaaatctttgattcgacaaactttgtaacaaaaaaaatcgaaactttgcaatttttacaga

SEQ ID NO: 3270 - DNA, 3000 bp, Unknown
  misc_feature (1)..( 3000): cDNA_ID_2999575_gDNA_ID_1620636_Annot_ID_47360 3000 nt of promoter + ATG
ctgtttttgtctaatagacaaatgttaaaatgagacataaaaaagctaattgtttcagggaaagagggcattttccgtaattgatcaacggctctctcagaaatatagccgttaccgactttccgattatagaaattagagtcctccaaaaccctaaattggctctacccctttataagcaacccaaaatttcgtaccttttcactcacttcatcaatctgctctctcatctctcatcaatcatcagccaccaacaattcttcgctctctctgctctgatctctctgctcgaatttactaacgatcccttctctgcaggctcatctttatctaatttcgtttactcattatatcttctaatccgtttcgtatactatcgctattcttgttttctgtttgtttgtattttgggattttctttgtgtttagtgataatggatgcaggtttgaatcggtgcccacttcaagaacactttcttcccagaaaaaattccaaggaaaatgtaagtatccttcttcaatcattcagatttgacctgtttccgtactctgttgagaatcaggattcgaattgtgtgggtgctctttaatttttcagattcaataccatgtttatgatacagaattagtgttttgattaacaacttgttcatctgaatccaaaattgtttgacccatatcattgatgaatctttattcagatactgtatgaacgaattgttggttttgttataagaaaaatcatgtctttccaattgattgattgtttcttgcataaattggatttgtgatatcgaatgaattgtactgatttgcttttatcttctaccagctggacaggttcataccgaatagatcagcgatgaattttgactatgctcactttgccctcactgaagaaagaaaaggtaaggatcaatctgcaacggtaagttcaccatccaaagaggcctacaggaagcaattggctgagaccatgaacttgaaccacacaaggattctcgccttcagaaacaaacctcaggctcctgtcgaactgcttccgagcaatcactctgcttctcttcaccaacaacccaaatctgtaaagcctcgtcgatacattcctcaggtatgtactgtatttattgcgtttgatccttaaagctcacttactggttgctgcattagagttgtattgatctgttgctaaactttctgttgtgattaacagacttctgagagaaccttggatgcacctgacattgttgacgatttctacctcaacttgctggactggggaagtgcaaatgtcttagccatagcgttggaccacactgtctacttgtgggatgcttccactggttctacatctgagcttgtgaccattgatgaggagaagggacctgtcacaagtatcaactgggctcctgatggtcgtcatgttgcagttggactcaacaactctgaagtccagctgtgggattctgcatccaaccgtcaagtaattactactctctctcttttatgttgagatataatatccggtgttcttagtctgatgtgtttctcatatttctgcagctgagaacattaaagggtggtcaccagtcaagagtaggatcactggcatggaacaatcatatccttactactggaggaatggatggactgatcatcaacaatgatgtgaggatcagatcacccattgtggaaacttacagaggtcacactcaagaagtttgtgggctcaagtggtcaggatctggacaacaactagcaagtggtggcaacgacaatgtggtacacatctgggatcgttctgtcgcttcctcaaactcaaccacacaatggctgcacaggcttgaggaacatacatctgctgtgaaggctcttgcgtggtgccctttccaagcgaatttgcttgcaactggtggtggtggaggagacaggacgataaagttctggaatactcacactggggcttgcttgaattcagtagacactggttcccaagtttgttcgttgttatggagcaagaatgaaagagagttgcttagctcacatgggtttacacagaatcagcttacactttggaagtacccatccatggtgaaaatggctgagctcactggtcatacatcaagagttctatatatggcccaggtaacgtcatcaatttctttaagtggtgaagtagtttgagtctttgaggtcattcagtccttaaacttgtgttgtttgttgtgttttctacagagtccagatggttgtactgtagcttcagcagcaggagacgagaccctgaggttttggaacgtttttggagtaccagagactgcaaaaaaagctgcaccaaaagcagttgccgagccattttctcatgtgaatcgtattcgatgaagctgttgaagactaaaacaacaaggaaaacccattgattgttacaaaaagaaactatatatttttatttttattttattaccaaaggattcattcttcgtgaatataaagattacttgtatatattgaaatttgaaaaaagaaagattatgattttatactcttgaaggatatccacatttattattctactggaaacaaagtgagacttcatgaagttgtgatcagagaactcgtagatgctgacagttttgtttgaaaagatgttcactggtgaacttttggaccatggttaatcgaatgcaaactctagtgtagtatcaatctttaaaagcaaactgagaaaatatttatttaccgagtctgtggcatcaaaatggcttaaaaatagttatttactaaacaaccctttgtagtttctctgtcatcctaatttaacccaaacgttttgtcaattgcaccattagcccaaacgacaaagctttgtcgttttggcttttaaaccctagattcgtcttatcagcgaatctcctctgcacattcctcagtgatctatcaaagttcgaagagaccgacgcaaaagggacagaaacggagaaggagaaagaggcagagatg

SEQ ID NO: 3271 - DNA, 3000 bp, Unknown
  misc_feature (1)..( 3000): cDNA_ID_1820185_gDNA_ID_1620636_Annot_ID_47361 3000 nt of promoter + ATG
gtttcttgcatagatttgatttgtgatattgaatacgttgtactgattgccttgcttttctcttccaccagctggacaggttcataccgaacagatcagcgatgaattttgactatgctcactttgccctcactgaaggaagaaaaggtaaggatcagactgcagcggtaagttcaccatccaaagaggcctacaggaagcaattggctgagaccatgaacttgaaccacacaaggattctcgccttcagaaacaaacctcaggctcctgtcgaactgcttcccagcaatcactctgcttctcttcaccaacagcccaaatctgtaaagcctcgtcgatacattcctcaggtatgtactgtatttaatgcgtttgatccttaaagctcacttactggttgctgcttttgagttgtattgatctgttgctaaactttctgttgtgattaacagacttctgagaggaccttggatgcacctgacattgttgacgatttctacctcaacttgctggactggggaagtgcaaatgtcttagccatagcgttggaccacactgtctacttgtgggatgcttccactggttctacatctgagcttgtgaccattgatgaggagaagggacctgtcacaagtatcaactgggctcctgatggtcgtcatgttgcagttggactcaacaactctgaagtccagctgtgggattctgcatccaaccgtcaagtaattactactctctctcttttatgttgagatataatatccggtgttcttagtctcatgtgttttatcatatacttgcagctgagaacattgaagggtggtcaccagtcacgagtaggatcactggcatggaacaatcacatccttactactggaggaatggatggactgatcatcaacaatgatgtgaggatcagatcacccattgtggaaacttacagaggtcacactcaagaagtttgtgggctcaagtggtcaggatctggacaacaactagcaagtggtggcaacgacaatgtggtacacatctgggatcgttctgtcgcttcctcaaactcaaccacacaatggctgcacaggcttgaggaacatacatctgctgtgaaggctcttgcgtggtgccctttccaagcgaatttgcttgcaactggtggtggtggaggagacaggacgatcaagttctggaatactcacactggggcttgcttgaattcagtagacactggttcccaagtttgttcgttgttatggagcaagaatgaaagagagttgcttagctcacacgggtttacacagaatcagctcacactttggaagtatccatccatggtgaaaatggctgagctcactggtcatacatcaagagttctatatatggcccaggtaaaggaaaacaactaaatcaatttttaactgttgaaagtagttggagatgtttgaggtctttagtcctaaaacttgtgttgtttgtgttgtatttcttacagagtccagatggttgtaccgtagcttcagcagcaggagatgagactctgaggttctggaatgtttttggagtaccagagaccgccaaaaaagctgctccaaaagcagtttccgagccattttctcacgtgaatcgtattcgttgaagctgtgaagactgacggacaaggaaacccatgatacagatgcaaaatattcattttttttgcatctgattcattcttcatgaattgtagtgacaagaaaagtgcatattgtacaattatatatatgtaaatgatatatattgttgagtcaaacttatttgcttgcatttgaatagaaagaaagatcttgattatatatgtcagatgatacaagaagcaggagcattaagtactgtaaactgtaagatgataattgtaactacatcaaaatagacattgaaaccacactaacctaatcacattagtgtgtagaaacatgtgttcgattagggattttggaagattttattttttccgctagcttatgtaatttcagggattttagaagattttggttttatgtttttaaaccacttgttatgttttcaggttaatgaattgattaacaaatgctttttttggatataaattttttatatgattaaaataatactaaaacaatattataggtgaaaaataccgatcacacaataaccattatttaaccataaagcaaatattcaatcacacaataacctaaccaaatattatcgaggttaatacaaaaattattatttacaaggaccatacatcgaaatacgttggatggttctcgtatacaatttgaaactaattttggatggtattaggtagatgataaattgttattatggtctatttaccgtatgaaactttttcactattgtatttgttttttttcagtaataattctagattaaaggtaattgtggtatttatgtgagtgttaacctcttttttgtaccaatagttatttcagtatcttttttgagtgagtggtaagcagtgttttatttgttttgtataatatctataagtattttaatgtttttttatttttgttacatgtctctgtttttgtctaatagacaaatgttaaaatgagacataaaaaagctaattgtttcagggaaagagggcattttccgtaattgatcaacggctctctcagaaatatagccgttaccgactttccgattatagaaattagagtcctccaaaaccctaaattggctctacccctttataagcaacccaaaatttcgtaccttttcactcacttcatcaatctgctctctcatctctcatcaatcatcagccaccaacaattcttcgctctctctgctctgatctctctgctcgaatttactaacgatcccttctctgcaggctcatctttatctaatttcgtttactcattatatcttctaatccgtttcgtatactatcgctattcttgttttctgtttgtttgtattttgggattttctttgtgtttagtgataatg

SEQ ID NO: 3272 - DNA, 3000 bp, Unknown
  misc_feature (1)..( 3000): cDNA_ID_1820181_gDNA_ID_1620636_Annot_ID_47362 3000 nt of promoter + ATG
aagatcggtgatcatcgtcgacgtcgtcattagtttcaaattgcaacaagggtttgactatttacattcaaaaaaacgctttttgttttcctcaagtgtacaccatatataacagttgaagatacaaaagccctaaacaaatctgggccgatagtgggcttcagaatgtagtcggtcttttaatgatattttggtgtcaacccaataactccagtttcatctcaattctcaacatacaagtatctcggtggcaagagcagggagaggaagagagaagatggaagagaattgcgaggattgcatgaaatgggaagaagaactctactggactcattttcaaactctccatttcactcagctcctccttcctggtttccacaatcgcctcgtatgtctctatcactttctctaagaaccttcttcttcatgcatctttatcagcaattcatgttactctttcaatttcttcatgtattcactttcctttgttttccaccggcttttaatttggagatttacactcaaatgtatcaaaggggtttaagcaatttttgtttttttctctcaaaatcagttctttgcggatttaagagtcctaagattgccaattctagcataaaaattaccactttttgcaatttattacaggtcatacctcgaaagttttcaacacactgcaaaaggaagctgcctcagattgtgactctcaaaagtccaagtggcgttacatataatgtgggagtagaggaagatgatgaaaagacaatggcttttcgttttgggtgggacaagtttgtgaaagatcattcgctagaggagaatgatctattggtcttcaagttccatggagtgtctgagtttgaagtgcttgttttcgatggacagactttatgtgagaaacctacttcttatttcgtcaggaaatgtgggcatgcagagaagactaaaggtattattgattttaatgcaacctcttcgaggtctcctaagagacactttaaccctgatgatgttgaaactacaccaaaccagcaacttgttatatctcctccagttgataatgagctagaagacctcattgacattgatcttgattttgatattgataaaatactaaatccgcttcttgtagcatctcacaccggttatgagcaagaagaacatattaactctgacattgatacagcatctgcccagcttcctgttatatctccaactagtacagtacgagtcagtgaagggaagtatccccttagcggttttaagaagatgcgaagagaattaagtaatgacaatctcgatcaaaaagctggtatgaaaatcttcttacttagtgattacacagtgcacttgtttcttggtattcatctgataagccctgtctgtactctgtagactctgttttgcatgcaactgttgggattaaagtttcaggttttgagaatgttgctaacagcttggagtaactgattccttagtcttggatattatatgattctggatattaggtgtggagattatagaattgtctcatctttctcattcagtagagaaagtttcttgttccgaaactttattaacttcttactacccataggctttgatccatttgtcttcaaagtttataactttatataatggagtgagtccatatatttatcagtttctatctcatttatcatgcatctaaaatactaatataccttatcaactgtcgtaagacgtggagatgatttcagctggaagcaataagaaagccttatctctggccaagagagccatttcgccggatggtttcttggtgttcatgaaacgctctcatgtggtatcaaagtgttttctggtaagacttttgcatcgctttgtgtatagtccttgaagcttcgattattgaaaaaaatagaagaggtcacatttttcttttgatacagacaatcccatacaaatggtgcgtgaagaacatgcttatcacacgtcaagaagtggtgatgcaggtggatcaaacgaaatgggagatgaagtttaacattttcggagctcgtggtagtggtgggatttcaaccgggtggaagaaatttgtacaagacaacaacttgcgcgaaggtgatgtctgtgtgtttgagccagccaattctgaaacaaaaccgcttcatctcaatgtctatatattccgtggtgaagaaacggaaagaaccaacaatgttgacccggtttacacaataagtgaataactaagcaaggctacaacgttttcctcaaccctgtagtgtaaagtatatgtagcgtagatgaaaacttgtatataaaggtaaacgtaagaatgtgtgtaatctatctctcactcacgatgcctcttttttttgggtgcatataacggaactcttctggttctggtaatgcctattttcttgtgttggggcttgccacaatatttaaaccaactctttttttgtcttttggtttagtcttgttaaatcatataagtaataccaagtgtttttttgctttggtttgtaagatttgagaggagtataaccagtaattttattagtatttactagtctgtgtgtaaaattggtctgatctgttgctatacttagcctaagaattgcagatttattccgcaaataaacgaagagtgtacattagcgccaggggcattaccgtaaaaccaaattttacaacgtctctctccgaaatatagccgttacagtttccaattgtaagatttagagcaaaccctaaaaattgactccactgctttataagatccctaatttcgtacattctcgatcacccaatctactctcgattctcatcatctgcgacgaaattcatcactcgctctctctctgctcggaacgattccctcttcgctagctttatttgattcgtatttgtctgatttcgtttaatcttctagatcttttaatattcgtttcttttatcatcgcttttgtgtgttttgctctgttttcttgtttttgtttggtgataatg

SEQ ID NO: 3273 - DNA, 3000 bp, Unknown
  misc_feature (1)..( 3000): cDNA_ID_1820169_gDNA_ID_1620636_Annot_ID_47365 3000 nt of promoter + ATG
tttatcgccttaggtagtttttcttcgtgaacaactttggctactttggaggagatattaaaccttttattagtgaaatagtattaagaaataagaattgttttgtaaatgccagagacacaaaaaaaagaaagagaaaaatacatctccatatactatagttttctctgtgaatatttaagcgaaataggcgaaaggttggaacccacgtcacaactagatatcatccatatatttattttcaatcaaaaagctattatgtctcttgataatatattgttttatgtggaattatctgacccaaaaaagacttggcaatgtgtacaccacttaaattctagggaaatttgggaaactaacgcaaaaaaaaactttaattaagaaactatcacttgccaaaaaaggagatattttctgtattttctgtatatatgacaattttgccctcatatattcttccatctcttttgtttctctcgtcttcttctcaaattattttttctttcacgttgacttctcctccgccatagtccgaaacagaggcatcacagcaacccaactcgaaccctcgatctcctcatcactctcaccaccaccaccaccgccactctttttcgactccctcttccacagaatcttcaaatcctaccgccggagctcgccgtaatccatttcggagatgtcgtatgggttgtagatcactagatctatcatgggtatgtcgtttcaattccatattctgatcatcctcaacatcaaaatccataatagagagctgcatgagaacacggcggcttgctcttcctctccaagcattagtagttgatttgttaccatgttcattcataacttcgtaatctccaaattcatcagctcatgtttcaataattcactcaattaatttatgatcaactttgagaacttgattttttttcttttcttattattgtctgtttcaaatctccactcatggcagcaatactatactattttataaatgcaaagtcttttgtttttattgaatttgatattttcttataacaataaatgttagcttcttattcttgatttaatacttaaacttgagttaaactgtccaactctctaatttcatgtttatcatatagaacacaaaatcattattagtttgaggataaaagaattagagtttaattgattggatcatgtctataattagtttccttgggttccctaaattctcttagggtttatattttttctatcaaaactcttgtttaattcaatcaaaacataatattatgtatgttcctagttatgttttctattgtccaatttattctttacatactaaatgaatttgttatgaacaattaaagtatcttattatataaagtatagttttcaaagttgctaattcataggatcgtgccacgtgtcaagtcaaacgatcagatgtttacatgtgtcattcaaaatttaacttttttattctctaaaaaaatagaaaatcttaaaaagtaaacaaatttacatatactaatttatatcttattatataaagtatagttttcaaagttgctaattcataggatcgtgccacgtgtcaagtcaaacgatcagatgtttacatgtgtcattcaaaatttaacttttttattctctaaaaaaatagaaaatcttaaaaagtaaacaaatttacatatactaatttatatgtctatatatttataaataattaacatttattcaacaaaaggaaaattaacaaatttgtctttaactcatgtaatcataagtgaaaaataaaacattttgagaaaaatagcttagcttataggatttaacttttcaattattttcatttattaattttaaatcatttaatataaatttgcatgatgtaaaattaacttacgagattacgacatatatacaaaatatattttcaacaatgtttggtttctaaatatttttgtggatttctttttttttattaattattagccctaagcgtttgggtattcggatcgggtatttcgggttcggttttttgggtttagaagtttaggacccgttgaggtaatttatgattttaggtcgggttcgggttcgagtttatttatatattgaaatatcaaattttgtgtgcaaatctattaaattacttgaaaatttcaaaaattcccaaaacaacacgagtagttttgtttgaatatatctaaaaatacacaaaataactaaaatatccaaaacatcctaatattttctatatataagtataaagtggtagagcggtcggctgttaactgattggtcgtagtctttaccgattaaccaatttctaaacgctggagagtatgttaccgattaaaatatacttatatttgagatatgtttggatacctattcgggttcgggttcgagatttttcgggttttaaagtttagacccgttcgagtatttgaaaatttcgagtacacctgcctaaatagacgggccttatctagtataatatgatacacttctatatagtatagtccaattgttttgtatacagcaaaacactaaaatggttttttccattgtcccacatgctagtttctttattattacacttatcgtgctatattttaattcatttttcaaatatagctattcttgcaaatcaccctaaattctatcaacttcatgtgaacacataaaaatactttcaaaaattctcgatagagatatttgcaacccttttctttccagtctccattaactttatggtaatattagaatgaccaattggatagtcttcttcttcttctttggagtttctattttaaaatagttttaaaaagtcttgtcgcgtgcttgttgctttaggaagctgatgatgttgtcagtgtcactgcgaattgctaggaaattttcaagtggggtcctccactactacttgctcctcgttgcttatttagtcttctctctatctctctctcgagctccattgacttgacttggtggtatccaatg

SEQ ID NO: 3274 - DNA, 3000 bp, Unknown
  misc_feature (1)..( 3000): cDNA_ID_1820147_gDNA_ID_1620636_Annot_ID_47372 3000 nt of promoter + ATG
tatgtgtacgaggtaagttcttacgtatttaagccaacactcctgatgtttatgctcataaatatctggagagaaacaaccaaactcagatgggcaataaacccaaatattgcatctcgtttctccaggtttcgcacgctttgcctggtctaagcaagcctggcaacaatcagctgcactctctttatgatgtgtaagcccccatctcactgcagcaccaccataatctgtgtgaagctctgcattacatacagctggcactggtctgcctgccaatatttcctctacggaaaaaatgcacaacttcatgagatttgaattcgccagtgtcaccacacttttccacccaaataaatgcaaaagcagagatcaagaatgtagaaaattttgaaaacattaccaggctcttcctctccttcaggtttatcatcatgttctacattggtaacctcagcaggtaaccagaaaccgatttcttcagacagcacatcccactccaactccaaagctcttacaagcatccctagataattacagaacaaaaattagttttctctctaattatacaaaacaaggatagagtatcgggaggactccataaatgaatctttgctcaaggtgagaaactcagtaatctttctaaaggagtaatacctgcttcctccactataagggtggaatttactccattttgcccttgaattagctctttagcttcctccagcttctcattgcgccacgtttctacaacttctgtttgccaaatgaagataagaaggtattaaaggtcactacagagataacatgaatgtgtcaaaaggaaaactattgtaggcgaaaacattaacaagtctacgtgcattacgaatactacaagggaaaacaatagaactcagtttgaagcatcaaaaagaaatccagtgtcttcaaagtctggattattagaattttgtcacctctctctaaccaaataaattaacccattcctaccttccacctttttccaataactcttgtaaataactaagaattaacgcacattgcgcattagcctagtcagcacataataaatgttaagagttgttcaagtgaagtgaatagaatgaaaaatctacttttaacaagtcaaaaaggtaaatatcatgactttttggaattcttgagcatactttttctgatgcagtagaaaggaattagagaagcatgttgagacatacgaacatgttaggtaagctactgagaatctaaagaacatcgaaaagattatgtatacaatggcaccaccgctagagtttctgtggctcaaatgtttcatgtacatagcatatgatcatcaatgcatagattataacagaacttaagtgggtgttagagcttatgttccatagacctgatgaacttatacaagaagaatagaaaaactaggcatgaaaaaatctccattgaaaatcccgctaaaatcaattgttctgtctagtatgtgatagtgcatgcagaaaggtctgaaatttgtgagcctattttactatcctgataaccatatgcattattgagcaaaaatccacttctacatgaatgataatgaaatatttactaaactgagctattgataccaacaaaatcttacacaggttaggtaataagacaaatcaccatgacattccaaagaggtaataagacaaatcctaagcagctagatcaggaaaagtcatgaaatgcaagtttgtggcagtttgaaaaataaatgtcatgaagctaatgggcatagtagagtagcacaaacctctaagctgagtaacattagatttgtcctcaaagcttttcaaacgctggaggatctcatcaactagtttgtgtttaacattaggagatagttcagtactagattctgcagtggaaacctcatgcttgagcttcttcacctaacaaggaaatcaaacattgtgagaagagccaatgtgcatcttcgagttccattttaaaaagccactaaccaattgaagaatcagagtaggttccttcgatcttcgaatccgaatagattcctccattttcctaatctcatcagctgtgtacttaacaactgaataacaaaaaaccaacagagctgcttcagatacgaattatcatgaatcagagagcaaaaatgaaaaggaaaataaaaagtaggaaccattatcgttattggaatagatgtggagagaagaagcatagagaaagcgaagaacaaagagagcaatgagaatgttgaaaaagcaaacaagtagagtgattcttttgaaagagagaactccggttccggcgatccctccggtccattctcctcctcccctcgccatctccctccgccgtcatcccaccatttctcaagatctcgcttccgattataattacacttttgctttaaatcgaacacttgaaagagagattcgatttcttttttttttgcttcttcttccggcggaaaaaggaaatcgtgggagatagagagagagagcttttaattattactctattaatttatttttcactcgacagagacagagatatataccaatctcatcaatgcgtgtggataaaaacgtcgtatgtatttctttggcagcgtctatactagataggaagttttgtagtattatttcttgcaattgttatgtaaatactacatctttaaatgtggtgataatcctatgattcatgtcattgccatttttcaatccaatatatgaaaaaaatggaaattaaatttttgaaaaactaccttttacctagctccttgtcaacatacgaattctaattgagactctcttcttgtagcttttcttttctttgcttataatcagaaaacacaacacacccgatcattccccaaccccggtttaaccaaaactccgtgtcggtcatatctatctgcgtgatcttccttgaaagtcgagagatctgctgattagggtttggattcgatctttgaaaaagttggcgagtggattttgaatcatg

SEQ ID NO: 3275 - DNA, 3000 bp, Unknown
  misc_feature (1)..( 3000): cDNA_ID_3409023_gDNA_ID_1620636_Annot_ID_47373 3000 nt of promoter + ATG
accaaaagaaagcttactgagatgaatcgagatgggtcaggaagccaaggctcaactaaagctgcggcgtggaaaacgatatcgcaaccggagcaagcatccgttagagaacggtaatccgttacgtctccataggcgagctcaacttctggaggtaagtcagagagatcgctggtgcggcggaccaatgcacgtacggagtggccacgacggaggagaacgtggcagagtcgtgcgcctaagtaaccagtagagccggtgactaatattttcatattttctgtttctgtgttgggcatctttgggcccatcgttgcttttctaagccaagaaacctctaattggttgagagggtttaattaattaatatttaatacaaacatcattgtctgaaagctggatcaaccaatagcaagattcttttgtgttttgttttgtcacatactacagataacaaagaactagtaagtttctcatttgagtgaaacaaaatttcaaattacagacagatccacgaaaatacaagatgacataatgagtaaagaaatctcaattcggtgatagctagttcgaaacaagattagagcacgaaccttgaaacaagattacacctctcctctgtatccatcagagccaaaatggtctttcctagaactagatatagctacactcttctgatgttcaaattttggacactgtagaatccgatgcccgagaccaccacaataagcacaacccttgacaccgcttgcattagcaatggtttctgtttcttccattggaccattaagctcagcaaggacaggtggaatcctctgtttagcttcttgcaacaagtgtttcaaatcgagcagcgtgatttcgctttggttcttgtttataaacgtagttgctatcccagttttcccacagcgacctgttcttcctatcctatgcacgtagttctcaatctccccaggcatgtcgtagttgattacatgttgtatatcagggaaatctaaaccctttgaagcaacatcggtcgcgaccaaaacgtcttttttcccagctttgaacaaagatattgcgtaatctctgtcttcttgatcttttcctccatggatagccactgcttccactcctttcagtaacaagtactcgtgaatatcatcaacatcagctttgttctcacagaatattaaaaccggtggagtggttttctgcagacactccagaaggtaaacaatctttgcttcttgcttgacgtattcaacctcctgtatgacatcgagattcgcagctccagctcttcctacattaacagttacaggtttcaccagagcacttgtggcaaagatttggatttttgcaggcattgtggcagaaaacaaaagtgtttgacgctgagacttaaagtggtcaaagacatgtcttatgtcatcttcgaaacccaaatcaaccaacctatctgcttcatccagtgtcaacaacctgcaagcatctaagctcatctttttcttggcgaggatatccttcaaccttccaggagtagcaacaacgatgtgaacacctttcttaacaacgtccaactgtgatctcatatccactcctccaatgcatagcaacgacctcaaccgcgggtatccatcctcgactaaagatgccacaaactgttcaaccacatcgtaagtctgcttagcaagctctctagacggacaaataacaagcgcaatgggaccttctccagcagctataggcatcattatctcctcctgcagagctaatatgatcataggaagcacgaaaaccaacgtctttccggaaccagtgaacgcaatcccaatcatatctctgccagacaaaacaacaggaagaccctgaacttggataggagtagggtgcattattcctttatccttgagcatacggagaagtggactcggaaatttcatatccatgaagtttttgattggaggaggaatatcttcaccgttaactgtaatatgccattgcttcctaatcaaatccatctgtttggttgacatcttcctaacgtgcagagggggtttccaccatgttgagagaggctctgtataagtgatacctctggctaattcaccaacagacataagcttcttcttgtcagataaatgctccatcatccccttctcttgtaaaataatggcctcggtagcactgacttaaggtacatgtcgcttgagctgagttgcttgaacaagtaagctaggtttagcttcttcagtgagctttaccttgccaggttcttccaccacctttcgcttcatctgcgctagacgctcctctactggaacatactccacgtaaccatcatctacttccatgattcaaaatccactcgccaactttttcaaagatcgaatccaaaccctaatcagcagatctctcgactttcaaggaagatcacgcagatagatatgaccgacacggagttttggttaaaccggggttggggaatgatcgggtgtgttgtgttttctgattataagcaaagaaaagaaaagctacaagaagagagtctcaattagaattcgtatgttgacaaggagctaggtaaaaggtagtttttcaaaaatttaatttccatttttttcatatattggattgaaaaatggcaatgacatgaatcataggattatcaccacatttaaagatgtagtatttacataacaattgcaagaaataatactacaaaacttcctatctagtatagacgctgccaaagaaatacatacgacgtttttatccacacgcattgatgagattggtatatatctctgtctctgtcgagtgaaaaataaattaatagagtaataattaaaagctctctctctctatctcccacgatttcctttttccgccggaagaagaagcaaaaaaaaaagaaatcgaatctctctttcaagtgttcgatttaaagcaaaagtgtaattataatcggaagcgagatcttgagaaatggtgggatgacggcggagggag

SEQ ID NO: 3276 - DNA, 3000 bp, Unknown
  misc_feature (1)..( 3000): cDNA_ID_1820143_gDNA_ID_1620636_Annot_ID_47374 3000 nt of promoter + ATG
cgtatctgaagcagctctgttggttttttgttattcagttgttaagtacacagctgatgagattaggaaaatggaggaatctattcggattcgaagatcgaaggaacctactctgattcttcaattggttagtggctttttaaaatggaactcgaagatgcacattggctcttctcacaatgtttgatttccttgttaggtgaagaagctcaagcatgaggtttccactgcagaatctagtactgaactatctcctaatgttaaacacaaactagttgatgagatcctccagcgtttgaaaagctttgaggacaaatctaatgttactcagcttagaggtttgtgctactctactatgcccattagcttcatgacatttatttttcaaactgccacaaacttgcatttcatgacttttcctgatctagctgcttaggatttgtcttattacctctttggaatgtcatggtgatttgtcttattacctaacctgtgtaagattttgttggtatcaatagctcagtttagtaaatatttcattatcattcatgtagaagtggatttttgctcaataatgcatatggttatcaggatagtaaaataggctcacaaatttcagacctttctgcatgcactatcacatactagacagaacaattgattttagcgggattttcaatggagattttttcatgcctagtttttctattcttcttgtataagttcatcaggtctatggaacataagctctaacacccacttaagttctgttataatctatgcattgatgatcatatgctatgtacatgaaacatttgagccacagaaactctagcggtggtgccattgtatacataatcttttcgatgttctttagattctcagtagcttacctaacatgttcgtatgtctcaacatgcttctctaattcctttctactgcatcagaaaaagtatgctcaagaattccaaaaagtcatgatatttacctttttgacttgttaaaagtagatttttcattctattcacttcacttgaacaactcttaacatttattatgtgctgactaggctaatgcgcaatgtgcgttaattcttagttatttacaagagttattggaaaaaggtggaaggtaggaatgggttaatttatttggttagagagaggtgacaaaattctaataatccagactttgaagacactggatttctttttgatgcttcaaactgagttctattgttttcccttgtagtattcgtaatgcacgtagacttgttaatgttttcgcctacaatagttttccttttgacacattcatgttatctctgtagtgacctttaataccttcttatcttcatttggcaaacagaagttgtagaaacgtggcgcaatgagaagctggaggaagctaaagagctaattcaagggcaaaatggagtaaattccacccttatagtggaggaagcaggtattactcctttagaaagattactgagtttctcaccttgagcaaagattcatttatggagtcctcccgatactctatccttgttttgtataattagagagaaaactaatttttgttctgtaattatctagggatgcttgtaagagctttggagttggagtgggatgtgctgtctgaagaaatcggtttctggttacctgctgaggttaccaatgtagaacatgatgataaacctgaaggagaggaagagcctggtaatgttttcaaaattttctacattcttgatctctgcttttgcatttatttgggtggaaaagtgtggtgacactggcgaattcaaatctcatgaagttgtgcattttttccgtagaggaaatattggcaggcagaccagtgccagctgtatgtaatgcagagcttcacacagattatggtggtgctgcagtgagatgggggcttacacatcataaagagagtgcagctgattgttgccaggcttgcttagaccaggcaaagcgtgcgaaacctggagaaacgagatgcaatatttgggtttattgcccatctgagtttggttgtttctctccagatatttatgagcataaacatcaggagtgttggcttaaatacgtaagaacttacctcgtacacatactactttacccaattttcagtttccttgagattactcgtccaagttggactggaagcttggctcatatccaatatgtctatgtgaattgcaggcagagaagccaaaacagaatttcaaagacagatattctgagacatacagaaacaaccacccaaaagcgccatctatcgttccatgggtttcaggtgttgtaacggcttgagcaaaacccatgtggacagattgatgggagaaataggagatagttttggtttttttttctcagctgtgttaccattttcagagtcttgaaaattggagtaccgtaccaaagatgcaaacatcttttggccagatgtatacgagggaatagaatgttttgttgtttttgttgattggctttaaacacttgtggtcgaagtcgaatatggtgtaaggaatcatgtttttgttcaagcttgttcgattctatagtggatgattaaaaagctatctataaacatgacgaatgtctgtctcctgttatatgatcagatcaaatgtttatgtctggtctgtaattatgtcacaaaacatcacagtaaaactctgaaatgaaataatggttgaaatataggaactaaaaaaaacaaagcagaaattacggagggaaaagagaaaacagaggagtgtgttcatcttttgcttccggggttgtctctattctaaatatagactttccaattgtgtacctctcttttcttgtcttcttaatcagaaaatcaataattctcttctactttcttcatttttccctttctcttgtaagtctctcttttcattgattctttctattggtggcgagcttcgttcaatcgttttagcatttctcttgtaagtttcggccttgctttcctccg

SEQ ID NO: 3277 - DNA, 3000 bp, Unknown
  misc_feature (1)..( 3000): cDNA_ID_2049637_gDNA_ID_1620636_Annot_ID_162908 3000 nt of promoter + ATG
caaaaattcttaagacttcaatattatatgcacttatgctatgagcaaaacatgaaaatttcaagaatgtcactttctcagcaagaatatacactgcaactagagttctgcttacccaagaaaactgagcattgcggaacttgttgtcagatccagctaaatgtgcatcaagaggcctcaacttaagcaaccttggtgcggcaatcttatttcccatgcgaccctcgaagccggtctttgttttgccacttttgtcagtgaaaagggtacagataacaatcaaatatgtgtcagttgtaccaacaatccatttcccatcgaatgtagcatccacatgagtaacaggtgcaccaagtccagggaaagccgtctttgcctgcctcatagtgttgctcgagtagagtctaattttgccatcaagagagccaacaacaattgagccatcaccagtagttgcaaagcactgaaagttagtccctctagaaaactgatgcccctgtgcccaattcaagactggagtattcgcagtagcaagatcctgaaccatcccatatcggtcacgcatatcccacctgcaaagcctattgttatccagaccaagaaacgttgacgcagatggatccaattgagcacctttaccatcattagtaatgtcactcatagagatatccactccatctttctcaaacttccactctgaaataattttcccggtttcaatgtcaagctgatggatacctcgtgaatgaggcgtttggctcataggactcatgagcagcatattagtctcagctctcatgagaagagccttcttcggtgctgaagaatgagttcgaccataaccaggctcaaagttaacacaaacacctttcccttgaatcccctgtctcatgttcttgaaaacctgaataccagaatctccaactagaaagctattatctaaagcacctagagctaagctatgtatgccctcacttgtagcttcttcaaaggcctcagtcaaatcctgtgtatctctagccggagttgcagatcctcctcctgggctttgaagcaaaatatcatcagcatcttcccacatggaatcatcagcagcttcaggattagcccacccaatgaaatctttcccatagatttttgccttgttagcctcattaaactcaacaccatgattgttctcaaacaagcaattgttatagctgcttacaaaaaccgaaaaatcttcactgctggcgaatttcatagcccaaacagctttagcaacgaaatcaacacggcgttgatctttataagctttcaattgcatttcatctgataccttttcacggatcttgcttccgactttcaaaatccaccattcgttttccacatctccgttctcatcgtcgtcttcatcatcttcatctcctttgttagtcttgacgaaacaataagcagtcagtttctcagctgtgacccatttggctttgggagtgttgccattgatgtagcggaaaagccgagctgagttctgagtagacggggctgattgcgtcaatgggtatttcagcttcagggcttggagttttgcctcaacgtcgtcgagtgatgatgaaggagatttaggccggagacgacgaccaccggaggaagatatacctaacgtatcatcccgcgagtcctgaaacgtctcttcctcttcctctccctctcttccttcttcatattcttcatattcatcttcatcggaggaacagatctctagatcttcatgactgtgagatgctcccatatcgaagaatcctggaaatgggaagagctagagagaataacggcaatgagattattcaaacgaaggtgggaagttgaagaagaagagagaagagcgtaaagttcgaattttgaaaattagggtttttcaaaagcatgtgttcctgttcccctttggacagattgaagttaaccggctatagcccgtaaatgcggatctgtaagtactttcatataccggctatagcccgtaaattcggatctgtaagtactttcatgtaccggctacagccagttgaaatttttatgatttgtggttcattcaaattcaaattagaagtggtccgatttttaagaagtacggttatgttgtgatttggtgatgctgtaacttcgtcttaaatatgttgtcgttttgactcgcattacaatatgttatcgtttaatttacgatacactgtaattaattaatagtttcaatattatagaaacgtttggtcctttagtcggagagactgatatgcgacagaggatccaacgtcgcgactgaaacctagatcccaattctccgtttccaccactgtctctcctccgtcgttagggtttctcaggtgacacactccgcttctcttcttttccgtcttgatctaatttttccgtcaattggtttctgcaatctctacgtttcttctctttcaccttagatattgcttgattcccacattaattgttgctgagaagtataattaatttcttgatcgaatttaccagttctcaaagttttgtgtccgttgagtacaacaaattcctcgaaattgagtcattgattgaaataccaacttaatttttgatttctgggtttgttattaaaatgtagacacacacttggataactgagtttccttaacttcaatctggttataaacaattttaaatttaccctttttcttaaagaactcaactttagcttgaggtctgaatttttgtgccaaacatgtacttagtagcttagtaaccatgtcttgtgaactattatctttcttgatgtcccttgttctgtaaagttcgtaaaaacttaatctttttggttttaaggtggcttacatgaggtttgttggtgtgattttttattttacaggttcacatctgttggaaacttattgcaactcctaaaggcatttcacatatttgcttttatgcgtacgaggcttgggggatatttatataatccgaaataactcttttcttatc

SEQ ID NO: 3278 - DNA, 3000 bp, Unknown
  misc_feature (1)..( 3000): cDNA_ID_1820139_gDNA_ID_1620636_Annot_ID_162907 3000 nt of promoter + ATG
actaaaacttcttcattacaaaagccaacgttttttagtattggtatctctattcataagaaaaaattaaagaacttgttaattgtttatttttcctccctttgagtaacgcaaaaaaaatgagggatataagacatcatctctctttctgaccaattttttttttttttttctttttttgggaacttaagaatacaagaattcttgatctgatgttttcctactaagcgtctttgttttatgtaatatgttttagatttctgaatcatcttgattgatataataaactcagatctctatttcatgagatttctcaatgggattagataatgcaggtccttcccacagctccgcaagatcctttctccgccatgacatgaagatcaccggtcctaacgtagatggtacctatatatccacatcgaaaacagattatacatcataatctcactatacttcacactgatcaagctcttaaaatcattggattgagactacaaagattctatcaacaaaatttcagttgaatcaagtgttgatatcggttgtgcacaaatacacgtagtagaatatatacttttgatgttagaccaagaggaacaaagaagtcacatgaggagaatattaccagataaagtagagctggctgaggtgagtgggtcaagacacctgcagctagagccgccaccaagccaatggcatatccgggaagtgcataccaaatgtatttgtgtcccttggaagattttagatcaaaaatattcaccacatctctagtttttcgatggtcaaagcagaggaccaaagccaaaagcattgcagggatagcctggaacaacaaaacagttaatcaatacaacatgttttttttatctcctcgtcactatagtctgagagagaacatttcttacagttagtacacatataacgacataccaatcttaaaatcaaagaagggattagtctgtaccatgtcaccaagaccaagcatcatgaaatctgaggcactcacaccgggcaccacaccgcccaataggttccgaggaaacacaattttaacaggtagttccagtttctttgtgatcaattgcagtccaggaagattcaaactgttagccactgtgtgaactgggtttgatgcttgctgggttgccacggccaccataacgttagcaccaaagaatctctcagagaagaaaacccagaatatgtcatatacaaagagacacacgaggagcattgcacagattttgatattaggaagacgaacatggctaacaaacgcaatacaaatggagattccgagcaaattgttcaacacccaatggccagagatgagccatgccacaactgtcatagcacaagccacaagtagcaatccttggattcttgtaaacgatttggagcagcagcgtgaaagaaagggatcagatagaccaagctgcgtcttcatatataccgcatatggtgataaccaatagaagagagaagaaacagaggcgatggctgtaaacgcggtcaggagctgagaaacagaagagaacaaatagaacatgagaagcaaactgcaagagctcataactgggatcatcaaggcctgagagctatctagtgttatggatgcttcagagaagtcacggtttctctccatctctttcccgtagttaagtgcacggaaagcggatgcaaatgtcacggtgacagctgtgacaatgagagtagctggagcaggttctagcaaatacaaaagagtccacagagtctccatgataagaaaagagttatttcggattatataaatatcccccaagcctcgtacgcataaaagcaaatatgtgaaatgcctttaggagttgcaataagtttccaacagatgtgaacctgtaaaataaaaaatcacaccaacaaacctcatgtaagccaccttaaaaccaaaaagattaagtttttacgaactttacagaacaagggacatcaagaaagataatagttcacaagacatggttactaagctactaagtacatgtttggcacaaaaattcagacctcaagctaaagttgagttctttaagaaaaagggtaaatttaaaattgtttataaccagattgaagttaaggaaactcagttatccaagtgtgtgtctacattttaataacaaacccagaaatcaaaaattaagttggtatttcaatcaatgactcaatttcgaggaatttgttgtactcaacggacacaaaactttgagaactggtaaattcgatcaagaaattaattatacttctcagcaacaattaatgtgggaatcaagcaatatctaaggtgaaagagaagaaacgtagagattgcagaaaccaattgacggaaaaattagatcaagacggaaaagaagagaagcggagtgtgtcacctgagaaaccctaacgacggaggagagacagtggtggaaacggagaattgggatctaggtttcagtcgcgacgttggatcctctgtcgcatatcagtctctccgactaaaggaccaaacgtttctataatattgaaactattaattaattacagtgtatcgtaaattaaacgataacatattgtaatgcgagtcaaaacgacaacatatttaagacgaagttacagcatcaccaaatcacaacataaccgtacttcttaaaaatcggaccacttctaatttgaatttgaatgaaccacaaatcataaaaatttcaactggctgtagccggtacatgaaagtacttacagatccgaatttacgggctatagccggtatatgaaagtacttacagatccgcatttacgggctatagccggttaacttcaatctgtccaaaggggaacaggaacacatgcttttgaaaaaccctaattttcaaaattcgaactttacgctcttctctcttcttcttcaacttcccaccttcgtttgaataatctcattgccgttattctctctagctcttcccatttccaggattcttcgatatg

SEQ ID NO: 3279 - DNA, 3000 bp, Unknown; identical to SEQ ID NO: 3276
  misc_feature (1)..( 3000): cDNA_ID_1820143_gDNA_ID_1620636_Annot_ID_162906 3000 nt of promoter + ATG

SEQ ID NO: 3280 - DNA, 3000 bp, Unknown; identical to SEQ ID NO: 3274
  misc_feature (1)..( 3000): cDNA_ID_3092946_gDNA_ID_1620636_Annot_ID_162904 3000 nt of promoter + ATG

SEQ ID NO: 3281 - DNA, 3000 bp, Unknown
  misc_feature (1)..( 3000): cDNA_ID_3070973_gDNA_ID_1620636_Annot_ID_162902 3000 nt of promoter + ATG
aacaatctcatctccttttctttttcttacttcaacttgttttttttaaggcagtaacaattagtaaggatgaaaataatcacattatcattaagctgagatgtcaaagcgattatgatgagaggaaaagaaaatgaaaataagtattggtaagacatcttagttttaataatcgtatatcaaccaaatttgatcaataattagcttaaaccaacatatcattttagaggcctcaacctcctttgaataattaggctgatactacattctaatgacagatgaataacgtacatctccactttttaaaacaaacaagattatgttatttgatttaggtatccgtatatgccaaatatatttttctggatgtaagaaccacgagtaacatgttgatgatgtgtttaagtggtaaaaggagaggagaaaactaaattttgggactgtgttgagctctttgggcaattgataatattgcaaaatctcaaaagaggctgttttttttttatcaagtaaaaatacacacattgtgtctattatggttttactctttgatcaaatcctgcatgtgttgtgcataacttcttcccggtggaatgaatattacatcttcccaacctgaattcttctcgctcatctacattgattcaattcagatttttattagactaccaggttttcatactttaaggtttctttaaacaaagaagaagcgtgagtacctccattttcctcaacacatcttccagactcccaacctgcaaaacaaaaagattagttccatggtgaagataagaaaactcttaacaaaaccaatgctgtgaaattactttatatattgatctctgatatgcaactttgataacgataaaccttggaattcattttaactcagatatatgaaggcatgtacaatctgaattccgctctttctaaagttttctaagacttttccctttccctcgctgttcctttgaaaacatggtgttatatgtttgcagaacatgtaatcacaaaaaatgctagaaattacatatgatgccaacacagctactagctactcccacttgttagtaaaccatgtctttagatcaaggtgtttgtttctatcttacgtggcctatcgaagattcaaatacatagaaggtaggtatgaatcattaccataatttgttgatctcctcttgatgctctcgtatatttagaaagttccctctctatatcttcctgaaagtggtcacgcagaacaggaaagtaagagttatcttcctctgttttggcttatgagagatctattagtattctttaacgtgggagaagaaactaaccaaccttactgaaatatacagggcagtaacgtctattttttttcctcacaacaagaagctcagactgtagaggccaataacaacagatagatatcaagagaaaacaaagcaaaaacaccaaaacataaggaatccatattggtataatagaaaaacacagaaaatgagtatatcaatttacctgaaaaaccggaactccatcaaacccattcttatttcctgaggatttgagctgagacgcaagaaaatatagcttatggataagattgaaatgccaaataaatgctatagacacatataattaaaagtctgtttagcatgagccaacctctaacgcattctttatttggattggatctggcaagaagcgaaaggaaatcccttcaacttttagcaagtacacctgtaaacaacatcatcttaacttctgggaatgtagctaccacgattacgcaaataacatcaaaaagttccctaaacgtagttataacttataagttccaagccattagagggattataatcatgccatcgttgcattctttcttgtgacgatgttgtcaacattgctacgtgcacaagaacacaatctcccgttcattcaaactgccaacaggtgttcctattaccgtataatataaacaactaaaatgaggccagacatgaacaagtctacttagaatttgagctcctgaaatttgtttgtttcatttgatttaaccaatggcttcttccacattgatctaatgcagtgatcataaggaaagggaactacctggtccagagtaatgggaacaaccttcgcattggttttcaattctcttctccgaagtcgcgcctaaaggagtatattagagaattatgagctcagaaacttcacatttttttaaaaaagttcggaggagaaaaatacaacaaaaagcgaaacctgagcaagaaaagcttcagcatcctcttgtcgaaaacagagcaaaccgatagacttgcctccggtaggatccgagataagaacgaattcgttattggtgttactgactgtaaacaccgacgtcccagcgagagctttagcgacaagagatggactcaacgtcgtcgtcggggttccagacttggattgtgagacggaggcgaaaggcggcggagtaggaagagagaaacgtcgagtagctagggtttcggcgaatcgtttcgtgtcttcgattcgggcggagaggtcggagctgaagcgggtacactggtggtgaatgaaagaagagaaggagaggaaaggattgggtttcactgatgactccatttttggatttgcagagagaagaaagaagtagaagaagaagaagcaatttttgatactatgaagagagtgaagaaaaaggcttcagagcaattcgtttgggcttttttatttgggctttattggacttgattggttttagtttacgtttaatatggcccttgatcaaaagtttggtgacaaagcatttattaactttctaaactcaacttccacaccattctaaacacatgacatgacttacaaaaagcttttgtcactcaaaattcatgtcgatgacatttttttcctccaaatttctcctccttataaaatacttactagatcaagcaaacaacacactaaagaaaacaaaattgttaaaactctcgttaactgaaaaat

SEQ ID NO: 3282 - DNA, 3000 bp, Unknown; identical to SEQ ID NO: 3273
  misc_feature (1)..( 3000): cDNA_ID_2049665_gDNA_ID_1620636_Annot_ID_162896 3000 nt of promoter + ATG

SEQ ID NO: 3283 - DNA, 3000 bp, Unknown; identical to SEQ ID NO: 3271
  misc_feature (1)..( 3000): cDNA_ID_3092962_gDNA_ID_1620636_Annot_ID_162893 3000 nt of promoter + ATG

SEQ ID NO: 3284 - DNA, 3000 bp, Unknown
  misc_feature (1)..( 3000): cDNA_ID_1822589_gDNA_ID_1620636_Annot_ID_162892 3000 nt of promoter + ATG
gcttttatgcagtttgagcctgagcgcatgaacactcatatcgtggctcgaatcttggtcaaggctcttatggctatgccaactccagacttcagcctttgcctcttcttgattcccgaaagagtggtattcttctttcctcttaacttcacaatgttttgctttcttacatatatagcttatcgtagatacagaagaaacgattgttcaaatgtttctgactcaagttattatgccattccaagttatttctgtcagttcagtctgtgtactgagcattcatgataaagtgtgagtttcaatgtgttggattcttgaggactaataaatgtacttgtttggattgtgtgtttcagcaaatggaggagcagttcaagtcactaattgttctatcacactaccttgaggtacgcaaacatcagtattagttagttgagagttgaaaaggtgtgcattgagtatttaaagcacttgtttttcttttgcagactgggaggttccaacagttctgggatgaagctgccaagaaccgtcacattctcgaggctgttccaggtaactaacttctgaatcataaataaatcgtctactaataacaaatttctagatgtagatttgttacttaaggatatttgtgtgtagatgtcttatggtacgaacaaagtcctcagtagtggtttatggtactgtctattcattttatgattgtgtctagtgtagatgtcttatatgcgagagattaaatgcaggttttgagcaagctattcaagcatatgcaagtcaccttcttagcttaagctaccaaaaggttccaagatcagtgctggctgaggtatgatgtttggtttatgatctcgttttcaccacggatagcttaagtcatcaaaatagtagaacttcggatgtgaaatcttttactttctcatataattttctgttacgaatattccacatcatagttctggaaatctaatttgttgaccttttatttgtcaataaatgacaattttcacaggctgttaacatggatggtgcatctctagacaaattcatcgagcagcaagtgactaacagtggatggattgttgagaaagagggtggaagtattgtcttaccacaaaatgaatttaaccatccggagctcaagaaaaatacaggtgagaatgttcccttggaacacattgcccgcatcttccccatccttggttgaaccaattcatgagaacactgcaaattttccttttgtctcttgttatcttgtgatgtacacttttaagacaccgtaatgtgaattttggcaatggccttcctctttgcaatttgacagattttcttaaaaatctagtagaccgagactttgccataattagtagatcttcatagtctgagctctgcttcttacctttttttttaccttccatggattccaatactggtttctcaacaagtgttggaattggctcgtttctgattgattatcttctgtttacttcattacatctaaataaactaaacgaatcttcagacaacccaaacaattgtcttctttaaaaagcaaaggaaaaaaaaaacttttgtttaggtttcttggaatatagaaactgacacggcaaatttgtattgagaaagtttgaaatacaaagagactgtctatgtcttgtcgtcctctctacacagatcacatacgaagattgacagccatccatttggaagctcacatgttgacaccaaatcatgtcacgtgcacaattttctcttttcccatgcatattttgactgctccctatgtgataaatttgactgattaaactataattagttagatcatctcgtatctaagatgattgcttaaaacaatactattattctactaacaactaggttattcccaagatcataacttttgattttgatgtaactagttttgtaattttgtacatatatgagacttttttgaattgcttaacagaataaataattgaattttatgaatataatatataaattttcaatttgatcgacaacaatgaacggtgttttatttataattgtttttttgacaatcatgaacctaatgatttgttttttctattttatttagtcgacataatgaagactaatgaagatacaatatgtgattgaagtgaacaagttagatttaattaagatacgtggaggatataaagaagggtgataaatacgtgaataaaaagtgaaataaacaaaggcaaacgatcagacagacaagtcgtgaacataaaaacgggagagacaggaaaaacaaaagaaagccagacgagcaccaaaaaagaaactgcaaatcttcgtttatgtaaatcttcttaccgtctctctcttgtatttcttcaatttcaaaggtggcttttttttctttctttgttgggtattaatctgagagaaattgaggaaaactgttttcccctttctatgttctcagcttggcacttttctttgagattatggttaattggttcccttttggaaattgatttcaaatcttatccagaagaaatttggtgccttctgtttttaaacaaattttctagagtttccgtgtttaatttttgtttcttattttgttttctattaaaaaattcgtttcttgctcgtgttagttttcgcatttggagtttcctgacagcgagagttgctcgttttctggggtcacaacagaagaattcgagcttggaagattgaaatttgagatcttttgatcttgaatcaagcataaattctggattttgaagtttgagagtgacccagtgactttggtctgaatctcggaggtatcttattccaggtaaaatccattaacatctctctctctctctctcaagctcctttcttcttttaagagaagtttatgttgattttcgtggttaccattcatcttcagggatcaaggattagacttaatgcgattaagcaaatgggtttttcacgatgactctccttgttgttggggagattcaataaatg

SEQ ID NO: 3285 - DNA, 3000 bp, Unknown
  misc_feature (1)..( 3000): cDNA_ID_2147485_gDNA_ID_1620636_Annot_ID_162923 3000 nt of promoter + ATG
aatgctacgagaagaaaatattaccataagcgtttccaatcgcgaagatatttgaggtagagcagacaacgatcagacacaccaccagaagggaccagttaagaaccggtatataaatctgtccaatgaatttctttgaggtgtgaatgattttaagacgtgggaaacagcctagtgctattgactgtttgatgcatgtaaatgtggctgttgtcattgcacgactggcaattaaagcagcaacattagaaatgagaaagactggccagaacaaagaacctgaaaataaaaaagagtgataaacagttagaaacgtgaaatgagaggtaaaatcaagccagcaaatgaaggaatacccttgttgatcttgacgtactgtggaagctagtggatcttacttggaactgacgaaaagaaagcatccccggcagcgctgaagttttcagagaggtatgcggcttgacccaaataacccagcaagaggcaaggtaacaccagaaggataaaagtaagctgcagataaacaccagtactgaatcaaaagttcagatgactctaagaaagacaactatcagaagagcaataaatgagtatttatctccttaaagtacctggatagagtgaacagagaaatagctaagatctgcaaacatggcctccgatcctgagacaagatccacatgtatagaaatgagcaatgacatttagtcaaaaagtcattcaatgtatttaagctttctaaaatatttcccagaatatgaaacttaccagttgcacataaaacgcaacccccaagtgcataccaagcatttacagagtttctcttgaaaaagaaatagatatatgcaggattgaacgctttaaaaacgctgctgtcatattttacgaggttgtaaattccaatgcccgctagacaaaaaaaccacagaagtaaagcaggacccaaaacaagccccaatttgctggttccatatttttgtacactgaacaagatcacaagaaagctgactgatatcacgaccacctgatctgcaaatgaagccatagtcagaaactttacacaaaaaatagtcactaatcactcatcaagataagattatgttttttgaaagctttgtacaatcattagcccctattcagggggcagaagagtttaccctcttctttgttgtatctataatctaattgaagtcaagggacccaggatgcaaccattaaagacccataaaaagttttctggtccaaggaatacatatatccaaggaacgattacaagttttgaaagccagacgaaatcatgctcgtgaccatacataggcgctaataaacgtcaactagaattagttaccttgttctataacaccaactccaaccttcagaccaccgatagcagacattactgtgtccaaaaaagagggtaaaatttagctgcagattattcatgcaacgataatgctcacatgctttttctctatacttgatatgtgacataggaacaaaaaatgtagcctgacagcatataagtacctgacattgctggcgtaacaacagcatcagcaatcaccatagcagtgccggcaagaactaaaatcagaagaagctttttcaaggccattgacgcctcaagtctttctttaattatcaatgatctttcaagttctggagacggaaccttcaaaccaaagcctgatatgcgagcatctgatggaagttgatttgggataaggctaacatttgcatgccggcagatcaacgaatacaaagcaaacgtcccacctgcaattcatttccaaaacttaaacctttaaaccttaaatgaacttcaatctacaccatataaagaggaagagatataccttcgccatcgtcattggcccaaagaacaaaatgtacatactttacaagaggaatcaatattaaagtgtatataaccaatgacaaggctccaataatatcttctttgtcgttaattggagatcttctgaacatgacagtgaaggtatacaatgggctagttccaatatcaccaaatacaaccccaagtgtctgcaaagcaagtatgagtttctttcctataccagtgtcctgaaaaaacacattaccaagttcaacaactcaatcagatcgaaaagtaaacaacatgaagaagaagaagaacattcacacacaaatgctaacctcgatttcgtttttctgagttccaggaatctcaagagcatctacatcgaaagagtcaacggcagggctagtgcgaatcaaacgctgctccacattgtcatcctcctcatcggaatccatttccgggtgattatgctcatcatatccatcatcgtcgtaatcttcattaacctcataatcatctttctcatcgaacacccatcgcgacaatgacgtcgttgaatcgtctccgccaaactcctcatcaatctcagacccatcgcctccactgctttcttcttccacgtgaaacatcaatcaccgttggaaaacactgaagatctcgagattgtgattcagattcgtatctctgatccaaggaaacaggattggaattggtgtttttgagagattgagagatggaagagagagattgatctacatacactggagaggacctggcacgaatgagaaagaagcttacacgtgtccaatcatgattggattcgagactcacggtttaaggaaaaacaaaccagaccaaattaggcttaaccgctaaaaaaccgggttctcgttttgaaagattgagagagacgatctacaaaggaggacaggacccggcacgaatgagaagaagcttacacgtgtccaatcaggattgaacgatttaatcaagcttaaccgtatgtaaaccggattttagctgggtccacaagtagtcaaatatagattttttaatagtcaaataattttcataggggcgaagttcaagatgagttactacactcatcaaagctcacaaaaagagaagagaagagacgaggatcaatcaccattctc

SEQ ID NO: 3286 - DNA, 3000 bp, Unknown
  misc_feature (1)..( 3000): cDNA_ID_1820105_gDNA_ID_1620636_Annot_ID_162921 3000 nt of promoter + ATG
aggaaacacgaagacttacgagtgctggacacgagatcgaacttctctggagcagaattctccggtggagaagaagaggaagctgaagactttgaaggtgaaatggaattagccaactgtagctgagaggacaatcggaactcaggaacggaatatctgattccaccgggaaatctccatgaacggtgaagagaacaagggaagatgagaaaaggaggagcttgaagagaaagaatcaaatgatcggccataacttaaacattgaagtctgtaacaaagagtgtcacagaaatggtttagagtagacgaagaagatgataattgggtgacgttacaaccggtggtaaccctctgtttctatcagatgtgttcgcttcacagatattttgtggctaccgtttttttttcataattgggctataaaaatcatatctttttgactcttctcttctctatccattctctgccgaactagtcgtcaatcgaaatcccaaagatcagcgatggtgactctaaacgcttcttctcctctcacgaccaagtcgttcctcccctaccgtcacgctcctcgccgtccaatctctttctcccctgtcttcgccgttcattcgactgaccccaagaaatctacccaatcagcctccgcttcggttaaatggagtctagagagttggaagtcgaagaaagctttgcaattgccggattatcctgatcagaaggatgttgattcggttctacagacgctttcttcttttcctcctatagttttcgctggtgaggctaggaaactagaggataagcttggtcaagcggctatgggtcaagcctttatgcttcaaggtggtgattgtgctgagagtttcaaggaatttaacgctaataacattagagacacctttagggttcttcttcagatgggtgttgttctcatgttcggtggccagttaccagttatcaaggtcgattctttacctggagatttttctgtgtgatgaatctctagttagggatagtttatgattttgtgggttttaagttttcaggtgggaagaatggctggtcagtttgcgaagccgagatcagacccatttgaggagaaagatggtgtgaagctgccgagttacagaggagataacataaatggtgatgcttttgatgagaaatcgaggattcctgatcctcataggatggttagagcgtacacacagtctgtggctacgttgaatctcttgagagcatttgctactggaggttatgcagctatgcagagagttagccagtggaaccttgatttcacgcaacatagtgaacagggtgacaggtttataaacttctctccttgtttataatcttgtttgttatgatgttaaccaattgagaatacacttttcttaagtcagaaacggtttcttatttcttgatgttgttgtgacaaaacaggtaccgtgaattggctaatagagttgatgaggctttgggattcatgggtgcagctggacttactagtgctcacccgatcatgactactactgagttttggacatcccatgagtgtttgttattgccttatgagcaagcactcacaagagaggattcaacatctggactttactatgattgctctgcgcacatgctttgggttggagaacgaactcgccaacttgatggtgctcatgttgagtttctgaggggaatcgctaaccccctcggaatcaaggtatgtgatcatcaagtctcttggtttggttaattggaataggagtaagtttcatagctttgttcgtatagaaaaaaacactgagatgtagactcaagaactgttgttaactctataggataccctgcaggtctcaattgcctggtattaaagatattggaaaaccattacaaagaggctacaacagatttttgtatgagaaaatgacagatgttgattgatgtactttgatgcaggtgagtgataaaatggtccctagtgaactggttaagctgatagagatactaaaccctcagaacaagcctggaaggattacggttatagtgagaatgggagctgagaatatgcgggtcaagcttcctaatttgatcagagcagtccgtggagccggtcagattgtgacttgggttagtgatccaatgcacggaaacacaatcatggctcctggtgggctaaaaactcgttctttcgatgcaatcagggtaatcattcgaacttacttcttcatccaactctatgcataatcttgcttatgattcatgtagttacccattaaattatatggtgtatcaggcggaattgagagcgttcttcgacgtccatgatcaagaagggagtttccctggcggggttcatttagaaatgactggtcaaaacgtgacagaatgtgtcggagggtcacgcaccatcacttacaacgatctaagctcacgctaccacactcactgtgacccaagactcaacgcatctcagtctctggagcttgcattcatcattgcagagcgtctgcgaaagagaaggcttggttccgggaatcttccgtcatctattggagtctagagaacaagaaaatacttatccgagctaggatgtgtgtgtatagaggctgatctctacttattaagttgccaagttaaatgagcttgtgtactgttaaaagtaagatattgttgtttttgtgtgttgggttatgattttgtctgaaataagtggctgactttataaacccgtaaatctctacgtcacgcttgcaacaaaaattcgatatttgattcaatcacagaaaagtcctcccattaaggtgtaaatttttgactcaaataccacaaagcataaaccttttgacaaaccaaaagttgtatgaagaaaattggaaaactctgaatgccatttccacacgtggacactattcgtttagagaacacttaaacaaacgcaggaggcctggaaaaaagaaagataacgggactcgagagattgagattacggagccacccactttc

SEQ ID NO: 3287 - DNA, 3000 bp, Unknown
  misc_feature (1)..( 3000): cDNA_ID_1842843_gDNA_ID_1620636_Annot_ID_162920 3000 nt of promoter + ATG
aattctgcaatactgtgccatccctaatgaccatgaatcccgaatctccaatattggctatgtggagttcctacaaagtaattttacatgatcacagactgactctatctcaaaaggatttccaatgcaatatatatgttagggaccaagtctcacattattgtcaagatgagcaattaaggctgttgatgatccagaggacttagtctcattgacacttctatggagaacttgaactgggtcacttatcttagcagtttcattggaaataatcttttcacagttgctcatgagttcttgagcatacattcccttattgattcctgaaagatgaatcaaacatatattcggcaaggccaaatacaagtgactgagtttctgcaagaatttggaaaactatgtgaaaatacttatatacagtatttaccttcaaatgaccactgagagactccatcagcaatacctatccaattgtggtgagagataaaataagcatcttcccgacctgccaatgcctggacatcattatttctaaattactaaccacataacataagtatagggatttaaaattcaaaaattgtcagaatgttaaaaatgatgtttttgaggtggttggaaatgagaacaagatatgaaagatcttgagatatagagtgttaataattaatatttcaacaactgtctcttatttttgtgtatactaaacagaaagaattacaggtaccttaaaggggctttggagtgaagcaaaaccagagtccaagtaaaatgctttggacacaagttcttccctgtttagatgtcaaacatccaaccatagcaaaacaatcatgcttttataaaagctgcaatatgattcctagccctgtatgaaaatatgaatagatacatacatatatgcatgtagctgtatctgtgcaagacaatagtacagtttgtctaagaagagttaaatatatcacttactaacctgccagaagccgctttaatgggttcaagactggccgtttcaggtacaggaagttggagatcttccacttttgtgtcatcattattggatatgctaccactatcagttattgtgtccctcacagttatttcatcttctgtggttgaagctacattttctccatcattttccttcatgaatgataagtaattagagtggtggcactaattctgttcaacaacactctctgatgtctctttccttctacacctgttaaaactacttaatggtttagagttagtactcaccacatcagacgtaacaactacaagcttttcagtgctctcgtcaacgctactatgcactgcttctggttcaacaaaagtttccatagggtttttctcagacgtatcaataataggcttttgagcgatctcatcaacgctgtgacgtgttgcttctgaagttgaaatgagttcatcagaagagacagcagctgtagctgttggttcaactacaggattctcctcagcttcaaaagtgttcagaaggttttcctcagacgtatcaattacaggtttttgagcaatctcatcaacgctgcgatgtgttgcttctgaagttgaaaggagttcatcaggagacaaatcatctgtagctgttggttccgcgacaagattctcctcagcttcaataggcttttccgtcacatccaaattgtcatcaatttcaatggtggatacaggcgtaatttcctgttgtgtagacaatgacggtcttgcctgaacctccatacgattctcttgataaccatttgtctcacagtctcctattttattgacagaaactttcttcatggcttcagaagaaagaggctctacattatatgacttagccgtgatttccttctcaacaacagcttcttcttcagtagagctaattggaatagcttctgctacactaactatggagctcagattggaaacactagcactcttggcatcaattttatcttcgctccgtgatacattcacagtttctttcttcttcttagtaggagaacgaacccttttacgatcctttattttaatgacattgctaagatcggaaggagcagctgtttcctctttctcagtacttgtttcaataatagaactgaccaatttcttttgtttccttgaaacttcactggcttcttcagcaatcttagcattttgcgtttctacctcaacacatctcgctttttcttcagcctcgagatatttctcaatctcacttgcatccccgaaccgaaagacatgacttccatctttaagctctgcaagatccaaacaactatcaatataagagtatagctcagatttcaaagtaaataacttttctattcttaaacttgaaactaaaaaatattttaggttttgatacttgaatccgaagtaaaattggttacaacctagtaattgagtgttcagacacttcaaaaattagggaaaaaactaaaattcaaaacttctccggtgaaggaagataaaacaaaagaagaagaggaaacacgaagacttacgagtgctggacacgagatcgaacttctctggagcagaattctccggtggagaagaagaggaagctgaagactttgaaggtgaaatggaattagccaactgtagctgagaggacaatcggaactcaggaacggaatatctgattccaccgggaaatctccatgaacggtgaagagaacaagggaagatgagaaaaggaggagcttgaagagaaagaatcaaatgatcggccataacttaaacattgaagtctgtaacaaagagtgtcacagaaatggtttagagtagacgaagaagatgataattgggtgacgttacaaccggtggtaaccctctgtttctatcagatgtgttcgcttcacagatattttgtggctaccgtttttttttcataattgggctataaaaatcatatctttttgactcttctcttctctatccattctctgccgaactagtcgtcaatcgaaatcccaaagatcagcg

SEQ ID NO: 3288 - DNA, 3000 bp, Unknown
  misc_feature (1)..( 3000): cDNA_ID_1023835_gDNA_ID_1620636_Annot_ID_162918 3000 nt of promoter + ATG
cttaattgctcatcttgacaataatgtgagacttggtccctaacatatatattgcattggaaatccttttgagatagagtcagtctgtgatcatgtaaaattactttgtaggaactccacatagccaatattggagattcgggattcatggtcattagggatggcacagtattgcagaattcgtctccaatgtttcatcatttttgttttcccttgcatattacgcaaggctgtgatgtcctaaaacttgcagaggtacgatgtcgttacttaagcaagaaatctttattttcaagtaacagacactcttgaatggttcatctacaccagaatatgtgcaacataagtggtcttgctttacacaatttgcaggtttaccatgtgaacctggaagaaggcgatgttgtcatcgcagcaactgatgggctctttgataacttatacgaaaaagaaatcgtttcaatagtttgcgggtcactgaaacagagtctggaacctcaggtgctcaatggtcttgaattatctcctctttttggttgaacaagtagtttcggcgggtgttagttgtgtacgagtcacttagctctcgttttcaaatggttttgagatgaaatgtgctgttatcaatgtgttggggatatatgagtttgattaatgtttgtgcggtgtaacagaaaatagcagagttggtagctgcaaaagcacaagaagtaggacgatctaagacagagagaacgccatttgctgacgcagctaaagaagaaggatacaatggacacaaaggtggtaaacttgatgctgttaccgtcatcatttcattcgtgaaaattgtctctacataaatatgcatcttcctattaattgtaaataatggagagagccgcacacattcacaacaccattctagtttttccaaaaatttcattgaaacgatgtacactggagtaagtttgcattcctgagctatatatgtgagccggatcagtcctggatctgacccgatatccagtttccgacccaaacctagtaaacacagtacaatattactcaacccttgtgacttgctctaaggccttctcagacaaaacaaaaaaaaggatgaagctttttcttagaaatgcttttaaaaccttaaaccctaagagaaaactagcgacgacgattcttccttcaatcaatttaattctcgttaaacccttctctcaatccaccaccattcccaaaaaacaggatcgagttcgtgaccatggctacgacaattacatggaagtggagaaaaaaatccgcaaagtcgtcaaatttcacagcttgattctctctcaacccaaccacacaatcgcaatctctcttctagacacgctcgctcgtcgtctaggtctcggcttcaagcaacacgaaccaggtgcttttctcctcaagttcccacacgtgtttgagatatacgagcacccagttcaaagaatcctctattgtcgattaacccgtaaagctttggatcaaatccgtcacgaacacgaagctgttctcgaccaaatacccgacgccgtgacccggttgaggaaactcgttatgatgtcgaatacgggtcggatccgtcttgaacatgtcaggattgctcggactgagtttggactccctgaagatttcgagtactctgtgattctgaaacatccacagttctttagactcattgatggtgaagagactcgagataagtacattgagattgtggaaaaggatcctaatttatcgatttgtgcaatagagagagttagagagattgagtatagaacaaaaggaattgatgcagaggatgttcgattctcattcgttgtgaattttcctcctggatttaagattggaaagtattttcgaattgctgtttggaaatggcagaggcttccttattggtcaccgtatgaggatatatcgggttacgatttgagatcgatggaagcgcagaatcgattagagaagagatctgttgcttgtattcatgaattgctgtctttgactgtggagaagaagatcacgcttgagagaattgctcattttaggaatgtgatgaatttgcctaagaaattgaaagagtttcttttgcaacatcaggggatattttacatatcgactcgaggaaattacgggaagcttcatacggtgtttcttagagaggggtataagagaggggaattggtagaaccgaatgatgtttatttagctaggaggagattagctgagcttgttttgatgagtcctagaaaggctaaggttgatgcagagttggttcgctacagagatggattggatgatgaagatgatgtcgaatgaacatacgattttcttgaccgttgtttcatctacactctcattctctgcgcatcactgtaagatctttatgtctctgtatctttcctctggtttgttaatagccaaatgaagatgcttttgagctttgaaatttatcgttttcttctgtaatggcagatttgtatccagaaagctagaagtggactgatgatgatgatgatgatgacgaagaatcgaagattgtgaaaaggtgcttattcacttggatggattaatgattgtgaatctcactcattgttctgaatcaatttgaatcgaagaagatgcctgcaagattgcttacttcagctgcaagatatactttggctctaccctttctcatcagcaatattccttaactcgattcttgattttcgcagatactaagaaacaacctggaatattttttgctcaagtcccctatggtttaagccaagaatccttattacctgtctacatattgcaaaccaaatttaaaaaggtttctttgcttatgcatcaacaaaaagacaattctttgtaataaatatcttcaattcgtaaatgtcttggcctttgtcgttttcaaacttcaacatcagcatcacgtgattggctaatacaaataaaattttctctttattttattattttgccacaagccgtgaaaagatg

SEQ ID NO: 3289 - DNA, 3000 bp, Unknown
  misc_feature (1)..( 3000): cDNA_ID_3092933_gDNA_ID_1620636_Annot_ID_162916 3000 nt of promoter + ATG
cccatcaatttctcaacccgtcttcttcgtttcccgtctcgttatcagtctcatctccgaagaatacccgccatcttcgtctcctcatcacctccgctttgaatccacagacgggacagccgacgaagaaggcctccaccggtagtgataagagtagtacgaacaagaaacgtaagaaaaaggggaaaattgcgaaacctgtggaggattgggaattgagagattcagaagacgcttttgaggaagatgatgatgccgattattcttcttcttcgagttctctagcaacttttaactctcctcctaccatacccaaaccacctgctgggtttgtgattaatgaaactggtagggttcttatggcctctaagaagcgtatcaccactgtggtgagtctaaagtgtcacttttttcatgaacattataagttttggtgtttgggaaaaagagaatctaaaaatgtttgtgttgtgagacagattgatccaacaaacaatagccctttggattgtgtgataagaagagtatttacaagtagtaaaggagaggattgtatgcttctttgccctgtggatacgtaagtactgtttttcttcttctcttaccattttagcaacttcttcttttccgtttgattgattaatttcttgcttcaggccagttcagattttgaagagcacaaatattgatggatggtcagctgtaagttttatccttaatgaatctttcttcatgtgtttcttcaagactgcacatctcctgatgtagagagaccttctggatgcatgacactatgcttttgagaactcgaatattaattaattgtagaatagtcagtttctagatgaaagttgcttcgatcaggacctgtcttttgcttatctaggatcgttctgccttttaggtcagtgatgaagaggtcgaatctcttcttcctgctgctgcttatgctcttgcaaagatccatatgcatctagtacacagcgggtatgaccgtgccctgtttcaagcatgacatcatttattatcctatgtctcttctttgtgtctgataccatctaatgggttatcactgtaaatcaggttctgttacactgcaaggggaggcttttgctacacggaagataatgtctttgattttcgcacaggcaacacccttttcttctgatttttacgcatgacgaaaatacttctgattaatgtttttgtggcgtctgctctatatgagcacactaaatgattttggcttcatatacggtggatatattttatcatgattttatatttatgtgtcaaatttcaatctcatggtcatgtgtacttgcaattgcatcttagtaaaattatgtggttatcttcattcttccttatgtttagttctctcgatctgcttcgttctaactgttaggtgttttgacgggtctgctcatatgcttatagtttaaattatgtgtcctactttttcatattactaaatgtttcgagcatcaactatttgcagatgatggccaagatgttgaaggcttgccaactgaaggggttgagattacgtgtttccatctggtatactattgcttttggcattttgcttattgatatgtttgaggcgctttatatagtattttgaacaatcttttgagatatcactattatagcatacttttaaacactaaacctgtcattcaatttatctctgaaccaagtttgtatttgccattgtggatccaaagttcaccactgcaatctggttgtgaaaacagactggttgtgaattttattgtttgaattctgtagaacatgaaacctttgaggtatgatgtggcccctttttcctcgtctaaatataaattctgattcaggatggatcacactatatggtctacacaccttcagatccacttctctttgttgctgctaaggtaagcttgttatctttagttgtttattgtgaaagttttgccgagctgtagcagttttcagatgttacttttatagaagaaatatggaaccttaggactactgtagaataaaaacagagtgatgaatggcaattttatctatgcaggatcaaaatgggctgctgcaaatcgctgatgatgtaagtcgaacctcaattatgtactttttctcctctgcaatttggttgggttataaaaaggttttgagcaaaagttacaccaccagacttggaaaatctgtgaattcatccaaagaagagacttttggaatttgatccaagtagatttgtgataggtcttggcggacaaactaatgatgtttagtagacaatatagagttaagggaaacacaacttggtgattattggttctctgttttttagaagagaggagtgcttataatcctaaataagatttgtgtgtgatggtcaatatgaatgaagtaagctcaccactcgaatgttaatgggtggttgcaggaactcttagacgatccagctgtgatcagcgccatagacgaggaaaccgaattcaatgccttggtggtacgtagagaattcaacaaacttttaagttaagaggtatttaataaaatgatattgaacgtggtaagtaatgtttgtgcaggaggaagaggcggctctcctggaatcactgcttggggaaagaatttgatgttttcatagggactacttagctttctttttgtattccataattgcaatgccatgtaatctaaattttctcttagaaaaactcattttgcctttccaaatctctcttgttgacaattgggttcgatcattaccgaaacagaagtccctccaaatgaccatgcacctacttgtaaaccgaaggattcttttcagttttcactaatacatcaataatatatgttatgcgtgctcagctcttgtgggagtaggaccgtagaaagcctatccatttaacaaagaatatcaaacaaagtcttgtttttcttttaatctttttttttatggctgccttcagtagtaacctctgagcttgagggaaactcatg

SEQ ID NO: 3290 - DNA, 3000 bp, Unknown
  misc_feature (1)..( 3000): cDNA_ID_2049619_gDNA_ID_1620636_Annot_ID_162915 3000 nt of promoter + ATG
tagaaacatatgcaagaaaaatcaatggaggaagtatcttctgaaacccagtggatcatccattaattgctcatttagtacagagaagaatcctctattaccatctatccagcagttagccgatgctcgtctcatatacagtgtatctgcagcattgggtcataacaaggtttttacttgctatattttgttgtttctgtccctctcaatccttttttcacattcatttaagcaatcttttactcgcaggaatcacatccagaatgcagcgctagagttcctgccattgttaatgctctcgagatgaatgagctcactcctaaggtatgaaacaatccatctctatcgtttctatctgacattcttctatattatgcacatgtagctagggaagtttggttaaccgtgatttacaatatttaaggcaaatctcaagtggatggagaccaacataatgcttgtgtaaagttacattagctgaaattttgtacttttctggagttagttagatagacttgcacatttcttctcaaacaagtagattcttttcgaaatatgtttgatgtatttataggtctgcttttgttgtatacaccattcttccttttgttggtttgcttcttcgatggtgaagatctctgtcactatttactgaaaatgacctacgtcttctatcaatgaattctcatatgtgaatcttttttccttgtgtatttcagttccgtggctcacagattcttgaactcgcaaatttcaagactgcaactgtagaagacattgcaaatgttcacgacaaggcttatgtctttggcctagaaaaggttattaactttactcatgttatattattagcatttactcacaactttttatttcataaccaatacattgacacatatagcaaagcaagtaggattgaaaaatgaggatgtacggtacgatttttattctgaccattacaaagacattcttagtgtaggcaatggatgaggcttcagattcgggactaattttcattgaaggctctggaccaacatatgccacttcaacggtaactgctttgtgctcatccggtaacatctccaaaggaaccattttacctacctaaacatcttccctctgtgccagacattccaagattcacttatcgcagcaggagccggaatggctttagttgattcagtggtgatgtctcgtctcaccatgttagtctgcttttactgcttcagtttcattatgttgggaatggttgtagatttcttatatgattatttgtttcagatcgcagcatccagaaacagcgtagatccacccattggttttgcattgataagacctcctgggcaccacgccgtgccaaaaggtccgatggggttctgtgtttttggtaatgtggcaatcgcagctcgtcatgcccaacgcacacatggtctgaagcgcatcttcataattgacttcgatgttcaccacgggaatggcacaaatgatgcatttactgaggaccctgatatattctttttgtcaactcatcaggtaagcctctaacatttttgcgtgacatgtttctaattagttcattgacaaatgatccataccttgtatttcaaaatcattgactaaataacacatgaatgttcaactaaagtgttaagatcattgattgaataacgcatagttaggattagatttcagaaatcaacaaaagttatttattttctgaaaaatgcaggacggaagctaccctggaacagggaaaatcagtgacataggtaaaggaaaaggtgaaggtaccactctaaatttacctttgcctggaggttcaggtgatattgcaatgagaaccgtttttgaagaaatcattgttccatgtgctcaacggttcaagccagatattattcttgtttctgctgggtgagtgagtttataacgtttttcatctatttttgaactgaatatatcatcgtattcttacaaacacttctgcttcattgctttaatctgcttaaggtatgatgctcatgtcctggatccactagcaaatttacagttcacgaccgcaacatactactcattggcaaaagatataaagcggttagcaaaagaagtatgcggagggcggtgtgtgtttttcttggaaggaggatacaatcttgaatcactttcatcatctgtggcagactcgtttcgagcattgcttggagaagatagcttggcatcagagtttgataacccagcttacttgtacgatgaaccaatgagaaaggtgcgagatgcaattcagagagccaaaagcattcattgcttataaggtgaatttgtttgagaagttctgcatcttagtcgtcttaaactgcctgcctacttatgttttcttttgtaaaaatatcattgtaaacattgttgattagaaaattaaagttatgtaaacagaaatgattatggtttttgcttatatatttaaatcagggacagctatttctagtgacctatcaaatgagtccaaaacggatgaccgtcacacctaagttgttccacgtacttattcttgtatcattattaaaaagaaacgaaaatatctcatcacgccgaccaactccatttaataaaatactagaaagaataaaaatcgtgggaagaagtagtagaagaattatctcgttacgttatctatctgcagtcttcatgcaaatcgaaaaatcgcattcgcaatctcacaaactaatccgccacgtgcatggtcaccaccatccttcacacgccacgtgttcccaatccaccgccgtaatccgccccaccacgccacgttgcgtcatatatcttcttgtctctcacttacgtccccacatcgtacttataaaaacgttagatattttcgaagattcattacattcaataaaatccactctttcttcttatatatagaatcaatcaaaagactttgagagatattcatcaaaactttttgttttgtttttcaagctataaaatctgagagatatg

SEQ ID NO: 3291 - DNA, 3000 bp, Unknown
  misc_feature (1)..( 3000): cDNA_ID_2990410_gDNA_ID_1620636_Annot_ID_162910 3000 nt of promoter + ATG
taccgtcggtgttaggagcattcatcggagcaaggatggtcatatttctaataacaacattactgcaaaacaaaagttacagaggtcatcgaaccatgcatacttctaacacagtataaacgcaggaaagatagttgaaagtaataaagaacctgcaataaacaggatggattgtccagaaaggagaattgagcaaagtgaggttagagatgaggatattatgagagttcttgagttcaataagatggcctctcgtatgcaccaatgttctgttccaccataactcccaccacattttcccctgtccatcaattgtcccattttctcctgcagatttttattttagatgtgattagaattagaaactgattttactttgatcatcacagagaatctaagtacagacactgaaccaaggagaaaaataaacagaaaagccaagaagttgatggcgtacttggatactggattgaattctagaattataattgatgtcaaggtatcagaaacattcaagtagtattcttaacaaatcagagaaagcaggccaaattgttcaatgaaacccaacaattcatacaagctccagctaatgattgaacaaaaagcctactgttgatgaatgaaataacaaagtacctgtaatgacaacattagtgagattgtctccatgaatgaggctgatgtgtctaccaccaggtctctctctccctcttccataagaaggcaatggctctattatcggccattcgtctaggtcctatcaaaccataattccagacaaaaatatcaatattgtacttacaacgtaaaattaagaatgtaagaattaaaaaaaacagcgttccaaagtatctatataagtacagatgacttttgagtttacatcgacacatgaaaatgtgctcaaacactagcagacaaacttttaatcagaatcaaacttgacagcaaaaaaactcagtaataatttaatactaaattaggagacaacacaagtaatctgatagatctagttcgtacatgaacatgcttcagacaaaagttgtctatacatctaactcctttcttggaatatgatcatataaaaatggtttcttccacttgactttttttttgttacagctactatcgagacatcacaagaacattcattgaacaagtcaatccgaaattaacaagtgttaatacaaaattcatgcaaaacactgacttttgatatgcaaatccagatttcgcactactagagactatccccactcaaaaataacagcttttttgctgtatcaaacaatggtgggtccattttaaccactgaccgtgattagcgaaatgaatatagtgtttaccaacaaaactttatgaacccacaaatcaaaaagcaatcacaaacccaaattttggattctcacagagcaatcaacaactaattgaattctcttaatactactactgttcagaaccaatcaacaacaaacaaagcaaaaaaaaagtaaactttatcaatgtgttaaagaattcaaaactttgatataaccttggatcccaaaatgagagcgccgcgttcgagaaagagcgtgaaattgctggtgaggttgaagcttccagaaagccacgtgccctccgggacattgagctgggccccaccctccgccgcaaaaccttcaaggtgccttacggcgcggcggaaagcggccgtgttcgacgtctttccgtctccaacaccgccgaaatcggtaatcgacataacgatccggttagggaacgggtcgtgattgaaaaacccggagcaggtaacagggtcgtcatattgagaagtcgggatccagagagggagaaaagaattggaagagatttggagagagagaatcgctaagacggtgaaaacaaggagaagaaacgcccacgaaggtcttgtaatggcactcaatactgtggtcggattcttctccggttccattgttttttggaaacagagagaaaactcaaaagcccatgaagcaagctctgagataaaattacaaacagaagaatgctaaagtgggacttttagatggttggagagaattatgcatgtgtgtggcaatgattagcgtagtgtggtggtgacaacaaacaaaggtggaggaagatagaaagtcgatagataccttacctcgaaaattcgtctctctctttgattatttttgtatatataaatagaaaaaagtagtagtaaataagaaaattggatacagacacagatatgtcgtgaaaagggcactaaaatattggatggtgcatgtgaatcgtcaaaaagtggcaaggagaaagtgaaagtcttcacgaattatattttggtttatatataaaagaagaagaaagaagaagaaagaagaagaaagaagatggatgatacacaatcggtcacggactcacgggtaggaaggattgtgaggcgttacaatctcgtcagacttccaagtcttaatctgatgggcctttaaatagcctactgtactgagttgtttgttgtgtttttgttttgttttttaatgccaaactaaggtatatgtccgtattttattgctggcaacatatactctgtccgtttgtgttttttgttttttatttcatttttcctcaaaattacttttgttcttttaaaaatattaaatggcataaatagttaaactatcaaccagtaaattatatatgatacaataatgttttttgttttgtttaattcattggaccagatggattattcagcttacatttttcaatattgaattgtaattttttagagctataatctttaaaaaagaataaaaaaatcaaaaaagcttttgctcatctttggaataaacgaacttgctattaagaccaagcccaataaacaataaaagcccgaaaaaatagagctgggccggtaattaggattatgatgatggtatataactcactatcaactatcatgagttcatgaccatcatggtttatatctaatgtcatatgatg

SEQ ID NO: 3292 - DNA, 3000 bp, Unknown
  misc_feature (1)..( 3000): cDNA_ID_2049633_gDNA_ID_1620636_Annot_ID_162909 3000 nt of promoter + ATG
accgcgtttacagccatcgcctctgtttcttctctcttctattggttatcaccatatgcggtatatatgaagacgcagcttggtctatctgatccctttctttcacgctgctgctccaaatcgtttacaagaatccaaggattgctacttgtggcttgtgctatgacagttgtggcatggctcatctctggccattgggtgttgaacaatttgctcggaatctccatttgtattgcgtttgttagccatgttcgtcttcctaatatcaaaatctgtgcaatgctcctcgtgtgtctctttgtatatgacatattctgggttttcttctctgagagattctttggtgctaacgttatggtggccgtggcaacccagcaagcatcaaacccagttcacacagtggctaacagtttgaatcttcctggactgcaattgatcacaaagaaactggaactacctgttaaaattgtgtttcctcggaacctattgggcggtgtggtgcccggtgtgagtgcctcagatttcatgatgcttggtcttggtgacatggtacagactaatcccttctttgattttaagattggtatgtcgttatatgtgtactaactgtaagaaatgttctctctcagactatagtgacgaggagataaaaaaaacatgttgtattgattaactgttttgttgttccaggctatccctgcaatgcttttggctttggtcctctgctttgaccatcgaaaaactagagatgtggtgaatatttttgatctaaaatcttccaagggacacaaatacatttggtatgcacttcccggatatgccattggcttggtggcggctctagctgcaggtgtcttgacccactcacctcagccagctctactttatctggtaatattctcctcatgtgacttctttgttcctcttggtctaacatcaaaagtatatattctactacgtgtatttgtgcacaaccgatatcaacacttgattcaactgaaattttgttgatagaatctttgtagtctcaatccaatgattttaagagcttgatcagtgtgaagtatagtgagattatgatgtataatctgttttcgatgtggatatataggtaccatctacgttaggaccggtgatcttcatgtcatggcggagaaaggatcttgcggagctgtgggaaggacctgcattatctaatcccattgagaaatctcatgaaatagagatctgagtttattatatcaatcaagatgattcagaaatctaaaacatattacataaaacaaagacgcttagtaggaaaacatcagatcaagaattcttgtattcttaagttcccaaaaaaagaaaaaaaaaaaaaaaattggtcagaaagagagatgatgtcttatatccctcattttttttgcgttactcaaagggaggaaaaataaacaattaacaagttctttaattttttcttatgaatagagataccaatactaaaaaacgttggcttttgtaatgaagaagttttagtgataatataagttaaaattaaaagtgtgtaaccaattagtcttttttttttccgtcaaaaaaaagaaaaaaaaaaaaaagactaattggttacacacttttaattttaacatatattatcactaaaaccaattagtcaattacacaaatttagtaataatacatagggtctctaatatatattaagctttatataaactaatgaggaaatctgtaaaaatatacaaataagaatttccaaagtagatcctatgtaatttcgaagcgtattactgtgcataagacagtgttaaccaaaaaaaaaaaaaaacatttccgagatgaactgtgttttgtcctcaccggataagaaagtggaagaatgaaccactacaaagtccgcgtcgaaagcactcagttataaaagtaaaattgacatgcgattacattaaaaataccaaactcgcttgtccatttttattgatattgcttgctaatggaagccagctacatgtccgctttcttgtttgactttctttcttttctctttgagttctcttcaatattaatagatgcattttatgttttgcttcttctgagtagcatcgtgaatcaagtcgccattatcttattcagcactaatataattatatatagccagaatttctaaatttcaagaatgtagacaagttctagaaacgccgtccacagttccataaattctagctagttttctgtaatatttcacataacgattcatagacttttctgttcagacaaatatatactttgcaaaacagaacatcaagctcagtagctcacaaccaaaattctctgtccaaatttgaagtaacggaacctagtgtcttgctgggtttgagacttctcaatcaccatatagtcagaaatacctatgaataagattatcttgatgattttttaaaaaaagattttcttcgttaagcttttcttttgtaattagttataaaccttctcactttcaatgaaattcacattcatataagtttaaattttaaattaaaatattggtcagctatagactatagtaagtatattaaataataataacattttttgtggacaaagagaattcgggttttggggttttggcaaaggaaagaaatggtcatatgtggaacactacgtgccacttttcatgcaataacatgcaaatattaggtcagccactaggaatagaataagttgaatagttttttacgatgataagagtaagcgggaagccataatagaccactatcccaaaactttaatctgcttccaactcattatgggaccaactaatacaaaatgatatgtattccatgttccaaccactccaatacgaattacgaagcaagcgtgtctcagtgtctgagtgcgactgccttctctctatatataagagatatacatagtgaattaaacatcttaattatactgatctttatcatgttgactagatttaagaaacaaaataataag

SEQ ID NO: 3293 - DNA, 3000 bp, Unknown; identical to SEQ ID NO: 3278
  misc_feature (1)..( 3000): cDNA_ID_1820139_gDNA_ID_1620636_Annot_ID_47375 3000 nt of promoter + ATG

SEQ ID NO: 3294 - DNA, 3000 bp, Unknown; identical to SEQ ID NO: 3292
  misc_feature (1)..( 3000): cDNA_ID_2049633_gDNA_ID_1620636_Annot_ID_47377 3000 nt of promoter + ATG

SEQ ID NO: 3295 - DNA, 3000 bp, Unknown; identical to SEQ ID NO: 3291
  misc_feature (1)..( 3000): cDNA_ID_1820135_gDNA_ID_1620636_Annot_ID_47378 3000 nt of promoter + ATG

SEQ ID NO: 3296 - DNA, 3000 bp, Unknown
  misc_feature (1)..( 3000): cDNA_ID_1820131_gDNA_ID_1620636_Annot_ID_47379 3000 nt of promoter + ATG
tcacctgaattcggaactttgtgttgttccagtaaaattaagcgaacacaaggatagagttctgattccttttacgaaagctcataattaaaatagaccatattatacaacatcctagtctccaagagaacaccttttcatctagtaaaataacgtagcatctatttggcgacactactttctgactcctacaaatgtaacacgttgcacgaatagcttttacaggaagacaaacacgatcaaggaaactaaagacaataattaggctgcttattaaaaacgtattaaaagaagagagtagaatatggtgcatacaagaaacggagtttcttaagtcggccgagagttgatggaataggcccgcttaaattgttcaagtaaagatccaagctcaccaattccgtcagatttccaagctgttctgggattgtcccagtaatgttattgctataaagctccctgtcattaccattctttaatattaatttcaccataagatcggaaagatatataactaataatctatgataatgcaaaattatgcagttatttggaacattgtaacatttttaacatcccacatacaccaaaagttaaaagacggccttttaaagaaaagatgacttacaagtactgcaagtttggaagctgaccaagttgcattacgagctgtccagatagatttgcattcccaaggtcactgagcaaaaatgaagttcaagtaaattctcagtagatgcgaaaatccgaatcatcttggctagatatagaaagaaacttacacacgtgtaacactattgtcgctattgcaagtaacatgaaaccatgtacatggagtaacaagagtagcatcccaactttgaagcaccttattagggtcggctaaactgtttttcagtgcacttagagcatcacctacaattaaccaaagaagaagaaaaaatcaaactttgcaatcatcaagtgtcacgaggatacataatcactggaatcagtcgaaacagatgtaacccaaatataactcaagtcaatacagcaaaacaagtaacagataagttaaaaatgccttctttaggtgagaacaagctctcataagcctatactaatcaaaatactcaacaagggaaactaatttaattggaaagaatgaaaaattgaaagagaatgagagagaaaggggaaaccttcggcgttgcccgagactctgagaaccaaatccaaaacgagaatcaaccaaaagaagcaagggatcattaatcttcgttccattttatcctcaagagattaaaaacaaaccctagaactatccctcatcagagaaaatccatcattgttaaaacccctgataaaagggatctcgaatccttcgattaagctaccacccacacaaggtaataccaagatgatgaaattagaagcagaatacgagaaaagccctctcaacgcgtatccacccgttgacttaatttgaagagaaaatcaaaatacccaaatcgattaatcgcggaaaccaaaaaagcaaaaaaaaaagaaactgaagctagacttttccgattagaaggaacgccgagatcgctgaccgttgactacttaatgctgagaagagagaaaactgagatagagaaaacgaaaggaggaagaagatatttcctggaaatatactaaaaaagggtcgaaacaaagagagatgagagagaggagagaaaccaagttatcgccgagagcaaggaaggaagacgaattttaattattttctttgcttaaagaagggattttactgggttgagttgttgtactgtgaaaactatattaaaaaaatgacatttaagattgagaaaacgacaaagaggatgatgacgtggacgagcattttcaaagcttttttagagctagtcaaagtcaaagacgcacgacttcattccgaatcatgtttgttatgttcgcccaccttatcatcatccatcatatgacattagatataaaccatgatggtcatgaactcatgatagttgatagtgagttatataccatcatcataatcctaattaccggcccagctctattttttcgggcttttattgtttattgggcttggtcttaatagcaagttcgtttattccaaagatgagcaaaagcttttttgatttttttattcttttttaaagattatagctctaaaaaattacaattcaatattgaaaaatgtaagctgaataatccatctggtccaatgaattaaacaaaacaaaaaacattattgtatcatatataatttactggttgatagtttaactatttatgccatttaatatttttaaaagaacaaaagtaattttgaggaaaaatgaaataaaaaacaaaaaacacaaacggacagagtatatgttgccagcaataaaatacggacatataccttagtttggcattaaaaaacaaaacaaaaacacaacaaacaactcagtacagtaggctatttaaaggcccatcagattaagacttggaagtctgacgagattgtaacgcctcacaatccttcctacccgtgagtccgtgaccgattgtgtatcatccatcttctttcttcttctttcttcttctttcttcttcttttatatataaaccaaaatataattcgtgaagactttcactttctccttgccactttttgacgattcacatgcaccatccaatattttagtgcccttttcacgacatatctgtgtctgtatccaattttcttatttactactacttttttctatttatatatacaaaaataatcaaagagagagacgaattttcgaggtaaggtatctatcgactttctatcttcctccacctttgtttgttgtcaccaccacactacgctaatcattgccacacacatgcataattctctccaaccatctaaaagtcccactttagcattcttctgtttgtaattttatctcagagcttgcttcatgggcttttgagttttctctctgtttccaaaaaaca

SEQ ID NO: 3297 - DNA, 3000 bp, Unknown
  misc_feature (1)..( 3000): cDNA_ID_1820119_gDNA_ID_1620636_Annot_ID_47382 3000 nt of promoter + ATG
ttgatccaacaaacaatagccctttggattgtgtgataagaagagtatttacaagtagtaaaggagaggattgtatgcttctttgccctgtggatacgtaagtactgtttttcttcttctcttaccattttagcaacttcttcttttccgtttgattgattaatttcttgcttcaggccagttcagattttgaagagcacaaatattgatggatggtcagctgtaagttttatccttaatgaatctttcttcatgtgtttcttcaagactgcacatctcctgatgtagagagaccttctggatgcatgacactatgcttttgagaactcgaatattaattaattgtagaatagtcagtttctagatgaaagttgcttcgatcaggacctgtcttttgcttatctaggatcgttctgccttttaggtcagtgatgaagaggtcgaatctcttcttcctgctgctgcttatgctcttgcaaagatccatatgcatctagtacacagcgggtatgaccgtgccctgtttcaagcatgacatcatttattatcctatgtctcttctttgtgtctgataccatctaatgggttatcactgtaaatcaggttctgttacactgcaaggggaggcttttgctacacggaagataatgtctttgattttcgcacaggcaacacccttttcttctgatttttacgcatgacgaaaatacttctgattaatgtttttgtggcgtctgctctatatgagcacactaaatgattttggcttcatatacggtggatatattttatcatgattttatatttatgtgtcaaatttcaatctcatggtcatgtgtacttgcaattgcatcttagtaaaattatgtggttatcttcattcttccttatgtttagttctctcgatctgcttcgttctaactgttaggtgttttgacgggtctgctcatatgcttatagtttaaattatgtgtcctactttttcatattactaaatgtttcgagcatcaactatttgcagatgatggccaagatgttgaaggcttgccaactgaaggggttgagattacgtgtttccatctggtatactattgcttttggcattttgcttattgatatgtttgaggcgctttatatagtattttgaacaatcttttgagatatcactattatagcatacttttaaacactaaacctgtcattcaatttatctctgaaccaagtttgtatttgccattgtggatccaaagttcaccactgcaatctggttgtgaaaacagactggttgtgaattttattgtttgaattctgtagaacatgaaacctttgaggtatgatgtggcccctttttcctcgtctaaatataaattctgattcaggatggatcacactatatggtctacacaccttcagatccacttctctttgttgctgctaaggtaagcttgttatctttagttgtttattgtgaaagttttgccgagctgtagcagttttcagatgttacttttatagaagaaatatggaaccttaggactactgtagaataaaaacagagtgatgaatggcaattttatctatgcaggatcaaaatgggctgctgcaaatcgctgatgatgtaagtcgaacctcaattatgtactttttctcctctgcaatttggttgggttataaaaaggttttgagcaaaagttacaccaccagacttggaaaatctgtgaattcatccaaagaagagacttttggaatttgatccaagtagatttgtgataggtcttggcggacaaactaatgatgtttagtagacaatatagagttaagggaaacacaacttggtgattattggttctctgttttttagaagagaggagtgcttataatcctaaataagatttgtgtgtgatggtcaatatgaatgaagtaagctcaccactcgaatgttaatgggtggttgcaggaactcttagacgatccagctgtgatcagcgccatagacgaggaaaccgaattcaatgccttggtggtacgtagagaattcaacaaacttttaagttaagaggtatttaataaaatgatattgaacgtggtaagtaatgtttgtgcaggaggaagaggcggctctcctggaatcactgcttggggaaagaatttgatgttttcatagggactacttagctttctttttgtattccataattgcaatgccatgtaatctaaattttctcttagaaaaactcattttgcctttccaaatctctcttgttgacaattgggttcgatcattaccgaaacagaagtccctccaaatgaccatgcacctacttgtaaaccgaaggattcttttcagttttcactaatacatcaataatatatgttatgcgtgctcagctcttgtgggagtaggaccgtagaaagcctatccatttaacaaagaatatcaaacaaagtcttgtttttcttttaatctttttttttatggctgccttcagtagtaacctctgagcttgagggaaactcatgtccatggcgctaattgtccggccattctttgttcctggtaattttctcttctttcttctgttcagtgcctttgttttcggctaaaagctctcttctctgtaatccattagataattttccgatcttaaacaatttgtgtaaagaaaagcgacaatctgattctggggatgtttcgtttgctcctccttttcatttttataacataaaaatgggcgtcaaaggttttatgtgcatattgtttcaactacaggagtgattagattccatatcatgttctcactgtttttctttatatcggaaatgaaatgatatatgacattttaattgccttaggaagtgctggaatttctgggagtagaaacatatgcaagaaaaatcaatggaggaagtatcttctgaaacccagtggatcatccattaattgctcatttagtacagagaagaatcctctattaccatctatccagcagttagccgatg

SEQ ID NO: 3298 - DNA, 3000 bp, Unknown; identical to SEQ ID NO: 3288
  misc_feature (1)..( 3000): cDNA_ID_1820113_gDNA_ID_1620636_Annot_ID_47384 3000 nt of promoter + ATG

SEQ ID NO: 3299 - DNA, 3000 bp, Unknown
  misc_feature (1)..( 3000): cDNA_ID_1820109_gDNA_ID_1620636_Annot_ID_47385 3000 nt of promoter + ATG
ggcaaaacagcagctcccaagcttctcaaagctgaattcgacgaagtaaatcgactgccatgaaacccaccaagacgtcgcacggagggagaacagcgagcgagcaataaaggatggaggtgtctggcgccggtaaagtggcggttaagtgctttagaaatagtgaggagaggtaatgaaggaccaccactacttcgagccatcgctgttgccttgacggttgagaaagctgagagtgtagactccatgaaagtgggtggctccgtaatctcaatctctcgagtcccgttatctttcttttttccaggcctcctgcgtttgtttaagtgttctctaaacgaatagtgtccacgtgtggaaatggcattcagagttttccaattttcttcatacaacttttggtttgtcaaaaggtttatgctttgtggtatttgagtcaaaaatttacaccttaatgggaggacttttctgtgattgaatcaaatatcgaatttttgttgcaagcgtgacgtagagatttacgggtttataaagtcagccacttatttcagacaaaatcataacccaacacacaaaaacaacaatatcttacttttaacagtacacaagctcatttaacttggcaacttaataagtagagatcagcctctatacacacacatcctagctcggataagtattttcttgttctctagactccaatagatgacggaagattcccggaaccaagccttctctttcgcagacgctctgcaatgatgaatgcaagctccagagactgagatgcgttgagtcttgggtcacagtgagtgtggtagcgtgagcttagatcgttgtaagtgatggtgcgtgaccctccgacacattctgtcacgttttgaccagtcatttctaaatgaaccccgccagggaaactcccttcttgatcatggacgtcgaagaacgctctcaattccgcctgatacaccatataatttaatgggtaactacatgaatcataagcaagattatgcatagagttggatgaagaagtaagttcgaatgattaccctgattgcatcgaaagaacgagtttttagcccaccaggagccatgattgtgtttccgtgcattggatcactaacccaagtcacaatctgaccggctccacggactgctctgatcaaattaggaagcttgacccgcatattctcagctcccattctcactataaccgtaatccttccaggcttgttctgagggtttagtatctctatcagcttaaccagttcactagggaccattttatcactcacctgcatcaaagtacatcaatcaacatctgtcattttctcatacaaaaatctgttgtagcctctttgtaatggttttccaatatctttaataccaggcaattgagacctgcagggtatcctatagagttaacaacagttcttgagtctacatctcagtgtttttttctatacgaacaaagctatgaaacttactcctattccaattaaccaaaccaagagacttgatgatcacataccttgattccgagggggttagcgattcccctcagaaactcaacatgagcaccatcaagttggcgagttcgttctccaacccaaagcatgtgcgcagagcaatcatagtaaagtccagatgttgaatcctctcttgtgagtgcttgctcataaggcaataacaaacactcatgggatgtccaaaactcagtagtagtcatgatcgggtgagcactagtaagtccagctgcacccatgaatcccaaagcctcatcaactctattagccaattcacggtacctgttttgtcacaacaacatcaagaaataagaaaccgtttctgacttaagaaaagtgtattctcaattggttaacatcataacaaacaagattataaacaaggagagaagtttataaacctgtcaccctgttcactatgttgcgtgaaatcaaggttccactggctaactctctgcatagctgcataacctccagtagcaaatgctctcaagagattcaacgtagccacagactgtgtgtacgctctaaccatcctatgaggatcaggaatcctcgatttctcatcaaaagcatcaccatttatgttatctcctctgtaactcggcagcttcacaccatctttctcctcaaatgggtctgatctcggcttcgcaaactgaccagccattcttcccacctgaaaacttaaaacccacaaaatcataaactatccctaactagagattcatcacacagaaaaatctccaggtaaagaatcgaccttgataactggtaactggccaccgaacatgagaacaacacccatctgaagaagaaccctaaaggtgtctctaatgttattagcgttaaattccttgaaactctcagcacaatcaccaccttgaagcataaaggcttgacccatagccgcttgaccaagcttatcctctagtttcctagcctcaccagcgaaaactataggaggaaaagaagaaagcgtctgtagaaccgaatcaacatccttctgatcaggataatccggcaattgcaaagctttcttcgacttccaactctctagactccatttaaccgaagcggaggctgattgggtagatttcttggggtcagtcgaatgaacggcgaagacaggggagaaagagattggacggcgaggagcgtgacggtaggggaggaacgacttggtcgtgagaggagaagaagcgtttagagtcaccatcgctgatctttgggatttcgattgacgactagttcggcagagaatggatagagaagagaagagtcaaaaagatatgatttttatagcccaattatgaaaaaaaaacggtagccacaaaatatctgtgaagcgaacacatctgatagaaacagagggttaccaccggttgtaacgtcacccaattatcatcttcttcgtctactctaaaccatttctgtgacactctttgttacagacttcaatgtttaagttatg

SEQ ID NO: 3300 - DNA, 3000 bp, Unknown; identical to SEQ ID NO: 3287
  misc_feature (1)..( 3000): cDNA_ID_1842843_gDNA_ID_1620636_Annot_ID_47386 3000 nt of promoter + ATG

SEQ ID NO: 3301 - DNA, 3000 bp, Unknown; identical to SEQ ID NO: 3286
  misc_feature (1)..( 3000): cDNA_ID_1820105_gDNA_ID_1620636_Annot_ID_47387 3000 nt of promoter + ATG

SEQ ID NO: 3302 - DNA, 3000 bp, Unknown
  misc_feature (1)..( 3000): cDNA_ID_2993840_gDNA_ID_1620637_Annot_ID_47388 3000 nt of promoter + ATG
tcaaagattcaattaaacaagacaatgttcacaatcacacattaacaagcttttcaaatcagagaaatttccaagattcaaaacttacaatgaacatcagagtctctttgataactctactcaaaactatagtctcctaaattgggatttcattcaaacatctttattgtcaatttcagcttgctttcttcttctttcttcttcgtcccatcttagtcgaccaaacaaaaaacaatgaatggtgcaatatactaactcagaccactggataactgtgttatgtggacaacgactcttacattggaagcaaataggtcgagacataacctgagtttttaaaagaacatctgcatgcctgtggtcgtactcaaacgatgaaccgggcttcaagtataattctttcccaatcaaacattgaatgtgcagggtgacacaacaatattcatcacacttataaaaccgttcttctgaatttatctctttctcgcaggcttcacaccaatacatcatggtacttgtctcctccccataagaaagagtgagcatgtgcttatcatgcttatacctcacctcgtgaggtaaagtagcacatccaaaacacaaagcaaaggtacactcaccttcaatacaattgaatgtttccgtgtggctaagtggcttttttttgcaaaccccacatcttcttcgttctcttggtttggatgttaagaataaaggatgcacatgactttcatggactaatggctcagaaattgtggcacactgcacatgtagcttaaaacgatcacattcttctttaccgcactcatagaagaaaccattggtgcacatcctaggacacactgaacagaaatccttataatacttggtaacaccgtcgtatcctcccactagattgagcttatgtggatgtatcgggttatgtattttgcgagaaaaattcgcacattcttcatggagaatgaagttgcattgcatacaagagtagatgttaccaaaatagattggtgtgatgcatgcttgacactgcttattctcgtcgtagtctctgccggtattcttatccattctcaaatgatgtggatgactaaaatggtgtattgttccgtcacttattatcacaaatggctcaacttcttcttcttcaacttcttctggctctccctcaaggtctagaccatcccacacattcttttgtgttgcacatcttgaatgtgccacatacgaacaaccgtccttgaggcaagtataaccaccgtaatcattatccatctttttgcgacaaataccacaataccaatttcctttctcaaatgaaggagtgaaggagatacgatgatggtggcgggatatccttatgacatgtggtaagctgagacacttttgatggaccacgaagtcacaggggggacaaatatagaaaggacaacttgaatgtgtgagggcacaaaggttacaaggaaaggaagcctgacttggaaacaaaataaggggatgctgatgccacttgggatggtctatagataagactggtggtggtttctccaaacagcttacattcatagcaaaatcgcaagaggagcaatagtaataataatccatgagatattcatcacaacaataacattcaatcatcgtttcctcctccgaccattgtctaacggcaagctgaagagaatgtcttgggtgaagagggtgtttgacctctataggaaccttgtcatactcttcatggttctcgccattgcatagtatacagtgaaaatggatttgtcttgtagatttccaaatttcgtaagcatacaactcacattcccgctctttagcctttctcggccggacaacttctgtcgtcagttttccatgtacaagttccaccataacttgagggcatacggaaataaactgcataggctcccaattcatagatatgaaggtagagatgatccgcctggtgagtgatgtgagctccggctccggcttggcagagactagttggctaatgagtgatagaagctcagattcttgtgttggctctgaatccgaatccacagaggtatcgatacgcatcaactgtgtaatgagggaaacgagctctgaacccgtatcgggtttagagttgaagagagaaattattttcttgatgagagatgtgagctctgactccgaatccaaatccatagagctaaccagaaacattattttacaaatgagggatacaaacttccactgtctacccatgtccgtagaggtccagaacttgagtatttgacgaaggagtaaatggaactccatcttcgggtaaagggactttatttccatataaacagagcgccaatcatagaatagttgagaaaagagtgatattaccctcggatccacctttaaatttgtggagatgagaaaggttgtgtcagtgatgaccgatatgacattctcctccacctccgaatccatagagatgccaagaaaaagagcgagcaagagagagagatagagagataatttctaagtagttttgagtcgtatgagagattttgagtgctctttacatattgatttgtaatctctcccacgttctctagctatttgattttctatattttttcccctagcttccgggtcttgccttaatatgttttttaaagcagagataatcatagagacaatctcaaacttacaggctgtccgtatatgaagtcaacgattcatttagagttacatatctcaacaatactataatattacgacagctaactaattaactactcgactttctatactaataatagtgttttttaaaaagtaacacttggactaatttactaatttagttagtttgaaattgataatcacgaccgtggttccggtgaggaagaccattggaacgatcacagatttcttgttttgtttgtgataatactctgctttaaaaacagagacaaatgttgctgcccaaaaaaaaaaaaagaaaaagaaaaaaagaagaagacatgcatg

SEQ ID NO: 3303 - DNA, 3000 bp, Unknown
  misc_feature (1)..( 3000): cDNA_ID_1820214_gDNA_ID_1620637_Annot_ID_47393 3000 nt of promoter + ATG
tccggtctaacgggaaccgctcttaaccctttatctcctaagaccgtggaggaccagggctggcttcaatgtgagtctccaagagatgtgtactcgttactataacaaatttttaccaaacgtttccaaaattaatatacgttttttcacagctatattttattcatttaatgttgtatagttaacattttcacaaaagaaattgcaaaattgaatttttttttaacaaatgacttgggttctctacagttgtagatgggtattaaggcttactttatttcatttaacgagtaagttctatttgaattattaattgaagatttaggtattaattaccatagtctaaaataataataacaaatattttgagagatgatatacgtataacatacaaaagagcatgctagcttttagtttttcatacatgaaattctttttcaatttttatttctctttttacaatctaaatcagataaatcatgaagataaagacattaatccaaatgtaaatcaaaactatatacaaggcaaacatgaacttgaacctgaaccttaacccagtcggatttcaaagaaaaatgaagtcaatgaacaaatctcacaacatcataaaagtttataacagttatctcgcaacttccaaaatttgaaaaatgtgcctacaatataaagattgtgttgattgtattgattttatttttcctaattatgcctaaatttatagtattgttgccattatcttcagttagcaatacattttagcgaaagtatcacatttcgacgataaaagtgtgttatattgtcatcattcactcagtcatagatattatacaatttgaaaattgaaataattaatatattatttggatttttgtactaatggccgatacttgtcatcaaatgtaggttaatgttcaaaacttgattcttcgaccttaaacacacaaccgtcttaagaactcatttgaagatctagttaaatgaagatctagaagaactagatgatgctaataatgatgatgataataattttgtcaacaaaagggtatgacaacattagtaatgatctttgtggctgcgcttcaggcaggttgggttctcctaaaagcagtatgatggtgggacaagttggagcctgatagaggttgttgtcagagatctctggtggatacaagaagacacaagtatgtcaaaagagtgtaatgcgcacacgtcactgcttacgaaacaaaaacatgtctcaaaataagaccgttgactcgacggccatgtggctgtatgtcaagtgatccaacaactataagtctataaatgtggtccatatttttccctgcttttaatcaaaaattcagaggaaaaaaaacacgatcgagaaatggagaataatccaagaagctcatcgtctctccctctagccgggcgtgtagctatagtgaccggagccaccagaggcatgggccgtgaaatcgcgattcacctccactctcttggtgcaagagtcaccatcaattatgtctcgagctcatcaaaagctgaactcttggtttcagaactaaacgactcatctcaattaaagtcagcgatcgcagttaaagcagatgtgtcagacccggaccagatcaacaacttgtttgatcaaacagaacaagagttcggatctaaagttcacatcgtcgtgaattgtgcaggtgttttggatccaaagtatccatctttatccgagacgacactagaagatttcgataacacattcacaataaacacaagagggtctttcttgtgttgcaaggaagcagctaaaagggttatgagaggaggtggtggaagaatcattatgatgtctacatcaatggttggtggtctcgccccgggttatggagtttacgcagcatcaaaggccgccgttgagacaatggtgaaagtgttggcgaaggagcttaagggaagccggataaccgcgaattgcgtggcgccagggccggttgcgacggagatgttttatgctggaaagagtgatgaaacggtgaaaatgcttgcaggggcttgtcctatggggaggatcggtgagtcaaaggatataaccgagattgtagggtttttggccggtgatggtggtgaatggattaacggtcaagttattagagccaatggaggctttgttgtctaataaatgaagaactaacattggaatttgatgttgtcttcttcttttcgtgtgttgatctacttttatgtcaatgatgatgagttgtttattgggcaagacaatacttatgttttttaaaagtacattcaatcaaacttaaaaaaattgattgaaaataaaaagacaaccaacactccaaaagctagccttcctctgttttgtcttctagtaagatctttcgacaatgtcatctgaagttattgtgaagtttggaggattctcttacaacataaatcgtttataattaacaaaaaaaaaagaaaaaaatttgtttagagcaaattctccaaaagaacttaaataggttttttctgatggatttattctttctagtagttccttattagttgatccgtttcattcgaacaacatataccgtttccaacgaaagcagctaaggttgtggttcaaaatctgaagcagaacttaaagattatgagaatgtttatatttgaatcgatgaaacagaatcatcaatcttctttggatagtccaatagtaatactcattagcctatcgagttctataagtggagtttttcactgctataatactttaaactcttgtatcatacgtaccataatgattcttagaaatccaataatgatttcttccatatctcatccacagatcataagttttgtccccaacgtaagccaattttgggcttcttaagtaaaggggccaatattgggctttaaacccattttaaaccctagccttgtgttgtgcgtcatatatgataatctactttttcagagccgaagcaagggaagaagaagaagaagaagatg

SEQ ID NO: 3304 - DNA, 3000 bp, Unknown; identical to SEQ ID NO: 3303
  misc_feature (1)..( 3000): cDNA_ID_1820214_gDNA_ID_1620637_Annot_ID_162937 3000 nt of promoter + ATG

SEQ ID NO: 3305 - DNA, 3000 bp, Unknown
  misc_feature (1)..( 3000): cDNA_ID_3089790_gDNA_ID_1620637_Annot_ID_162952 3000 nt of promoter + ATG
ctaatatatatgtcatttgatatccatgtaattgaatacatatgataagagggaaaaaaaatcttttttaacacttttcctttttctcatcaaacgccacttttttagactgaaagtggagatcagggtgatgatgatgaaagtaaagaagaatctgagtttaggtagaagttgatggatgttgaactctactctactcgacgtgtcccaactatactaaagtgtctacaatcatggctctctaccacataaaagttaaaagtggtatatccaagaactaatttgatcagttcatgaaattggttcacgacatgttacatgcggataatgttcttccaaaatctgttcatgagatgaagaagctcttgaagctttttggttttagttatgatttgatttacacatgattgcatcctttatcgaaagatgtttgaggagtttgttagctgcccaagatatagtgcttcgagatggaagtaagataagcatactagagagaaaaagaaggggttcccgcaaaggttcagaggtatttttcgatctaaggatagatttaggaggatatttagattaaaaaggattgcttaggagttgtgttggcatttcaacaatgctagtgtaaccggtccaatgagacacccagttgattcattgacttggtctcaaataaaagataagttttcaaagtattctactaaaccaaggaaccttcgactcgacttttctacagataggatgaactcgttctctatgcagaaaaaagtattgtacatgatcgatgttgttagtcaactacaacatgttccgactatgtgtatgaaggctgggaacatcatgatgactttgctcttccctagaccaactgcaccacacaacaacatagatgtgtatcttgcacctattatagatgatctaaatggtctgtggaaagaatgtataaaggtttatgattcttatatgaaggagaattgcacacttagaactatattgttgtgggctattagtgattatcttgccttagggacactggttagatgtatggttaaagggaaataggagtgtaacatatctggtaaggacaaagggaaataggagtgtaacatatctggtaacgaaaaaaaactataaattgtgtaaatatatcacttaacaaatgctattagagggttacaggccggagaacagagtatgtaatattgtgtttagctacaagatttcgaagaccgcgtgatacaacacccgttattatatgtaattcaagacactttcacacttttttggtgttattgaagagcgatacaatttgacttgtgttgaagtgaagaagaaagttgcattgaatcttataaaaatgacaaggatggtgtcattgacatcaagatacaaaggtaacgaaaataatttgatgaaggaagatactgagttgtttcaggaagttgaagccgttgaagatgaagacaatgatgatgagaatctacctttgattattgtgacgattctgatggaacagattctgatgacgggaattttagcttgtacgggtttccaccacaagaagaagaaaaacttaatttaccaatgaagaagatgagtttaggtatttttattgaagaaaaagaagatgatcattattcaaagttagaaatgtcttctttggatttggttggttgaaatgttatgaaacaaaatatcatttggagacacgattgaagacaacaattatggtataaaattttgattttatgttcataaatcgtcaccatttatattgtttttcaagtcttgtgttaaaaagtgaatgtggaggatatgagctacaccattaagcgactctccaaaattccatgtgtgtgtgtttgtcttggaacatacattttcaatgacagacctttatgcacgtgttcgacaagcaactgatgatatacttggtatgttccacaaaggttttagtaatccagagagagaattggtaaggggaagtccagagaatggatatgagaaaatacccatatacgtatacatgataaggagagaagatcatggaaccttaaatgcgacttgaagttgataaacacatagatgtaagtatttcgcagttaaataaatctagtttgaatcgtcgccatcttttgtaggagcattagattcaaagagagatggctagggtttagtagaaagatcgaaaaagataggacatgaattggaaaatatgtgagagagaaaaaaacttaagaaacgaaaaacctaaatcgagacttattatgttttttggtttttgtttcttaattttgtgttttttatttatttaattaaagaatcaaatttgtatataattttttataggtatggcataatggttataataagtttgatggaaggttaattagtgttttaacagaaaatttagtttactctagttatctatttcgattgacaatcattctagttattttttcaaagttttcagtcaaactagataaactttttaaacttataatatggttaagtttgggttttgtggtcaattttaatgtctaaggttagttcatttgatttattcttcatggttaagcatacatttcgaccctaaaatctcttctaaccaaaggcttaatttgttcatgtttttgtctaaacttagttaatattatataaagaaaaatcttcttacacacacagagaaaaaaaaattataaatactacttgttaatgcccttgtttctccaataattaatttagatccgagaaatgttacgtttaatatttttcatattagttactgctatttgttctacgaaaactgaagcttgcgagaaaaatacaatagtaatcataaacgatctcggtcctggtagaattctccaatatcattgtcgctacacaaaaaaagacttaggagtccaacacctaaacttccatgctattaaaaccattcatcttcaggacgagggaaaaaatataacaaaatggcattgtctctttaagcaagggcttaacatg

SEQ ID NO: 3306 - DNA, 3000 bp, Unknown
  misc_feature (1)..( 3000): cDNA_ID_2166858_gDNA_ID_1620637_Annot_ID_162954 3000 nt of promoter + ATG
acttattttgcattatagatacagatctattatattttattgacaccgtataaaaaagacttattttttatattttgcataaaatcgagatacttataaaaatgcaccgcatattttgttggaattgaaaattttaccctagaaatctatttcaaaaatcattatccccttgcattacgtctcggtaaagttcattttcactgcgcatgtttctctatttggtagcaaatataattagataattgtgtagatagaaacaaattaggtttgggatttattcaggaagtttcttctacaatattgtgataaaataagattgtattgggtaccatttgaaggttccttcaagttaagcacatgcaagttcaaaagagtcagtcatgtctctctttttcattttctcgttttctcctttttttttgttcttgcctaattcttattaaaaacctttcctaatttttttttaatgaaccaagcctagtttgaaacccgttaactctatacatctttactaaattctccaaagaaagacatgatcaaaaagacaaatctatacatattcactaatacccagagaaagaaaattgagatgtcgtatttattgatattccgaaacaataacatgagatgtcgtatttattgatcggaagaaaatttaaactcccattagtaacgaacgcaagaaataaaaccaaaactaaaaaattacaaaaaccaaacaataacatgagatgtataaatcatatataatctaaaccaaaaactacaatttgaaaaaaggaaagctatctatccatcatttcttccgatcatcatcatggaggtgaacactcgactgactcgagaagaacatccattccaagattcatctgcatggtttctacggtaccttgaccaccaaggcgactggcttgaaaaaactaggggaaacctggtcgttgctgcaacagtcatagctgcaatgagctttggggtaatggtgaaccctccaggcggtgtttggcagagtgaagattgttcctccaaaggccaaactacttttcaaaccagaacttgtgaggggaagcttgggacttcgatactagagcacaatccttcaaagcgtatcttctatcttggcatggtcattagcaatttggtatcgttttccgcctcaatgggtatcattttcctcgtcatcattggcttccgattcaggtactagatccattcataaaccataattatataatgtgttttcttcttaaacatttccttgcaaatagtcgaaataaatagtgagacctgtttactaattagtgaactaatattatatctatctgactatctgtaggaaccggttaataatgacgatcatggtcatgtttatggtggtggcggttctatgtatatcggcagccttcttctttgctgcggggttggttcaacacgaggatgatttcatcgagaagattcttcaaatttatttgggattttgggttttgcttcctgttttagtaatcctgatccaattagtgcggtttttatggtgggttattaggttcatatgttgtggttgtggacgtcgaccacggtctactccacggttgctgcctttggctctgccacctgtccgttgacgaagaggaggacccatggctcgaaccgacgtgttaaatggaaatactgtcagcaatgtgataagtagaataaagctctcccatgttgatcattttaaaaagatttctattgtatgtgtgatcttattgtttacggagtcgtcactagctctcaatgggcctaatgtaagactttaaaatgtgtccctcatttactgaaaaatatcttatactagaaaccatctaaataaatgtgaattccttataaacataacttagttctatgaaaaaactatagatataatcatataaatcattttatttgaagatagacaaaatacgacatactaggtcagtacatttataaaatcaactaaaatatcatctattgctgttttataaatatctttcttatcagtattttattttattttgttgatttaaatttatctgatcgaacagagccacgttataaatttattataaatataaattatataatccattaaaagttatgtaaagtaaatataaacaaattttatgataataataattataaaaaaaacaatcgaaagaaatttaggtagccacattacgggttgtggactaaagaggtggaagttttgttctcgtgacacataaggaaagggtgtgttgtaaatacagacacttactcaatgtatgacacttaaacctatcatgcataattcgattaggttaaatattagctacttaataacataggcaaatagccaaatacaaccaaactaaataccgatgacatttatcataaattattacgcggcaaaaactaaaagaataaggaatagattaaaaacaggaataacaacttaaaattatataaaaatacaaagtcaaattgtatctatgcggctacaaaatgagcatatataggaaataggacagagttctaattgaaagaaagaagtgatttaaccaaaagttcaccgatcagtggattggcctaaccaatcggtggctcaagcattttttcactaggtactaaactctagcaaacgggcctcttgatggatcctctctttttctaatgctttttgacccaattcctctttgttatgctcacttttgctttacaggtccatattcctaaaaagacttaattaaacctataaaacaaacgaaataaaactataaattgtgtaaatatatcacttaacaaatgctattagagggttacaggctggagaacagagtatgtaatattgtgtttagctacaagatttcgaagaccgcgtgatacaccacccgttattatatgtaattcaagacactttcacacttttttggggtaattgaagaacgatacaatttgacttgtgttgaagtgaagaagaaagttgcattgaatcttataaacatg

SEQ ID NO: 3307 - DNA, 3000 bp, Unknown
  misc_feature (1)..( 3000): cDNA_ID_2166862_gDNA_ID_1620637_Annot_ID_162955 3000 nt of promoter + ATG
gtggagtactgatttgtttcgtctccatgaagttactgctcatgtttcttgagtggaatggcatagttatatacaagtatacagtcaaaatacatttgctcctcaatgtgatcaactacgtcaatggagtttcacaaagagtgcgatagggtttacatatgatgaccgtcgaccttcaggacccaaatatcgttggagtacttcctagttttctattcttttttctaattctatttaacatttatgcaattcgtttgcggcttatgacctaagacataagactaattcattagtcaatttgttttgtttctttttaatatatatatacagctcatttgatgtttatgtttattgaataaatgttttgaataataagaagacatctttttatatatgctaatgtttacttttataagaaatgactttatatgtatttgtttgctctagaagaatttgttattgatttcatgtttattccgtggagaactatgagttttgaattatggtacaaaaactcgatttgacagaaaagtcggttgtttatattgatggaggtttagacatggttgttacgtagaaacaaaggtctctctatttgaattaagtagttaatgttgaactaatttgaatatgaataaaaatgtaatatattgtatggctttagcttattattaaaaataatatgacagctgttttataagggtaacatttcaaattatataaacgcacagttacatcacaacgatggaatactagtttactattcagaagagaccggaacaccaatcttgcttccaactctacgaagacaatcgttccatgtctgtttgtttcttggaatagatgcaatatttttatattcatacgatgagaagaagattttaatcaatccaagatgacaatctttgccaatcttcaatatatcacgacaacatttatctgtcactaaagttgttgcatccagcacgttctggaaaatctcacctccgcatatggagctcggcttttcaacgcaagcctctagaaaatcatactgtttttgcgagtaatggggaagcttcatgtcatattccattgcgggtgaattagcttcttcgaatggagttggagatatggctacatcttcatgtatctcctgggagaaaattggacaagccatgtaaaacattacaatggatacaagcatgaccatgagaagagactttgccatatttacttttggttttggatgtaagattgctgatataaaaaaaaaacaagagatgttatataggacaatcagtaaggatatttaattaataaattgtttatttattaatagtttatgttactgacttcataaacttcttcatttactagttttgtttagaagacgtttgcagtagagactatagacttataaacttctctacaagtcataacttacaatgtgtgaaaactctttttttcttaatgtttttacaaatcaaagtgatacattagatacaacataattacacgattatacaaaaaaatgaaagaaagaattgtaatgaggacaaccgcatggagactttcaatccgaaatacagcgagtaatattcttgggaagtatatgatccttagacggtaattacaacgagtgttttttgtaatttgaatatttttggggagagtaaagattcaaggacgggatagatcagatttgtttattgacccttataacctcaaatatttatacacattcttatcttttactggttttaaaaccatacggggttaagaaaatagaagtctttaatttagaaaaagattttaaaaaaaaacagtatagatcttctgttacagagggtctagcaagagacatttaaatactctttatttatttctatattttaaataattaaactaaataaatatattattattaaattttaaaaacacatttatcggtagttaaccgatggtgatgctctaaaaatccaaaaatcaaaaggccatagttatatgtttttgttgtagaatttgaacaaaaaaactaagacaaaaaaacgtgtcatcattgagatggcgtttgaaataaaagacccataaacaaaattaacctagtttagtaactattaccaaaaggaaatcaaatcgtcgtcgtttgctttttacttttaccaatagttatttcgcttttgtttaacaaactatctacttattttgcattatagatacagatctattatattttattgacaccgtataaaaaagacttattttttatattttgcataaaatcgagatacttataaaaatgcaccgcatattttgttggaattgaaaattttaccctagaaatctatttcaaaaatcattatccccttgcattacgtctcggtaaagttcattttcactgcgcatgtttctctatttggtagcaaatataattagataattgtgtagatagaaacaaattaggtttgggatttattcaggaagtttcttctacaatattgtgataaaataagattgtattgggtaccatttgaaggttccttcaagttaagcacatgcaagttcaaaagagtcagtcatgtctctctttttcattttctcgttttctcctttttttttgttcttgcctaattcttattaaaaacctttcctaatttttttttaatgaaccaagcctagtttgaaacccgttaactctatacatctttactaaattctccaaagaaagacatgatcaaaaagacaaatctatacatattcactaatacccagagaaagaaaattgagatgtcgtatttattgatattccgaaacaataacatgagatgtcgtatttattgatcggaagaaaatttaaactcccattagtaacgaacgcaagaaataaaaccaaaactaaaaaattacaaaaaccaaacaataacatgagatgtataaatcatatataatctaaaccaaaaactacaatttgaaaaaaggaaagctatctatccatcatttcttccgatcatcatcatg

SEQ ID NO: 3308 - DNA, 3000 bp, Unknown
  misc_feature (1)..( 3000): cDNA_ID_3089786_gDNA_ID_1620637_Annot_ID_162953 3000 nt of promoter + ATG
aatactgtcagcaatgtgataagtagaataaagctctcccatgttgatcattttaaaaagatttctattgtatgtgtgatcttattgtttacggagtcgtcactagctctcaatgggcctaatgtaagactttaaaatgtgtccctcatttactgaaaaatatcttatactagaaaccatctaaataaatgtgaattccttataaacataacttagttctatgaaaaaactatagatataatcatataaatcattttatttgaagatagacaaaatacgacatactaggtcagtacatttataaaatcaactaaaatatcatctattgctgttttataaatatctttcttatcagtattttattttattttgttgatttaaatttatctgatcgaacagagccacgttataaatttattataaatataaattatataatccattaaaagttatgtaaagtaaatataaacaaattttatgataataataattataaaaaaaacaatcgaaagaaatttaggtagccacattacgggttgtggactaaagaggtggaagttttgttctcgtgacacataaggaaagggtgtgttgtaaatacagacacttactcaatgtatgacacttaaacctatcatgcataattcgattaggttaaatattagctacttaataacataggcaaatagccaaatacaaccaaactaaataccgatgacatttatcataaattattacgcggcaaaaactaaaagaataaggaatagattaaaaacaggaataacaacttaaaattatataaaaatacaaagtcaaattgtatctatgcggctacaaaatgagcatatataggaaataggacagagttctaattgaaagaaagaagtgatttaaccaaaagttcaccgatcagtggattggcctaaccaatcggtggctcaagcattttttcactaggtactaaactctagcaaacgggcctcttgatggatcctctctttttctaatgctttttgacccaattcctctttgttatgctcacttttgctttacaggtccatattcctaaaaagacttaattaaacctataaaacaaacgaaataaaactataaattgtgtaaatatatcacttaacaaatgctattagagggttacaggctggagaacagagtatgtaatattgtgtttagctacaagatttcgaagaccgcgtgatacaccacccgttattatatgtaattcaagacactttcacacttttttggggtaattgaagaacgatacaatttgacttgtgttgaagtgaagaagaaagttgcattgaatcttataaacatgacaaggatggtgtcattgacatcaagatacaaaggtaacgaaaataatttgatgaaggaagatactgagttgtttcaggaaattgaagccgttgaagatgaagaccaggactgatgaagacaatgatgatgagaatctacctttgattattgtgacgattctgatggaacagattctgatgacgggaattttagcttgtacgggtttccaccacaagaagaagaaaaacctaatttaccaatgaagaagataagtttaggtatttttattgaagaaaaagaagatgatcattattcaaagttagaaatgtcttctttggatttggttggttgcaatgttatgaaacaaaatatcatttggagacacgattgaagacaacaattatggtataaaattttgattttatgttcataaatcgtcaccatttatattgtttttcaagtcttgtgttaaaaagtgaatgtggaagatatgagctacaccattaagcgactctccaaaattccatgtgtgtgtgtttgtcttggaacatacatgttcaatgacagacctttatgcacgtgttcgacaagcaactgatgatatacttggtatgttccacaaaggttttagtaatccagagagagaattggtaaggggaagtccagagaatggatatgagaaaatacccatatacgtatacatgataaggagagaagatcatggaaccttaaatgcgacttgaagttgatacacacatagatgtaagtatttcgcagttaaataaatctagtctaaatcgtcgccatcttttgtgggagcattagattcaaagagagatggctagggtttagtagaaagatcgaaaaagataagacatgaattggaaaatatgtgagagagaaaaaaacttaagaaacgaaaaacctaaatcgagacttattatgttttttggtttttgtttcttaattttgtgttttttatttatttaattaaagaatcaaatttgtatataattttttataggtatggcataatggttataataagtttgatcgaaggttaattagtgttttaacagaaaatttagtttactctagttatctatttcgattgacaatcattctagttattttttcaaagttttcagtcaaactagataaacttcttaaacttataatatggttaagtttgggttttgtggtcaattttaatgtctaaggttagttcatttgatttattcttcatggttaagcatacatttcgaccgtaaaatctcttctaaccaaaggcttaatttgttcatgtttttgtctaaacttagttaatattatataaagaaaaagcttcttacacacacagagaaaaaaaattataaatactacttgttaatgcccttgtttctccaataattaatttagatccgagaaatgttacgtttaatatttttcatattagttactgctatttgttctacgaaaactgaagcttgcgagaaaaatgcaatagtaatcataaacgatctcggtcctggtagaattctccaatatcattgtcgctacacaaaaaaagacttaggagtccaacacctaaacttccatgctattaaaaccattcatcttcaggacgagggaaaaaatataacaaaatggcattgtctctttaagcaagggcttaacatg

SEQ ID NO: 3309 - DNA, 3000 bp, Unknown
  misc_feature (1)..( 3000): cDNA_ID_3070980_gDNA_ID_1620637_Annot_ID_162950 3000 nt of promoter + ATG
ttgtttttctaatatatatgtcatttgatatccatgtaattgaatacatatgataagagggaaaaaaattcttttttaatacttttcctttttctcatcaaacgccacttttttagactgaaagaggagattagggtgatgatgatgaaagtaaagaagaatctgagtttaggtagaagttgatggatgttgaactctactctactcgacgtgtcccaactatactaaagtgtctacaatcatggctctctaccacataaaagttaaaagtggtatatccaagaactaatttgatcagttcatgaaattagttcacgacatgttacatgtggataatgttcttccaaaatctgttcatgagatgaagaagctcttgaagctttttggttttagttatgatttgatttacacatgattgcatcctttatcgaaagatgtttgaggagtttgttagctgtccaagatatagtgcttcgagatggaagtaagataagcatactagagaggaaaagaaggggttcccgcaaaggttcagaggtatttttcgatctaaggatagatttaggaggatatttagattaaaaaggattgcttaggagttgtgttggcatttcaacaatgctagtgtagacggtccaatgcgacacccagttgattcattgacttggtctcaaataaaagataagttttcaaagtattctactaaaccaaggaaccttcgactcggcttttttacagataggatgaactcgttctctatgcagaaaaaagtattgtacatgatcgatgttgttagtcaactacaacatgttgccgactatgtgtatgaaggctgggaacatcatgatgactatgctcttccctagaccaactgcaccacacaacaacatagatgtgtatcttgcacctattatagatgatctaaatggtgtgtggaaagaatgtatagaggtttatgattcttatatgaaggagaattgcacacttagaactatattgttgtgggctattagtgattatcttgccttaggaacactggttagatgtatggttaaagggaaataggagtgtaacatatctggtaaggacacaccaacatgcatgttttattttgctttagtcaaattttgacaacacgactactggaagtgcacagttaatcgtctgtagtataatgggctttctaaacccattccaactctcatttagtatgatattgtcctctttgggcttatatgctcaagcccgcaaggatttgttattgggttccttcccaaaaggtctcatactagttggagttggacttggcttatatattagaaactctttttctaaactttcgatgtgggacctttggtttgtacccaacaatctccccttcaaaccaaagaccacgaacttggacctccttcttgaggcaccttcttatcgtgtcatgtttgagagattttcccacatcgatcatagcccaagccctaggtccagtgtttcaacctggctctgataccatttaatgggctttcaaagcccattccaactctcatttagtatgatattgtcctctttgggcttatatgctcaagcccacaaagatttgttattgggttccttcccaaaaggcctcatactagttggagttggacttggcttatatattagaaactctttttctaaactttcgatgtgggacctttggtttgtatccaacatagtatttatggatcgaattccattggaagagaagtaattcaaacaagtctgtcagaagagagtaaaactaggacaaatcaataaaagagggggaaagggttgttattgtgtcacagttgtaagtaagtgaagcaagtaaatagtaagtgatcaataagagacaaaagttggacattcaagggatcgtaggggttcaatgatcttcatgatctaatcatgtttatttccatgttttcgagcatataaaacacataaaattcagctactgaggaaaaatatataaacgcatatatacatatgtacacgtccacatactttcacgtttaggttttcgttattagggaagttggacttttaataggtttactgatatttgggtctcacgtaaagcagaccggctctttggaggtgcatgaggcgcatttgttctagatccaaattttttttggtaaatttaaggatctgattagtatggaaaagacctacaatttttttttttttagtatgaaaatgtcaattttaatgtgtttttaaaaaattagcataaaaagggtccaaatttttgttttatagtttagaaaaagattaatttttaaaatttgtacagggactataaatttattgagttggtagagacaaaaagcttaaagtttacacaaaggagaaaattatcataaacacaaacattatcaacttttctttgtttgatattaaatttttaatttataattttttattgttctaaaataatataaataagtaagtggtagtttgacaataatctctatcatctactcaaatgtgacaatggatactacaataatttactcaggtacataagtaatgacgaagtctgagtaaaatgtaatttgaaatcaaattttggctttctagaagcaaaactgaatcaaaattttgttcatgtgaaccaaaatctaaagtagctcccaaagagagaaaaaaatatcttgaaaacatgcgaagggacaaaagaaacacaaaatgacacgtgtcaatgttaggctaacgagatgaggttgctgtaacgtgtggccatcacacttctcttccttctttctttccctcacctctttctttcttcgtcctaatctccttcttcttcctccgatcactctatttaacgtcttcgacgaatccgaagctgaaaaatatctaacaatctatcttttgggtccctaaaaaagctccttcgtttatcttgttttctaagttatctttttgtatgagtttcaaagcttatcattatctcactcttcttccatagctatg

SEQ ID NO: 3310 - DNA, 3000 bp, Unknown
  misc_feature (1)..( 3000): cDNA_ID_1820210_gDNA_ID_1620637_Annot_ID_47395 3000 nt of promoter + ATG
tagtcgtttgcttttatctctattacggtttctctcggggttttcataaaggaaatatggtgtacagtatttttggtaatatagtgaggtggtcacatgtaatggattcaatccaccttcctccctcgtggggtttaattgtgtacataaaaatacactcttattataaaaaaaaacttaagttgtctaattattataccaccgaaaatggaacattaattgacaatgatgctttcaaaaaacaaaccttttactacaagataatattgaataatgtaactaaagtaaaacaataacaattgatcttgcaaagttgcaatgtgtttgtaatttttaatattgtactcactatcttcgagtctcttgactagtttttaatgggacattattttagacacgcaatatctataatcggcgaagcgtagtcaacataacattttcttaggtaagcaagtaaagctacaaaaagtcttgagaaataaatcaaaaggaggaaaaaagcatgaaaaccttctttatttcacctagtctcttttgcttttttctccttagctttcaagattctttgccatagccaattgaccattacatgctttggccttttcctcgatattttcctcttctccagtggcagtcctaccaaaaaattagaaacattcatagggggcaaaaccgtaacctaaccaaagaaaacctgaactgatagtgcatcttattcaaagccctactctgtcccatgtatatgtctcacactcttcaaagatgctcacataaaagggctctttagtaatttgatacctcgtgcaatatctgccacactttttttataagcaggtgtcccatttttttcttcaaaggctgaacaatctttgatgcgatgttttccaacaacatctttattataccattattagattaaagtgcgtgtgtggaaatttgaatatctctctctctcataattagctcatcaagctcctccttcattttcttattcgtactagatttctcttttgcctttttatttggtagagctctgctggttcatggatattgagccctgcttgaagttttggggggtgtttttttcttctttataattgcatggcaactacaattgatcaaaccagcatcaagtcattgcatttccatcaagtcatccgtttgatcatcacaatcatcttcttagctttcttatttctcattggccctacaagttccatgaatcatcaccttcatgaatcctcatctaagaacactatggctccttccaagaggttccttctacaaccttccactccatcttcatctactatgaaaatgcgtccaacagctcaccctagacgcagtggcacttcttcttcttcggcgaggaagaggaggagagagttcagagctgaagctcatgaggttccaagtggtccaaaccctatctccaactaggtgagcaaccggttttttgggtaaggtaatttaattaattaaatatttggggtgtttggagatgagttaatgtatattattaatattgaattttgtaatggatggagagaattgtcatggattcttaattatatatctatgtttcctttacgaatttcccttcttcgtttattgaaatcttttgatcttcgtcttctaagttttggaagttagcattgtatgagaaaaggagagacaaatacttttcacatgtgtatgtatccatctgtatataattccctcacatttctgttttatttcttttatatatttagtgatgcatgtatatataatatatctataattttaaaccaaatatatatatatatatatatatataaatggggacatacgaatgataatatgccaaaaatcaattggctgcttattatattagagcttattctattgggttactctcagagaaaaaaaaatagttgaacacaagaaaatttaaaatctacggtaaataatttaagaatgtggaatatacattatttcattttaacgacacttttatacttaacgatacaattttaagagtaaaaaatggtttgaatagttatatatcaaaataaatacatgtttagactaagttgtattctatggattattaatctcggtttaaggtggtttttgttaagtcatcggttattagagtttcacgtcaaaaaactgtgaagtggatgtttaagtggtgtgcatacaaatttttaacctatttgacctatttttactctttcttttttttaacctagaaaaaaactatttcattaaaattaaaaatagtttagacttacgatgtgaatattatacacaaatgatctcatgacaaaaaagtaaaaaaaaaaaaaaaaaactaaaacaataattcataaaaaaaattattccctatttttacttttcaagcaccaaggatgtagaatataatttacatcaaaagtttgaacccgaaattattcccatttgcgatctgaacaactagtgaagcccaattttggtaaaattgattgaattatttttaggtattcgtttcttttagcgatctattagacttaaacaagctaaacaaaaaacaatagagataacaaaaacatactaaaagaagaagtcaacattaattaggatatctggtaataattaagaatcgtaaattattattggaaaacgttagtaaagattctctgttctactaatatcctcaaccctaagttgttttctaaccaaaaaaaaaaaaaacagcctgctcacatctcatcatgaagttgtctttttagttcttgtttcatcgtcaaacatgtcttctttcttaagaaacatctgaatttaacaacaaaacataatcaactattaaagtctggataaataaataaataaaaacagggtttgtaggatctctggcatactttatgttgttcttgtgaaatccatcaagaaaattttcaaaatttattcttaaactaacaagagagatcctacaaaactaaattttagcttaggtttttggattctttagaaatg

SEQ ID NO: 3311 - DNA, 3000 bp, Unknown
  misc_feature (1)..( 3000): cDNA_ID_1820193_gDNA_ID_1620637_Annot_ID_47401 3000 nt of promoter + ATG
ttttttatattagttactgctatttgttctacgaaaactgaagcttgcgagaaaaatgcaatagtaatcataaacgatctcggtcctggtagaattctccaatatcattgtcgctacacaaaaaaagacttaggagtccaacacctaaacttccatgctattaaaaccattcatcttcaggacgagggaaaaaatataacaaaatggcattgtctctttaagcaagggcttaacatgaggtatcgtaattacgtagaagcatacagtcaaaatacagaggctcctcaatgtggtcaagtacgtgtatggactgccagaatgagtgggatatggtttaaaataagttataataatccatctggaagatatatacgaggttggaagtattgaaaacgggttctaatatttttgtaaaactgtttaaatttatgtaattcttcagctgcttatgacatgaacaaaagttataattcatgtcaattgtttttctaatatatatgtcatttgatatccatgtaattgaatacatatgataagagggaaaaaaattcttttttaatacttttcctttttctcatcaaacgccacttttttagactgaaagaggagattagggtgatgatgatgaaagtaaagaagaatctgagtttaggtagaagttgatggatgttgaactctactctactcgacgtgtcccaactatactaaagtgtctacaatcatggctctctaccacataaaagttaaaagtggtatatccaagaactaatttgatcagttcatgaaattagttcacgacatgttacatgtggataatgttcttccaaaatctgttcatgagatgaagaagctcttgaagctttttggttttagttatgatttgatttacacatgattgcatcctttatcgaaagatgtttgaggagtttgttagctgtccaagatatagtgcttcgagatggaagtaagataagcatactagagaggaaaagaaggggttcccgcaaaggttcagaggtatttttcgatctaaggatagatttaggaggatatttagattaaaaaggattgcttaggagttgtgttggcatttcaacaatgctagtgtagacggtccaatgcgacacccagttgattcattgacttggtctcaaataaaagataagttttcaaagtattctactaaaccaaggaaccttcgactcggcttttttacagataggatgaactcgttctctatgcagaaaaaagtattgtacatgatcgatgttgttagtcaactacaacatgttgccgactatgtgtatgaaggctgggaacatcatgatgactatgctcttccctagaccaactgcaccacacaacaacatagatgtgtatcttgcacctattatagatgatctaaatggtgtgtggaaagaatgtatagaggtttatgattcttatatgaaggagaattgcacacttagaactatattgttgtgggctattagtgattatcttgccttaggaacactggttagatgtatggttaaagggaaataggagtgtaacatatctggtaaggacacaccaacatgcatgttttattttgctttagtcaaattttgacaacacgactactggaagtgcacagttaatcgtctgtagtataatgggctttctaaacccattccaactctcatttagtatgatattgtcctctttgggcttatatgctcaagcccgcaaggatttgttattgggttccttcccaaaaggtctcatactagttggagttggacttggcttatatattagaaactctttttctaaactttcgatgtgggacctttggtttgtacccaacaatctccccttcaaaccaaagaccacgaacttggacctccttcttgaggcaccttcttatcgtgtcatgtttgagagattttcccacatcgatcatagcccaagccctaggtccagtgtttcaacctggctctgataccatttaatgggctttcaaagcccattccaactctcatttagtatgatattgtcctctttgggcttatatgctcaagcccacaaagatttgttattgggttccttcccaaaaggcctcatactagttggagttggacttggcttatatattagaaactctttttctaaactttcgatgtgggacctttggtttgtatccaacatagtatttatggatcgaattccattggaagagaagtaattcaaacaagtctgtcagaagagagtaaaactaggacaaatcaataaaagagggggaaagggttgttattgtgtcacagttgtaagtaagtgaagcaagtaaatagtaagtgatcaataagagacaaaagttggacattcaagggatcgtaggggttcaatgatcttcatgatctaatcatgtttatttccatgttttcgagcatataaaacacataaaattcagctactgaggaaaaatatataaacgcatatatacatatgtacacgtccacatactttcacgtttaggttttcgttattagggaagttggacttttaataggtttactgatatttgggtctcacgtaaagcagaccggctctttggaggtgcatgaggcgcatttgttctagatccaaattttttttggtaaatttaaggatctgattagtatggaaaagacctacaatttttttttttttagtatgaaaatgtcaattttaatgtgtttttaaaaaattagcataaaaagggtccaaatttttgttttatagtttagaaaaagattaatttttaaaatttgtacagggactataaatttattgagttggtagagacaaaaagcttaaagtttacacaaaggagaaaattatcataaacacaaacattatcaacttttctttgtttgatattaaatttttaatttataattttttattgttctaaaataatataaataagtaagtggtagtttgacaataatctctatcatctactcaaatgtgacaatg

SEQ ID NO: 3312 - DNA, 3000 bp, Unknown
  misc_feature (1)..( 3000): cDNA_ID_1820368_gDNA_ID_1620639_Annot_ID_47435 3000 nt of promoter + ATG
atccaagcgctattttgtaaggcgagaatggaaaaaccagacgtcctaagttatgtgcgagtttacatcatagcctaggactgaccctttaccacgcttgtgcacaatgagacatttactttatgtctttatcacatcctttttcagactacattgtctattttgaacttgaagcaaattttcttcccgtttttgtggcccaaaaaccggttaaaaccaacattacaatggcataacgtataaactaaaaggctcttcgtcttaatattttagttgataactcgaatagattatacagattgtattgggtgggctgggttccattttggtggcccgtatgagcaataattatattacaatgtattatttttttttatacttgtctgttgttatcaactaaaatactttgcatttgatccatcgtgttactttcaaatatgggtccatatcaaaagctggttctccatgacacagtgcagtgaacaatcttgtacactcttattctacaaccaaactcatgaatttttttttctattttcagggtaaggtcctcgatttttaaagaatggccacggaattgatcctattacgatcatctttgattataatctgattgtcaccaagaatccgatcgtcaccactatagttgtgcatacgatattaacacttgatgaaagtgaatttctcattaattataaaagaaacatacaagatgtatttatagttacatgagagtagtgaataacataagctaaaggagacttatatcaattctacatctctatatattattaatacacccccctcaactcttagaatcaaaaccttcttgtggagtgaagagagttgacactgacattcgtccaagcaatgaatgaaaaggacctgggggcagaggtttcttcaggatatccgcaagctggttagctgttgaaacatgaaaaaccttgtgaaaacctagctttatacgatcatgcgtcttgtgacaatctatctctatgtacttggtcctttcatgaaagactggattatttgcaatatgcatagcagatttgttgtcacacatcaacttggcttgagttgtgattgtaatatgtagatcttgaagaagctgattcaaccaaaccatttcatcagatgccactgccatggctctgtactcagcttctgtactactactacttgccacattctgcttctttgacttccaagaaatcagagagttgccaagaatgaaattcagctccagtgttgagacgatctgatacaagaaccaacccagcatgatccgagctatgaagaaagaacgaattatcatattgatctgtcgacattgttgtaattttgaaccaaagatgatgttgaacgaaagaatcgatgaatgatgatagaatcaatgatgaatcaaagaatcgaagaaccgaagtatcaatagatgattgaattgaagaaaacgaagatgaagatgatagcgaaagtaacaatttcttcgatttggtggatgaaagaaatgatgaagaaaatggagcatcaatggcttgattctctcatcgtacaataaggatgatgaattttggagaagatatgatgatgaagatgaagatatgaagatgaatcgaagaaattgttgaaaattgatgatgattttcccagaaatgtttttgttatgattttcctggaaaagaatgagagaatgagataaaagaaacatacaagatgtatttatagttacatgagagtagtgaataacataagctaaaagagacttatatcaattctacatctctatatattaatatacgagacgagtgttgcgcaagaaaggtctcctcataagttgcgtgttctactgcttgcatacacatctgaatcttgctagagatttatctggatattaggggttttagagaaattttatacaaatcaaatgtccattgggcctaagatcccggcccattttaaactctggatctaactctaacatttttttttatttttttttggtcaactaactctaacattattatcacattattttcttatctgaatacaaattgccacatgtctcatcgaattatttcagataaatgattatgaacaatgaactaattctaaaccgagaattaagaataaggatcacagttttcgaaccggagggagttacagaaatactatcgtagtagacagaattcatgacaaatacaaaaagatactaaaatttttgatccccacagtcacgtgcattgtagggctcgaaggcttaatgggtcccatagctccggtccggctcgaggtttctgtgtcgcacgtgtgtggcacacacaccagggcacacaaatctctggtacgtaacatatacatgattcccatgttgacctgactggagcagaaggtgctgtgtagtgtggaccattgaatctgagccgttcaaacttttaacctcatcgtcacattttatgaaccacaattaccagagaaacccaaatggcatctttttttttttaaccaatcattcatcaaccattttcttcttcgacatgttttgtccgttggattaaaccacacagattgtgatcttacggcgaagaaaccaaactcaaagacattattatcccttttccaccgaacattgtcagatgaacaaagtagttttttttttttttaataataaaacttcccaacttcaaaatcagtacgtgaggtcatagattctcacctccttttcaccttttgttttccttattatgccaaattagttacaaacatacaatcacatcaaaatttattttgactaatatggttagtccataatatacgtaacaaatcatataaatacgaaactttctctattaaaattatttaacttttgcctctcttttctcctcgtgaaggaaaattctttagtcattttttctctcctcgagaattacgcaaacacaacaaaaacccagacattgaaaagtaaaaaacaaaaacagagaaagtgggagatagaagatg

SEQ ID NO: 3313 - DNA, 3000 bp, Unknown
  misc_feature (1)..( 3000): cDNA_ID_1820358_gDNA_ID_1620639_Annot_ID_47438 3000 nt of promoter + ATG
taagagatgaatgatcattcatttacacgaaaatcatatgattttgagtctatctaagaactagaagtgtcaggcaaacccaaactgcgtgttgattgtgacaccaagaggagggcacttgggatgggtggcaggtgaagaagctcccaacggagctccttggaccgaccaagtggttatggagtttctgcaacatgtagagaatcgtgaaaccattaacggggagagatctttcgaggatgtccatgatcagattcaagtctaattctgtttgtccattcttcacttggagtggtatgtttcacttgtacactgttgttgcgcacaagaataataaacatgtaaagaatcatagtatataagacttcttgcatttcctcctaatatagatgatactatcttcaagttccttagttacattcatgacctcataccatacgtttccacttaccacaacgaattcacattatgtatatatttctaaacccttagataaccgcagatatgtgggatcatattgaggctttatcaaagggttatagctcccagttcttcatagaatcgaacctgtatggaagagacgagagattagtttcctcgacttcagctgcttagagcatccacaacggttaggttctcacaaaaatgtcctttattgataaaaaatattatttttatcatagtttttttagttagttaaatttaaagttattagttaaatctgaccaataaatataaaacatctggcaagtaaaatcttttaaagtagagagacgtctctctcccaagagatttcagaaacaattgtttcatgagtttctctctctcttctccttttcagaattttattattattttaattgttaaaattgatgagagaaccctgcgtgttggagatggtcttagaatctcctccaaaaagctttctccattgtagaatttagaccacaagatcaaaatgttatggtgaagatggagatttgatagtcttaagtgatgaagaataaatgatctctcagctaaactggataaagatatgatcagtaaactaaagcatgcatggtttgaatttgagtcttggttaccgttggtttaattctggttctctcgataaaaggaaccgagttatttttgagtttgttcagaggtcgtaccagagtagtaatatcaaagctttgaacatcttcaagatcaactgatcaagcatggtgttcttcttgtaattctgccgatgcatagagtttaaatttgtatgttcttgtgtattttaaagatacataaaaacagttatagttatgttaaatattcagatatacatacatattaagtataggactgagcaacaaatccaaaacgtttcgctttcaagcttagggatagaattggttaccggtcacttttatgatcaagaaattgttagttcttggaagttttctagagaagaaaaaaacaacacgaatattatgaaaaaactatatagaaacatttcatggtttatttagcttagcttcgacttcattattgttatgttcatgtgggaaattatttattaatttcgttgcaataaaacgaaaaaataaaaagaagtggaacacatggtatcaactatcatcaagagtccttatgcttttttcgtgggtctagcttccagcaaatgccatcaaatcttctttgtcatatatttccatttgtttcagcatatgaagtataacataaattagataaaatacgacttttcctttttagaagtataatatatatagtattatttttcttttgcaagtatgatagtattcttttttcctgattttgttttagtttagcttcaagtctctctaactatgaatgagaattccaacgtaccatttttatgacaatctctaaatgttttgctaacctaaagttgtactcatatattcattgagaaatatatgtgatgtatgtccctaaaatttaattataaccaactctatatgcgtagttttgttcaaccagaaaggtaagtctatatcatagtatgataataaactatacaaaataatactataactacccaaccaaccccctaaatttatggagctcacaatctcaataaattaacaataaaaattcgtacgactaacaccaattatggaatattttatatacttcaattaaaagaaatgagattttaacctatatagccttttgtagaagaagaaaaacagctataggctatatatgttccattaattaatgatctcccaatattaatctcctaattaaccaaattttaatccaaattaaatgcatatcatgtgctttatgtaacacaaatctacaagaaagtgatggtttgttttataagcattactcaagaatctcaaaactcacaaaagaaagagaagaactgtccccacatgaacataaacaaacacacatcaactttaacatttcaaaattcctgatttattctcttttaatcatatactaataataaattttcaaaacattggaggatgagagagagaaatggacatggcgtggctgtctggtcactgagaaataaagtaatgctttttaaagaagaatatttttgttcaacaaaaaaggcccacaaattacatgtaatcatcaaaatcatgcgaagagagagagagagagaagagaggagacaaaggtaaagtagaagataaaggaatcgtagagagacaaaggccatttgatgcatctctttctttgttctttatagttttggcttttctcttcttttcaaaaatctcttataatcacattattgttactataaactttgattctttaaacaccattattacctctccaatcattcattctacacacagctgtttttgattcatctacaaatttctgattttttttctagggttcttgtttttccccccaaattgacttgttctcctctctgtttaggtttgtgtctctttaatggtgtgtgaaaggtgaaagctttaagcttttgtgtgtgttttaacaacaatg

SEQ ID NO: 3314 - DNA, 3000 bp, Unknown
  misc_feature (1)..( 3000): cDNA_ID_2105726_gDNA_ID_1620639_Annot_ID_162991 3000 nt of promoter + ATG
atcattaaaaaaaaggaatttttgtaagaatttctaaaaataaatgactaattttgttgttcaattggttttagcctttctttttattctaatttttgtgtggatatagttaaatttagggagttcgcttatatttattactccctctgtttctaaatatttgtactttaaggtttttgcacacaaattaagaaaacatataaatctcatttaatttatctctttcttataaaaacatcattaattacaactaatccaaccaataaaaaaatatgatgtaaaatataattggttaaaaactattaaatacatttaatgtttgcatagaaaaatgaaaataacacttatattgaaaaaaatgaaaaacctttaaactacacttaattaggaacagaggaagtatgaatgttgacaacaaaagggaaaaactgaattgttacaacaattatgaagtattttaccttgttcatgatttcttatatattcatatcaatatttgttttcagtcacattcacggtaaaaaataaaagaaagatttttatttattttgtattggtttctcataaaaattttaatgtattgattatacttcaaaaggttaactaacaattgttttttgtggacaaattttttaatctgcatttttctttggttgatataaaatattagatgtggaagctcgcaaccggatctgtagaacctcggagaaatactatcgcgaattttgcggccatgcaggaaacgacgattgcctttcaaaatcaaccaaaaaacctaaaccatttaaatgtgtttgccatgataataggagtcagaatataacttcaattaatgatcgatataataactgcatatgtaccttttattgctaagtcttaataaacaaaatagtaactactagatattaatccgcggtttaccactgcgagacgatatttattaaataagaatttcaaattttaagttgtatttttttttatattgtttattttgtttagttttttttttttttttttttttggcaaaattttgtttagtgtttaagattgtatatttttatttgattttgttaatttcacctatagcacacaatcatgtattaatatcaatacaaatccatcaattctaagattttatccgtggtataaagtttaaatgtttataatgtataaatttcttataaatgttggacattcagttgagaaagacatcatatttaccaaatctaaacaatctgtaaaaaatgttacttcttaaatgtcggcatcattcatacacttcatcgcccctgaaaaaagtttcgacttctatatagagtggagataaacttctacgcaaactagtagctcctataattggcgactccccatttaataaggtgcaaaaacatcgtaatcggttttaaaattgatagcttaattctttctattttctgaaaaaaaaatctttaggtcatcatcaatgtctgccaatactgtacttggaagattgagtttgacagtgtgatgaacgcatcttgctcttgattaaatatattttacttccaaaaacgacacacagttttcatctcctatgataagccatgccatggtatgcgtcaatcgtcactctgcccattgtatactaaatttctttctttccatgttctaaagtttttttttttttttttgtcgttctttctttctttccatgtcctaaagtattttttattttttggaattacgagaaagaaccaaaaaaaacttggctaatgcaaatctttgatgtgaccacggtagtttccataccttgcgaccgtatatctgtatttatcgccacaatcgaggataaatatgaatattttacacataactctaatagatctcccaaattgtatataaaaaaagaaaactccgatagatctagtttagcttaaaaaattgatatgattctttacacaaaacggtaacaaagaatttagacctccatatttaatttatatatgtatgcccacataaagcaacattgttctaaaacgctgaaagtgaaacatttaaatattcttccgaataaatcgacgtgtacacgacattgtcaccgttgatctattattgaagcaatatttaattcctccgtaaaacattataactcatccgtaaagaccgtgaaacattataacttagcggtaatatgtaaatttgttgtgaaataataacatgaaaagaaaccgaaaagttcctcttgataacttttttttctttttaataatgtagattaatataattttcgttaattatgttttaatgaaaaagattaattaaacaaactaatcaaatgtgttaattgtaatatacacaatgatacaaaaaatatgaaataagtttttaaaaatatgtgatattccaacaatattccaacttttctataacatcaggtaaatatttcttcaccttttcatgtcaacattttacaagagaagcataaaacaaaacaaaaaatcctctcggcaaccatatgccttttaaactaatgaggatttgtacttttttttttttttttttttttgggcacaaactaatgaggatttgtacaaaagctaaatgaaaagagctacaaaactaagcccatagacatatatctcatgaagccactccagatcacctgatgctacatcaaactaagaatggttttaattaatatatgggcctcagctgaggaaacaaaagcccattaatttgcttcaatattggtttacccgtttattctacatgccacgtggaagaatatgagtggtcacgatattataaaatgcgtcaaggtaaacaacaaataacaaactcgttttcgagcaaaaaaactttgaagattgatttgaagaagaaagctctctctcaggttcttgttctcaaccagacattgatttcttcgatttgcatatttcccttcttcgtcttacgaattttacttcctttagcgatggatttgatactacgttgacttttatcttccttttggaaatg

SEQ ID NO: 3315 - DNA, 3000 bp, Unknown
  misc_feature (1)..( 3000): cDNA_ID_2169105_gDNA_ID_1620639_Annot_ID_162984 3000 nt of promoter + ATG
ccacaacaaaatctgaatttggacatcatttatcatttatagatcttaacttctcgtcgtttttgttacattctcaaaaatagcaagcagttccgtccgttacccaattacaattcacaggcccacgttagactactgagcccatccacgcaacattccacgctcattaaacaaacatgtttggatcaagacttggataagcttttgttacatgttctctgacttattcaggcaagttttttcgaagctaacggccacgccacccggaaacagacttggggacaagtgaaatcgaatttgaggcagcttctaatctgcacaatgccgaaagtgcaactgtttatttccacaccacaaatgcagaaaacagtagactgattgagagagaaggattagggaactactttgatatttcttcaacagccttcatgacttcagcagaactagtttccagtacttgtcctccaaatacaatctcatctaacaccgcgtgcatctgcaatgaaggaaagaaagaagaaggcataaagctatattattgacacgcttttgtttcatgtagctatctaaaagatccaaccaatctgcagcagcaaattctgaaaataatatcaactacactgcaggacaaactgttctgtgtaataagattaccttgctgtagttgaacacaatgtcgagttcgcagacattgctgaagcatttgtccagtgtttcaacaagaactgccaatgcaagaaactaactttaaatcatcatacaatgagaatacattttcaaagcgttaagcaaaaagaatttacgagcagaggaatagacaatgattcatatgtaacatcagtcgatggcatgctaagtcagtctctgtattcacaaaaacgaagaactaatttgatctaagagaatctctactctcgactgaacccaataccaatccaaaaatactcaacacccagttctcttttaaacacatcctatgcagaccagctgagctcgcacaccactcatatgcatttgtactagattcacggcaacaagctttaataaaagagccaagacactgcacaaactctactattcaagactctgattccaaattccctctttctatatatagtcaagctaaacggttaaagatgttcaaaacaagctacatctatgaaacttttctcattccaaagcacaaaaattgaaaatggaaaaaggttttacaccatgccatttcagattatattgcaatctaagaaccatagtgattaaaaacggaccttgaatgagatcaagcatagcaagctcattttctgaaccatcaaatacaagaacaaaatagagtgtagcataatgcttgtatacaagccgcgagtcctgcaaacacactaaataataagtgtccaaagcaacgtttttttttgttaaactaagtattgtggttatatagcataaacaatgaagacgccattaccggtccaaacaatgattcgatctccagaaaattgcttacgttctcaggtctactgcacaatactgtaaattataaacaaaacaaaaaaacaaaatttcagctcaagtttcacgatcgacccagatcttagcgatacagattatgaaattgttaggtatcgtaagatgcagaaagtgattgagaacctgaaaacacgccgcgaataagctcctgctgcttctccacaggctgaaatccaaaaaaaacaaaatcaaaaacccaattttacaaaatcggtcactttgatcgaagaaaccgaaattgaaaaacatatctcaacaagcatcgtaccaagtaatcgtagaatttagctagacgtggtttgccttgtgtgttcatcatcatcactgccttaatcatcttccacctctcctctctttctttcttcgtctctctcgctgacaaactctgaatctcacattttcaaaccctctctctatcttagaggcttcttcaattacatttgatgacgtcatcaccaataacaaccctccacgtgtaaccaaatttgagtgccctaataaatagtagcggggccgtcgtgaggattggtcacaatcaatggctctccgagaagacgacgacgatgttaacatcggagaaaaagtagtcgacgtagaatcggagcttcagaagtaccggatcaattcgatcgaatcaacggttgtgattcgtcagttaccgacacaaggcattgccttcaagctctggatacctgcaacaactctcgtcacgcttttagataactaccgtcgtgacccaaacattagtcctctcaatcgcaccttctcgagttttcaatccgacggttcagattcttcttctccgattaacatcgtcgagctcggatctggaacgggaatcgtcggtatcgcagcggctgcgacactaggtgctaatgtcacggtgacggatctcccaaacgtaatcgagaatctcaaattcaacgccgacgcaaacgctcaagtcgtggctaagttcggtgggaaagtccacgtggcgtctcttcgttggggcgaaatcgatgacgtggaaagtttgggtcaaaacgttgacttgattctagcgtctgacgtggtttatcacgttcatctttatgaacctctcctcaaaacgctgcgttttctgctcttagaaggatcatccgagagagtgtttcttatggctcacctcaagagatggaagaaagaatcgatttttttcaagaaagctcggagattcttcgatgttgatgttatacattgtgatgatcctcaagaaggtgctagaatcggagttgtagtttaccgttttgcaccgaaaaatcaaaacctttaagaagattttgtcaaatgttgataaatgaaatttgcttctttgttaaataagaaacactttatgagaaacatttaattatgtacactttataaatgttggagcttcgaacccgtgaccttgtaagcagagcacttctgattaaaatacagagaacgaagactgaggaaagagagaagaaaatg

SEQ ID NO: 3316 - DNA, 3000 bp, Unknown
  misc_feature (1)..( 3000): cDNA_ID_2169101_gDNA_ID_1620639_Annot_ID_162983 3000 nt of promoter + ATG
ttgataaatgaaatttgcttctttgttaaataagaaacactttatgagaaacatttaattatgtacactttataaatgttggagcttcgaacccgtgaccttgtaagcagagcacttctgattaaaatacagagaacgaagactgaggaaagagagaagaaaatgactctgggactgataaacgcgaatccagtggtgcaagctaagaaggaagggcttgttcgtagagaagatcaatatagagatgatggtgttgatcctcttgaaatatatgatatcctttttctattttgagatcaattttgttttggattttgttctttttggggggtttaatgtatatttttggaatctttgacgaaaatggacaaagtatgtaagagatataagagatccagaacacccttatactttggagcagctaagggttgtctctgaagaatctgttactgtcgatgacaagctcgatcgcatcctgtgagtttatattaaacatcattctttgttgaatcgatttttagagactatcagaagaaagttccaatttttatctctgtattggtaactaatgttgaggcctctttttgtggttacttgcatgatctttaacaataagctggtttgggttatgtgatgaactcaggataacgtttacaccgacgattcagcattgtagtatggcaaatataattggtctgtgtctgagagctaagcttaaagaatgtttgcaacttcattacaaggtcatcttgcttttaaaaaactcttttctgattaagacaaatactcaagatcacttgttagttgttacatatgtgtgattgcttctgttttgttttacttatgtttaggttgatatcagagtgtctccgggttctcacgctgatgaagtttcaggtgaggaagtcttatgtttactagaccatctcttcgcaatggtttaagttcatatatgctttctataaaccttaactaatatagagattgcaaattgaatggatgatttgtgtaaattataaacattgctcttgtccttggtttgatagattttagtttctaattaacatcactgcaaaatctggttttctatatttgtatttttgggaaagttgatgtcttaagctctgaactttaatactcattgggatcatttttgtattgcagttaacaaacaactgaatgataaagaaagagtggtggctgcattggagaatcctaatctccgtcagctcgtggatgagtgtatctactccgatgagatatgatcacatcatttacttctactctcttgtacaggcttcatatcatgggtttatataatgccttagagagcgctctttaatctcagaatacaaattaagggtgtgttcaaatgttgtattctacttgataatgatacagaatctcagaatacacattttaagggtcttctacttctccttcttcttcaaagttcaactgctgcaatgttttagcatcagcaaaagttagtaaatcaaattcttttaattgtatagtatttctgttgaagttcactctttcgataagaacgctaggtaccatcagtttcaccaaaactctaaaaatcaacttgagatatgaaaacttgcctttgactgctccttcaccatggtaacaggataaattttattaagatctctgatgaacattaatttcctgctaataggcctcttgactgtgttcaactcctgcttgataaaccataaaattgggaagtgaaaatgggaagaacttgtgctcaaatggagttagacaatgacatttgtatcaatataatcgaacagcagatgttttagagatttttttcttgtttctaacttttctatataagctttaaaatgtttttgttttaaaataagcataatactacttcacttgcagaaccaagcaaccaaccataataagtataaactcattatttaaaatacttaacatgctaatggagatataaatatagtacatatagttctacaatttaaaactactaatgccaatatagtgtggtcaacaatgaaccaaatcttgatgttgtacaaacttctttgtaaagttgttaacaaaacaggcaatgtacaaggcaaactcttccgaccatagattttctattctgacataaatatcaatgtcttgtctacattaatcatacatatccctgtcttcgtcatgtagattttgttttatatcactgaggctactttggtggttgggggtaaaaacattcagttggccgtttgtttatgtggcaatataatatcttgtttttaatcaacgagttagtttgacttaaccattggttagtctaattgtttgtcatctaaagaatgagtacaacatttgttaggttaactctctcaaatgaattcttatacaaattgtaacatgcatagagataactcacaaaagggtttgatagaaagaagaagaaatgaatgactttgaaagcatgattgattttgatacattcatatatatcttaaattatattattgttctgtcccaacaaattttcaaagcatgattgaggcattttaaatcatcattatatatacatacaaaaaaataataaattttgggccaccatatctttgttatccgcattaaaaccataattggttgaagatttttatagtgttttttttaaaaaatactctaaccaaagattagttagaatcattatgtattcacaaataagaagtttataaagcaaaatttggagggagtttattaacaaatgagtgcgactttgcctcttttcaatgcccaatttcttgagattctggctgttctgcatccaaatattaaacaatcaattccttttataaaaagcaaaagacagaaatatttattattaagctaaagaattgatcaaaaaactcgattcacttttctcaaaaacccgaatataatctcattcccaatagcttccacttccatcgagagattttctttctttgtttttttctgtgattttctccaatg

SEQ ID NO: 3317 - DNA, 3000 bp, Unknown
  misc_feature (1)..( 3000): cDNA_ID_1808168_gDNA_ID_1620639_Annot_ID_162981 3000 nt of promoter + ATG
ggtggcgttagtcaattccgatatggaagagctcaaggtcgctgcgaagaaactgtttagcgatgtttcgaagcttggtggattaggcttcggtgtttcttttctcaaattcctcgcttctttcgctgccatgtgagtttttcaagtcgccatctctgatttcgtgtctcgtcgatttattttgaatttgatttgattttctcgtgggtttttcgataagtcgactactgtgtaatctcgtacatgttgaattcgaaaaaatctgtttatttctgttaatttgttgacatttgcagtaaccctattgtttctagcaatagcatctctgattggttgaaactatagaattgatcagtgatcagtgagcacaaacatgataagggtgtgagagtgtctttgtttcttttactcaatttagaaaagctttctggttattcatggtttcctactttccttaacgtttttgttttggtatttttgatgcagttacttgttaattttggatcgtaccaattggaaaaccaagatgcttacatcactcctaataccatacatcttccttagccttcctagtgtcattttcaactttctcaggtaacaatcttttcttgtcaaaagacacaactattcttaaaactgtagtctatatactggactggtgtaagtggcatttttcgatttttgttatcagtggagatgttgggaaatggattgctttcgttgcggttgttctcagacttttcttccctaagcatttcccaggtgatgacatcttcatatcattcttgatttgtatctttgtattgttgtcatacaatcgctgaagatgtctcgagaatctttaaaatgctttgaggcaaatctatactaacattcaagtcagtgtaattgctgaaacaaaattaaagtctcacacttttgttattgtggttttcaaaatgtgcagattggcttgagatgccaggttctctgatcctgctactggtagtttctccacacttccttgctcaccatatacgtggaacctggataggcactgtaatcagccttttcattggatgttaccttcttcaagaacatattcgagcatcgggtggattcaggaactcattcacacagccccgtggagtatcaaacactttagggatcattcttcttttggtctaccctgtctgggctctaatcgtccgtgtcatgtaatccacattcctctttcatcgacaagttgtttcttgctcggctgctccaataaactgcgtgaaacatcgagcagagcaagtctctatggtgttcctttcttctgattatgttgcatacccaaatactacctcaagctcaatcaatgttctatgtataaaaaaatctcatttttcaactatttgtttgtcctactataagaaaaagttctttattgaatgattgtaaaaaaaaaactagccttcatgagttcatgttgtttgcctagtgttgaaaaattactcgtgacttccgtttcgagtattcacattcgcaatacgtggcgttttcaataggaagaaaactacacgctgtttgaattttataactagacttcatgtcgtctaaaagtaggggggcggcttaaaaccctaaccctagtttggctgactccttataaatacttctctctccgccgtatataatcttaagtcatctctgatctccgagtgcaactcaaatttgaatctctggcttcttaattctttctgatatttcgttttattggttaatctgttttcgatttcatatcattagtctagtatttgttcttctttttgtgtttgattatcttagaaaaaagggtttctcagtgatgaatacacagatgacgagtccgatgaaatccattcattaaatcatggggacaaacgaggcatttgtctgagaggaatccttttatacttttttcaatcttattagttttttctgctaaatgtttttcaaagttgtttgattcgtgattctcgaaaattgaagaaaaaaaggcatgatgaggattgttttattgtcatctgattctcatgatgaatatatacctcctactcattctgagtgccttttcttaatttcttaccatgaaacttcgttgagtctataaactttattcgttctatagtctaaattattgaattggatacttatcaattgatcgaaatctagaagtttgactgtctcagcagtttttgtttttaaaactaggaaatttttgataatctgtgcaagctgggtcggattcatagctactattgtgttcttggttctggaaattataactgttatgttactattgtggatgtgaggacggcttttcatggatgtactctcaattctaactatttgacatggttgcgtaagaatcaggagatgaatgtactgaacctaacagataaacaactgatctttagagaagcactgccctagatgtgtatacctcgaagtcaatcgatgatacttctctgagaaatcacttgtaaactttgattttgtattcaagaatcttaatataataaaataaactctttattcattcgttgtgtcttctttctcataaacaaccttcatcatcactattgaaatcttaatattaatgatatgcataagtgatttcattctgcgattaaaatgttgtgatatgagaagcataataaccgaacatttagttatcctttctctggtgtattccagaccggtcttgaaccgtttctagaaccaaactatttattcaactttatatattccagtggaattgataacattataatcacgtcatcaatactgattgggacagtatctctatttccacatcagctttagacacgtggctattgatcgaccatatagtcatgaaaacaatccaatggaaaattttcaaaacttatccgaccttatcttagcgaaacaaaatctctcctctgattattactactcaacttcgcattatcactcaaacaaacatattgacatctgagtcttgtcatcatg

SEQ ID NO: 3318 - DNA, 3000 bp, Unknown; identical to SEQ ID NO: 3313
  misc_feature (1)..( 3000): cDNA_ID_3071040_gDNA_ID_1620639_Annot_ID_162976 3000 nt of promoter + ATG

SEQ ID NO: 3319 - DNA, 3000 bp, Unknown; identical to SEQ ID NO: 3312
  misc_feature (1)..( 3000): cDNA_ID_1820368_gDNA_ID_1620639_Annot_ID_162972 3000 nt of promoter + ATG

SEQ ID NO: 3320 - DNA, 3000 bp, Unknown; identical to SEQ ID NO: 3317
  misc_feature (1)..( 3000): cDNA_ID_1808168_gDNA_ID_1620639_Annot_ID_47442 3000 nt of promoter + ATG

SEQ ID NO: 3321 - DNA, 3000 bp, Unknown
  misc_feature (1)..( 3000): cDNA_ID_1820347_gDNA_ID_1620639_Annot_ID_47444 3000 nt of promoter + ATG
tgttaaataagaaacactttatgagaaacatttaattatgtacactttataaatgttggagcttcgaacccgtgaccttgtaagcagagcacttctgattaaaatacagagaacgaagactgaggaaagagagaagaaaatgactctgggactgataaacgcgaatccagtggtgcaagctaagaaggaagggcttgttcgtagagaagatcaatatagagatgatggtgttgatcctcttgaaatatatgatatcctttttctattttgagatcaattttgttttggattttgttctttttggggggtttaatgtatatttttggaatctttgacgaaaatggacaaagtatgtaagagatataagagatccagaacacccttatactttggagcagctaagggttgtctctgaagaatctgttactgtcgatgacaagctcgatcgcatcctgtgagtttatattaaacatcattctttgttgaatcgatttttagagactatcagaagaaagttccaatttttatctctgtattggtaactaatgttgaggcctctttttgtggttacttgcatgatctttaacaataagctggtttgggttatgtgatgaactcaggataacgtttacaccgacgattcagcattgtagtatggcaaatataattggtctgtgtctgagagctaagcttaaagaatgtttgcaacttcattacaaggtcatcttgcttttaaaaaactcttttctgattaagacaaatactcaagatcacttgttagttgttacatatgtgtgattgcttctgttttgttttacttatgtttaggttgatatcagagtgtctccgggttctcacgctgatgaagtttcaggtgaggaagtcttatgtttactagaccatctcttcgcaatggtttaagttcatatatgctttctataaaccttaactaatatagagattgcaaattgaatggatgatttgtgtaaattataaacattgctcttgtccttggtttgatagattttagtttctaattaacatcactgcaaaatctggttttctatatttgtatttttgggaaagttgatgtcttaagctctgaactttaatactcattgggatcatttttgtattgcagttaacaaacaactgaatgataaagaaagagtggtggctgcattggagaatcctaatctccgtcagctcgtggatgagtgtatctactccgatgagatatgatcacatcatttacttctactctcttgtacaggcttcatatcatgggtttatataatgccttagagagcgctctttaatctcagaatacaaattaagggtgtgttcaaatgttgtattctacttgataatgatacagaatctcagaatacacattttaagggtcttctacttctccttcttcttcaaagttcaactgctgcaatgttttagcatcagcaaaagttagtaaatcaaattcttttaattgtatagtatttctgttgaagttcactctttcgataagaacgctaggtaccatcagtttcaccaaaactctaaaaatcaacttgagatatgaaaacttgcctttgactgctccttcaccatggtaacaggataaattttattaagatctctgatgaacattaatttcctgctaataggcctcttgactgtgttcaactcctgcttgataaaccataaaattgggaagtgaaaatgggaagaacttgtgctcaaatggagttagacaatgacatttgtatcaatataatcgaacagcagatgttttagagatttttttcttgtttctaacttttctatataagctttaaaatgtttttgttttaaaataagcataatactacttcacttgcagaaccaagcaaccaaccataataagtataaactcattatttaaaatacttaacatgctaatggagatataaatatagtacatatagttctacaatttaaaactactaatgccaatatagtgtggtcaacaatgaaccaaatcttgatgttgtacaaacttctttgtaaagttgttaacaaaacaggcaatgtacaaggcaaactcttccgaccatagattttctattctgacataaatatcaatgtcttgtctacattaatcatacatatccctgtcttcgtcatgtagattttgttttatatcactgaggctactttggtggttgggggtaaaaacattcagttggccgtttgtttatgtggcaatataatatcttgtttttaatcaacgagttagtttgacttaaccattggttagtctaattgtttgtcatctaaagaatgagtacaacatttgttaggttaactctctcaaatgaattcttatacaaattgtaacatgcatagagataactcacaaaagggtttgatagaaagaagaagaaatgaatgactttgaaagcatgattgattttgatacattcatatatatcttaaattatattattgttctgtcccaacaaattttcaaagcatgattgaggcattttaaatcatcattatatatacatacaaaaaaataataaattttgggccaccatatctttgttatccgcattaaaaccataattggttgaagatttttatagtgttttttttaaaaaatactctaaccaaagattagttagaatcattatgtattcacaaataagaagtttataaagcaaaatttggagggagtttattaacaaatgagtgcgactttgcctcttttcaatgcccaatttcttgagattctggctgttctgcatccaaatattaaacaatcaattccttttataaaaagcaaaagacagaaatatttattattaagctaaagaattgatcaaaaaactcgattcacttttctcaaaaacccgaatataatctcattcccaatagcttccacttccatcgagagattttctttctttgtttttttctgtgattttctccaatggctaactccaagaagcaagcatg

SEQ ID NO: 3322 - DNA, 3000 bp, Unknown
  misc_feature (1)..( 3000): cDNA_ID_2105726_gDNA_ID_1620639_Annot_ID_47452 3000 nt of promoter + ATG
taaatatttgtactttaaggtttttgcacacaaattaagaaaacatataaatctcatttaatttatctctttcttataaaaacatcattaattacaactaatccaaccaataaaaaaatatgatgtaaaatataattggttaaaaactattaaatacatttaatgtttgcatagaaaaatgaaaataacacttatattgaaaaaaatgaaaaacctttaaactacacttaattaggaacagaggaagtatgaatgttgacaacaaaagggaaaaactgaattgttacaacaattatgaagtattttaccttgttcatgatttcttatatattcatatcaatatttgttttcagtcacattcacggtaaaaaataaaagaaagatttttatttattttgtattggtttctcataaaaattttaatgtattgattatacttcaaaaggttaactaacaattgttttttgtggacaaattttttaatctgcatttttctttggttgatataaaatattagatgtggaagctcgcaaccggatctgtagaacctcggagaaatactatcgcgaattttgcggccatgcaggaaacgacgattgcctttcaaaatcaaccaaaaaacctaaaccatttaaatgtgtttgccatgataataggagtcagaatataacttcaattaatgatcgatataataactgcatatgtaccttttattgctaagtcttaataaacaaaatagtaactactagatattaatccgcggtttaccactgcgagacgatatttattaaataagaatttcaaattttaagttgtatttttttttatattgtttattttgtttagttttttttttttttttttttttggcaaaattttgtttagtgtttaagattgtatatttttatttgattttgttaatttcacctatagcacacaatcatgtattaatatcaatacaaatccatcaattctaagattttatccgtggtataaagtttaaatgtttataatgtataaatttcttataaatgttggacattcagttgagaaagacatcatatttaccaaatctaaacaatctgtaaaaaatgttacttcttaaatgtcggcatcattcatacacttcatcgcccctgaaaaaagtttcgacttctatatagagtggagataaacttctacgcaaactagtagctcctataattggcgactccccatttaataaggtgcaaaaacatcgtaatcggttttaaaattgatagcttaattctttctattttctgaaaaaaaaatctttaggtcatcatcaatgtctgccaatactgtacttggaagattgagtttgacagtgtgatgaacgcatcttgctcttgattaaatatattttacttccaaaaacgacacacagttttcatctcctatgataagccatgccatggtatgcgtcaatcgtcactctgcccattgtatactaaatttctttctttccatgttctaaagtttttttttttttttttgtcgttctttctttctttccatgtcctaaagtattttttattttttggaattacgagaaagaaccaaaaaaaacttggctaatgcaaatctttgatgtgaccacggtagtttccataccttgcgaccgtatatctgtatttatcgccacaatcgaggataaatatgaatattttacacataactctaatagatctcccaaattgtatataaaaaaagaaaactccgatagatctagtttagcttaaaaaattgatatgattctttacacaaaacggtaacaaagaatttagacctccatatttaatttatatatgtatgcccacataaagcaacattgttctaaaacgctgaaagtgaaacatttaaatattcttccgaataaatcgacgtgtacacgacattgtcaccgttgatctattattgaagcaatatttaattcctccgtaaaacattataactcatccgtaaagaccgtgaaacattataacttagcggtaatatgtaaatttgttgtgaaataataacatgaaaagaaaccgaaaagttcctcttgataacttttttttctttttaataatgtagattaatataattttcgttaattatgttttaatgaaaaagattaattaaacaaactaatcaaatgtgttaattgtaatatacacaatgatacaaaaaatatgaaataagtttttaaaaatatgtgatattccaacaatattccaacttttctataacatcaggtaaatatttcttcaccttttcatgtcaacattttacaagagaagcataaaacaaaacaaaaaatcctctcggcaaccatatgccttttaaactaatgaggatttgtacttttttttttttttttttttttgggcacaaactaatgaggatttgtacaaaagctaaatgaaaagagctacaaaactaagcccatagacatatatctcatgaagccactccagatcacctgatgctacatcaaactaagaatggttttaattaatatatgggcctcagctgaggaaacaaaagcccattaatttgcttcaatattggtttacccgtttattctacatgccacgtggaagaatatgagtggtcacgatattataaaatgcgtcaaggtaaacaacaaataacaaactcgttttcgagcaaaaaaactttgaagattgatttgaagaagaaagctctctctcaggttcttgttctcaaccagacattgatttcttcgatttgcatatttcccttcttcgtcttacgaattttacttcctttagcgatggatttgatactacgttgacttttatcttccttttggaaatggcagcgtcgtcttctcttcttcttcttcttcactgtcccacctgcaatttctactttgactcttcctcgtaccttaaaagatcgagactttcgagctatagttcgattatctctcgtgggtctcctttgtttgtctctagctttggatctatg

SEQ ID NO: 3323 - DNA, 3000 bp, Unknown
  misc_feature (1)..( 3000): cDNA_ID_1825652_gDNA_ID_1620640_Annot_ID_47457 3000 nt of promoter + ATG
cagtttataaggtatgtttctttgagaaaacttcttaacggtaactttggtttcccttggttagatttataagctaaggatgatgcatttcttagggtgtgttctcgggtgggcaagaaatcgcggtgaaaagattatcgtgtacttcaggacaaggagacagtgaattcaagaacgaaattttacttcttgcaaagcttcaacataggaacttggttaggctattaggtttttgcatagaaggacaagaacgaatccttgtctatgagttcatcaagaacgctagtcttgacaatttcatcttcggtaattgttttccgccgttttctccatatgatgatcctaccgttctgttttttctgctctgtgttgatctttacgctgttacagatcttaaaaagcgtcaacttttggattggggagtgcgatacaaaatgataggtggagttgctagaggacttctttatcttcatgaagactctcgttaccggataattcaccgtgatcttaaagctagcaacattcttttggaccaagaaatgaatccgaaaatcgcagattttggattagctaaactctatgacacagaccaaacttcgacacatcgatttacaagcaaaattgcaggaacttagtaagttacttcatcttactaactcattaaccaagaaacaccggtataaacccgttattcatcttgtagcgggtatatggctccagaatacgctatttacggtcaattctcggtgaaaacagacgttttcagcttcggtgtattagtcatagagatcattacgggtaagggaaacaataatggtcgatcaaatgatgacgaagaggcagaaaatctccttagttgggtaagtacacaaaaccaaccaggtaattgaggtttgagtttgattcatcatgttaactgaatttgtaattctgtttgtttctcaggtgtggagatgttggagagaagacattatactaagcgttattgatccgagtctaaccacgggatcaagaagcgagatcttgagatgcatacacattggtcttttatgtgttcaagaaagtccagcgagtagaccaactatggattcggttgctctaatgctcaatagctattcctatactctcccaacgccttcaaggcccgcctttgcgttagagagtgtcatgccttcgatgaatgtttcttcttccacagaaccgttattaatgtccttgaatgatgtcactgtttctgagttatctcctcgttaggaagcttaatctgcatatctttttagtttcttcaatgatggattttgtttgtgtgattttttagacagcttggcttcatctagcttttgaaacgagtagaagttatagctttttcttttagttctacacattcgtcgttaatggtagatttgttttgcaaattcgattttactgtgttttaaaacatataacatgaaatttaacttaagaaaatgaaaatagtattagacttttactaagaaaagctttctactttatcctacacatgaaatgcatacacattggtcttttcaaaagcaacaaatcaatgttaaatacagttttctttatcttaactcctaataatgtagctatagaattcatgactaagcattgtggacccttggagcatttttagatggagatgggtgtttgtttctttattaggttttgttgcctagtagccacattctctcagttaaactaatacatttgtaaattttcacttgtaatcaactaatccaccaaatgaatcaataatgtaaactccagaatcgatctggcattgtatgagtatcaatatatgctttagtgccacttgctagtgcaatccacttgaggtttggctgcatcgatattagatataaatacttaagcgtcatgcaaaaaaaagattactaaataattgtagggttattatgggattttaggcgagcaaacaacatttaaactttgaaggaatacaatttgaaatatcaagatacgtaaaatatgtcacgtgcaataaaataaagagaagacccatccaaatcaagtgtgcgatactttgaccatatgagtcaatgtggcggccaaaggcaacaagcatatctaatctaagtattatataactaagcaaatattccactaaactagtatacaaagccaactgctccactaattgcctgacatacttatttattttcaaatttggtaaccacacctatagcttatacattttcttcgatggccttatacaataggaatatactattaccttctcattgttcttattatcatcaaccatttgataaatcctcatcactcttaaacattgactatgaactaaggacgtcagaagtagtccatacaagatatgaatggttggatcgtcctaagtcattgtattaatatacgtttctaatcaatggaaactatataattgtaatataatttttactaaatcatgtaacttgaaaacctaactttctttcttaataaaaattgaaccgctaaagtatctaatccatcatgtgtcaactgacaccgtccaaaatcctcttagagatgtaagaaaaagtttcaaaacaattaggtcagccaccaatcacatatttctatgcaggttgtataatcttgaaaaagaacaaaaaaagtagatgacaaaaaagaattaaaagacaataataataataccttataaagatgataataattcaaacagtttgacctttttatttcaattctctggtccaactttccaacctgacgagacaaaaatatagaaacttctcaacagcaataaaacagcaacctttcctttttgtatcccttctcctttgtcacctctcctcttacttttttatcaataggaagtttccgccattgtgacagacacagttcctctgtttctcttctttcatctttaagcaaacctcaaaaaccaatcctttattacgaagatcctcacttgtgtcttcttctccaacactaaaccccaagaaaatg

SEQ ID NO: 3324 - DNA, 3000 bp, Unknown
  misc_feature (1)..( 3000): cDNA_ID_1820428_gDNA_ID_1620640_Annot_ID_47458 3000 nt of promoter + ATG
acctcaccaagcagtgtccgctgacaaaacaagctgttgtatggtacacgcactgtatgtttcgttactcaaacaggacaatctacggaagaaaagaaacgaacccgactaaggcttttattgctggtgaagagatatcagcaaacagagatgactttgagcgtctgcagagaggactattggacagactcaaaggaattgcggctgctggtgggcctaataggaaatacgctcaaggaaacggttcagcttcggctgggtaccggagattctatggaactgtgcaatgtacgccagatttgtctgaacaggattgtaatgattgtttagtttttgggtttgagaatattccgagttgttgtgatgctgagattggtcttcggtggttttctcctagttgtaacttccggtttgagacgtggagattctacgagtttgatgccgacctagagccagatccacctgcaattcagcctgctgattcaccacaatcagctgcaagaactgagaggacaggtacatagaaatgtttgaatgtttctctcgtgtgtgctactgcagatgttgtccctagcagaatatgtttttgtttctaagattaagatagtgaatgttttattgcaggaaagggcaaaggtggatctaaagtcattatcgcgatagtcatcccgatacttcttgttgcgttactcgcaatttgcctatgcttggtcttgaagtggaggaagaacaagtctggatataaaaacaaaggtaacacagtgttcttcttcgtgttatcgttatcttgttactaatggattaactattagttctgataaatactatctgcgtattcagttcttgggaaatcacctttgtcgggttcaattgccgaggatgagttctcgaacacagaatcactcttagttcattttgagactctaaagacagcaacagataacttttcttcagaaaacgaacttggacgtggtgggtttggttcagtttataaggtaagcttcttcgaacaaacttcttaccggtaactttggtttatttatttgagagatttataaacttgggattatgtatctcagggtgtgttccctcaggggcaagaaatcgcggtgaagagattatcgggtaattctggacaaggagacaacgagttcaagaacgaaatattactacttgcaaagcttcaacataggaacttggtcaggcttataggtttctgcatacaaggagaagaaagactccttgtctatgagttcatcaagaacgctagtcttgaccaatttatcttcggtaaatctttttccggcttttactcgatctgatcctaccattcttcttccgctctgcattgaccattgcgccgttgcagatactgagaagcgtcaacttttggattgggtagtgcggtacaaaatgatcggaggaattgctagaggactcctttatcttcatgaagactctcgtttccggataattcatcgtgatcttaaagctagcaacattcttttggaccaagaaatgaatccgaaaatcgcagattttggattagctaaactctttgactcaggccaaaccatgacacatcgattcacaagcaggattgcaggaacttagtaagtaaattcatttaactaacttataaatccaggaaacaccagtataaaccagttatcatttcaattttaagcggatatatggctccggaatacgcaatgcatggacaattctctgtgaaaacagatgttttcagcttcggtgtattagtcattgagatcattacaggtaaaagaaacaacaatggtggatcgaatggtgacgaagatgcagaagatcttcttagttgggtaagtacagtatccaaaaccaagctagtaaatggggtttcagttttggtcatcttgttgataaaatttgtgattctgtttttcttttcaggtgtggagaagctggagagaagacactatactaagcgtgatcgatccgagtttaaccgcaggatcaagaaatgagatcttgagatgcatacacattggtcttttatgtgtgcaagaaagtgcagcgactagaccaacaatggctacggtttctctcatgctcaatagctattcttttaccctcccgacgcctttgaggcctgcgtttgtgttggagagtgtcgtcataccttcaaatgtttcttcttcaacggaagggttacaaatgtcgtcaaatgatgttactgtttctgagttttctcctcgttaatctgtaaatgttttgattcttctctgaaaacctttgaaatgggttttgtttgtgtgatttttcaggcagcctggcttgatcttgttgtgaataaaacatgaatgtgaagctgtgagatactttttcctttgtctcattttttttcttccagtttatcgttacttgatttcgttttaaggtacaatttgatagaagtatatatatatgtcagtaagtttagaaaattggataagagatttatattgagtccacatatataaatatgagagttgaaagatgatccactaatcatctacagaagtaaaagaaattgtaaaataaatggcttagacgaaattagatggttcctagttagtcttatattttctagtaggtttgaaaagtattcaaactctttagttttctttcctggtacttgtggggaaagaagtgagcaatgaacacttctaatttaaataacgttttcacaccaagtcgttagtttcatattgtgagtctttgaatctactaccatcatggacccccacaacctcataaagactccacttgtgtttgctactgggttttataattgttattgatcaacaagttttgttctttctgctgttggatattgatttagttcaaagaccatactgcttttgaataattccaaggtcaagttagattgacttcttccatttttagactcgttattacattctggggttttctcatatagattacagaagaagaaaaaagcttcaagcgtccatg

SEQ ID NO: 3325 - DNA, 3000 bp, Unknown
  misc_feature (1)..( 3000): cDNA_ID_1807702_gDNA_ID_1620640_Annot_ID_47459 3000 nt of promoter + ATG
gaggtacgttcccttagtttaaaagttaagacaaggttgagttagaaaggtctggtgtttatgtaataatatattgctgcaatatccaggtgaagaaaatggcgattcataaaatcagcgaagctgtaaaggaaattcgggaactcacatcttcggattcaactggtgcattgagattatataactagagctagaggtaccaatcttgattcttgaccattggtaattaccctattcttctgggaaagattcagctgttgagtttcaaggagtcgtagaatgtaaaaatatatagaaataaagagacaatagcttagagaaagaaaaaaaaaagaattcatttaccattccgattgttgttggatgatataaagaagcattgatatcaaatttgatagtggaaaatatcttgattatacaaaagtctaattacatatgttggtttgttattgttgacaacctaatgatcatatatacacaacttagttacaaatattgacttgcttgggctcattttgttctaagaacaatcttaccttttgcatcgtcatgcataattggtagaactatctccggaggctgaaccctccagactttaggatcctgaaactgatgtcctaacttagccaatttatcagcgactcgatttccttctctgtaaacatggctcaacacgcagttgttcagctcaggcataaccactttgatgtaattcacatgcttatttgtcttttcacatctcaatctccccctcctcgagatgatatccattatgatcttggcatctccttcaagccatagatccgtcaacccgttctctagagccagctcgagccctcttttgagggctgcgaattctgccatggtgcttgtggcttcccctatggattctgagtacccaagaaggaactcggctttgtggtttctgaatacccctccaatgctggcttgtccttctcttcctctggatccgtcaaagtttagctttatccgtccattttcaggtttcttccacacaactttgacaggctgtttgtggtagtctcggattaacaataaagtagcccgggtttgcagcaacccttggaatctagcaatctttgtgaaagctaacatagggtttaatttttttggtaacagattttcttgtcgtaaaaaatggtcgactcagatatttcttttggctctatagtcgtggtgttataccaagagtaggcaatattgtggaaggggtttgttagggaaatgatccttgcaaggaaagcaaagaatgatccttaattgaattgaaagggaaggcacatttgcagaatttagtaagcagtgttatatgaggaatgttttgaagaatgattctgtttcaatggagattttaagtagaagaagttttaacgaagaaaatttaaataaacatgactacttttgtcttatccctaaaatactgaaggtctctcctcaacctcaggaggatctctctttctctctccctctctagaaacttgcaagcaaagaaggaatgagaaacagagttacccacatttcccggaaacataataagttcttatacatgaagttattatttatgttggttctgtttacgaagcaagattcacaacatatcaaacaactaagaaatgattcaatatagagaacacttgtcatactggaggccacttgtcataaaaagaaaaactgatgagtctttagtgtccaagaaacagatcgatcgatccccactaagacattgtctgatacttttttcccatacatcgtggatccattccctcttcgaccaaacttccacaggttcaaaccaaaccggaaatcacagagttcggtttacaactcaagaacctaaattaaaaggatcctaaaaccagagacaaatagataagcaaaccgaaccgttgaccctgtcaaaaatacgtaagttcagcattaccgatccggttattatattattcgacccggtccgagattatttttgttcataaagtggaaccgtcctcactctatccctcagcttaatccgccgtcgttggttcaaacgacggtcgtattgatcttcgctgattggatctttataatccgtacaaactcccggagctcttggcctatcaatgtccgggattgatggagctatccaaaccagctgctctgttacgcacctctggaaccacggcgataagcaaaggcgtcgaattgactcatcacgggaacttcattactttgctgttatttccaagcaaaggattgtgaaaaagtatgaattttcttcattatagtacatgcaggagttatgttttctgtgctgaaaaaaataacattttttcttggtttctggtttgcaaattgcaggtttctcgattgaagaggtagctagtaaagttccaattgcatttctttgatgcattaacaaagcattcagatttgaggtctcattcagcgagtaagatccaagacataaagatcttccacaatccgcacctcataagtataaattcaaatacagcaggagggatgtgaaaaaaaaaaggagtctctaggatgtccttaagtagtttatttcccattaatggaagattagttttagtttctagttggttaaagtttcagactttgagttcttattggtcctggagagaaaagaagtgagaaatataaacttattttaaatgttttcttgtaacttataacttcttatttcacacaccgttgacctgattcgttgcaccaactcctaaatttttatattgaaatttttatatatcatcatgcaggacccaacaagcttacaatggctgtccacttgtgtctgtctgttactgaaatttataattgtttttgatcagcaacttgtgttctttcggctgtgagctagtttaaagaacacacggcttttttttaaggtcaaattaggtcgacatttaccatataaagactcattacacactggtgggtttctcatagattagagaaaaaaagcttcaagctttcatg

SEQ ID NO: 3326 - DNA, 3000 bp, Unknown
  misc_feature (1)..( 3000): cDNA_ID_1840725_gDNA_ID_1620640_Annot_ID_47462 3000 nt of promoter + ATG
ttcaatctctaacgcggagacataaccctaatattacggatggtttatactattaatcttcattaaaaatcgctaaaataggttataagatttccttaacaatgattataaagagcaggcagctatatttaagtatgtgtgatgttcctaataatttgcgattgataagaagaagatattaagatataatttcatgatgcttacattagatttagtccgtagctatatgtaattaataatattattgatttgaaagtgatgcatacgactattgctctcaatgcaaattaattattcacaaatcttgttattttcaataatttgaaggttttgatcaattattagtttataactatgtcattctctagctagtttatatagtcaaggtatgagatttttgcataactgtctatgtgaataatatgttcggcccatgaaattcaatatttagaaatcgtactatgtatgagtgaaggaaaataaatgaatttcttttcttaagtaagataatttaaatatataataatgatagtttaaaaaaaaaaaaaattaaaataacgtagagaacacgagtcgaaaaactagtggttcgtataagcggccaatggtcctcacatcatggcatcatgccatgcgaaaatataccaccaatctttagttttgttttcgtttaattattgaagccaactaagatataaacttttaggttttactcaatatatccgctatgagttgatcattttgaattggtttagtgttagaaatttttatataggaaaatacatgcaacaatctgaaaatgaaaatatcggttagacttagaatttatatcgttttttgggactgacttttgtttggcttgattagaatcacctaagttataacccaatgtgtatattcagaatctcacacaggaaagctagtaggtacaaaatatttgggaaacagagagcagcagcaatatattacaaaataaattaaacatacacacagtcacaaatttattggtggataatattattttttgtctataaagttatcataatgtttccacaattaatgttttctaatttcggcaaataccaaactccattattgccattcgaattaaatgcgctcccctttctctataatgcatagaaaattgacttttgataaaatttcccctttgaccttgcaatccaagggaaatggttggtctaatattttaactaaagtatttctcttcattttaaaatattttatcatcataagacatatcgaacgtacaaaacaattatttcagttatagagaaacttttatcgaaaacaaaaaaaaatgtatatatagagaaactggttttttttttccgttttttttgaaacaggattgagatttatagagatcaaagttaatcaaattgaaataaatattattgcgatgatcctctgacgacaatactataacaccactaatgttcaacatgaaaactcaaccatttataagttgggaaaataattcccttgaactgtcttagatttttaaagctaagtatatcgctcaaactagccgaaaagagttggaaaacctgaaaaactagtccaaagaaaaatcaggatggaagttgaaattgagaggtgcacacaaaaaaaaataaaaaaaattgaaattgagagggataaacgtgacgtggcatcttcatgctggcaacagctaatgtgaaaccttcccacaaagcttggagagcgacgctttttagtcgttcatcaatcctcaccccattgattgtgttactttcattatcacaaactgtttcctaattaaagtcctcttatttcgaatttatttcagtatagtacttgtgtgttaaacttaacaacgttgaaacaactatttccttcatttgcatttgaatgtacaatgaaactacatatttctacattttagtatgagtttttttagtttagtatatttaatgattatctttgtatacaattcaaatccaatatatataagaaactctcattattaatctcgaataagagtacgtacacattaaatcttatatgctaaaactaggtctcgttttagggatgtttataaccatctttgagattattgatgcatggttattggttagaaaaaatatacgcttgtttttctttcctaggttgattgactcatacatgtgtttcattgaggaaggaacttaacaaaactgcacttttttcaacgtcacagctactttaaaagtgatcaaagtatatcaagaaagcttaatataaagacatttgtttcaaggtttcgtaagtgcacaatatcaagaagacaaaaatgactaattttgttttcaggaagcatatatattacacgaacacaaatctatttttgtaatcaacaccgaccatggttcgatttacttgcttaaatatatgacatttgcacttttgagatgcatgttatttacaccttataaaacttacttgaactttaataatatttgaccatatatcatcttggaaatataaaatgtaaacacgaaacacaaaaggaagttttcgttgtatttgcatctatatttctatatttccaaagactaaaacactatcaatgtgttgtgttcaattttgaacgtttaacatgtaagcataaaaacaaactcagaaaaagaagaaaaaaagaagaaaaaaatcatcaaggcatgtctcgtatagctgccacaaacgtaaaaataaaataaaaagcatccataataatggataaaagcatcgtataaacgcaaaatctattagatttttgtttttatgggacacgtataccaattgataaacagaggacggcaccgaaccattttgacttccctcttcttctctccctataaatactttgtacttccccttacggaccctacgaccttttgtttctctcttctctattaatactatagttttcctcaaactctctgattagctcataaatactaaaccagttgaccatttttttctgataaacaatcaatg

SEQ ID NO: 3327 - DNA, 3000 bp, Unknown
  misc_feature (1)..( 3000): cDNA_ID_1820425_gDNA_ID_1620640_Annot_ID_47463 3000 nt of promoter + ATG
acaacatactagtaactagtacttgagtttccttagaacatacaccattcttacaatagttttgttattagatgttcccgttttgtgtataatttgattcttcttctatatggtcttgtattgtggaaaacgattattggggagcaaagaaacatacaccaaaaaaaatatgatcaaaatttttagtgtgtggaacctttcgaaaaccctacgatgttcaagtaagaaattgcaattatatgagatattatatatatatgcaattgttcttagtatttaggtgtttagaatatatactttagaccgttttaagatgtttgttaaaagttagtcttcttctaattagaaacatcttcttttgtttttatgaagtaagtgataagatatacatataatttacctcgaccaagtttgaatacttgctaggttaccatgtcatgtttaatcgtccacatgagatatctgtgtgactgtgtcttcggttcgatgtggctaattttctagaacatgttatcaaaagcaaacgttgttgtaattggctgatactgaggaaaatgcagtttggcaatgacaagaaccacacatatatacaatattgatatctattgaataattatacaatattaaattcctttgcattattcatttgtttcgtataaactaaaacctttgaactctaaatagttgaaaggagcagagtcagcagacaaggaccaaagatcccttcgaccacacatataaaacgatataatttgatacgaaatcgtaatggttgtgcagttgatgttgccacttaagacacttacgtaagacttcatgcaaatataatttaatatacgtacctcttgaatttacgtgttagtttgattatatatatattggtcatttttttggtatttgctcgataatagagttgatgggaaaccttgataatattaaaaattatcatatgaattttggaggaaagacagcaacacactcgagaactctctggaaaattgcgttttcactttttttgttttccaggattagttgatctaaaatctataatatatattaataaatacaacctaataaacaaaaattatttatgtttcagttaatgtaacccattaatatagaagtaatctcgtaaatatggagttgattaaaaatatgtacttaatcaaattcatctatatatatatatatgtgtatatatatatatatatatatatatgaattatattacgatcaaattatcttagcttttaaaataaaatttttttatcttagctcttattcaaaagtctttattccatcacaaggttatgttatcttttgtatttttattttattttatacaaggacttccaagttccaacatttcaatttctaagtacatgcatatcttattaaatagtgatttaaatacacaaaaatatgaaataaattctaaacaaggtccactctataaaagaagaaaacccacaaattccaaagcccaaattaaaacaccaaaagagcccaaaatacaaactcattcttcaccactaaaatattccaaagcaaagcaacgaacataacggataagtgttatcctcatctagtcatcttcaccctctaactcaccgagaaagaaaagtaaagagagtttggtgtcactatgaacattgccattcataattaccgtcactcaaaattcatcgtaaatcctcacatagacaagacttttgcaaggactcgacaggcaagatcaaataatattacattcatgacaagtactcatggaagaagaagaacgatgggactttgtttggtaagagcaagtgccgagaccggagaagaagaatccgacgatcaaaacaagcctgagagaagaagtttcttgagcttagcagaagctggtctagtcgaaatctcaggccttggtgcacacgagaagtttctctgtcgactaacggtaaattaaatcataaatttatccctacatattataaaccctccaataccaaattttaattgcaatctattaataaatctcttacattgttttgaaatatattggtatggttaagataggaaatgaaacattaattttacataggaaattgaaaccatatgtagttgtgaaacaaaagaaaatcttataacacgtcctcaagaaatgaagtgtgattaacagtctatagtaaacatatgtacattaagtaaataactggaatatcatttttcttagaagcatgtacattgatttatagatgtttcgtatgaacttcttcttatattttggaactggatttggcagatatcatcattgaatttgctaagagtgatatcagagcaagaaggatgttcaatagaagagttgaatgctggcaaaatatgtgattggttccttaaggacaagctgaagagagagcataacattgaatctgctgttcttcaatgggatgatcccgattttcctttttaaatatccttattttttacattcaagccacacaaaagtatgatcattaacaaggtgaatatgtatcgtaagtcttaattagtctattgtggtctgactaggaaaatataaaccttttgttaagtcctacaataaaacgtattcaacaattccaaatattatccatgactgaaatacataaagaaaaggtttaaattttatctagaaaccaggaaaaaagacaacagtaaacaaacaattaaaaaagaaaagactttgaaagaaaatccaaaagttgtagaagaaaagacttaaataaacacaaagagaatccaatacgctgtcgtttttgagcaaagtctctatcgacttttttccttccgttaatcaagccatcggatattaaataattacaaaattattttcagacaaaacacggacgcgaaatcaaccaattaaatccacttctctctcaccatctcacgtccgatctctcctctctgagctctcatcacgagtcaacccctttctccgtcgaaattcgcatgcttaaactctgagagaagaag

SEQ ID NO: 3328 - DNA, 3000 bp, Unknown
  misc_feature (1)..( 3000): cDNA_ID_3091295_gDNA_ID_1620640_Annot_ID_163027 3000 nt of promoter + ATG
tcttggcgaagtggtaagctttacttgtttgatcttcttcagggtactagttttatcatattccactaagtagttctcttgttcagtagggtgtgaagcgtgttttaaagtcagtatgtggtacaggaaaagagcttcagcaggttgtccttgaccatcttcaggtacagtattctttacattcctgaaaatggagttatagtttttagactaagtagcgtttatttatacagctaatactttttagatagagttttgtcacgaattaagctttctttttcagcctgcagcagaaattatcggattcaggataggtgaattaagaggtctatcgaggtggcgtgcacggtaccaaggcattggtttggatgagatgctccttaatgaagccactgaaaatactggtctgctacttgtacaagtgcaacggtttatgatggtactatcttctgttgtccaacaggtacagaggcgtgcagttcttttgacactgaaaatcatagttatttagtatgttggctgtcccatgtttcccacgcaatggtcatttcaatagaattataaactttttgtttcagttctcaaatttcttcaactggctcgtcagaagtataaagtatcttatgcaagaaccgaatgatcagcttttgtcatacaacaggtatgcacatgtgtttttatgttgttaaaggtgttaaagccaaatctttgcagttacatggtttgtttctgtggcagtgaactccttgtggtattcttgaagttcttatatgaccaagatcctgtgaaagacctcttggagctatctgaagctggtgatgacattgaaattgatctgtaggtcaactctttctatgtctgtgcttttacctaccttttctgatcacttatcttgtagtcgagcagaatctctgtcaggttacctaaaattttttaagccatttataaccacatacaataggggtagtccaatgtgataatacgaatgaaatccgagcaggtttctctaaccacactaaaacgaaattcagatatgggtaatgtgtgtgcgtttgtgaagcatgaagtccattgtatcatccctagctgttcattcactttgttttacttcatttcatttaaactcttaatgttttaatgtcccagcaaaaccatcggaagagtcaaagagttacttcagtttggagggttttcagagtgtgattttctgcagaggacattggctaaggaattccaacacatggagtctaggtattttctttacatcttcacttcttaaaacataaagtttcttaaaaatgctgcatcatggagcacaacgttggtaaactgatacgtgtaaaaggctatggtagagacaaaggtccgataccatggctgccttggcattttgaaatacaacatgaacaaccatatttatggtattggagtttacttgcaaaacaaagtgtgctgagtctttataatctggacatactttctcatggctttctctgactagacgtcaaattctgattttaatgctttaacaattttagcttcaagatggcttctcaaatgccctttacaacaatatcaagaaagatatcatgtatgaagttgttgcctctttgccctcttcagttgtcaacaacgcaaacacctacaacaattcccatgtctctttccttctataaggtacttgcagcaacaatcttaatgcactttattatgatcccatagggcatccttaggaagagattgctgattgctatctccaaagtcttcatttgctcctgatatactaaagtctctgtttgcttgtgcagaatgaactttctgatgatacaccttgtcaaagtgggtacactgattacatatcttttcaagtccccgatgagaccttcccagagatttcaaactgtattggcatagctaagggttataagcagaattccaacaatgagaaaaatggttatacttctctggaagccgttttgttatctgtacctaatggctacacttgtgttgatttgtctctctacaaggtgaatactcattctcttctgcaacaatggttgatttaattggtatattttttcttttggagttgccttgtaaatcctgtgtctgattttgaaacaggataaagaactggttttattattgaataagacaaatacagattccgaaggctcgggagaagcatgcatgatggttgtacaaactggtgacctcgcattcatttccatttcaggatctagttctctaaaccagtgggagctagaggatttgaaggtattgctaatttcaagcattaacatcgacgtttgttttaaaattagtgaagtttatgtaagaacttatgcatctccagggctcgattgtgaacctggaaatggagaatgaaaaggttcgcaaagtaccacattctgtcattgctcctctagcagtaagcggtaagagcttaattttctgtcttttcttcttcttcaaactagaaatgctttttcaaaatcatgaaataatttgcttaattatttaaaattcttacagcttcaagaggagtggcttgtgtttttgctgaaagaagacgagctttggtgtacatattggaagaagatgaagatgaagaaatctctgatgaaaagtaaacctcctccaatgcctgctttgattgttgtttgtgtagattattaaagttaagaaacagaaacttgactacttgaagttgtaaacggtgacgttttgttagttaatgacttcttctaatgtctgtatcagtctcttcttttcacacttgcgtcataattaaagagggttacgccacgtcagctcagccactcgacaggttaaagcgcgtggttgtcacttcccctttgatcagacaaagctgaccaaaaaggtgggttttttcaaagtccattctttattcttagctcaactaaggaagcaagacgaaattctctctctttctctaagctctacgccaccgtcacggaggttgtcttgttttgtctc

SEQ ID NO: 3329 - DNA, 3000 bp, Unknown
  misc_feature (1)..( 3000): cDNA_ID_3071055_gDNA_ID_1620640_Annot_ID_163026 3000 nt of promoter + ATG
tcaccatcgtcatcatctggaattgcgaaacgtctgtgaccagaggatgtagcagccattggaaggtaagggtggaaagagaaagcattgacggtatctgcattaatcgaatggagtatatatgccaaagtcaggatctcatcaacaattgcagaagctactgaagaactaagtgttagctacctgaagcagcttgatatccagaaacccagtttccggtttgtaaatcgtacatgtgaacaagcccatcctggaatacaagacaaagaggaatgagaaaatggttacatgatctaaccataagagtgttaacagaggaaaaaagattgcttgcagttttatagttaatgaaaaacaaaagctcaggcattagaaaggataggaagatcaaaagtacctgaccaccggtacctaaatgtcgaccacatggctcaatatcaaagaatacacgctggtttgtgttctcagttgctctgtacaatctgatcacacatataaatgatccatttcaaacacatgtcaacattataagagcttcaacatctaccatttctcaagctaagacttctattaacttgaacattgatgtaacgttaatcttaagctgctcatggctcattaagcattaatcttgtttacagcacttgttcttgcttctagattatattgtaaaacaagtatgagcttagaaaccaaagactacccaaaccaaaataaagaagtaaatactcacttatagactatttcaacagatttccgaatatcccagcaaagaatgtaaggatcctgaaaaagagcaaacaaaaaagaaacatttttttggtgaggttaggacaattcatcatcctattacatatcatactctaatattggacaccaacgagaatatctctggacagacgatactttcctccaaaaagggttatccttaaaatggaagtcaagttgcgatataatatgctcaacattcagagggtaaaatgtttataacagtatgttaccttgcgacctcctgtatataaatagttcccatcctttgaaaactggacctaaaagccaccaaaaattcgatcaataattggatcatatcccaatggacaaaaataaggcacatttagtggtcaatgcttacatgtgtaacaccgccttcttgaccatgtaaaacatacaatagctccatgttgtcttctctataaatcccagtagtttgcccgtaagaccccacagccaacattccagaattagttggggagaaagcaagagtagataatatacctggaaattatgaaccagttaaggttgttcttgtttctgtataatctgtaataatattgttatgcagcgtctgagtggaaaagaaagaaaaaaacctgcttggccctctttgtttttctgtagagttgaatactgcctaaaatctcttccaggacgatgaagatcaaacactctgatggagctgttgtaaccagcaaagatcctaaagacataacacaggcaaatgaacatagaccacttttaatcaattctttaccgtgtgggaagatggatacaacttagatgaagtttttgcttacttggttccatcaggattgaatccaactgaaaatgcagcagttatttcatccatagcatcataggcccggtatgtgcatcgaagctgacattgtgttattcacatgtaaataaacaaaaaaggatggtagaaaaaatctccagtaaacatgttaagtttcatggaaaaaatcagcacctcaccagaagtactatcccaaagatgtatcggatggtctctagtggaggtagcgaagacgcatgttaaagggtctgatatcaatcagtgaacagccaaaatcagtaattcaactgatgaaatcattaagccaaaaaattgaaccccttatgatgagcttatctattacctgaaactgacatgtatggataccaacagaaatcatagacagattcaccctcattcactagaagactcgcaccatacgaatctacaattccaataaacacaccatgaatcacaaaattacttcacacatattttacagcatttgccacaacatacaaatgctagatggaaaagctaaccttcttcagggactggcactccatagccattagaatcccctccatcttgtggcctgatggggcaaatttgcaaaactaaagattcaacagagaactaaaactacacaaacatacaaaattattgatacttaagctacaaaaatatttcaattgaaattattcaacttacagatgaaacagactaagtgtattatcttcagagcttgcaaggaaacatgaaccatcaggtgacctatataagaaacagtaacaaaatcagtacctcaaaagttaggcaaaaagaaaaaaccaaactttgagaaagaacaaaactctactcaagagattgatttgaaacaagaagaaaagggtaccacttaagacccttgaggaaattattagggtttcgagctgtcctgaactgcttagagaaatggtgcgttctataaggagagacatcaaatctcatagtaggccaggatgatttttgttctcctgattctaccttaagtccaccattttcttctgctactgcttcttcttcacccatcttcttcgtcagagcttctggaaaaaagcagcagagagaggtttactttcgttctaaaccccagtcaaaatctccaaaacctgaaccaggttttcaatctcagaccgacaaattgaaccgaacttaaaccaaaaaccggattagggattttgattggaatttggaagaaaagcccgccaggtttgtcattagtgcgtctctctcttctcccggcggatcggcgaatcccggcgaccaccgtcttctttcctttatccactctctacagctttcttctcaagtgtttctctctagttacttccttcctacagctttgctagatattgaaaattagaatattaacccctaatcccaaaaacctcggaatgtcggaa

SEQ ID NO: 3330 - DNA, 3000 bp, Unknown
  misc_feature (1)..( 3000): cDNA_ID_1395335_gDNA_ID_1620640_Annot_ID_163024 3000 nt of promoter + ATG
ttttgcaaatttgccccatcaggccacaagatggaggggattctaatggctatggagtgccagtccctgaagaaggttagcttttccatctagcatttgtatgttgtggcaaatgctgtaaaatatgtgtgaagtaattttgtgattcatggtgtgtttattggaattgtagattcgtatggtgcgagtcttctagtgaatgagggtgaatctgtctatgatttctgttggtatccatacatgtcagtttcaggtaatagataagctcatcataaggggttcaattttttggcttaatgatttcatcagttgaattactgattttggctgttcactgattgatatcagaccctttaacatgcgtcttcgctacctccactagagaccatccgatacatctttgggatagtacttctggtgaggtgctgattttttccatgaaacttaacatgtttactggagattttttctaccatccttttttgtttatttacatgtgaataacacaatgtcagcttcgatgcacataccgggcctatgatgctatggatgaaataactgctgcattttcagttggattcaatcctgatggaaccaagtaagcaaaaacttcatctaagttgtatccatcttcccacacggtaaagaattgattaaaagtggtctatgttcatttgcctgtgttatgtctttaggatctttgctggttacaacagctccatcagagtgtttgatcttcatcgtcctggaagagattttaggcagtattcaactctacagaaaaacaaagagggccaagcaggtttttttctttcttttccactcagacgctgcataacaatattattacagattatacagaaacaagaacaaccttaactggttcataatttccaggtatattatctactcttgctttctccccaactaattctggaatgttggctgtggggtcttacgggcaaactactgggatttatagagaagacaacatggagctattgtatgttttacatggtcaagaaggcggtgttacacatgtaagcattgaccactaaatgtgccttatttttgtccattgggatatgatccaattattgatcgaatttttggtggcttttaggtccagttttcaaaggatgggaactatttatatacaggaggtcgcaaggtaacatactgttataaacattttaccctctgaatgttgagcatattatatcgcaacttgacttccattttaaggataaccctttttggaggaaagtatcgtctgtccagagatattctcgttggtgtccaatattagagtatgatatgtaataggatgatgaattgtcctaacctcaccaaaaaaatgtttcttttttgtttgctctttttcaggatccttacattctttgctgggatattcggaaatctgttgaaatagtctataagtgagtatttacttctttattttggtttgggtagtctttggtttctaagctcatacttgttttacaatataatctagaagcaagaacaagtgctgtaaacaagattaatgcttaatgagccatgagcagcttaagattaacgttacatcaatgttcaagttaatagaagtcttagcttgagaaatggtagatgttgaagctcttataatgttgacatgtgtttgaaatggatcatttatatgtgtgatcagattgtacagagcaactgagaacacaaaccagcgtgtattctttgatattgagccatgtggtcgacatttaggtaccggtggtcaggtacttttgatcttcctatcctttctaatgcctgagcttttgtttttcattaactataaaactgcaagcaatcttttttcctctgttaacactcttatggttagatcatgtaaccattttctcattcctctttgtcttgtattccaggatgggcttgttcacatgtacgatttacaaaccggaaactgggtttctggatatcaagctgcttcaggtagctaacacttagttcttcagtagcttctgcaattgttgatgagatcctgactttggcatatatactccattcgattaatgcagataccgtcaatgctttctctttccacccttaccttccaatggctgctacatcctctggtcacagacgtttcgcaattccagatgatgacgatggtgaagataagaacgagcttcaattgaaaggtacattacactaaaacgctaattagttcctctcccatcaatgttaaagacacacaatctaatcgttcctttctctttttgctcacacagctgatgagaactgtgtatctctctggagtttctacgtagaggacaatacttatgatgaaaacaatggcgttgcaagcgagtctcatctccaaaatgtcaccgaagaaatagttttaacataaattttaatttttaaaagctacgttagaaaaaaagaatcgaaacaatattattttattagtcttatccaaagcatattcttaacaaaaacaaaaaacaaaaaaaaaacaaattcccatacttatctccagatgtttcagaatccgatgagctcaagtgggactcttctattttaaaaaccacaacccttcctctgctcattaaattcacaccgttcaagctacctaagcatacacgtcacaacaatcaatggacaaaacactcattatgaacccgcacactcatgatatttcctcccgaataaagtgggtttatcttgtactaactgactgataccgaagaagcttaactcaacttggactgatcgaaacacaaaacgccaatgacggctgtccaataacaaatcaccacgtgtcgaatcggagcttatattcttcagcaaatctctctctctctttttctctactttgctctgtttttggcgttctaaatgatccattatctccatttcatcggtgaattttgtttctccagtgctgttaaagtagttgagtggttctcggagaatctgtttctcaaaagaagcacaatg

SEQ ID NO: 3331 - DNA, 3000 bp, Unknown
  misc_feature (1)..( 3000): cDNA_ID_1820413_gDNA_ID_1620640_Annot_ID_163021 3000 nt of promoter + ATG
tggcttgcaggaggttgaagatgcacagagaattcgtagtactgtcattgattcatttgagaaggcaagtttacctggactaaacgaacaagagagaaagagaatgctacattttgtagttgttggtggtggaccaacaggtgttgagtttgcttctgagcttcatgattttgttaacgaggatctagtcaaactatatcctaaagccaaaaacttagtgcagatcactcttctagaggctgcagaccacatcttgaccatgtgagattttcttactcttaaacttttgatctatatcgaagattagctcatgtcctatggtttgacaggtttgacaagagaatcacagagtttgctgaagaaaaatttactagagatggtattgatgtgaaattaggttctatggtggtcaaagtgaatgataaggaaatttctgcaaaaaccaaagcaggagaggtctcaactattccttatggaatgattgtttggtcaactggtattgggactcgtcctgtgatcaaagattttatgaaacaaattggtcaggtgagtagccaaaggtctaatgataatgctcatattttttcatagtgaacgagctttatcaactcggtctataagatgatttcttgtaaattccagggcaatagacgtgctttagcaaccgatgaatggcttcgtgttgaaggatgtgataatatatatgcacttggtgattgtgcaacaatcaaccagagaaaagtcatggtaaccaaattcagaacctagataaaaatgagctcgcttgtgtatagggtttctctgtttcttatacttttggattgttatggcttttgtacaggaagacatagctgctatattcaagaaagcagataaggaaaattcaggaacactgacaatgaaagaatttcatgaagtaatgagtgacatatgtgatagataccctcaagtggagctctacttgaagagtaaaggtatgcatggcattaccgatcttctaaaacaagcacaagctgagaatggttccaacaagtctgtcgaactcgatatagaagaacttaaatcagctctttgtcaagttgactcacaagtgaagcttctaccagcgacaggacaggtttgttctgtttttacttacttgaaagttttatcttcggtcacaagtgtcacacactcacactcacacactttgtttgctttctcatcctttgtctggtggctttataaggtcgctgctcaacaagggacttaccttgcaaaatgctttgatcgtatggaagtatgcgagaagaatcctgaaggtcccattaggattagaggagaaggtcgtcaccgcttccgtcccttcaggttggttcctagtatctgcatcttaggaggctttagtcacttttgagattgcatgttttgtgaatttctcaatactgattatatactttatagtaaggagacatgagacaatgaatatatatgttatacaggtatagacatttgggacaatttgctccattaggaggcgaacaaaccgcggcgcaacttccaggagactgggtttcgataggacacagcagtcaatggctgtggtactccgtttacgctaggtaacgttaaatgactaatgaaatacgaaatgtattcatatgatttttgtatttttttgtaactttttggttacaagtttttgtttttaataatacagtaagcaagtgagctggcgaacgagagtcctggtggtctcagactggatgagacgattcatcttcgggagggattcaagtcgcatttgaaaatctcatgtctctcttactctctcgtttgaattatcatggatagtcttattgctttttgttttttactttcaaataaaagcataacaacgggaagatgttaaacttcatttggttacttctgtttttggaattggtacgtgaaattgatatatttatattgctggagattggagtataatttcacaaagaatataatctactgcttttcttatagaataacgtttaacattacaagatatgtcgcctagctagtcagaaaaaaataaaaataatacaatgttagaacttttgttgtccttagattttgacaattaattccctttacatgatacagtatcaattatgggagaaagaaataggagaatcttctggcaacacgtaatacttaaattgttcatctttctattagtaaaactaaaaacaaaacctaacctaccaaaccactactctccttgacctcgactaaaatcgcaaacttacctataacttctttctaggtaaaaggcaaccaaaaatattaattcaaatcaaccaccatacactcccgattcatatcgttaaattttttacacgttagcctgctagctaggatactaaaaataataagattactttatactaaggataaaaatgatctactattttttagagtgaatctaccaattaaaaagttttcaaaaataatgtatattgacttatgtgcctggattatttacccatttttgggtgggaatctaaagattttatttccaatttttctcaaatctctataggtattattttttaccacaaaaatgaattatcatctttaagagaaaaaaagaagagaaacaacaattgacttcaaacattgttgtatataacatattccttcggttacatttcaagtgttgtttaagtgtcttacacatatataaagaaacaaacatagattgcgtaattttttttgtcttttttccattaaaacatcattcattatttagaaaaatatattcaaccaataacaaaacagtctgtctaatactaacagtcaacaaaaatatataaagtaataaaaattttaataggatagtttccctaaaacaacattaaaaaaatttaacaaatggagtaacaacagttcatcaacttctcctcttttgtttatataaacacacattaacgattcataagccattgtctactaacaaaacagaaaaagactaaaatg

SEQ ID NO: 3332 - DNA, 3000 bp, Unknown
  misc_feature (1)..( 3000): cDNA_ID_3091303_gDNA_ID_1620640_Annot_ID_163020 3000 nt of promoter + ATG
catgtaaaaaagaaatgtaaacttgggtttgatgataatgaattgttcatgttaaggactaataaaaacagagaagaaagtgtactaaaatcgaaatttgagctctccaattactaaatcggtgctaaatgaaccggtcggtcgtttctatatttgattcgttcggtttatcctttaaccggtcgaaccgaagcttcttttgttcgtatgaagaaaactaaaatccaaatctctctctggtacaccatgagaggagctctgttcagaaatgcatctctctgcgctcgcagaatcattctttcttctaggatctcccccaatgttccctttctcactccaatcgccgctccggctcctcccaaattcagatttttcagttccgaatccggtgagaactcgactactgccactgagtcttcgccgactgattcatccgataagaaggatctcgttgtaaaggatgtcagcaacaaaggtaacagactctatcctctcttcaagcttgtttggttacctcacacttgaaatggccttgtattagttgaaatgtgtgagtctaattctcatctcgccatttctgaatgcctcacagttttcaattgatccttcgatataagattcgtagcttcttatctcctgaactactaggtaatcgtttgaaattgactttatatgttggattttgtggtctcagagcttaaaagccgtatagacaagtctttcaatgagggtaatgaagatgctttacctggagttattgaagcacttctacagagaagacttgtagacaaacacgcagagactgatgatgaattgatggaaaaaatcgagagtctacctttcaaagatgatgtcaaggatgaagattttgaatccgatttcgaagaagcgcattctactgacgaagaacttgaggatttgtacaactctcccgagtatgtagctgaaaagatgaggaagaaagaatttttcaacatggacgataacaagtgggatcacatgattagagaaggtatccaacatggctgtcttaccgatactaaacaatgcgaggagattctcgaggatatgctcaaatgggaccagcttcttcctggtaatgctcttttatttttcaatcttcccgttcatcgactcacatccttagacatagattaggttgattaatagactattgtgcctcgttatagctaaacacactctcttagtggaacttatcttttgtagttaacctttctatttggattttaatgaatcatggtagtagaaccattcttcttttcttaactctttcaaggtaatgtactatgtcggatttgttgcttctcggatcagtagggctgtttagagaatatattggtttgttcctgttatgcgtatgtatgaacatcctctaactgtgtatcttcattcagatgacttgaagaaaaaagttgaagcaaagtttaatgagctcggggatatgtgtgaaagaggtgaaattgaggccgaagcagcttatgagcttttcaaggaatttgaagatgagatggtaattcagtatggggatcagatggaagctgagggtcctccccaatttggtgaaacagatacttctgacaggaatactgacttggatgatccctccggtaaaggcccaatcctcaggtggcaatcaaggatagtttttgctcctggaggtgatgcgtggcatccaaagaacaggaaagttaaaatgtctgttacagtgaaagagcttgggctctcaaatcatcaggctaaaaggctaagggaacttgtgggaaaaagataccattcagggaaagatgagcttacaatcacctgcgagaggtatataaactataaatcttaagcttttcgcgagacaagaatgttgaatcatgtaatgtttttgtcctgtcacaggtttgaacaccgagaagaaaacaggaaagactgcttgagaactctttacgggttgatagaggaagctgggaaagccaacaagatcgctgaagacataagaacttcatatgtaaaacagagactccgagccagtccagcttttatgcagaaactacaagccaagatcataaggtctaaagaatcaaatgccatcaacgcttgaaaaaaacttttcccggttcgcgcctttcttcttgtctcaccaaataatctgtggatcgtcttcttttggcaatcatttgatccggtacgggttttcagatcgatgaagaatctttgatggtaactcctattttagtttggtttgcttcttgtatctcatgaagacatgaaccttggctgtgctgttggtaactccatttgtcttcgtcgggaaactataaacagaacagtccgaccactttttcatgctaacttctagattcataatgcaatgttggtaaaaatagacaatgaatgaaactttttcatgtataaaaaatatggaaacttggggttgataatgaattgttcatgttaagactaaaataaaaaacagaagagggtgcttgtgtggttagtctcaattgttaaatcaacaattaagttctccgattaggcgttgaattaaccggtcgcccgtttttaattttcatcgttcgattttcaacttaacctgtccaccagaaggtcccttttgtgcctaattttgatgaaatgtcgtcatttcgtcgttgaagctacaacacaaaatacaaaacgttgtagttagattgctgaatctctttgtaccggtcaaactcggtcataccgagtatcaatccgaatgatccggtaggaccgggattttaattaggaatccgaatctctaaattccagatgctaccttatacgtgtacgtcttctccgcccttcttattcatttctactctgctgcgttatttctccgtcgtcctcaactcatcgccggcgtttaccatccgctagatccgtcgcctctccggtcgactatttatatggaatcgtaaatttacagacactaataagaatagtttgacaaaatctgtagctggaata

SEQ ID NO: 3333 - DNA, 3000 bp, Unknown; identical to SEQ ID NO: 3327
  misc_feature (1)..( 3000): cDNA_ID_3071063_gDNA_ID_1620640_Annot_ID_163018 3000 nt of promoter + ATG

SEQ ID NO: 3334 - DNA, 3000 bp, Unknown; identical to SEQ ID NO: 3326
  misc_feature (1)..( 3000): cDNA_ID_2140779_gDNA_ID_1620640_Annot_ID_163015 3000 nt of promoter + ATG

SEQ ID NO: 3335 - DNA, 3000 bp, Unknown; identical to SEQ ID NO: 3325
  misc_feature (1)..( 3000): cDNA_ID_3074219_gDNA_ID_1620640_Annot_ID_163010 3000 nt of promoter + ATG

SEQ ID NO: 3336 - DNA, 3000 bp, Unknown; identical to SEQ ID NO: 3269
  misc_feature (1)..( 3000): cDNA_ID_3070966_gDNA_ID_1620640_Annot_ID_163034 3000 nt of promoter + ATG

SEQ ID NO: 3337 - DNA, 3000 bp, Unknown
  misc_feature (1)..( 3000): cDNA_ID_3071051_gDNA_ID_1620640_Annot_ID_163029 3000 nt of promoter + ATG
catctggtagtgataagacactcgtataccaaggacctgatagtaaacttgaaaatctggattggagagaaatgaaaggcccatttgtttcagtatggcttcataatgttccctggggtgctgagaacactttggctgctcctgacgctaaggtcagttaaacattttgaaaccacgaaaacacgatttttttggaatccttttgcgtttacttgctataaaatcttgaaagcttcatatggtctgattaacagttttctgatggcttcctggatttgattgtcatgaaagactgtcctaaactagccttgctatcacttatgacaaagttgagtgatggaacccatgtccaatcaccatatgcatcatatctgaaggtttgccatgcgaacccaattttatagttgtaatatttcatttgatgactttgatgtctcttttcgaaatgaatcggaattttatgattgactaaaaagcttacacgttggtttttactgttgaaaaggtgaaggcattcgtactggagccaggtgcacgcatagacgaaccagacaaggaaggaatcatagattcagatggagaagttttggcaagaggaagaaaatcgtacaaatgtgatcaaaaggctttgatgtcttacgacaagcttcaaataagtgttgatcaaggtttagccactctcttctctcctgaataattctgactgatacatgagatgtgatgagatgagatgaagttgtcccttgtggctataatttgattgatggacattacaatacaaaaaatgagaagatgattcgagttatatagtaaatccctaaagattaccattgagtgtattgtttattgttgtattgctgttgtattgcagttttgagttttttgttagaaagttgtgtgaactaagatattgagaagaccataaatactaaatgtgagatttttttgaactcttggtgtaaagtgtaaacatatttatgttgggggatggtagtcctaaagcttaaagctttgtggcaaatataaaatgaagattaatattgtcaactagcattagtgtgacaaaaagttgggagagattttatgaggcaagcaactaaaaaattgatgcgacatatcatataactaaaatgataaaatattgtccctggaatttaatttggacctaccatactaatgatgacttggcgttatacattgaatattttaattaaaaaaggaataaatatcatagaaaaagcggaaataaataagtaaagtaaatgttgtgagagagctttctttttcagagagtattttgtttagctgatgaggcaaaaacaaatagaagaaattaattacccgaaacaacaacacttcactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcgtaagcaaccttttccgtacttcttttcttcgcttatttttactctccctgttccatttttttgagttgatcatttttttttttttcaagtgtgcttgtctttgattttggaaaacttacttggttgtttttttcctacttctttctttgtgtaatttgggtctgtcttagtaagatgtggcagcctgtggtaatttctgagtttttttgttgtttgctttgttttggagtatagagtccccatgtgttgactacaagccgagaaattaggagccactcttttcggatgttttggaattgtttaacagtgttgaatttaagtgactggaatatagagttttaagcattttgatgggcgtgtgaggactaattcgtttcacctgaattctttatgtggcatcgatgttgtgtaacaagtttagagtctagaggtccaaagtccaagtgacacgaaagagatagaagaagtgatactaggagacaaaataattaaagcaataggaagctactttgcattctgatccattagattcgagaatttgttcactagtggccggttttctgaatttttatattctgcttcatcaaagttagaaattagacacatgattagtttcttaggcttactatgatattttgtgaaataataaattgggtatggtaatggtttctatgtaaacaataaggtcaccttcatgggattgcaaagccttttgagtatcaggaattaactaggaatgagatacttttgctcttactacttcttgattgtaaacatgcatacatgtgttctgtctttgatgggtttatttttggaaaacatgtatcagtttgatgatataatcttcaataattttcgttcctgtatgtagatcttttcttaaaaatgctttgattctttaactatggatgcgtggagactatatagtgtatagtttccttaggcttctgtttttgttctgaaacataaacttcatcagagctgaaaaagtatagttaaagcttacaagttctagttgcattaggcattaaccaacacaaatagtctggtttttctttgtttgatttcagtactctgcagacacgattcttttacctgctctttgcatcaatttcattaacttgttagtgtattatcgattttgcaaatatctaatgattgtattctggttccagctctgcgtatgaacaaggaaagttttgtgacgtatttcaccaaagggcttctggatggaggtgttgtgagtcatgtggaaaggtaactatatgatttactagttaaaattttctatgtctccttggcatcccaaaatcatacatggggtttccagatgtgaagtctctcactaatagcatttcgtgcagcgaattcattgtggatgtattgcgtctgcttctgcttatacgtta

SEQ ID NO: 3338 - DNA, 3000 bp, Unknown
  misc_feature (1)..( 3000): cDNA_ID_1825652_gDNA_ID_1620640_Annot_ID_163008 3000 nt of promoter + ATG
taagctaaggatgatgcatttcttagggtgtgttctcgggtgggcaagaaatcgcggtgaaaagattatcgtgtacttcaggacaaggagacagtgaattcaagaacgaaattttacttcttgcaaagcttcaacataggaacttggttaggctattaggtttttgcatagaaggacaagaacgaatccttgtctatgagttcatcaagaacgctagtcttgacaatttcatcttcggtaattgttttccgccgttttctccatatgatgatcctaccgttctgttttttctgctctgtgttgatctttacgctgttacagatcttaaaaagcgtcaacttttggattggggagtgcgatacaaaatgataggtggagttgctagaggacttctttatcttcatgaagactctcgttaccggataattcaccgtgatcttaaagctagcaacattcttttggaccaagaaatgaatccgaaaatcgcagattttggattagctaaactctatgacacagaccaaacttcgacacatcgatttacaagcaaaattgcaggaacttagtaagttacttcatcttactaactcattaaccaagaaacaccggtataaacccgttattcatcttgtagcgggtatatggctccagaatacgctatttacggtcaattctcggtgaaaacagacgttttcagcttcggtgtattagtcatagagatcattacgggtaagggaaacaataatggtcgatcaaatgatgacgaagaggcagaaaatctccttagttgggtaagtacacaaaaccaaccaggtaattgaggtttgagtttgattcatcatgttaactgaatttgtaattctgtttgtttctcaggtgtggagatgttggagagaagacattatactaagcgttattgatccgagtctaaccacgggatcaagaagcgagatcttgagatgcatacacattggtcttttatgtgttcaagaaagtccagcgagtagaccaactatggattcggttgctctaatgctcaatagctattcctatactctcccaacgccttcaaggcccgcctttgcgttagagagtgtcatgccttcgatgaatgtttcttcttccacagaaccgttattaatgtccttgaatgatgtcactgtttctgagttatctcctcgttaggaagcttaatctgcatatctttttagtttcttcaatgatggattttgtttgtgtgattttttagacagcttggcttcatctagcttttgaaacgagtagaagttatagctttttcttttagttctacacattcgtcgttaatggtagatttgttttgcaaattcgattttactgtgttttaaaacatataacatgaaatttaacttaagaaaatgaaaatagtattagacttttactaagaaaagctttctactttatcctacacatgaaatgcatacacattggtcttttcaaaagcaacaaatcaatgttaaatacagttttctttatcttaactcctaataatgtagctatagaattcatgactaagcattgtggacccttggagcatttttagatggagatgggtgtttgtttctttattaggttttgttgcctagtagccacattctctcagttaaactaatacatttgtaaattttcacttgtaatcaactaatccaccaaatgaatcaataatgtaaactccagaatcgatctggcattgtatgagtatcaatatatgctttagtgccacttgctagtgcaatccacttgaggtttggctgcatcgatattagatataaatacttaagcgtcatgcaaaaaaaagattactaaataattgtagggttattatgggattttaggcgagcaaacaacatttaaactttgaaggaatacaatttgaaatatcaagatacgtaaaatatgtcacgtgcaataaaataaagagaagacccatccaaatcaagtgtgcgatactttgaccatatgagtcaatgtggcggccaaaggcaacaagcatatctaatctaagtattatataactaagcaaatattccactaaactagtatacaaagccaactgctccactaattgcctgacatacttatttattttcaaatttggtaaccacacctatagcttatacattttcttcgatggccttatacaataggaatatactattaccttctcattgttcttattatcatcaaccatttgataaatcctcatcactcttaaacattgactatgaactaaggacgtcagaagtagtccatacaagatatgaatggttggatcgtcctaagtcattgtattaatatacgtttctaatcaatggaaactatataattgtaatataatttttactaaatcatgtaacttgaaaacctaactttctttcttaataaaaattgaaccgctaaagtatctaatccatcatgtgtcaactgacaccgtccaaaatcctcttagagatgtaagaaaaagtttcaaaacaattaggtcagccaccaatcacatatttctatgcaggttgtataatcttgaaaaagaacaaaaaaagtagatgacaaaaaagaattaaaagacaataataataataccttataaagatgataataattcaaacagtttgacctttttatttcaattctctggtccaactttccaacctgacgagacaaaaatatagaaacttctcaacagcaataaaacagcaacctttcctttttgtatcccttctcctttgtcacctctcctcttacttttttatcaataggaagtttccgccattgtgacagacacagttcctctgtttctcttctttcatctttaagcaaacctcaaaaaccaatcctttattacgaagatcctcacttgtgtcttcttctccaacactaaaccccaagaaaatgagattcttccgcaaaacctcactttatctttctctcttcttatacttctttctttatgaatcttccatg

SEQ ID NO: 3339 - DNA, 3000 bp, Unknown; identical to SEQ ID NO: 3332
  misc_feature (1)..( 3000): cDNA_ID_1820417_gDNA_ID_1620640_Annot_ID_47465 3000 nt of promoter + ATG

SEQ ID NO: 3340 - DNA, 3000 bp, Unknown; identical to SEQ ID NO: 3331
  misc_feature (1)..( 3000): cDNA_ID_1820413_gDNA_ID_1620640_Annot_ID_47466 3000 nt of promoter + ATG

SEQ ID NO: 3341 - DNA, 3000 bp, Unknown
  misc_feature (1)..( 3000): cDNA_ID_1820409_gDNA_ID_1620640_Annot_ID_47467 3000 nt of promoter + ATG
aaatcattcaacatacaagattgaatacatcctctatcttgaatacaccctctaaaatattcttttttataaacaaaaattcaatgtttgaaacaaatggaatttaatgaagaatttaatatctgttgactactaaactgttttaaaaaaaaaagacaaaaccaaaaccctcgtcggggcttttaaatgcaacgaccaccaaagtctttctctttctctcagcttcgaaacaccgtcacgccatggaagaagaaactctacaagtcttcttcttctctcatcctctcttctccattttcataactctctacagtctaatcctcatctatttccccaatgatttgcttcgaatctttctctcccctgttcttctcatctccggagctctccttctctctcttctccgtctcggatcgacccgagaacctaacacccaacccgataaaagctacgaggagtctgaagaacctaaggtttttctggttcgtgaatccgatttgatgggtggttttgtggaatggaacttgagagcaccattggaagtgattcacgaagcttacgaagatgaagaagaggaagaagaagaagaagatccgacccggtttagaaaaatggagagattcccatcgttgtcactctgttacccagaatcagattcggaatcggattctgcttcctcgtcagaattcaatttcccggaaatcggtgactggaactcgccggaaaatatgggattcagatgggaagaagacgagggtggaataggatgtgaaggtttgattgagataaagctcgatcattatagccataataggaagatgatgagtaaaacagagattgattttcatgcagaggaagatggtttgatcgagatcgatctttttccatgaagaagaagaagatgatgattctctttgtgcttccgattagaaagcatttttccgattagaaagaaagaaaaagaagcaacaattaatggttgttcatttttttctatacgaatatcatttgtgtaaatattattatacgagtgtaattcaattttcaactttttacacaaggattaattaatctccgatttaacatgatctggaatttaaaagtcgaatttttaagaaaagtttttttttttttttaaagctgaaaatgagtaatatatatacgcagaatttaattaataatccaaaaatgaaactgaaactatccatatctacaccaatttgaaaagaaaaaaaaaaacttttttttttctttaccatttgaaaccagttaacttgtatactttgtttttaatacttttataattaaattgtatacttatttatgagttgtattaccagagtaacattatggattaaatacattacataaatatatatataatatatatatatatatatatatatatatatatatatatatattcaattgctttgtattgagtgattgagatctcgcagatcaaatcaacatatatttcatctatgttgtcaaatgaatagctcattggatttcttctgcgtattgttgttcccacaaagcaatgacataaaacaacattataaaacatgtagaaatgagtgtcacatgataacaaattaaaccaacatatgcaatcaaggcagacttaaggaattcagagttcctgaataaatcttaaaaattggcctttttcatactaaacaacaacaaaattgggcccttttttatgctaaaaaaattcttgaaaatctaaacaaataattgggccttattgaacatacagtatttgtaacaaaagcaaccgattaaatgaatgtagctgtgagtggtcacaagtctaagcttggcttgcctgtaatcatcaacgctatgcgtgtaataatgttgtcttagagtcttaaaatgagtcatccattttaactcacgacccttggttgtagacgtgtagtagacttaaaaaatatttgtcatttgatcaagttggctaatagcctattcctaagtcacatcctaacttattctattgactagataatatacaaacatcataggaagcaaaactttaagcttaataagaagtgctcgatgtcataggtagccaacattgtcttcttgcttactgaacttgatcctctttgcttctctctcgtttactttgtattggagtcattacaaggagagttatatgtatcaaatcgcaaagagacatatgcgacaacgatcagaaaacaataattttacattatgcaaaacgcagatgcatcacatttttattaattcttcattaaaggttcaataccgatatgataaaaaaagaagcacatggacaagaactcttgccgtggccgtcaagtcaaaccaaaaagctggaaaacgacacgagtttctgtttctcctcctctctatttgttggctcagcttttctaatttccttatttctcattttccttttgtccattgcattgacacgtgtccaaccaaaacggttagcatcaaaacagaattatcgtcactctccttctcccacttggcctctccacatcattctttcttctcctttctccatgattctcggctctcgatctctatgtaagcagagaataaccaattcgttcttggagactgaatcgcacatcaagagaaattatgagacctttcgcctacttcgaaagattatcccaagctttccatgattatccttctctctccaaaattctcgtcgtctccaccatcaggtcagtgtaccatctcttcgccgattcatctgtatttcacgtttgaatttctctatttgaaactttgtacttctctataaatttactctgttctgtattctgaacgtatcctccttttgcttttgccataaattgatctgcgtcatgagacttttccttcgcaaaattttgttttcccgtgtatgcaacagagtcttgttatgtttacttgtcatatacgttagatcgaaatctgtgtttacgagagcagagctgatgatattcataatcaaaaatatagatg

SEQ ID NO: 3342 - DNA, 3000 bp, Unknown; identical to SEQ ID NO: 3330
  misc_feature (1)..( 3000): cDNA_ID_1395335_gDNA_ID_1620640_Annot_ID_47469 3000 nt of promoter + ATG

SEQ ID NO: 3343 - DNA, 3000 bp, Unknown
  misc_feature (1)..( 3000): cDNA_ID_1820402_gDNA_ID_1620640_Annot_ID_47470 3000 nt of promoter + ATG
acctgctgaagctcttttcctgtaccacatactgactttaaaacacgcttcacaccctactgaacaagagaactacttagtggaatatgataaaactagtaccctgaagaagatcaaacaagtaaagcttaccacttcgccaagagagttaactaaaaactgattaagcgctgggcttattcgtgcaccacccaaaaggctaagaaattcttcttgaggagatgattccagtcctagtagaaaagcaacaaagccctgtaaatctataagcaattaagcataagagaaaaacctcaaccaacaaactgatagtgacaaataccattatcaatgatcaaggtggaaagagaatgaaacttttcatgaaaagttttcattgcatccgcccattgtttgttcataactgacagggatgctcgaataacctcggtcaaatcttcaatgttagaagcttgttgagcaacctgatgaagctcatatttcctgagataaaaattagaagagataacgaatatgacagatgtaaggcagaaaaacagtgccaattattaaaggttattaaaatcaagatttaaaacaatgagaaggaacaaaagaaagaagcagcggcaaagtatagctaggtttggtgtattaccttttccaaaatatagatgtgtccattgcaaggcaatgtaaaccaggcagatcttgaacatttattttttcctctcttggcttgatatcacaatccttaagctctcctgtgcacattactaccagacggcaaaggtcttttgacagagcaacctaagaaatgaaatatacaaataattaatttgaatctaaagactccttatcatctaccaagctctcctttctttgtttccacaacagacattaacagtctgagacatgagaaataacgagaggccatttatatcatttggaaagcgtggctcttgaaaggatccaagtaccttgtaaatggaagcattaaatagtttgcaagaggcatgctcatcgagatgaggcacaggaagagacagctcgtgtatgttctgatcatggtaatgcaagagcagcagagcaaacacatgaaacaagagaaatgaagacttaaattaaaattatactaagagaatattgctcatagctagaaaagaaataagaaacttacaaaccgtaaactttactcctaacaatattaattacttgttataaacgaacaattaaggatctcagaaaataatttccatgtagaaatagtgttgaaattcattaagcatcctgcaattctatatgcaagcggaatggaaagatgatgaagcatcatcaaccataatacatgaatggataattacggcttactaattacttacagtcaaaagagcgacttacaatctttcctatctgaaatattccaaatatactgaagcatatgttcccatcacgatcaccagtgcaaagaatgttaaacttccggaatgaggtattggatagctctgccaaagagtcttcaccgtcatccatgaaactggagtcaccagctaccagtccaggcatctttggaggtcttggagcaggaggaaaaaaacgggaggtccggtcctcataaactgagaaattaccactttcatcctgtaaaccaaactctaagaaaaagtaagcacaagctcaaataactataagagttgggtgtgaaaaaaaaaactaagagaatagatgcttcaactgggattggtaaaagaaactttctcagtttgtcaacacaaatatagataccgcaaccaaacatgagttcttgtacaactagtcagaggagaaaacatacagtattggattgtccatcctcctcccagttaagacacacgacagctacatcatggggcttcaagttccttaatagcttcccattctgcatgaaaagagtattaccaactttttgatcagcatgatcctttataaataaaacataatactagtttctatacagcaaagtttaaaaaggaatatttaggctatcaacaacgtcatcatgtaaaacatggattagtttcaatctatacttgcctcaacatcgtgaagtgaaatggttccatcctcgagcccaacagctatggctttgccatcaggacgccaacataaagaagtaacaggctttcctataaaccaaaagaaaggaaatacacttagtaccagaactattgacaacctacttcaaattgcattccactttcaatttcagcaaataactaagttccacaaacgaattttcatcaagcctgaaagttaaggaatacaataatcacaaaccatcttgtaatcaaaattgtctactttaaatcaaacaaagtgaacaaaagagagaaactttaccaggcgaaatagtccataatctctgccaattgaaccgatgcagcaaaatcttggagtcctcagtaaccattgccagtaaatccttctccgggttccactcagctatcttaatctaatgaaattgaacatatataaacatctaaatccttaaaagcataaaaaagacacgaactttgagcaggagtagaaccaaaacctgaaaaggtatgggcttgtcgaactggagctggaaaggaatgatattttcttcctcgtcactcgccatttccgacattccgaggtttttgggattaggggttaatattctaattttcaatatctagcaaagctgtaggaaggaagtaactagagagaaacacttgagaagaaagctgtagagagtggataaaggaaagaagacggtggtcgccgggattcgccgatccgccgggagaagagagagacgcactaatgacaaacctggcgggcttttcttccaaattccaatcaaaatccctaatccggtttttggtttaagttcggttcaatttgtcggtctgagattgaaaacctggttcaggttttggagattttgactggggtttagaacgaaagtaaacctctctctgctgcttttttccagaagctctgacgaagaagatg

SEQ ID NO: 3344 - DNA, 3000 bp, Unknown
  misc_feature (1)..( 3000): cDNA_ID_1820394_gDNA_ID_1620640_Annot_ID_47472 3000 nt of promoter + ATG
agtttatgaggaccggacctcccgtttttttcctcctgctccaagacctccaaagatgcctggactggtagctggtgactccagtttcatggatgacggtgaagactctttggcagagctatccaatacctcattccggaagtttaacattctttgcactggtgatcgtgatgggaacatatgcttcagtatatttggaatatttcagataggaaagattgtaagtcgctcttttgactgtaagtaattagtaagccgtaattatccattcatgtattatggttgatgatgcttcatcatctttccattccgcttgcatatagaattgcaggatgcttaatgaatttcaacactatttctacatggaaattattttctgagatccttaattgttcgtttataacaagtaattaatattgttaggagtaaagtttacggtttgtaagtttcttatttcttttctagctatgagcaatattctcttagtataattttaatttaagtcttcatttctcttgtttcatgtgtttgctctgctgctcttgcattaccatgatcagaacatacacgagctgtctcttcctgtgcctcatctcgatgagcatgcctcttgcaaactatttaatgcttccatttacaaggtacttggatcctttcaagagccacgctttccaaatgatataaatggcctctcgttatttctcatgtctcagactgttaatgtctgttgtggaaacaaagaaaggagagcttggtagatgataaggagtctttagattcaaattaattatttgtatatttcatttcttaggttgctctgtcaaaagacctttgccgtctggtagtaatgtgcacaggagagcttaaggattgtgatatcaagccaagagaggaaaaaataaatgttcaagatctgcctggtttacattgccttgcaatggacacatctatattttggaaaaggtaatacaccaaacctagctatactttgccgctgcttctttcttttgttccttctcattgttttaaatcttgattttaataacctttaataattggcactgtttttctgccttacatctgtcatattcgttatctcttctaatttttatctcaggaaatatgagcttcatcaggttgctcaacaagcttctaacattgaagatttgaccgaggttattcgagcatccctgtcagttatgaacaaacaatgggcggatgcaatgaaaacttttcatgaaaagtttcattctctttccaccttgatcattgataatggtatttgtcactatcagtttgttggttgaggtttttctcttatgcttaattgcttatagatttacagggctttgttgcttttctactaggactggaatcatctcctcaagaagaatttcttagccttttgggtggtgcacgaataagcccagcgcttaatcagtttttagttaactctcttggcgaagtggtaagctttacttgtttgatcttcttcagggtactagttttatcatattccactaagtagttctcttgttcagtagggtgtgaagcgtgttttaaagtcagtatgtggtacaggaaaagagcttcagcaggttgtccttgaccatcttcaggtacagtattctttacattcctgaaaatggagttatagtttttagactaagtagcgtttatttatacagctaatactttttagatagagttttgtcacgaattaagctttctttttcagcctgcagcagaaattatcggattcaggataggtgaattaagaggtctatcgaggtggcgtgcacggtaccaaggcattggtttggatgagatgctccttaatgaagccactgaaaatactggtctgctacttgtacaagtgcaacggtttatgatggtactatcttctgttgtccaacaggtacagaggcgtgcagttcttttgacactgaaaatcatagttatttagtatgttggctgtcccatgtttcccacgcaatggtcatttcaatagaattataaactttttgtttcagttctcaaatttcttcaactggctcgtcagaagtataaagtatcttatgcaagaaccgaatgatcagcttttgtcatacaacaggtatgcacatgtgtttttatgttgttaaaggtgttaaagccaaatctttgcagttacatggtttgtttctgtggcagtgaactccttgtggtattcttgaagttcttatatgaccaagatcctgtgaaagacctcttggagctatctgaagctggtgatgacattgaaattgatctgtaggtcaactctttctatgtctgtgcttttacctaccttttctgatcacttatcttgtagtcgagcagaatctctgtcaggttacctaaaattttttaagccatttataaccacatacaataggggtagtccaatgtgataatacgaatgaaatccgagcaggtttctctaaccacactaaaacgaaattcagatatgggtaatgtgtgtgcgtttgtgaagcatgaagtccattgtatcatccctagctgttcattcactttgttttacttcatttcatttaaactcttaatgttttaatgtcccagcaaaaccatcggaagagtcaaagagttacttcagtttggagggttttcagagtgtgattttctgcagaggacattggctaaggaattccaacacatggagtctaggtattttctttacatcttcacttcttaaaacataaagtttcttaaaaatgctgcatcatggagcacaacgttggtaaactgatacgtgtaaaaggctatggtagagacaaaggtccgataccatggctgccttggcattttgaaatacaacatgaacaaccatatttatggtattggagtttacttgcaaaacaaagtgtgctgagtctttataatctggacatactttctcatggctttctctgactagacgtcaaattctgattttaatgctttaacaattttagcttcaag

SEQ ID NO: 3345 - DNA, 3000 bp, Unknown; identical to SEQ ID NO: 3250
  misc_feature (1)..( 3000): cDNA_ID_1820382_gDNA_ID_1620640_Annot_ID_47478 3000 nt of promoter + ATG

SEQ ID NO: 3346 - DNA, 80 bp, Unknown
  misc_feature (1)..( 80): cDNA_ID_2991393_gDNA_ID_1620642_Annot_ID_47504 3000 nt of promoter + ATG
gaattcgttagcgtttatgtgaataatcatccatcatcaggaaagatccgaagaaaagcgacgccgttttaaaggagatg

SEQ ID NO: 3347 - DNA, 2814 bp, Unknown
  misc_feature (1)..( 2814): cDNA_ID_2991393_gDNA_ID_1620642_Annot_ID_47505 3000 nt of promoter + ATG
gaattcgttagcgtttatgtgaataatcatccatcatcaggaaagatccgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggtgagattatgattgttactgattgtgttagttatttcattgtttgatgcacaaatatgagaaacctctgaatgaaaaatgcttggtttgcttgaaatttggaagagttagtgtaatcaagtggctagaccttatcatttagtgtaatctatgagtttctaaatgtgtgttggcttcttggttcatatacaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatcaatggcggcaaaaacttttgaaattcgtttgctcattgatctcacaacttttttttgcgctttgtttctctcatcgatctcagttttatgtgtttatctctccttggcagagtccatggttgagcatcttgatcatcccgacttcccctgaattcgcctactttgtcaaaaatgtgttgtgtgtgtgtgtgtgttgttcctctctctctgcctccctcgtatgaaaatggtaacatttacaattggaaagtcggtgttagcctttagctattagctgaagagctagttttcttgttgcccaggccattctttaccctatttttcatctgaagtaacaatgaaacaaaatctatatatactcgagttttgctttctaggatctgtatttcttaattgtttctatattttgatcaattttgaacttttcatatcaagttatcaacatgtgtagtagcaacccttcaataatgagaccatggaataaaagcctatcctatatgtcatccagtttttgctaagataaattattttcagttacccaaattacataatcaaaactgatatcataaacaacaaaaatagcacacacaaaaatcataactgaatctgattcttccagaaatgtgaactgttgtttactataaaaagaagaaaaccagaaccacaatacatttgactccatgaatcagtcatactagtccaacatactaaatataaaacttaaggggcaatattgaaaattagacaaaagttgatagaccaaaagataaattaataacagttaccagtatctatcgccaagtctcccctagggttttttttctctgaaacggacatcgagaaattccaggagtgagttttgacaatcggagagaaatg

SEQ ID NO: 3348 - DNA, 3000 bp, Unknown
  misc_feature (1)..( 3000): cDNA_ID_1820550_gDNA_ID_1620642_Annot_ID_47506 3000 nt of promoter + ATG
ctgttgtttactataaaaagaagaaaaccagaaccacaatacatttgactccatgaatcagtcatactagtccaacatactaaatataaaacttaaggggcaatattgaaaattagacaaaagttgatagaccaaaagataaattaataacagttaccagtatctatcgccaagtctcccctagggttttttttctctgaaacggacatcgagaaattccaggagtgagttttgacaatcggagagaaatggggtcgacagaaaaagagcagacgacgcaacatcacccgcctcacatcagcagtctcgtcgtacgtccctccggaagcaacgacagagaagacggccgcaacgccgccggagactatgagcccggagaagtctctcgtgaccggccttcgtttaatcgctcggatcggtataagggtgacaatggtggttcgtatctcttctaaacattccagtcctcttttctcctgagtttctcttctcgttattggtttcgatttctgaaattgggggaatgaagaacagaactaagtaggcatcacttgtttctttcactacaaatgcttgtgattgtctacgtcttagtcaatgttttatctcctttgacttgtgattccgatgaggggaattgtgtgtagttatctcgtgagcatttggtgctatcttaaaggtttttgataatgctctcataactataacaatgctgtgtaaattgcaaatgagcattgttcttgccttgaagtacttaggtcttgatgtttacataatgcattgttttcgtaaaagatgcattatgtaatgtatctaaagagtatagtgactcttagtgcgattatacattgctacagatgcatatcaacattccctgttcagttcttagtgaattgtttggtatatgctctgagaatgctgacaccaacggacttgtaatttcacagtgtcagtgctccattttattggtctgcaaagaaaatgattttttgaactttgctgtctgctgatgtatatttgtattatactgtagttgacttagtcttgttctactggctactttttgtgtgtgtgttaggacatagaactcgggcaagttctagctcaccaggccgtcgtggatatgaagatcacaagcatggctctgatcttaatcattcaggcgttccacctcgtggccgtgagttaagcagcagaagggaagcacctgggagacacagagactattccccacccttagctagaggtggagctggtgctcgtccttatcgaagaggtttagatgggcctgaacctccacatggaagggatggcatgagcagaaataatatatcaaaggtgcaaccaagagaaggagattggtactgtcttgatccattgtaagtatccctgctattctaaatttctacaatctcaggttattctatatgaactctatagaatattggtatctcagaacctagagaagtttctaaatcccatattatgtttgttttgtcatgaatacagatgcagaaacttgaactttgcgagacgcgagtcctgctacaaatgcaagaggcatcgttatgcaccggctaatagtcctccactgcctcgccttcttcctcctcccatgaatcattccccaagaagagactttaatggctacagatctcctccgcgtggctggcccagagactacccgccgccaaggcatgaccatcccacatggagagacagagaacgagaccgtccgcattactcagaccatgagtaccctcctagcagaaggatagcatctgactgggcccatacagagccgctcccaaaacctcattatgacagacgaccacctctcagtccacctcgtggtggcagatggggacgagttttgagagagaggagcagatccccgccattgagagatgttccaccaccgccattgagagatggtccaccaccgtcattgagaggaggcggtccaccgctgcacagagattaccgccgtgacagtcactttgacagagaaagacgagacgatgggcgtggcggcagaggcagaatgggaaactcttactgatgcaaaaactgtgtatgtcttgggattttggtttagacagttcaaattttcgcggaatgtgaccttgtattacaccttagattctttgttcttgttagcaaaactcttgtgccattagtgcaaaaaccaaacaaatgagaagcaattttggtgctctttcgtaattaaagaaacatttagggccgaaacaaaaaatatacttcttcttaatattccccttccgtttcggcttccgcttgagaaggtgcgtactatgagttcacgagtggtctatctacgtgtcagttttttattgggtgatagctaaatacacgcatattaaaagggctttttggatatttgcttcaccgtagatcggacggtggaaagagacaaaacctaaagcatttatgaattgacatcgttggatcatcgtatttaacaagaaccgtacgatgagattgccacgcaaatctaaccgtcgaatataatccagaaaattgaaatttcaaaacatgttagagagagggaggaggagagatggtgtgagagaagaagaagaacaaaaccgaaagtatttttttgtgcttttaatttttgtttttaattttaccaaattcctctgagggcttcttcttcttcttctccgtcttcttcttcttcttcttcttcgtttagagctaaaacccaatagaaccctaattctcatctcccttaaagcttatcccttttctctctctatatatatacgcggatcaaattcaaagtctcagtttttgagctttcttaacagccgccgaatcgatttgtgattttcccgctccggagagattcggatctggatttttcgagctgatttgtaggaatttctcgttttctcgcggtgaattatatcaactgtggaaaaaaggaaaatttctgggtttttttggttttggagattggaaaatctttgagag

SEQ ID NO: 3349 - DNA, 3000 bp, Unknown
  misc_feature (1)..( 3000): cDNA_ID_1820546_gDNA_ID_1620642_Annot_ID_47507 3000 nt of promoter + ATG
gtaacttaactctagtgtttttgtttagtggagagagtagtgaagagtgttaagtacttgggggagatttatatagaagagtgaagggttaaaattagggttatagagtgacagatggataagttataaatgaatgttggaccatctcatcacctatatgttcgatgcagatccctccacgtcaagagttacaatttacttctcttatgtatacataaaaaaaaatccattttgttctcttgtaaatcactgatattagttagaagttacttttgacatgatatatgcatgttgtaatgttctatcttcttctatatgtctataattgtttcggtaatttcctggcatagatatggattaattcatcggatactctatttcgtcgatggattctttgtggtaggtaggagggttataaaatggactggagattataatgagattaattaacgtttttccatgcaattttgatcgtatgttttttcttgtcaaataaaaaaattagagttaagagatgtaaagttcaagtgtaaagttcattttcttgcctcactatttttggtgaagtaaaaaaatggcgctcatgggaatttacacaccaaaagactcgactcacattttgtttctccatattgatatacaaacgtattttccgtcagtttacgtacgcagagtatacctcaaattaaaatgcttaaaatcagttctcataatccaaaactctataaactttttgacaaaaagtaaagaaataaaccgaaaatgttaagtataaatagcaccttattaatgtacatatatgtatacactacaagtgcaataaatgagagcatgcagagcatgtggctgcgcccaaaggccaaagttagtagaacatgtaaatgcattaaattgacaggttgggagacaaaaagattaatatggaagattaaaaaaatctttcaaatccataaagtaaacagtatttctcgagaaatgatgatgtaataagtaatattaatacaaaactcgaagctcgtaagttaattggtgattagttgcgtttcttaaggaaattgtttactcaggaagaaggtgaggatgacaaatcagatgtgttttgggtaggaggcaagagtaatgatatttttatttgagttatacaatagtcgagtagatgtattaagtaaaaattgatctatgtcaaatttgttctttgatacataagagatcaaacaattacaatcttgtttagagtttatatatagtgtcggttttgaaatacacagttttaacttctaagcaaaataagaaacaactaagacccatataatttttacaaatcgcgaattcatattaaacattgcaactttaaatggtactagctagttcaaagattagagtttttagtcatttattgacgatactgaactataaacaccctaaaacctggaaaataaattgtcactgaaaattaaatgatcacgagatttcgaacagaagcaatattattctatccaaggcattatgtatctctctgagatattaagaatgacagctgaagccagtgaaaataagttgttcgttgggcctttcttgtagttcagttatttcacctcttcaatgctgttttgtcttcatatcaaaacatattaatatactatagactgtgtaaaaaaaaaaatcatatactatagactatatagtctctctctcttctcttgtgattaatactcgtaagttataagtatgaagcttcaatttaaaatgactttacatttctactgtggtacagctaagagaatagcatacttaatggttgatcatttgatcttgatagtttagtctttgatgtgttggcagcaaatggtatcggactaaaaccgaatttaatctacaataatttgctatcgattcaaattatttgaaactattttagtcatttgtcaaatcattaggctgaaatcgtttaacagaaaacaaaagattgtggatcttatatatactaagtactgaatatacaaaactataaattttcaaaccaacaaatgttagtggacattttcatataattatatttgtcatggtacattatatagcattattcggagaaaaccacaaacgcttatagatatatttgttcacatccttggttttgttcgggcttagatttgctgaaagtaagggtacattaactattgtatacgatcttaatcgtctgaataaaaattactccattaactataatgttaggtttggttcttattggctgcgaatattttattttaattacttgtcaatataatgttttttttttcttaacacttacttgtcaatataatgtttaattattattttatagcacaaacttatttttttaaagaaaaattataaatcattataatattttgtgattttttttttattttttttgtcgtattttgtgatttatcttttactttaataaagtgagtttttttatttattttttgttgttgttgtaataattgaattaagaagatgggcccgtacatggctcaatatacttgtcgttgtagtccactattggcctgcaaatcacaaaaatgtattaagaagcccaatatttgtgggttcgaagtttaaactgaaccggtataagttgagagttaacgattttgaatttggtaactactaaaccaatatctaaaaaggaactctcaacttgtgatgttatcttctaaattattttgttaccgctctatgtttatcaatcgggattcatatagttgaatattaactagctggacaggccccaaacaaatatgaatgcggccttgttgaccagaagatttggttgcttatgacgaaaatgacgaaacaacaagttaggaaagaaatatcgatcacgttacaaatgtaaactcctgatttatcaaaggccccatttttatcacaaaaccagatctttatccaattttgtcactcaccgaataataaagctttcatttttcaatctcatcagagagaaattaagctatg

SEQ ID NO: 3350 - DNA, 3000 bp, Unknown
  misc_feature (1)..( 3000): cDNA_ID_1820542_gDNA_ID_1620642_Annot_ID_47510 3000 nt of promoter + ATG
gatgaagtcattttgatttattttttttttttttttttttttttttgtgtgtgtgttttcctgcttatgaaatagaatagttcaaaaccttgcactatataaatatagagtagtttactatatatcgtttctcagaaattcagaatatatggattaatgtttatttatatgctatatatgataggatatgttattgactgagagtcattatattctataactttgattatttgttatggttatttttttcctggtcaacttctcttttgttttaaaatttaatttaattgataattttgtttaggtaagtagtttatgaagagacaaactgaatacaatatattttggaaaaaaatactgcaaataaagagcattaatttcgttacagtttgttactattgcatttcaacgaatccaatatattgttattaatttcaataacgtaacgtaaaactctgaatactttaccagctacttttatatagttaacaaaaaagtatgccaatactgtatatataactttagtttaagtaaaactaggttaatgaaagaaacagttactttaacatatttattactttatacattaaatttattcgattatagatttcaaattatagtactgttcataatcacaatctaaaccacaatattaaaaaaaaaaaaaatcacataataaactcaaaactaatactagcttacaccacagtataaattagaatttttttatttttaatatattatcacacaaccatctagtttcatcatttaatgtgaccaacctttcagcttcaattctaattaacctatgatcacgtaaatgatttgcagcatgactcttcattaatgcgatgtaataatatcaaaattaccgtttcactttcccactataaaaagaagtaacaataaaaattcttcctaaagtttttgcttgcccggaaaaaaaatgaattacatcaaacaatttatcttggcaatttgcttttatctagtcttaacatgtcaagatcatgttttagcccgcgacaccaccacgagagacatcgtagtcccgaagatttccgagtggcaagttacggttgctaacggtttgaccactggtgaaactcttttcatccattgtaagtctaaggaaaacgatctaggtgatattaacctgaagttcttagatagattttcttggaattttggagaaaatatgcttcactcaactttgttttggtgctatatgagcaaagatgatggtcatatgaatgtaaaagtgttttgggatgatgttattctatttcatagatgtgattggaagaattgtgtttggaccgcaaagaatgatggcctttatctttggaattctgcaatcggtgaagatgtactgtcggagaaatggaaatctggatggtgaaaacatatttttgatttgttggtaattttttaactattatatgtatctgttaattttggcaggcaaaaaaaactgaagtaatactttacttttgtcataaattctctcttatttttttgtatttttcatcgaagatttttgttttcttcgatcgtgtcttggattcaattgtttttggactgttcaagacaatggtttgctgctttataatccacctcatcatagaggttttagattgatatataaaggggattcaccatgattcaattcattgttgaagtcgagagatctttgaaagtttattcgagtataatccatattaaagaaaattcaaccatgtattttgatcacgatatactaataattaattatcagtatgagattttatgtatttgttatttatgggggactcatgggtcaatcatttctaagaaagtatggatcatggattcgttttcgttcaacttatttatgaccatatatacaagtactaatggtgacactagaatacattgtatgacaatagtctcttgaaaacaaagtcaaagcattaaatatagagatcggagtcaacaatttagagtttatagaattaaaaggaaaggaggataagaagaagaagaagaagaaaaacttagcaaatatatgaacaaatatataaagacattgtaacacatttacctctgacataagtttttttacatttgacaagaaagattttagaaaaatgggaaaatctttgctaagtttatttgttatcctcctttcgtttgattctataaactcttatttgatgcctcctctcttcagaaaattcaatgtccaaatagtaaatcaacttgagtttcacaagatactgaaagttcattgcaagagcaaatctcacaatttcccaatcacatatcttaaaattggtgaaagttttcagtttaaatttaaaatttatccaaaaactcagtattggtgtaatttatggcaggtgagaaaacacatttttaacttttttatacatttctttacatattgtcatgtataaaaattaagatgagtatcagtgattgtactataaatttttgaccaactttttatttcatctttgtttgttatagggaccaaattacaaacaccatgtggtttttgatgcgtttcgtccagacaaagattttatagatggtacatgtactggtatgcatcctaatgtatgtagatggactgcaaaagaagaaggagtctatgtccgcaacaaaaagttcgaaggagaatatttcatgtatacatgggatggtccatcaaaacttggaaacatctctccagtgtctgcacctacaagtgaatcagaattggactcatcagtctaaccccacatagatctaaaaaaaattatatcatgatgtataatctttggtatcaataattgtatgttggtttcaattacaagcccaactattgtttgggcctaatatttatatatgggccttagtcaaagattaaaaaaaaaacatttcttcttcccaaagccagaaaatatcagtacaagagtacaagagagaaagaaaggaacctcgaactcagagaaattgagagaagagagaagaatc

SEQ ID NO: 3351 - DNA, 3000 bp, Unknown
  misc_feature (1)..( 3000): cDNA_ID_1820534_gDNA_ID_1620642_Annot_ID_47512 3000 nt of promoter + ATG
tttcggtaatctattgtgcaaacatcggctaaatagtaattacacaggttcttttaagttttaacaaatcgaaacttacttcataatgtgaagagaggagataattcaaaagttactaagtgtcgcttagcgcccatgcgagacaaatggttctgtaaacgtcaatgtagccaccgaacagggctctgcaagggactcagctgcttcaccgaagccttcaatggctccaacgttctccctagctttcacaatgtcaaacaagttgtttggtagctgagccacaccgtccaagaactggatgacgctcgacatgcttggtctgacggctgcaaccggatgcgaacagaacaagccgagcttcagaaccagtgctacttgctcctcaaggtacttatcatcctgctttaccctctcatcaaccacttgcaatatgtcatcttcccaacaatctagcacccaatccgtaagaaccatctcgctcggcgaagatgctcgtggcaagacgggtcttcgcccgcaagtaatctctaacattagtattccaaacgcgaatacatcagaacttgtgcttgccttccctgttcttgaaagctctggtgagatgtatccaaacgtaccagccacgttagaggtttgaggatcaaacccgtgttcacagagctttgcgagaccaaaatcaccgagctttccgttcatagaatcatcaagaagaacgtttgctggcttaatgtctctgtgaataatgacttgaacccactggtggtgtaaatagcagagaccagaagcaacatctttgatgatcttgaatctttgtgaccaatcaagactctgttctggttggtggtagagaaacttatcaagactgccttttggcatacagtcgtaaaccaaatagagttctcctttgcgcctacagtagccaagaagccgaactagattaggatgtctgagacgcccaatggtcgcgatctctgccacaaactctctcattccttgtcttgaatcatgagaaactttcttcaccgcgatgtccatgttagacgtcgataatgtacctttatatacttttccaaaccctcctttaccaagaagctcgctgttcctgaaaccctttgtggcaatgtaaagatccttgtaagcaaacctatgtggaccaaactgaacctcccagtcttcaagaacttccattaacttcttccttttcaagaaaagcatatagcttatggtcaagaagacgaggatggcgaggctggttaaactcaaactaatagccaagatctttttcacacttgtactccgagagtctctaggaagttttggaagacgagaaatatctatatttgaagctgtcccattgagcttgaaggtccaaccaagaatatagtgagatgaacgaagacggcctgtggctgaagtgaagccaacatacatagagtcgaaaagatatggagataaatctttggttagagaaagcaatggaatctttggcttagggagatgaataggatggattgtgacgttaagttgtctccttgaggaatcatattcaatccaggcttgtataggtttttgatttatgaggcggatgtttttgaaagtaccatcatcgtcttcgtaataacctgctgtagaagctttctctgagctcaagctattgatgtcaataccaacatggttattatccatgtcatcaaattcttgattttgaaatgtatcaaactcaactgctacaatatgattagagggatctccattgtttgtcaaattaaagagccctagatattgtgaggatgaactatagggcaagcctttggtgggagagatgacaaatgcaagtccatggccatcaagtgcattaacattagagactatagcgaaaacaaaggtagtggagaaagacgaaacggtaccgtttggtgagttcttgaatctaactggagagttgtagaaaacgtgaccatatgagaattcagacgaatttgtgagcttcatcaagcctttggagttagtaattgcaattccagagttgtcgtacaagtaaccattaaaaccaaactctccttcttcactctgagaaagtgctttgttggagaagaattgcagcaccagaagaagcactagtacaaaaaatttcatcgttttgcaattcttttttcctctcatgaatgatcttaccataagtttttctttttttggtcaaaaccatatgattataatatgaaaaagatctaaataggctttatctgtatgacttggagggtcaaaaactaaagtcttttagactcttagtaataaaatgttgaataagtcttgttcgacgcctcttattgatttattaagaaattgaccagcatgaaaaggaggcattgctactatgtaatgtctgggggggagtttcacatcgatataggctattgatgggccttagtatgaagcccgtaagcccatattgaagctcgagtcttgatggcgcaggagagagagaaaaagacaatcacctgtagtaatctttgaagactcttatctcctctatccaccaagagagggaaaacgaaataaaaatagcacaggggagagacaaaatgagataaggatttgaagcctctcaccactctcctcgttttcgcttcgtgcttatttgtcaaacgcgaacatttcaccgaaacttagcgacttttctcgctttactctttctgggagcaatttctcagagcataggcgagcttaaaggtagctccttttcttagctttgctcaaatgggtttcttagttactcttcttatgtttccgtgataagatggttcgaaatttactagctttcttaatggaaatttttgagtttttctagttagactacaatgaaatttcaattcgaaattgagaaaaagagtggtccttttcttcatatgctttcagattagtctgtgttgttgtctgaggaaagcttgtaattttgacagtgtgtaatggttttctatgtgtaggtgacagttcttagct

SEQ ID NO: 3352 - DNA, 3000 bp, Unknown
  misc_feature (1)..( 3000): cDNA_ID_1820530_gDNA_ID_1620642_Annot_ID_47513 3000 nt of promoter + ATG
tatgtgtcccagctgaagtaacaagtgaagaggttccctcgtcagaaactcccaaggtagtagaagaagaagtgatagctaccaaagctgaagatgattcgccggaaaaagaagagcaaacggaaacacttgctgcagcagctgaagctgaagaggtggttcctccaattccagaaaccaaaagtaagttgactaaaaatcactagattgtaattttttttgtgtgctacttctcatattggtttattatgatcagtatcagtttatcagaatcatttaaaaagattatacaatgtttgtatcttagaactctatccaaggtaacatatacagctaaagcgttggggatactccaaattatagtagagaccttaaccacataaatagtcacatgaactacgtgttctaaaaaaatccagaataatcaaattcatgaagttttgtttgatggagcaaaaggtgataagaaacatataagaccacaaagataaagacattttagttcattgtgtaatgattactagcattgacccttttcttctaccggtgaccaggtgaagaggaaattgttgagaactctattcctccaaactcagccactgatgaagtttcatctccagaagctttagcaagtgaagaggttgagaaggagcaagtggttgccgaaacacctgttgatgaagtcaagactcctgcacctgtagtcacagaagcttcttctgaggaaagtggcaacaccgctactgctgaaagcatcaaaggtccttcttttgtccatcctttacctgttttacttcctgactcatgacctaatggtttatgtgagattccatctcctaacacaaaaatgtaacaggcatttcaccagctctagtgaagcagctgagagaagaaacaggggcaggaatgatggactgcaagaatgctctttcagagagtgagggcgatatggtcaaagctcaagagtacctccgcaagaagggactagcgagcgcagataagaaagcaagcagagccacatccgagggaagaattggtgcttatatccacgacagcagaatcggtgtcctcttggaggttaattgtgagactgattttgtctcacgtggcgacattttcaaggaacttgttgatgatctggcgatgcaggtaactccaagtttctagctgaaacattttcttcgttttgctataactgagaatataatttgacctgacatgtaggtggctgcgtgtcctcaagtagagtatcttgtaacagaagatgtttcagaagaaattgtgaagaaagaaaaagagatagagatgcaaaaggaagatcttttgtcgaaaccggaacaaataagggagaagatagtggacggtcggataaagaaaaggctagattcacttgcattgcttgagcaaccatacattaaagacgataaggtgatagttaaggatcttgtaaagcagaggattgcaaccattggagaaaacatcaaagtgaagagatttgtgaggtacactctcggagaaggccttgagaagaaaagccaggactttgctgctgaggttgctgcccaaactgcagctaaaccgaaagctaaagaagagccaaaagctgaagaggccaaggaagctgttgcaaggtgagaaattttttatagtctttgctcttcttgacatgaattcttataatgttggctatagaaagattcaaactttttgcaatacggcactgcagcccaccaactacagtggtttcagctgctcttgtaaagcaactgcgtgaagagacaggagctggaatgatggattgcaagaaggcattggcggcgacaggaggagatcttgagaaagcacaagaattcctcagaaagaagggtctctcatcagctgataaaaaatcaagccggcttgcatcagaagggagaatcggttcgtacatccacgattctcggattggagttctgatagaagtgaactgtgagactgactttgtcggaagaagcgaaaaattcaaggaattggttgatgatcttgcaatgcaagcagtggctaatccacaggtaagaaaatgtcctcagctgaaacaatggcataaattggttgttggtctctgacctgaaatgtctacgtgcaggtgcaatatgtttcaatagaggacattccagaggagataaagcagaaagaaaaagagattgagatgcaaagagaggatcttttgtcgaaaccagagaacataagggagaagattgtggaaggaagaatctcaaagaggcttggagaatgggcattgcttgagcagccttacatcaaagacgacagtgttctggtgaaggatctggtgaagcaaacagtggctactcttggggaaaacatcaaagtcagaaggtttgtgaagtttactcttggagaagataactgatgagacagacgaagtaaagttttcaaataagggagctctgttttgtgtcatggagtttaaagtaaaagtcttcctttttgttttgtagacaaaatcttcagtattcacattttgattagtttttaatcaaaacctgtaattttttgttcatgaaaatatgagatttgcattatataaatgtgcatttagtgacaatgtgacattatacactaaattcggagaaagattggttataatgaaattttaaaccttattttaaatagaagtttcaaatgaatttccctgaagaagtgaaactaaataaaataattttttgtttccttttggatattatatctaaatataaaaatcaaaccgaccgaattactacatacactacaataatgtttttttccttttataatttgtgggctaaaaaaggtcggtcggcccattttgagcccaataaaatttagggatagataaagacataaagtaacgaacgatattccgaggttgtcatttgctaaggaaaaaaaaaacgaaaacgtgtgtctgtctcttctcgtagcgtctctcaagctcaggttcgtgaacattccaatctctca

SEQ ID NO: 3353 - DNA, 3000 bp, Unknown
  misc_feature (1)..( 3000): cDNA_ID_4262264_gDNA_ID_1620642_Annot_ID_47514 3000 nt of promoter + ATG
gcgttttaattactgctcggtttatatttatttgatgtttgtccaacagttgtaagtccgacattgtcagaggatataaacgggatgtcgtttccacagagtgtttgaatgtagtttttatgttataaataacaaaatagtttattatgatgaaatagatagttaaaatataagtaaaattgaatgtgtatgattaaaattttatgtaatataaaaattactatattaaatattagaaaaagtgtgtagattactatttactatataaagtttaaatattattgataaatatttaaataaatttatatcatacatccgcctatttaggcggccttatctagtatatatatatgagggcgtgtgtagagattatactcagccaccaaacgatccaatattatatatatgtgtgtgtgttctatatgtagacagcgccgaaattaataaccgcataagaaaaacaaaaccggcagttaccattatgcggtttaatttgatgacaggttaaaaaattatatcgatctaatttgatgacaggttaaaaaattatatcgatctaatcatttatagccatcggattgattcgatatggtaggttatgagttataatggagcatgaggttcttgtatggatgttaaatcaaggagggtaagtggcttctttgtctaaagattcacactgtctctttgttctttttttttcttcttttttcgattacgacacaaaccgatctttcactaacgctgtaagtacggtcgtccactgatttaacattttaggtttagtgtaattccattcgatcctcaactaactacatagttttcaattatagtcataattattatgcttgatgaaaagcagaaaaaaatgaaaaaacattaagtataacatcagtactaaaaataaataaaattatagtatgtatttgtcgctcacacaagtctataaacaaacattcaaaaccaacattttaagttacttaagctgtctctcgctagtataattaaaccctagagttacttatgatgtctcttgttaatacagtaaacccaacgtggccatatataataataacaataattaaaaccgccacatgtgatgcaacatccatatagataagtaaatactttgggtaactccaactaatctttagattttatagccttcatatgatttctatagtgatagacacatttttactaaagattcgtatccttagatagctttgtaagtaactaatggcacgattagatggtgagttaaggtggaatataagttgagatgtcccaaaaacgacaaaaaccttgcccaaaaaaagagagagacaaaggaaaagttaaagaaaggcaccttatgattaagacactcgaacttacactaaaacacaaatctaaaaagctttagataagatccaaagatggatccaccttagaggcaggctttaaccaaattactatgcatatgatattttataatactgcaacttacaggtcttttttgtatgtcttcttgctatgtatatacttatcgttgttacaaatgaatgacttaatcaatacagccaaacaatatataaatcactggtagaatataaatgacaatatttcatatacttcttctcatgttatattgttatagcatcagatatattggtttaataaatatgggttaaaatatgagttgaaacgtttaaatgtagattgagtcatccacttaaaaaatatacttggagatagattagatgggcataaatactatcaaagttaaatctgatttgatcatttaaacttttattaatttaagactatgatccaagtatcaaagttttactaataggtcaaattgtaatgtactgtagcatatatgctcgattttgggaaaacattgtctgataaaaatgaaaagtggagtgtggagaccacaattctttttgggaacactgctcaatattgctactgcggctaagtggcaaagagctacccctactgtttctttcctcttttcatgcttctggtggacccaaaaaatgagagcctatgggcccaaaactttttcgagattctcttctctgttctcacccccaagcctaaatatcatcttccatcgcaattattggcgacttactaataatctccattcgttagctaaactactagtgaatttatacaagtttgtgaagtttaaactccaatacgtttgatttattatagaatatgttatgctatcatgcacatgattaaatggttcaccgttattagattatcattatcatcactcaatttcatgagtaaagattggtttcacgagctaacttatgagttatatcaaatcgtctagtgaatctaaaacatataatgttaagccaaactaaacagaattagtgactcattacaacatctctatacatatatcaaaaaggaattgcatacaaaagcgtattttagatactaaatcgttttgcatgatagcataacatgcacaccttcatgagatagcaaattgtttttttcaaatacaaaagtaaaaagtaaaacaaaacgtggaatacgagagtcgagacaagggcataataggaaaggtttcaggacgctttctgtgacctgtcggggagtagatgtctacacaaaacgtaacgtgtatatacaatacattcatgtgtaccattttcttaaatcaacattttgtgtttaaacccgccaaaagaggaaagtacttacttctaattacggtttatatgaatataaaattacgtatactacttccgtccacttttggaaaataatacgattccaagaaaaaagaagattaaaggtaaaaaaataaaaaaaaataaagctctctcacacacctttttatcatttctcattttcactcacaatttgatctcatctttaaatttttttgtttcccatttctctcagaaagtgttctgttctttttttcttttgtaatcactaaatgcttcaaaagtttgtccacaattatatttgaaaaaaatg

SEQ ID NO: 3354 - DNA, 3000 bp, Unknown
  misc_feature (1)..( 3000): cDNA_ID_1396981_gDNA_ID_1620642_Annot_ID_163080 3000 nt of promoter + ATG
tcaagactttgtaactttttctattcaataatgacgttaagagaaaaagaatttattttcagttcctcttctcttactagtttctttttatagaaaccaaaataaagttactgatctaatttttaaaaagggacaattgcatgggaatgtcaatatgattacgcaaacaacttctgcagataaaaatggtttgcagaaaatggaaagcacctatccatcatagctatcttggaagtctcgttatttcaaaaatatttctctcctttttattttcagctacttattaattccataatatttttatattaatatatttcaaaaaaatccagattttatttctatttttagaactataaatcaagaaattatctatgtaatgttaaattcctatttttttttagttattatagaaactgaaaatggtctaattcatacgaagtcgatttttctcacggcatattatgtaaaccatgaatgtattttattagtgattcgtaaaccctaagtttcatatacaataaaaacaaaaatggaacctaaattacgaataacctttatcactatacgataaagtataaaacactaataaatggaccctattacgaccaatcgtaccaatatttggtcgtatctttcatttttatttatttacagatttgtaaattttaaaatagacacttttgtgttggtcaataaaaaaatagactaaaataaaaaatgtatttacaagtgaaaccaaactaaaaccattatgagaaagaatctcacaaaattgaccagagtaaagagagagacaaaaatgggtcgagcaacgaggtggttcaagggtttgttcggaatcaaaccttcctcttgttccggcaccgactccggcactatttctaaccgccttgaccgctctttatgcgacagctacgagactataccacctaacatctccgagaaagaagctgcgtggctaaggtccttctacgcagcgggagaggaggaaaaagagcgtagaacgcatgcaattgcggttgctgccgcgacagctgctgcagctgacgcagcggttgcggcggctaaagcggctgctgcggttgttaggctccaaggtcaaggcaagagtggtccgttaggaggtggcaaaagccgtgagcatcgtgctgctatgcagatccaatgtgcctttagaggctacttggtactaacacaatttttcaatttttctaatcatttcaatatttttaatctttatgtatttgagccgttacatttttgtaacgtaaaaggcgagaaaagcgttgagagcgttgagaggagtggtgaagattcaagctttagtgagaggttttttggtacggaatcaagcggcggcgactctccggagtatggaagcacttgttagagctcagaaaactgttaagattcaaagagctctccgtcgtaacggaaatgctgctccggcgagaaaatccacggtaacacttacttttccggtttggccgtaccgagtttatttatttatttttatattaagcatacttagcaatcaaatctgtttagagttccataatttgatatatcaaacatagagatcattttaaataattttctcgggtcaaaagaaaataatcttaaaatgtaaaaagattgaaactgtttaacctttatgtaaaaagttgaaatcttcttaaactagtttgtaagcagataaacacttttttaactaggctgtaaaagtgttgatgtaactttttacaggaaagattctccggatctttggagaatcgaaacaacggcgaagagacagctaagatagtggaggtagatacagggacccgacccgggacttacagaatccgagcacccgttttatccgggtcggatttcttagacaacccgtttcgacgtacgctttcttcaccgctctcgggtcgagtcccaccgcgtctatcaatgcctaaacctgaatgggaagagtgcagtagcaagttcccgacggcgcagagcacacctcgtttttctggtgggtctccggcgaggagcgtgtgctgctctggtggcggagtagaggcggaggtggatacagaggctgatgctaaccggttctgtttcttgtcgggggaatttaactcgggttacatggcggatacaacgtcgtttagggcgaaactgaggtcgcatagtgcaccgagacagagaccagagagtaatgcttcagctggcggatggaggaggagtatcggcggcggtggtgttaggatgcagagacagtcgtgttcgggtgtcagagaagctgtggtcgggaatatcgagaggcgtaggatgcgttggtgattcttatttccataattattatccgtttagttttggttaattaggggagtaatgttattaatttaatatagtttgatattattatagttttctaagtttcactgacaaaatttaaaattgttgtttcttgtatgctacatattctatttctatgtaagttttttgctacggataatttacatttttattagcttaactaaaattatccgagtttttttatattcggtgttgagaaaacggtactgatcggttagtaaacaattattggttcggttaaatataccaaaccaatattatcggctacaacgcatgcaagagactattttgtaaacaaccacttaaacataaacacgtgttaacgcgattcacatcaacgcgtgtggaaaaaggaaagttgcttccttcgttcttaatcccttctctgtgaacacaaaaacgcgaaataacaaacaaaaaccaatacaagtgatttccattatttctcgtctacgtatacaattgatcttcccccatctccaattcagatttggacagaggtattttttgatccgattcttacgaatcctgaatcttcctcgtagattaatcgatcgatcggttcttaattcgcggaaaattgtttcagtaacctgtgatcgtgtcggttggggtagaagagatcgaagtgggagcaaaatc

SEQ ID NO: 3355 - DNA, 3000 bp, Unknown
  misc_feature (1)..( 3000): cDNA_ID_1820514_gDNA_ID_1620642_Annot_ID_163074 3000 nt of promoter + ATG
ttttttttgctctagtttatgatatttttcctagttcgaaaatattatatgcatgtgtgtatataactatatattgatagtctgtgaggtgaaggattgagcaagttaaaacttatataatgcaatgctctttcgaattcagcattcgtcagtcttatttgacgcgaagtcgaatctattttggaacactagtcagatgtacattattgaggacccatatgagaactacacggattaaaaaaaaaaaaaaaagtcttgcattaactttgaattttggtgaatcatcacatcatataaaattataaatacactatcaccggttctttttacccgtttccatgttaaacatggggttcataatattcatatatgtacactattgtcttgtaaatttttggtatggtacttgatcgtgtttcatgcatttataatcagtcgcatatcatgtacaatagtctccgctgtttgggaacaaaaaatatctagttgtctagtttatggacgaattacaagcaacgtaaaaatgatcgtaaagtcaaactagatgttgtttacttgttttgttcttatacacacaaacaattaaatatgcttttttttgggaaaaaaacgctttgtttacgcttgtgattaggtgcatctggtataacaaaagccttcgatagtctacggtcattttttgtgtgcataaatgtaatagaatatatatataaaatcgttgtgatgacaacaaaacagtgtcataatcgattaaagtaaactgtcatttacgattctagagatcgtaaaattatcaacgatagcaatgccaataatgttatgtaaccatatatactggagtatttgttttgagtaatattaaagataattatgttcagcggaaaaaaactaatgtaattaactaaaatcagataattgttaatgatgaaaataagatctggataagattttgaggggtcgacatcattagtctcctctaattgttgttcgaaaattaatgctcaacttttaatgtatgtactaattgattataaacattatattagtgtttgaaatcaccttaaatcgatagatagaaaaatcattaaagttttttcacgtctagcatttatcaacaacacacatctgcaacattttagccgctccacaatgtagtccgttccggtttttatacatggttccggtttcatccaaatttttacagttattaatagtttatgaatacttgaacaaaattaaactatagtaaaaaaaaaaaaaagtttctctaagattttgctattgttcgattaacttttccactctgattctttggattgggttcttaacagaaaaacaaatacgtgatggtaatcctctctcagtttttaccatcggaaaatgaatttttatgatgtcgtcaaatatcgaacatgcggtaataatcagagacatgcattgctattagtatttcgtttccccacctatattttggtcaaaagcaaacgtgtgggggtatacataccttttctttcatgtaatgatacatgctttttatttgtatataaatataattatattatatgatatctagagtatctaaatttattcagtgatcttcttaatcaaaggttaatcatatcaaaacaacattagtgaactggattgggaccactaatgagttgaaataagttaccagctatttcttctaatatctgataaatactactattagtcataagaacaacaattagaattaataatattcgtaaccataattgagagttgacttgtaaagaaaaaaaaaagttatctgatgtactcaggaactattgcaaaaatactataagagcacaatttaaagattgattagattttttaaaaatgagataatggagaatctaatgatgcagaaattgttgttcccacacggacatacaatatgatagtgtattacttttttgattataatccgttggaagaagattttatcaaaacatcaaaaatttaagacttgtaagacctctaagaaaataatttaatatcattgttcaacatgtatatagtgtaagtactaagtacaccctgtaaccctattagtaatcttgactacctttttttaatagcaaatttggttgtaaatttgctatattaataatgggcttggtatagattttattttagaaggtccattactttcaattggagtaaatgaaccgactttaaagacttttaactcaggccttaatgttacacaatagaataacattatgacccggcccaaataagtcgtcagatccagtaagcgtgcgaccaaactatttgtttcttaccatcgatataaactttaatgattttatacaaattgaataacatatttatacaaattgaataatgatatggataatcccttttatctaaacaaaaagaagtggataatccacatcatatttgtctgtaaattatttgttttagttatctactgataaaaacattgtttatctatattattttatattatgtagagccattatctcttacgattgagcatttttaatcttctgacagaaaaaatgctaagaattaaaaggacaaagaaaaaagaatgtgcaattatcatgtggttgattagaggtttgagaatgattggtgctaccagaaacttaggtggagaaaaggataaaaaccgaaattagacaaaaggttaatttcgtcatttcaacagattctattaccacttcttgttttgtttttccatactttacggacaagaacgagagaagctctcgcttacgtggtttctacactgtttttgacgaacccaccaagctcgagtagatcggtattagatccatcttaggtttctctaatttctctcaattcactccaaaattttgattatttcttctttctggcttgtcaattttagtcatttgtaatccttgcttttgcgatcggaatcgtaaaaatccgatctttcttttagattcgttttgtttttgattccaaatcggaaaaatg

SEQ ID NO: 3356 - DNA, 3000 bp, Unknown
  misc_feature (1)..( 3000): cDNA_ID_2049708_gDNA_ID_1620642_Annot_ID_163070 3000 nt of promoter + ATG
tctaagacatgcgagtattctgttaatataattattactttttatataatagagaactccaattgttgaaacagattaaaacaaagatttggtgtagaagatgatcaaatattacatgaaagaaaattctgtagttcattcttgtatatttttataagatatttagttatattatttatttgaatgaagaaagaaacaaacaaaaatgtaatattttgagatgtctaaggagtattaagatgtccagactaactttaaatttttctccgaagatttattttgagattttttttcgttttaatatttttgatcagtttatgacgataataaaaataaacgaaacttttcttaaatctatagttgggaaagtgattgattttcgtaaaaaccattttccaactaatataacatatgataggaaagtagtcagaaaaatcttacaaaaatgtgcatggaaatggtggaatttacaggtagcattacacataatcatttcatcattaaatgctaagtttatccaccatattggcttggttacagagtctaaatagaaattgcaagagttacatcctagttttgtcaaactttggactacactattacagtttcgcctcttgtaaagaaaaatcgttgaagagaatttcgatgaccagttgtgaatgtcctggactaagttaaagatctcacttctagttgtagtcccggtaataaatacgaaatataggattgtattgtattgtatgttttctgactcgtatattacaagtatatgtaaggatttcttggaaattgaaatcactgggaaacagaatattagggatctccaaaccctaggacattgattccttcgagattactggtcttcttcgttgtaggcaaaaaaaaatggtatttattgttaatttgtatttttctgatcatgcttggacaaaaaaaatgactcgttcaggttagaatttaaaattaagtgtatgcgtcatatgacacaatgctctcgtcatcttgtgtctaacagagtgaaataaagaacgaacaattgtttgtatacacacaaatacaatcgcacctacatgtgcacatattttattacgcttatctatagaaaactgtttgatacattttttcattctaaagtaaatacacaatccaaaaaatactatgtcatgttaagaatgtttagtatatctatttattttaggacaaggaacatttaacatatagtaaacagttttaacaaaatttctctgatttgaaatatattttttatattatcagtaaaaagaaaactgtaaaggtaattatagtcgttgattaagattatacttagttttttaaaataacatgttttaaaaattttgcaaaataagtttttttttttacatgtctcataatttttgtcctcagtttatgttaaaaatattttgttattttgatactaacatcttccatacgctgaaaacatctttgagaatatttttcaaaacacaatatacaaaaatccacagtgactttattccacgatgaaatgatatcaagacatatatgttcttacctttacctttcaacgaaaatgagagaaaaaatatatatatatagtatcacttttagaaaatgtttttttttgctaattaattattatataaaaatgttgagagcaacttgatcatatatgtaataaagtcgcagtgaaaaaaaaaatgtaataaagtcgcataccgacgttgtgactcgtttttatgtaattgattagttaagtacagagttcgttagatgtatttgcattgttacaattacagaaaaccctacgcaacacaattcagtactttttacgtcagcaaaaatagaatctttcgttgaaaataataccagaatcgttcttgtctttaattttcttacctttttgtaattggatatgatttttgactatggaattattattattttattctataaaattatagtttttattattggaatcatttataaatgctattactcagtgttctttaaagtccatactaacgaattcaagtacttatttaacaaaacaaaacaaacaaatactaataaactaaaagtacaaacattactatgttattaaaaaaagcatatagctgcgtgattttaaaggtatatgtgacatataatacaacgacgccgtcgtattttattgaatttttttgtcacttttaattagtatacagtgaggaaataagcaaaaagaaagaaaaaaatattgttggctcggctagtacctataaataaaaacactagtatttggcccaggatataatcattgcaagtttagaactagttagctaatctaaaccgttagatcaaagaagcaatcttactaatcagaaaaacaaaattcaacaagttacaagaatgaaaaaaatagggataaaaaaaaggataattcatttacattcgatcaaaaggcgaatgcatagatcatagatgcaagacacttgtgagttgtgatataaccaaaaatttatttaattatatgtaatatatattcgaaaaatttatacaccgtatataaaatattcgaataatccttttctttgatttaaaaatattttctgcttgttttctcaactcatgtattaatttaaataataaaagtagctaccacctttctctgccccactttaagataaagctaaagcatggaaaaaagcatgggaaaaaagtaaatatatgatatacaatcaaataaatctaaaaaaatagaaaagaaaaattaaaggaacgaaaaaaagagggaggaaaaagacaaaattaaaaaacaaaaataaaaattccaaaaaaattaacatcacatgttatcaaatgagatcaaaatttaagttagttttgagttttctctctctttctcttctctaaaactacttaagctaaagaatcaaacacttctcaacgtttctccaaagcctctgattagtaaacacataaagagatctatagagagagagagagtagagataaaaggtg

SEQ ID NO: 3357 - DNA, 3000 bp, Unknown; identical to SEQ ID NO: 3353
  misc_feature (1)..( 3000): cDNA_ID_4262264_gDNA_ID_1620642_Annot_ID_163066 3000 nt of promoter + ATG

SEQ ID NO: 3358 - DNA, 3000 bp, Unknown; identical to SEQ ID NO: 3352
  misc_feature (1)..( 3000): cDNA_ID_2049714_gDNA_ID_1620642_Annot_ID_163065 3000 nt of promoter + ATG

SEQ ID NO: 3359 - DNA, 3000 bp, Unknown; identical to SEQ ID NO: 3351
  misc_feature (1)..( 3000): cDNA_ID_1820534_gDNA_ID_1620642_Annot_ID_163064 3000 nt of promoter + ATG

SEQ ID NO: 3360 - DNA, 3000 bp, Unknown; identical to SEQ ID NO: 3350
  misc_feature (1)..( 3000): cDNA_ID_1820542_gDNA_ID_1620642_Annot_ID_163062 3000 nt of promoter + ATG

SEQ ID NO: 3361 - DNA, 3000 bp, Unknown; identical to SEQ ID NO: 3348
  misc_feature (1)..( 3000): cDNA_ID_1820550_gDNA_ID_1620642_Annot_ID_163053 3000 nt of promoter + ATG

SEQ ID NO: 3362 - DNA, 1939 bp, Unknown
  misc_feature (1)..( 1939): cDNA_ID_2991393_gDNA_ID_1620642_Annot_ID_163052 3000 nt of promoter + ATG
gaattcgttagcgtttatgtgaataatcatccatcatcaggaaagatccgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggtgagattatgattgttactgattgtgttagttatttcattgtttgatgcacaaatatgagaaacctctgaatgaaaaatgcttggtttgcttgaaatttggaagagttagtgtaatcaagtggctagaccttatcatttagtgtaatctatgagtttctaaatgtgtgttggcttcttggttcatatacaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatcaatg

SEQ ID NO: 3363 - DNA, 80 bp, Unknown; identical to SEQ ID NO: 3346
  misc_feature (1)..( 80): cDNA_ID_2991393_gDNA_ID_1620642_Annot_ID_163051 3000 nt of promoter + ATG

SEQ ID NO: 3364 - DNA, 3000 bp, Unknown; identical to SEQ ID NO: 3356
  misc_feature (1)..( 3000): cDNA_ID_1807786_gDNA_ID_1620642_Annot_ID_47516 3000 nt of promoter + ATG

SEQ ID NO: 3365 - DNA, 3000 bp, Unknown; identical to SEQ ID NO: 3355
  misc_feature (1)..( 3000): cDNA_ID_1820514_gDNA_ID_1620642_Annot_ID_47519 3000 nt of promoter + ATG

SEQ ID NO: 3366 - DNA, 3000 bp, Unknown; identical to SEQ ID NO: 3354
  misc_feature (1)..( 3000): cDNA_ID_1396981_gDNA_ID_1620642_Annot_ID_47522 3000 nt of promoter + ATG

SEQ ID NO: 3367 - DNA, 3000 bp, Unknown
  misc_feature (1)..( 3000): cDNA_ID_1820499_gDNA_ID_1620642_Annot_ID_47524 3000 nt of promoter + ATG
catgaatagtcaaccatatacgttgacttcgctgctttaacaaacatcatgccgttttggtaccataaaattggactccgtgtcgttttaaggttaaattcaaattaattggaataaaaaatgaaacagaaagcgagggataataacccgcttaagttttcaaggcttcttctacaattctctcatttcgaatttgataaagagaggagacgatagtgagggaagagagtgagagagagctgtagcagtgtttgaaatcctttggattgcatcaccaggagcaagagatcacgatggtaatatactctggacgaatgttctctacttgtgattttgtttcgctaatgaacctctgtgatttgtgcattttcctgggaagatcgagtgattattctctatgattctatgaatcgtgattatcttacactgatgatcttagcttgtgattcttcgacttacaagagaattttggatgtattgattcgacctatttgtttgaatgtttagtagtcatcgttatgtgtttctcttactcttcgaagaaatttgtttaaacttatcgttcatcggtagtaatgtttctatcttccgtagttcattacaaatttgtgtgaggaatttccgcaaacacttggactgcatgacgcgaatcgataggttctcgaattagcatttatctagcagccaattctcgcaatcagtgtagtcgctgagttgactgtatatatttttgacattttcgatctggaaactatttgttgacagatcatttgttggatttcgtcattgaagctctgaagttttttttcgtcattctcgtatcaactgaatcgctgctttctattgttgatgatattcagtctaagaaacggggactttcgctggaggagaaacgagagaagatgcttcagatattctatgagtctcaagacttcttcctagtgagcactttctttagtttttacaacttgctaatttttggacgcctttgaactagctttatctaccaagtgatctgatatctagagtcgtgaagtgcatatactgcctaaatttgttgctattgaacttttgggtttgtgatacaagcacttatgggtctctacttttgtaaaaaaatttcagctaaaggaacttgagaagatggggccgaagaagggtgtaattagtcagtctgtgaaagatgttatccagagtttagtcgatgatgatcttgttgcgaaagacaagattggaatttctgtgagtagcttagtgttcctatgttggatctttttatttcatttgttgccatatagtccttgtctctgttatatgttgtttgacggtgttcattattttgcaaatgaagatctacttttggagccttcccagctgtgctggcaatcaagtgagtcaccgttctgtatcctgagatgacatcaaaaagattcatattaatttgagcatagcgaaattcattgtttctgatctcattttgaatgaacagcttaggagtgttcgccagaaacttgaatctgatcttcagggtagtaacaaaaggttagcagaacttgttgatcagtgtgaggccctaaagaagggaagggaagaatcggtaagtattttcagtattgtagaattaatgctcgaataagcttacgtgtgcttttcaccagaattgctgttcttgctgcaggaggaacgaacagaggccttgacgcaactcaaagatattgaaaagaaacacaaagatctgaaggtcagattatacagactatctgtttgcatagagctattcacatgcttaacaagttgctaacagtttcttcttcttaaacagaacgagatggtacaatttgctgacaacgatccagctactttggaggcaaagagttaagttctgcataatacgttacttttgttttgtgttagatctcctatatggttttcccggtcttcgtggagcagaaataagaatcaatcttgtgctttactagctgtatcaatgtgtatattccttctaattttgacagggaatgcaattgaagttgctcaccagtcggctaacagatggacaggtatttcatttctaaaacttgggaatgtgttttcagttttaatacttacgtaattttcactgcagcctagattataattctttcaaacttactcagataacatcttcacactgcgacaatggtgttcaaacaacttcccccaggccaaggaacagctagaacatctatacacggaggtatcttccagatcttttcacttcaaaaggctataaattccacatttcacattctcatacatgaaggagagactaaatcagctgggtaactttcaggcgggaatcactgaggactttgattacatagagttatcatcattccctttgagctcatcccatgaagctgataccgcaaagcagctagtacaagatgaagcttagttctaatactctccagcataacagttaaagaaacaatagcttaagtaaaaaatcttttcactatccttttaagttttctggttttaaaggttgcaacagtctgtaattctctatgtgacccaatcatctaatgtcaaaactcggttacaaattctgtggtcagaaaagatttttattttctttgtatctgtcggctatgtccaagcttggctatgttttgttataatattttattggagttatatatatatcatgcgttagttgttgacccactggttacttcttgatagctgtattaccattttatattctttcttggccgcttttttcagtcgtgagcagcacttatgttatacacctccaggtcaattttgttgctaccagaagaggaaatgggcatagactttgtactttctagtcttttgtgtttttgtgttatcttaaacgcaggttgtctgtttttctgacgatgatgagctgagctttacaaaataagaagaacatgggagctcactctgtttttctcatccttttttccgtcattgccattgccattgtagtac

SEQ ID NO: 3368 - DNA, 3000 bp, Unknown
  misc_feature (1)..( 3000): cDNA_ID_1820598_gDNA_ID_1620643_Annot_ID_47528 3000 nt of promoter + ATG
atttatagaggggagtgaataataaagagagtgtgccaacttgtgtttcttttttattcctttgtcctttcttttccattatttctaattaaaaaaccatgtgtattaattatttgaaatttattatggggaagacagaaactcaaaggagattgagataacattttgaaaagttaaaatacttatgtgaataaagaatgggtcatattgacacaaataaactagtttttcgatcattaattcaaacttgagttgatttataagttgctggtttcaattttattggtgtgtagaaaatgtaaaaagagagaaagtgaggacgaaaggacaggacagagttagggagggattccaaaggtattggcgttgggggaagagagagaaagagagcgtttccgtttctccgcgaacacttgtcgctgactcagactcctcttatattagtattactttcttcttttaagttaaagtattaaagatgtgtactcttctcttttttataagagtacgtactatataatgaaaacaaagctgaatttgggatttgataagttatagacaaatcttacgtcaggagacgatggggtgcacgtggattagaggaaattattggttcagagttgtttgtatttttatgggatgtttaggattttagtatagaaaaatgaaaactaggttattggtagttattgtgtgttacttgatgatgctaatcttcgggtggtgaatgaatcacatttttttagggtttaatcatttggagggaattattgatacaaaaagatactgaaatcaataagcaaatcataagaggacaatgtgttaaaagaaagtaaaaaaaagagaggaccaaatgttgtgcgtatcttgctacgtattcttcttctagtattctctagctagtagctagacacacaataagaccaccctaatacaaatttgaaatcactgttttatgtctcaactttaaacgtttgttattaaatgttaacgatgttcgtaaagaggggcatacatgagcaatatccacgattgcctaactgtgtaaaacttgcgtcaatgtacttcacattcctccaatcactttggaaatgtaaaatgattatcaataaataactagagaggaacgtggtgttcatgagtcatgtcctcgtcgtcttccacaaacgcatgtgtctccataggtataaatcagaattgatatagtacaaaaaagactcttaacttattatatattgagtgtttgactctacgtacctacgacacaacataagtatttgcaatctcttggaactacaaaagccgttattgacttattggcccttcgccatattcaaaggttcttctctatgcgtgcgcctttccctttctcgtacgtatatataggagtatagtttttaaaacattttttttctgtcgtcgtctattttttaaaacatttatttatctgcggcgtagagaaaatgtaaaagggaaagtgatttgcaaatttctcagtggcgaatttacaaaacttctgacctaataagagaaatttctagctcacatcatcttccacactttgtcggaataggtctcaaactactaaaagtattacaattattcatttataaatacgatatttctacctgcaaagcaaatgataatttaatggactagtgagtattgacactggttcagtatttggttgatattttggtttaatgtagaaaatacgaaagaagaagaagaaaacagaatagtgatgtaatggactgatcatttaacttagataacgatttcataaaataatagcaattccaaaatttgagaaaattatcaatcaactactacatgtatttcttttttctaatggtcaggattcaggaagaaaatctggaagtgtatcttcgctttctgctttacgattgattaaatatataacatttcgaagagttttctactaactgttggcaacagtctgttgctgtcggttccgacgttgcaaacttatccaaaacagcatttagttctgtgtaccgtacagttgaactcgctggattgtaacatgcaaagttacaatcatttttttttttaattcgcctgatatatgacctgattagattttagtttttcatagaaatttaaacactaatctcatcattttcaaactaattaataacactagcttacgagactccggaatccaaacttttctttctttcatattttcttactcccacaacaatatcaccaccatttctcctcgtactgttttgtattttatctcatttaactttatcatctttaaccctttatcaaccatgccaaattgcaaaatatttttttgttttgtttttgttgttatcccatttcagttgtcaattagaagcaatgatacaacacctttcattcaataaataaacaaaatttgatggtagccaccaaaataaaacttgatgacgccaagcgtgtaagccacaaccacgaaaaaaacccaacaaataaacataaatgaaattaagtcaaatgaagattcgattagattttttggacaaaatctgtcggatgcttattcatagcatctcctctgttacagcaagaatgaggaagtacggatcaaagagtgtttgaatggttgacctgaagaaggagaagcaattgagcttaagactctctgattcttttcataacataagtcaagaaaatgtcattttcaactttttggtcatgcatgcattgccacacacagagggagacacatgtcttttgatactatccacttggttcagaaaaaaacaaaaagtcacactttttgaaaaagtgaaaacgtctcaagatatggtgaaatctgcaatctttttttactgtctttttgttatgatagataaggaatctgcaagaaccaatgatcactcttttcactgtatcaaggacaaaagaaagagagaaaacaaaagagttatacagagagaaaacgtgaatagagagatcactgtacttattgggttttgatctttg

SEQ ID NO: 3369 - DNA, 3000 bp, Unknown
  misc_feature (1)..( 3000): cDNA_ID_1820595_gDNA_ID_1620643_Annot_ID_47529 3000 nt of promoter + ATG
aaaacgtctcaagatatggtgaaatctgcaatctttttttactgtctttttgttatgatagataaggaatctgcaagaaccaatgatcactcttttcactgtatcaaggacaaaagaaagagagaaaacaaaagagttatacagagagaaaacgtgaatagagagatcactgtacttattgggttttgatctttgatggctccactgagtccaagagtagtggtgaaggtggatttgaagaagaagccatggcagcaggaccagccattgcacaatagatggcatccggagataccaccagtagcagaggtcaaggctggtgagtttttccgggtagaaatgattgatgcaatgggaggtgttatcaaagacaatgactctgcaagcgatatcaagaacctagtcctaactactgtaagtgggttttgtgagaaacatgtgaaaaatcaataatgaaacaatgagtttacttttaaagaaaaacaacttttggtgatatattgtacagactcatcacctaagtgggccgattagggttgtagatgaggaaggtgttgcagctaaagcaggtgatcttcttgctgttgagatatgcaacttgggtcctcttccaggagatgaatggggattcactggttcgtttgatagagagaatggtggcggtttcttgactgaccatttcccttgtgcgaccaaagctatttggtactttgaagggatctatgcctactctcctcagattcctggtaagaagaaaacaattcaatgtcttctatcaagaaacttagtagcataaccatgtagctttccttgttatgattcgttctgttgaatattcaaatgctaatattaccccatcatggcaggagtacgatttccgggtttgacacacccaggagtcattggcactgcaccatcgaatgaactcttgagaatatggaatgatagggaaagacaattagaagaaagtggtgttgagtccctaacactatgtgaggtagtgcatcagcggccattagcatgcctaccaacaactaaaggatgtctcctcgggaatgtacgctattttctgatgctataacaaagtttttgaactgtataaatagtgcttacctctgaattcccagggattcttacataatcctcttgtagattgaagaaggaacaccagaatgggaaaggattgcaaacgaggctgcgaggacaataccaggaagagaaaacggaggaaactgtgacattaaaaacctaagcagaggctctaaaatatatcttccagtatttgttgaaggggctaatctaagcacaggagacatgcatttctcacaaggtgatggtgagatctcgttctgcggagccatcgagatgagtggatttctagaactcaagtatataacaaataagttctctcgactatgcattctcagatgttcttgtatttgtgcagcgtattataaacaattctgaccagataccatgttgtaactccttaataggtgtgaaatcataagaaatgggatgcaagagtaccttacgccaatgggacctacccctctccatgtaaacccaatctttgagataggaccagtggaaccgaggttctcagagtggcttgtcttcgaaggtatcagtgtcgatgagagcggaaaacagcattacctagatgcaacagttgcttacaaacgggcagttctcaacgccatagactatcttttcaaatttggttactcaaaagaacaggtacttgtctttgcagcttgatgtttcttccagaatctagttgatcacacaccaaacatccataaattaaaactacaaagacagaagtgatcaagagaatatggtgtgaacaggtgtacctcttactctcatgttgtccatgtgaaggaagactatctgggatagttgattctccgaatgccgttgctacactagcaatacctacagccatctttgatcaggtatcaattttgcccctctgttctttgcataagtcaaaaagcttctgtataaacctcttgagtttactctgttcttcaccctcgtctctcaataatttgttagcaactgaaaagataggaatgcaaatatgttaattgcgtttgtatgttaatgcaggatattaggccaaagaatcggaaggttccagtaggacctcgggttgtgaggaaaccagatgtactgaagagcacatatgatggaaagcttccaattacaaagaatccaagttcttcctcttagcttctacaaaaaaattaaaattaaaatttagaagctaataccaagattgtataatcaagcatatgttccaataataaagcaataacttggtgttttctttagttggcgtcttggagattccacataaagcaactcacgaaacgagaaagcacacaaagggttaaatttgcaccattcaccgagtaaatccaagatcttcgacataatatagacaagcaactctctagatagtataatcagaaatgtttaaagagagaaatggtttttttttgttggttgcaaattccaaaatcaagaaactatagaaattggaaggtaaatgatatgcgtccttaatctatatgcactatctacagattctgtctcaaaaatagcttactttgaattgcaaaactgcgcaattactaagtcgaatgtaatattcctctctccggacattagaaagaccttattcagaacataagttaagaaaatgtcattttcaacttcttgtcatctatgcattaccacacacagacacaaagagacatacgtgtcttatggcattataagatgaatgacagtcatttgtctagatatagaaaagtctacaatatggtgaaagagggatcttttactgtcctttagttgtagataaggaatctgcaagagcaatgattccttaatacaagaggggaaaacaaaaaacaaaaatatattaacatagaacgtgtgagtagagagagaatataaattaccgtacttattgggttcggtttg

SEQ ID NO: 3370 - DNA, 3000 bp, Unknown
  misc_feature (1)..( 3000): cDNA_ID_1820589_gDNA_ID_1620643_Annot_ID_47531 3000 nt of promoter + ATG
atgagttatgggttgacccaacccattttattatgagttgagttgagttggattacccattttgacacttctaatcttatgtaagatttttttcattatagttatacttttgatgggaatttttttttttttgttaaacatttttgatgggacatccgatataataattctggtgaagagctattttttttatctaaagatttttagttagagaggtgttaatagttatacttaactaataaacgccgagaaaacaacagtaacaactcaattaacaaagactcgttaaaagtaaaatacgtttatattaaagatttaaagtgataggcaaaatgaaaaagaaaatggctaaccatgctcatcgtttatattatttaattttcggatcttcattaggcttataaatttatttttagttgttaacaaaaagatttctctttatactttagcttttgtaatcttgtttggccaaactctttttgaatatatattacatttattggtgagcacattgattattttatgtagccaactaaaccatcatcactatattggtgtctacgtactgtctacttaagtactgttaatggaccacgatttttaagatataaacttacaaaatacatgtttcaatcaaataatgataatcgttgatagttcaaccaattacactaaaaaacattagaggagaaagtggaccaaatcctgaatttgattgccaatgacgggggaaaacatagtgaaaatgtttaagctccgaattaaaaagaacatagaccgtcgtttgaattggtttactatctttacgttcaatcttatatcgatttgttttggtataatttcattttgataaatccaaaatggtttaaatcagattgtatcctatgttcctaactactagttagaataataatctatttttaatattgattttaattcttctgatggagtatataatagtgctcgacaatgtcataatcagtacaaaataaatcacctaccaacctgaactatatgttatatattttgaggggccacgtcaagtgtgccgtttatttttgtgtttatgattgtttaatatttgtgcgtgtgatggtgtttcttgcttagtttccacttaatacacaatcaaatatcaagtggaactatttatgaaaattgttcttcgagaagaattctgaccctaaaaggtcatttgagggcttgaggcttattgtttccaaattacaccagtaaacaagggtttttttttgtcaacaaagattattgtaattcgaatttcgtctacaataaaacaaattttcttactaaaacaaaacaattagctgacggttgatatttcggcttttgagtttaattaactaattggtgattatgttgatgatctttcacacctaatgaagtgtcatgtatatgtatatatgtatatacttatgtatatataaaacgtacatataatcatttgtcatatatatcatcatgtattgcatgactaaactacccttaaaagaggaatacgatagacatgacctttaggaatttgtttttttcttctaaatggattccttcgcttctttttagcctcgtagtgaatttgaacattgcagttatttctagtaagatattttttctgtatttttcggaaaatgttaaaaactaattatacacaatttactttctctctcaactcttattttacgttactgttttttttttcctcttgcaaaattagagctgctgtatttacatttactagtaatttggtagatagacagttaatgtagtatatagatggggttgagggcaaatgattacttgggagatggtgcaatgcatcagagtgatgatgtggaatttaataagtgtgaatttatgggcaaaggaagggaactagtagtagaaagggaaataaatacagtacaagtaagaggaaaacgaaaagagagatagaaaccataataatgagttaacgcagacatagccgccattttcaacttctcactcccacttacaacttctccttctgggcaagttttccacatcaatgctcgtcttaatcaccattaatctctactcatcattaatacgttgaagcccactatttcaaaatttactaggagtatttattcgtgaaaaacatttaaatgtccctaattataagagatttaatttcatatttattgtattaaagagaatttacattagctgtcaaaaaaaaaaaaaaaagagaattaacattattttacagaacataaaattttgaaaatagatagcgccactgcatgtaagaacatacaaatttctttttttcaacaaaatctatttatatttcttctttttttgaacattatgtgtagtttgtagtaaactaaaaagtgtgaccaacacaatttaaatcattcgattttgtagcaaaaacatttttgttccaatttccaagcagcaaatatggtaggaatataaattctttactatttttcctcttaacacataaaagtaaaaaaagcattcaatgatcagttaaaatctggttagaattctaccttatcatttagaactagctaatatttaaattcatatatacaaaaaataaaatgggaactgtagagactagagactataaatagaggattgagaagaagaacttttaaagctctatcaatcatgaactactcgccttctccaacttttaaaactcatcataaatagtaaaaaagtagccggaaaaataaaataaaaagtctatttctctttcctttaaaatccaaatcctataaactcatagctttctctgttctttacttatacctcacgttatacatatatatagagtttctataaatgcttctctttcctctcgaacaaatcttcctcacttctctcatttccacactcaccttcctctctatatattaaaccctatctacttaactcttcttctaactctaatctctctctctatttactctgcttctgttctcactctgaaagaaccaaaac

SEQ ID NO: 3371 - DNA, 3000 bp, Unknown
  misc_feature (1)..( 3000): cDNA_ID_2051688_gDNA_ID_1620643_Annot_ID_163121 3000 nt of promoter + ATG
aacctctgccgttcgattatcctaatgaagcttggtgattaatttcttaataagtactttgatatatataataagtcatgattaatggaaaaatatatgataaaattatgtagacacaaaggaagaggaaaaagctaatgtcattcactttgtgttgtgtataactgaaaaaaaaaattggtcgtaatttttgtgtccatgtcctaatgcatgacacaaccaaatcaaccaatagttttgcatttggtttaaaagtttactcaaagtttgtgtaaagatttctgaggtaaaccttcgtctcttaaccaaaatagaagaaaaaaagaaaaagaaaaaaacattcccccgtttccaaccaattaccaaaactaaactaaaaagtaacttatgggatttgaatccatgtaataatatatcgacgaaattagaagaaaccatgaaattgtgtaataatgtgtctccttcagtccttcttttggtcaattatccacaattatgaaccataattattgagtttggtgatgtacatctagatattagttataatatcacaatcacatgtgaatttatatatgtgagaagaaaattcattttatgaaagcaactctgaatcctggattatataacaaacaatatcacattaacattttgatttcaactttacaacaattaataagcattaataacgaaattaaaacacccatgcatgacaagtatttcacatttgttgattcttaattacataaatcacacataaatacgtaccaaagattctaaatgaacattcaaactgacccgtaacacataaacaaaacaattttttttaagagcctaagtatttgacaacactgtaactcttactcctttgaaacatcttgtgcttactcccaaagctaatcaaaggacttgcctcatctattttctcaaagccacgatgaccaccacaacttctcgaactcttagccttccgcaattttgatggttcatgtcgtgcaccatcaatggtcgcatttctagctgatgcggctcttacaagtttagccacacgatcatcttcagctctcacggaatattgggagtggctagcactgaaacttcgcggaagagtgcttacgttgcagacgggtatcccaaaactcatgccgcttccaggaaggtcatgggaagaaaattgattcatgcttcgtatgtacatgtctctagctttcaccagcatctttatcggaacttttatgtatttgcttagcttcgtctcctttttcttgctcatcttatctttgtcacaaagtgagaagggaaactaagattttgcaatgatttgtgtaagatgctgaacatttaacaagattttgcgatgatttatatacatcatatttgggtcccgactttttaaaatatttatatgtgtatgtacacatacacatttgaacttactatatagtatacgggaataggtattaaacttaaagtatagttttatggcatttgcgtacggagatgcataattgtatgcaataagtaaaagacgatttatgtttttagttgattatttttatatagcgcgagccacgagacgttgagagtttgatggaattcatacataacaaaagatagaatttgattatgataacaaaataaagttatgctactctcaattgtggagcctatttgatcgtaacccctatattattagacccatcgtattcataaatttaaaccatatatgctaagaaaatgtaaagtcaagagttgacttcaaaacatggaaaacatgagatgtgaacatcaaaatttatggaataatcaaattgcaaaaaaattgaatatatgtacatgaacgatccaccgtccaaaaatatgaatatctaataattacctctaaacttcatcatgcactgatgaatatctattatctctaaaccactgatgaataactcaaatattcgtatatatttatcattaattttcgaaggttcaatataaaatagacgaagttatgggcctcagtatatttcagcctgtacgcctgtttcttataggcccatggacggtcggtcctcttgagttatggttgtgtgtgaaatcagaaatttgaatcatgtcttatttatccaacatcatcactttacttctaaaaatttgcaagtaacatattttgtaactaatcatgcaccactaaagtaactaatcatgtaccacccaagtaaaagattataatatttttagggaaaaaaaaaaaaatcgaatttctctgaatgactgatgaaataactggatgaaataactggatgaaatgacggatggattttgtcgataacctcgcgaaattggacctacatttcattcatttatatttcacacattcacaacatcctcatctaccctacacatccatttatacaacaagcatcctacacattcatctatataccatccacatctccctatacattcatctcatctatacaagcatacatcacaccatatccttctaaagctttacctgcagtcgtcatatgtcagtctcaatatacacatacacacgtcacacaccctacacatcctatcatgacattatctatattttgttggagtaagcttgaagcttacttgaagaagaagcaatcaagcaaaaaggaaattagaattatactttgtgtttaggaagttgcctaaatacttatgtgtgttttcctaataggattaggaaattgtctagttcttttcatatataaaggagttgcaagagtgttgcaaaacttatgagttgagagattaagattgtgtgtttttaggttttgagttattttcttaaagcaataaaagagagagtcttttattcataatcttgttcttattcttgagtttgatatatagtttgaatcaataattggtatcagagcataatattgattcaagcatctttacgatcaaacaaaggcaatcaacgaagttagcgttgattccgtacggagaaagaaggtaacttgtgaagaagac

SEQ ID NO: 3372 - DNA, 3000 bp, Unknown
  misc_feature (1)..( 3000): cDNA_ID_1839219_gDNA_ID_1620643_Annot_ID_163117 3000 nt of promoter + ATG
aatcacttcaccttctactcaaatacgagaactgaaaactcaagcacattgcaaagaaaagatcatataacaaagcaaaataagaatagtaacaactttagttgaggcaagcaaacaatcgaacaccttgcgtgcttttttctcataaatcaaagtatataatacggtgaagaaagacggtaccttcaaaatggcatcacaagaagagccggcgatgatctcgccggagataataacgacgaatgtgcagccacggtgagcccaaagataaggccatgcttcacggaaccaacgcacaaactgtttgtcgtcaactggatgctcagcctccacatcgccggctgcagtcaccgcgtagtcaaacatattgcatttcgccgccgttatagaactaaccggcttaaaccatgaacagttaaaccggaattgagtagggtttagcttattttttggtttgaatgacgaaaaattcgactttgattggcgaaagtggtaaggaacatagtagctagaagtagaagaagaacccactaaagctcctcgctccatcttccttagacttcgatgagagaaagaattcaaataaatactaaattgttattgtaactaaaccggcaggtgacggctgattacggtcggagaaggcggcagtagtaccgtagtgggacccacggtaagtaggtattttatttattgtttatttttccatattttcttcaatagtctttttctattattatttattgtttatttttccatattttcttcaatagtctttttctattattatttattgtttatttttccatattttcttctttagtctttctctattactatttgacggaactctttgaatgtctggtcgttacaagcttaagttgtgtccccacatggaagttattcggttgggtccatcgaaggaaaattgattgaaccggtctggtcattctctcccaaactatagaaccaatttcggtctgcatcggagtttcgaagtcgcggacttatcagagtgggctttttaaggaatgtttttagaatatttaccagcccaatcccattttaagtatgtccagatcttaatttggcgagcctttttatatatggtgaacaactgattctaatgtgtatgtttcacttttattagagaaaaaatgtgaaaagatttaatgtgtatgtttcacttttattagagaaaaaatgtgaaaagattcttaaaagtatttatttatgctaattggcaaaactaaaacatcaatttatgtacatcattttagttcttcctctaagatttgattgatttgtattaatggctctgaatactgatactagtttcgttggcaagtaagataagtgataactttgataaagagtgtcaaattacaagtgccacaatttggagtacgtaaccaaattgacataaaacttgaataggtgaaaaaacgagccagaaaaaaaacgaatatcttctgcttatccgaataaaacgaaagtaatattcttacaagatccttccttatgaagtagtgccagtagatatttttatcattgtgattgcgacctgtttgttgcgattcatttatgccaattcacgttactatttatgttgtgataaaatcttttatttttcttcttctttccaaatacttaagtatgcatgattattgatccgtacaagcataaacgaagagctataaagtctccaacggtaaacgtacgtgaaccaaaataacaattcaatattatggttcgaattattctgtgtattttatgtaagaaaataaccaaaaccgactcgaaacaaaacaaaaaaatcttctgaaatgtgaatctttatttcggaaaattcttaacgatagatagtttttgctttaaaattaaatccaaacataaactagaactgaaattcaattcgttgtcaatattttctatacaaaaaaaaaaaagaaatccgaccaaataaacaaaaccataaatagacatctccatttttagttgaaagatgattaaatgcaataaatgtgccacaatcataaatttttccttttcacctaattgaaaattttaatcattaataagaagaatccatggagcacaattattttattttttattttttgctctcatatggtatgttaaattaattttcccttaatttaaattccccatatcaaataagtttttttttttttgagaaagacttgatttcataggagaaatatttgttaatattttcgacaaaacattttctctgtttgatgtatttccatcctcgtacaataaatactctagctattaaattcttagcccaaacgaaaataaagaaaaataaaagggtcctactaataaacaaaacaaaactagtggtcccaatttgaaatatataaaaatatataaaattcataaagctttgtggcttcagagcttccacttccatcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccaggtaacaaaatctcaccttttctctcctaatttcacgaaatcgaagaaaaattctcataattctcttaattacttatctctcaatttcttaaatcttacagggtttgtctttcgaaattcaggtaattttctcaaatccatttatggattgaagctttaggtaatgaatgagctgaatctgcatataaaaatcgatactttcattatccagaacaaaacaagatttagcataaacgttcaaaattgaaactttgattcctaacttcttggaatgattcagattgagctagatttagatctgtatgattgatattatgggtttggtttgtttatgagtagagagaaaatgggtgatgaggcagagatcaaggaacatttaaagccacaagcttcatctgaaaca

SEQ ID NO: 3373 - DNA, 3000 bp, Unknown
  misc_feature (1)..( 3000): cDNA_ID_3093580_gDNA_ID_1620643_Annot_ID_163112 3000 nt of promoter + ATG
ctcgatacaaagcattaatcttgtctatccccccgagctcatgcccattgtttaatttcgtttaaaatcccgaagtctcaaaattggaataatttgatcgccacgtacgtagcaccattataaaaaataaaataaaaaatctaaaaactaaatgatgatgttattttgtatattaacaagcaaacctacattacataactctccatattttctagtatgtaggaaagtttcggacatatttagatatatgctatatcatgctaaaattccaaactaattaatgaagaaagtgatcaaatctacattatagcctaggctagacataatgcagtagatatttacatcttatgagtcatcaccatctctggtagatcaaatgttctcatgatcagtttcttctacaattattagaagaaaccccacgctctgcttctttgtccctttcttcgaaacctatcgagtgttgcaattcagtttcttatgtaatttctcgaaatctgttcttgcattctaggaaaagtcccatcttaatcttttgaagaatatatatatatatatatatatatatatatatatatatatatagtcgataataatttcggttatatgtgccactatgttttatacacaacaccaaacagccatagcataaatgcataattacattgtttatgtatacagtagaccctaatttgtttctcgcatataaacccatattcattcgctaatttggttgttatgcatgcctgtatgctaattaagatttatatacttggagaaaacatcttccccatggttaggattgtttagccccagaaatgaaccgttaacttatctttttcgattagtaatgaaatgatcaaatatttttacaaaaatattctactatccttcaattaagccatagacaaaaaaaacctgtaggtctcccatcaatcacacaaaggtaaaaaaacagacttttaggtgaccaatttcgtaccattttgtaaaatctaaatcggaacaatgtagagcaaatgatgtagaaaatatcatacattattagaaccaactcaatcaaacctaactcaaaataataattttgacatgactattcccactaaaactacatataagtgacaccggctaaagttttttaaaaattgtacggcataccaaaatcatggaggttgatatgatatgtgtagaatcatccgaaaaatatatatttgtgaatttacacaaatttatgggtcatcaacgtacgtctagacctctttcaaacaactttttatgattgcaaaatgttatttggttaatggatttcgtaacacaacaaatatctcatcaacgaacttcgtccaccacttgaatatgaaaccaagctggttttcttagtcccatatataactgaatttttccttccctagtcacacttttagcgatagcaggagcagtgacatcagtccgaaccgcgaccaagtgaaattacaaccttcaaaaccgttgctaaactgtgatttttttatttttttggtaatggctaaactgtgaattttatccagcagatcacagaatcttggcaacttatggggtaacgaactagcttcccatggcagagtgacaatcggagaccacaaccacacgagcaacttcaacgtcatcccacagctgttccaatgcctgtccaacacataactcagcagaatcgcttaaagaaaaaaaatgattaacagttttattgtttatttttctttctcaaaagcatcccaaatattttagagaagcaaacatataccagagcccaaaatttgttaggccctaaaggccaataaagcaaacaaagccgtgtaaagaaagatcttaatagctttcaaggcctataaaggcccattctaagcccaaatctgcatgtccaacttttttgaaagtgtcattttccatgaagtcaaggtaaacgcattattcaattggagaagaataaaaaacactagttattgaactagaatgatgaacagagacataagcaattagtaccaaacgaataataaaaagacataaagcaatcaatgtttttgagtccaaatagaaccaatgggcttggtccaacgtggcgtccccgaagtgtcgggttttttgcaatagtctctgggtcaacggtcctccaatttctctttatttatataaacgaccccatttcttattattgtcaaaaatcaccgcacttttgtcccacaattgtcattcaatttggtcaaagtgaaatcaacgtgagcagccaaacaacaaaaaaccaaagctacgaaaggtaaacttcttagaaaaatcttgcaaaatatggtccaattaaaactctctgtatattatattccatttttttctatacagtatatattatattgagtaaatctaaaaattacgtcatttactcatccatagtattttactagtttttaaacctttttttttctgtaatcttctaatttttttaattataaaatgtccacattcattcacaaatttgggaataaaaaccaatcataaactcaacaataataacataaacgcgtaatgtactcgtcatggcctgcatgaatgtttcaagaatgatttaacgttcgttataaatggaaagtagtgcatgtctttatttaattattctcttcaataataagtcgaatgtttttattaaaaatgtaagagaaactttgttggacacacgaatttaaaacgagtcaactcagcttctcatcaccaaatgttaataaactcaacgactcggtcaaatgcttaagcaaaaaaaactcagatctttgaataaaaaaaaactttacctttcttctccattaaaagcttccgatttctcttcttcacccaccaaaaaataaaaaggttccttttttcttctccaccaaatatacagaagaatttgaaacagagagccaaacaaaaaagccattgaagctggaagacaaaaaaaacagaggagattgaagaagaagagggagtaagaagatg

SEQ ID NO: 3374 - DNA, 3000 bp, Unknown
  misc_feature (1)..( 3000): cDNA_ID_2999369_gDNA_ID_1620643_Annot_ID_163108 3000 nt of promoter + ATG
agatttaaaagaaaattgcgaaagttcgtagataaaattaaattttgtaatgctatagtatgcgactatctccattctccacaagagaagtagatgtaatagtgagtgttaactgttaagcatttcgggatattactaataatgggcctaaaacttattataaggtaagacccatctttatcaaaatgtttctacaggcccaatatataagtgagagtgacccatgtgtaataatgtagccaatgtagccggtctacataactgaggtccatgctataacaatctgtttttctttatcaatcaatgctagagtttgcccaaaaaaaaaaaaatatatgctagagggtactcattgacattgttactccaaaatatatgaacaaacaaagttaatatatcgatggacatattcgatagttatttatttcacggacacagaaataagatcggtggacaaattaacaaatatacccattcctcagcaagaaacataagatcggccctcacagctgaagctttggcgatgcttctcgctcttcagcaagccaaagatcttggattcacctctctgtcaattgcttctgattcacaacagttgatcaaagccatcacctcgagaactccattaacggagctccatggaatcctacacgatattctcctcctcgcgtcggagattgggtttgttaggtttcactctatccctcgaaatgaaaatcgacttgcagatgccctttcaaaattgggtcttgcttcaatttcgtctttgtacccggttgactccggtttaaatgtttaatttctaatgaaaaccaactttcgcacaaaaaaaaaaaaaaaaaaatgaacaaacaaagtgtatacaattcattaattttctacaacgacaactctacaagtattgatatgatgatagataaattagctaaatagtgaataaaatgtcagttgtttaatagaccacgttgaacatacacgttttaaaatcaaaacacaatcaatttgttgacgtgtttagacatattcgatagttatttatttcacggacacagaaataaattagtttttacttttagtgatggagctgttataggcatgattgttgtacttgttaataatttcccctaatttgtcatattagcaatcgtaaaagagaaagtgcctcatgaactatatgaagaggtcagcgtgagcgtgccagcaacttgagagattcgtgaccaagtatctatcaaaagagctctattattttttgaggctgagtcagcgactaataatttcgttattaaattaccgctttttcatttgtttaatcatacttttcgtatactctatggttaaatcgttaatttgtcgcgaagaggcaatgtgacgttttacacaacataatccaacaaatgaaacaaaaagatattaccataacctattattacctatcacaatcttacctaatctttgtcggtctttgaaatggtacattgcccatcgcataaaggggtatggtgcgactccggctcgtagcagttccgtgggttgatgaatggttgtttcaaaacaataaatgtttcaacttggacgaagataataatttcatgaaaacgaaaccattacatgactatcatcatttcattataagaatataaacatggacgagctcaacatttatttagctgactccttcttttatcatgtgttttatatacaaatacatgactaggatctgacactgtagtattagtattaccaaatcttaaactagacctaattttccctgataaaataatttaaggttattttattccgctgacatttaacatggtataatatatttggacggttcatttcaaacatgtagaatattctaattaaatagaagagactttataatcatattaatcaatatcgataacgtattatccacaatgcaacttattaccctttttgccatgttttgtgaaccgcttggaccgtacaccaaccccaaaatacggtagttcaaatgcggctagcaatgtattttgttgattctaaaaaaaattgtcgattagttatatatatcagacactatctaaaatacccgttttaagtatttggaattaataaaatagtcaaaattggaatactaatttcccataattactaaacttttattttactcgttttacttattatactatccgttatgtacgaactacatttatgtcgtttgttttatctgttttactctaatttgcaccgtcgaaaccatcaatccactaaaaaaaagggtaaattgtaggactaattaatggatatccattaacacaaccatacatcttaatatgaaatgtgtgtaccttttccaaatatacgtcgtcgccaacaactatacaatggataattaaatataaagcagaacatttggataaaggccaatatttgattaaagacttggatataatgtgaaggcatatatttgtttttggatagaataaaactaaaaaaagtgtgtgcttaggaaagttcgtccgacgtgtatatgaatcagcaaatacttatcttgatcctctccgtgtgggtcccatttcgacgtgttcacattttccaccaattaatcaatttagaccattataaatagtctcccgctcgctttgctctcttctttctcttattttcctattcttgaaaacacacaacacatctcatttctccgctgtttcgtcggcaaattttcccatttttgattccgaagataatagatattatcaacagaggataaggataaaacccagaacaatcattataatttagtggtgaagttgaccaaatttataaactgatccaattttaaaatctgtaagtcgtcaatatttctgtgtttttttcttagatctataaaactgaaattcgtaaaatttgttaaattctctttctttagatccaatatttgatctcctatgcattttcatacagattctgaatctgattttttttaccctaacctgttacagaagagatatg

SEQ ID NO: 3375 - DNA, 3000 bp, Unknown
  misc_feature (1)..( 3000): cDNA_ID_2156792_gDNA_ID_1620643_Annot_ID_163105 3000 nt of promoter + ATG
tacctttttcttgtaatgtcaacttgagcaataggaccggagaactcaaccaattaactcaaatatcgtggcattaggctgatgacatgaaattaaagtggagtttgacagctaaacttttgatacacacatactcgacaaaactaaaacaacggtaaacctacaagatcttttttattacatgtgatataaacagaaaaaaggagttaaaaaaaaatgattgaacatgcaatggtctaaatataatcgtgcggtagttaacgactgagcgatttaaatttaacaaggatcgaaaatgatttaaatagattccatcatgagtatgatcactttgatctcagacaattttaattaaaaaagaataagaatttagtacgaaataatataagactagctagggaaaagaagagataaaggctggctaaaaaagggaatgcatggaccacgttttggtggttcccataatcacacgagtactcgtccatattgtaattaggtaacatgtagctttcgactttcctatcgattcacaacgttcaatactttgggaaagaaaattctgataaaaaaaatatgatgttcattctaatcatttcaattttctaaacatatagaagaaatgacatcaaccgcatacggggatacctgcatgatattatgatatgagtatagtaagattaactatgtaaacgcgtaatttggtaaaaataatattaggtgagtgtcatatcagataagaaataatatttcagaagtgaaaataataaacataagtgtattttagatttaaagagaatcatcattagctattgttcctgatagtagtttatcactttatttattatttttgcgcacttcgaaatttatgccatttttcattcgcaatcttaggccatgtgctttgctataatcacacgaatatttctcagataatcgctttgataatttatatatttgttgcttatcatgtttgaccaaaaaagaaaaaaaaaatgttgcatattatcaactttgcacaagagaacaacttgtatgctatctcaatcatgttgactcacccaactcctaagatcataagtagatgccaatctgatgaagggaaaccaaaaaaaaacaattaaaaatccgaagaggcaaatctattggttaatgtgaatagattcgtgagatgtaaaaccatgtgaagatgaaacagcaatgaatcgacttctaacttcttaaagctagcttgcattcattggattcttattggctaccacatgcatcgaacaccaaaaaaaaacccatcaaatatttaacactaatctttcaggatctacaaaattaaatttgaagtgaatctaatcaagaagattttctgcaacgaacaccaaaaaaaaaacatatctttaggtccaaataggttaagaactctttgactttatttcttatatcaatatacttgtttgactcacaatttcacacgtatatatataaactatatattgtttgactcacaatttgacacatatatacatgtataaactatgttacaatgatcctatagtatccataagattcccaaagtaggagagattagggattcactaaaaatagacagttatacaaaactaaaatattttgtaaataatgtgattgatgaaatatattaataaaagaagtgattaataagaagaaaaagaagtgggagagataaaagagagagataatgaaaaggaaaggagaaaacatgtcctgaaaagaaggtaagtttgtctgaagagaagggggcacacaagtaagtgctttgtcagatttcgcgtgcattcatcaaaacaaaaacaaaaaagctcttctttcttcttcttctctctttctttcattcattcagttttcttggctccttcctctcctttcttttctttaattttctcaattttcaaagaagaaaagttgtaccgatttttattaaacgaaaggtcactgtttgattgtgtttaagagaaagaaaaaaagtagaagaatcttttatcatcaacctgatctggtttgtgcttaactcgaagagaggaaaagacttctgttttgtttttcttggtttgtagcgcattttgcgttcttgaggtttaaagtcgaagaacaacaacagctcatacttttttatattttctggtttctgtggggctcatagagagagagaaagaagagagattttatacgattatatagctattagatttttgtggtagtggtgttgtctcatgattaagagaagctttaaagaaaactcaagtttgcttctgaggaagacaatcaagaaaaaggtatccaatttttttttcttgtattcaagttttgcaattgaggatcttagggttttaaagaatcgattgatgtagaaagaactcattgtttttttaattttgagtcctcttgtaccaaaaacgatctctgccactagtgtcatgttatgtttttgttagattcttttttagcaaacatccaaaaaagatttgattcatcttgtctattgaataagtggcagtcttcaatttttttctctgtttttcttgattcttgcaggtttactattaaacgacaacgcttttgcaatcgccaccacaaaaagattcaagctttggattcgttttacttgtggacgactaaacaaataagagattaaaaaaaaaaaggtttcacatggttctgcgtttgtgaatgtgtgaagcacttagataacagagaaaaagaatttgattattttaaagagtttatctctgtgtgtgtgtgtcagtaaattcgagctttgagtgggtgttttgtgcatctctaagtttttatctcttttatataaaatcttatatttcttttttcaatgttctctttgagatgtgagattttcacagtgttgtctccttaagtgtgtaactcaagaagcattttggggagtgataacacacaagctgagtcttttttcttctttctgagatatcttcttctatcagtttcttcttcatcatg

SEQ ID NO: 3376 - DNA, 3000 bp, Unknown; identical to SEQ ID NO: 3370
  misc_feature (1)..( 3000): cDNA_ID_1820589_gDNA_ID_1620643_Annot_ID_163104 3000 nt of promoter + ATG

SEQ ID NO: 3377 - DNA, 3000 bp, Unknown; identical to SEQ ID NO: 3369
  misc_feature (1)..( 3000): cDNA_ID_2156784_gDNA_ID_1620643_Annot_ID_163101 3000 nt of promoter + ATG

SEQ ID NO: 3378 - DNA, 3000 bp, Unknown
  misc_feature (1)..( 3000): cDNA_ID_1820585_gDNA_ID_1620643_Annot_ID_47532 3000 nt of promoter + ATG
tttgatacacacatactcgacaaaactaaaacaacggtaaacctacaagatcttttttattacatgtgatataaacagaaaaaaggagttaaaaaaaaatgattgaacatgcaatggtctaaatataatcgtgcggtagttaacgactgagcgatttaaatttaacaaggatcgaaaatgatttaaatagattccatcatgagtatgatcactttgatctcagacaattttaattaaaaaagaataagaatttagtacgaaataatataagactagctagggaaaagaagagataaaggctggctaaaaaagggaatgcatggaccacgttttggtggttcccataatcacacgagtactcgtccatattgtaattaggtaacatgtagctttcgactttcctatcgattcacaacgttcaatactttgggaaagaaaattctgataaaaaaaatatgatgttcattctaatcatttcaattttctaaacatatagaagaaatgacatcaaccgcatacggggatacctgcatgatattatgatatgagtatagtaagattaactatgtaaacgcgtaatttggtaaaaataatattaggtgagtgtcatatcagataagaaataatatttcagaagtgaaaataataaacataagtgtattttagatttaaagagaatcatcattagctattgttcctgatagtagtttatcactttatttattatttttgcgcacttcgaaatttatgccatttttcattcgcaatcttaggccatgtgctttgctataatcacacgaatatttctcagataatcgctttgataatttatatatttgttgcttatcatgtttgaccaaaaaagaaaaaaaaaatgttgcatattatcaactttgcacaagagaacaacttgtatgctatctcaatcatgttgactcacccaactcctaagatcataagtagatgccaatctgatgaagggaaaccaaaaaaaaacaattaaaaatccgaagaggcaaatctattggttaatgtgaatagattcgtgagatgtaaaaccatgtgaagatgaaacagcaatgaatcgacttctaacttcttaaagctagcttgcattcattggattcttattggctaccacatgcatcgaacaccaaaaaaaaacccatcaaatatttaacactaatctttcaggatctacaaaattaaatttgaagtgaatctaatcaagaagattttctgcaacgaacaccaaaaaaaaaacatatctttaggtccaaataggttaagaactctttgactttatttcttatatcaatatacttgtttgactcacaatttcacacgtatatatataaactatatattgtttgactcacaatttgacacatatatacatgtataaactatgttacaatgatcctatagtatccataagattcccaaagtaggagagattagggattcactaaaaatagacagttatacaaaactaaaatattttgtaaataatgtgattgatgaaatatattaataaaagaagtgattaataagaagaaaaagaagtgggagagataaaagagagagataatgaaaaggaaaggagaaaacatgtcctgaaaagaaggtaagtttgtctgaagagaagggggcacacaagtaagtgctttgtcagatttcgcgtgcattcatcaaaacaaaaacaaaaaagctcttctttcttcttcttctctctttctttcattcattcagttttcttggctccttcctctcctttcttttctttaattttctcaattttcaaagaagaaaagttgtaccgatttttattaaacgaaaggtcactgtttgattgtgtttaagagaaagaaaaaaagtagaagaatcttttatcatcaacctgatctggtttgtgcttaactcgaagagaggaaaagacttctgttttgtttttcttggtttgtagcgcattttgcgttcttgaggtttaaagtcgaagaacaacaacagctcatacttttttatattttctggtttctgtggggctcatagagagagagaaagaagagagattttatacgattatatagctattagatttttgtggtagtggtgttgtctcatgattaagagaagctttaaagaaaactcaagtttgcttctgaggaagacaatcaagaaaaaggtatccaatttttttttcttgtattcaagttttgcaattgaggatcttagggttttaaagaatcgattgatgtagaaagaactcattgtttttttaattttgagtcctcttgtaccaaaaacgatctctgccactagtgtcatgttatgtttttgttagattcttttttagcaaacatccaaaaaagatttgattcatcttgtctattgaataagtggcagtcttcaatttttttctctgtttttcttgattcttgcaggtttactattaaacgacaacgcttttgcaatcgccaccacaaaaagattcaagctttggattcgttttacttgtggacgactaaacaaataagagattaaaaaaaaaaaggtttcacatggttctgcgtttgtgaatgtgtgaagcacttagataacagagaaaaagaatttgattattttaaagagtttatctctgtgtgtgtgtgtcagtaaattcgagctttgagtgggtgttttgtgcatctctaagtttttatctcttttatataaaatcttatatttcttttttcaatgttctctttgagatgtgagattttcacagtgttgtctccttaagtgtgtaactcaagaagcattttggggagtgataacacacaagctgagtcttttttcttctttctgagatatcttcttctatcagtttcttcttcatcatgaagttcatgaaacttggatccaaacctgattcatttcaatctgaaggagacaatgttaggtttgtgttctaatcctcatcttttacctttctgttttatgttcttgattattacaatg

SEQ ID NO: 3379 - DNA, 3000 bp, Unknown
  misc_feature (1)..( 3000): cDNA_ID_2999369_gDNA_ID_1620643_Annot_ID_47534 3000 nt of promoter + ATG
agaaaattgcgaaagttcgtagataaaattaaattttgtaatgctatagtatgcgactatctccattctccacaagagaagtagatgtaatagtgagtgttaactgttaagcatttcgggatattactaataatgggcctaaaacttattataaggtaagacccatctttatcaaaatgtttctacaggcccaatatataagtgagagtgacccatgtgtaataatgtagccaatgtagccggtctacataactgaggtccatgctataacaatctgtttttctttatcaatcaatgctagagtttgcccaaaaaaaaaaaaatatatgctagagggtactcattgacattgttactccaaaatatatgaacaaacaaagttaatatatcgatggacatattcgatagttatttatttcacggacacagaaataagatcggtggacaaattaacaaatatacccattcctcagcaagaaacataagatcggccctcacagctgaagctttggcgatgcttctcgctcttcagcaagccaaagatcttggattcacctctctgtcaattgcttctgattcacaacagttgatcaaagccatcacctcgagaactccattaacggagctccatggaatcctacacgatattctcctcctcgcgtcggagattgggtttgttaggtttcactctatccctcgaaatgaaaatcgacttgcagatgccctttcaaaattgggtcttgcttcaatttcgtctttgtacccggttgactccggtttaaatgtttaatttctaatgaaaaccaactttcgcacaaaaaaaaaaaaaaaaaaatgaacaaacaaagtgtatacaattcattaattttctacaacgacaactctacaagtattgatatgatgatagataaattagctaaatagtgaataaaatgtcagttgtttaatagaccacgttgaacatacacgttttaaaatcaaaacacaatcaatttgttgacgtgtttagacatattcgatagttatttatttcacggacacagaaataaattagtttttacttttagtgatggagctgttataggcatgattgttgtacttgttaataatttcccctaatttgtcatattagcaatcgtaaaagagaaagtgcctcatgaactatatgaagaggtcagcgtgagcgtgccagcaacttgagagattcgtgaccaagtatctatcaaaagagctctattattttttgaggctgagtcagcgactaataatttcgttattaaattaccgctttttcatttgtttaatcatacttttcgtatactctatggttaaatcgttaatttgtcgcgaagaggcaatgtgacgttttacacaacataatccaacaaatgaaacaaaaagatattaccataacctattattacctatcacaatcttacctaatctttgtcggtctttgaaatggtacattgcccatcgcataaaggggtatggtgcgactccggctcgtagcagttccgtgggttgatgaatggttgtttcaaaacaataaatgtttcaacttggacgaagataataatttcatgaaaacgaaaccattacatgactatcatcatttcattataagaatataaacatggacgagctcaacatttatttagctgactccttcttttatcatgtgttttatatacaaatacatgactaggatctgacactgtagtattagtattaccaaatcttaaactagacctaattttccctgataaaataatttaaggttattttattccgctgacatttaacatggtataatatatttggacggttcatttcaaacatgtagaatattctaattaaatagaagagactttataatcatattaatcaatatcgataacgtattatccacaatgcaacttattaccctttttgccatgttttgtgaaccgcttggaccgtacaccaaccccaaaatacggtagttcaaatgcggctagcaatgtattttgttgattctaaaaaaaattgtcgattagttatatatatcagacactatctaaaatacccgttttaagtatttggaattaataaaatagtcaaaattggaatactaatttcccataattactaaacttttattttactcgttttacttattatactatccgttatgtacgaactacatttatgtcgtttgttttatctgttttactctaatttgcaccgtcgaaaccatcaatccactaaaaaaaagggtaaattgtaggactaattaatggatatccattaacacaaccatacatcttaatatgaaatgtgtgtaccttttccaaatatacgtcgtcgccaacaactatacaatggataattaaatataaagcagaacatttggataaaggccaatatttgattaaagacttggatataatgtgaaggcatatatttgtttttggatagaataaaactaaaaaaagtgtgtgcttaggaaagttcgtccgacgtgtatatgaatcagcaaatacttatcttgatcctctccgtgtgggtcccatttcgacgtgttcacattttccaccaattaatcaatttagaccattataaatagtctcccgctcgctttgctctcttctttctcttattttcctattcttgaaaacacacaacacatctcatttctccgctgtttcgtcggcaaattttcccatttttgattccgaagataatagatattatcaacagaggataaggataaaacccagaacaatcattataatttagtggtgaagttgaccaaatttataaactgatccaattttaaaatctgtaagtcgtcaatatttctgtgtttttttcttagatctataaaactgaaattcgtaaaatttgttaaattctctttctttagatccaatatttgatctcctatgcattttcatacagattctgaatctgattttttttaccctaacctgttacagaagagatatggagaacatg

SEQ ID NO: 3380 - DNA, 3000 bp, Unknown; identical to SEQ ID NO: 3373
  misc_feature (1)..( 3000): cDNA_ID_1820574_gDNA_ID_1620643_Annot_ID_47537 3000 nt of promoter + ATG

SEQ ID NO: 3381 - DNA, 3000 bp, Unknown
  misc_feature (1)..( 3000): cDNA_ID_1820566_gDNA_ID_1620643_Annot_ID_47540 3000 nt of promoter + ATG
ttcttaccagaacacacatgtcagtgtagttgccatgagaaaatctttcaggcaaacagttataaagaaggtccatcacatgccaactagatggactagaaggaaggcgagccatgagctcagaatgaagtttgtggagatctgttttcctcaacaaatcgggtaaacggtgttgaagcgaatgaagatccacgacactcggtactttcgttgcagtgtatatagtgagcgccaaaaacaggaaaaacccaatcaagtgcctgcaaatcccaaagaacacacacacacaaacacactcaaggctcttgaactttaaacaaggatacatcaagaaacatgattcaacacttacgtccaaacattcaaagtctcattatgaatggtaaagatgctgagaagaatctgtttgatcggccattcggatcggtaatgaccaatgatgtactcattgtctcttaaataagcaggcaatgaatgaaactccaccaattgatacttgactttctgccataacctcttccctttcacattatgtttcttgtccattgtttcagatgaagcttgtggctttaaatgttccttgatctctgcctcatcacccattttctctctactcataaacaaaccaaacccataatatcaatcatacagatctaaatctagctcaatctgaatcattccaagaagttaggaatcaaagtttcaattttgaacgtttatgctaaatcttgttttgttctggataatgaaagtatcgatttttatatgcagattcagctcattcattacctaaagcttcaatccataaatggatttgagaaaattacctgaatttcgaaagacaaaccctgtaagatttaagaaattgagagataagtaattaagagaattatgagaatttttcttcgatttcgtgaaattaggagagaaaaggtgagattttgttacctggatcttcaatgccgacgagacaaaatcttctaagaaagatctctctctttcttaaaagtcaatcaaaatagatctcaaggtttcgtttttgtcgaaaacagagagttcttgttttggtatgaaatcgaagaaagaagaaaaaatagaagacgacgatggaagtggaagctctgaagccacaaagctttatgaattttatatatttttatatatttcaaattgggaccactagttttgttttgtttattagtaggacccttttatttttctttattttcgtttgggctaagaatttaatagctagagtatttattgtacgaggatggaaatacatcaaacagagaaaatgttttgtcgaaaatattaacaaatatttctcctatgaaatcaagtctttctcaaaaaaaaaaaaacttatttgatatggggaatttaaattaagggaaaattaatttaacataccatatgagagcaaaaaataaaaaataaaataattgtgctccatggattcttcttattaatgattaaaattttcaattaggtgaaaaggaaaaatttatgattgtggcacatttattgcatttaatcatctttcaactaaaaatggagatgtctatttatggttttgtttatttggtcggatttcttttttttttttgtatagaaaatattgacaacgaattgaatttcagttctagtttatgtttggatttaattttaaagcaaaaactatctatcgttaagaattttccgaaataaagattcacatttcagaagatttttttgttttgtttcgagtcggttttggttattttcttacataaaatacacagaataattcgaaccataatattgaattgttattttggttcacgtacgtttaccgttggagactttatagctcttcgtttatgcttgtacggatcaataatcatgcatacttaagtatttggaaagaagaagaaaaataaaagattttatcacaacataaatagtaacgtgaattggcataaatgaatcgcaacaaacaggtcgcaatcacaatgataaaaatatctactggcactacttcataaggaaggatcttgtaagaatattactttcgttttattcggataagcagaagatattcgttttttttctggctcgttttttcacctattcaagttttatgtcaatttggttacgtactccaaattgtggcacttgtaatttgacactctttatcaaagttatcacttatcttacttgccaacgaaactagtatcagtattcagagccattaatacaaatcaatcaaatcttagaggaagaactaaaatgatgtacataaattgatgttttagttttgccaattagcataaataaatacttttaagaatcttttcacattttttctctaataaaagtgaaacatacacattaaatcttttcacattttttctctaataaaagtgaaacatacacattagaatcagttgttcaccatatataaaaaggctcgccaaattaagatctggacatacttaaaatgggattgggctggtaaatattctaaaaacattccttaaaaagcccactctgataagtccgcgacttcgaaactccgatgcagaccgaaattggttctatagtttgggagagaatgaccagaccggttcaatcaattttccttcgatggacccaaccgaataacttccatgtggggacacaacttaagcttgtaacgaccagacattcaaagagttccgtcaaatagtaatagagaaagactaaagaagaaaatatggaaaaataaacaataaataataatagaaaaagactattgaagaaaatatggaaaaataaacaataaataataatagaaaaagactattgaagaaaatatggaaaaataaacaataaataaaatacctacttaccgtgggtcccactacggtactactgccgccttctccgaccgtaatcagccgtcacctgccggtttagttacaataacaatttagtatttatttgaattctttctctcatcgaagtctaaggaagatg

SEQ ID NO: 3382 - DNA, 3000 bp, Unknown
  misc_feature (1)..( 3000): cDNA_ID_1839219_gDNA_ID_1620643_Annot_ID_47541 3000 nt of promoter + ATG
ctaaaacaaaccttattcctagatgatgaagaaacgctatgtcctgcacatatatcaaatcacttcaccttctactcaaatacgagaactgaaaactcaagcacattgcaaagaaaagatcatataacaaagcaaaataagaatagtaacaactttagttgaggcaagcaaacaatcgaacaccttgcgtgcttttttctcataaatcaaagtatataatacggtgaagaaagacggtaccttcaaaatggcatcacaagaagagccggcgatgatctcgccggagataataacgacgaatgtgcagccacggtgagcccaaagataaggccatgcttcacggaaccaacgcacaaactgtttgtcgtcaactggatgctcagcctccacatcgccggctgcagtcaccgcgtagtcaaacatattgcatttcgccgccgttatagaactaaccggcttaaaccatgaacagttaaaccggaattgagtagggtttagcttattttttggtttgaatgacgaaaaattcgactttgattggcgaaagtggtaaggaacatagtagctagaagtagaagaagaacccactaaagctcctcgctccatcttccttagacttcgatgagagaaagaattcaaataaatactaaattgttattgtaactaaaccggcaggtgacggctgattacggtcggagaaggcggcagtagtaccgtagtgggacccacggtaagtaggtattttatttattgtttatttttccatattttcttcaatagtctttttctattattatttattgtttatttttccatattttcttcaatagtctttttctattattatttattgtttatttttccatattttcttctttagtctttctctattactatttgacggaactctttgaatgtctggtcgttacaagcttaagttgtgtccccacatggaagttattcggttgggtccatcgaaggaaaattgattgaaccggtctggtcattctctcccaaactatagaaccaatttcggtctgcatcggagtttcgaagtcgcggacttatcagagtgggctttttaaggaatgtttttagaatatttaccagcccaatcccattttaagtatgtccagatcttaatttggcgagcctttttatatatggtgaacaactgattctaatgtgtatgtttcacttttattagagaaaaaatgtgaaaagatttaatgtgtatgtttcacttttattagagaaaaaatgtgaaaagattcttaaaagtatttatttatgctaattggcaaaactaaaacatcaatttatgtacatcattttagttcttcctctaagatttgattgatttgtattaatggctctgaatactgatactagtttcgttggcaagtaagataagtgataactttgataaagagtgtcaaattacaagtgccacaatttggagtacgtaaccaaattgacataaaacttgaataggtgaaaaaacgagccagaaaaaaaacgaatatcttctgcttatccgaataaaacgaaagtaatattcttacaagatccttccttatgaagtagtgccagtagatatttttatcattgtgattgcgacctgtttgttgcgattcatttatgccaattcacgttactatttatgttgtgataaaatcttttatttttcttcttctttccaaatacttaagtatgcatgattattgatccgtacaagcataaacgaagagctataaagtctccaacggtaaacgtacgtgaaccaaaataacaattcaatattatggttcgaattattctgtgtattttatgtaagaaaataaccaaaaccgactcgaaacaaaacaaaaaaatcttctgaaatgtgaatctttatttcggaaaattcttaacgatagatagtttttgctttaaaattaaatccaaacataaactagaactgaaattcaattcgttgtcaatattttctatacaaaaaaaaaaaagaaatccgaccaaataaacaaaaccataaatagacatctccatttttagttgaaagatgattaaatgcaataaatgtgccacaatcataaatttttccttttcacctaattgaaaattttaatcattaataagaagaatccatggagcacaattattttattttttattttttgctctcatatggtatgttaaattaattttcccttaatttaaattccccatatcaaataagtttttttttttttgagaaagacttgatttcataggagaaatatttgttaatattttcgacaaaacattttctctgtttgatgtatttccatcctcgtacaataaatactctagctattaaattcttagcccaaacgaaaataaagaaaaataaaagggtcctactaataaacaaaacaaaactagtggtcccaatttgaaatatataaaaatatataaaattcataaagctttgtggcttcagagcttccacttccatcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccaggtaacaaaatctcaccttttctctcctaatttcacgaaatcgaagaaaaattctcataattctcttaattacttatctctcaatttcttaaatcttacagggtttgtctttcgaaattcaggtaattttctcaaatccatttatggattgaagctttaggtaatgaatgagctgaatctgcatataaaaatcgatactttcattatccagaacaaaacaagatttagcataaacgttcaaaattgaaactttgattcctaacttcttggaatgattcagattgagctagatttagatctgtatgattgatattatgggtttggtttgtttatgagtagagagaaa

SEQ ID NO: 3383 - DNA, 3000 bp, Unknown
  misc_feature (1)..( 3000): cDNA_ID_1393996_gDNA_ID_1620644_Annot_ID_47547 3000 nt of promoter + ATG
agtttgcttatcttgacatttagcaaagcttcgactttgaccaaaaaaaaaaaagtagaaaaacaaaacaaattatttcttattataacgtaacaaattataagcttatagttgcggcggataaaataatcagatctaacaagaaagaaccgttacttggaagatggaatgatccatggtaattgaatgaaacactcacctagtccgacatgatcgcacttggctatgcaatgggaatgaaactgtgcgttttagctttgccgttttgttctcaaatatcttctccatgcactttttctgatcggccgaattaaccacaatcgccaaactctcacaattgttatctttagtttctttattcccactcttctcggcagaaccgtcgacacactgttcttcttccaccatgaagctagcaacttgcattgaaccgtggcttgacgagaaaatcatgacaataccgagacctagccagatgagaataggaagaatgatcagggacaaggcgtagtagatgatccattggaatccgctatggttcttgccgtttaatgtccattcaaaagcaaaagcaattccggagaaaaatgtggcaaaactgcctataaaaaagattctaacgattctcgggttaggaacgtcgaaaaatgtcttgatgtggttaagccaacgctttggtggttgcggtggtggactagtgttggtggtctttagcttttggtccatgcttttttttcttttctttaagtggaactttgagagtaagcttgagatgaagagactacataagtcgttgaagcttgactctaatataaggagattattaaatttttttcctttttatttgttgaagttgttcaaattcttgcgatttaatgggtgagatttcgaattttgaaattacaataatacaaagtagatgataatgtaactatttacataaaacaacaaaaccaagtcaaaacagtactactagatatttgccttttaacggaactatcgacagtaaaaacaataacgagcctaacttcatctttcattcgacttttgatcctaattgttaaatctaaagcgacaaaaaaaaaatcaaaagggatgacgagagagcaatacttgatatatagtggctactggctcataaatcttggttacttgatagtgatgtagcggttggtgccgtgcctagcccaatagttcttgagatcaaccggagaggaaagctcatgcccttcaccagctaaacgactaagtaacctggagaagacacttccactcattttcctgccgccaactcgggaatgccgcttgtttggcatctgcgggagcggatactcagacaaagtggttgtgcagcaagatgattgccagccgccattgccccacttataacactgacgagcagtcccggtgcaagtgcacatgggcactggcattgtcatctcatcgaacgtgactaggacatcgttactgtcccaatcctttctgcttttctttccgggagaagcaactggacggttcagatcctcgcccattttctttccctgcttgctctctttcttccttttggtcggtctcgtgttggctgcttcaggtggaatagttgatataggggaaggattaggtaagtggctttcttcagttataaacctttgggaaccaccgcgcttggcacacgacaaaatgtagttaagattgttttcacggtatcgaagagcatttaacgcactttctgtctccatgatagcattatctctttcagagagagctttgtcccgctgctcaagtgcttcatcacgagaggctaatgcttccttagttgctgcaaccgcttcgtttctttccttgacagctgcgtccctctcagcaaggatggagatgatcttcttattcatcaccaatgcattatgttgctcctttttcggcatcacattctactgcacacacacacagtttgtacttaggtttcattcaaagtaacgaaaacatgtttttttgttttagtgatctgcttcttcaagtgtttttgcttaccacagattgtgttcctttgtagtaatcgggcttgtagcgcccattttcatactgcccaccactctccatcctcttactttcaactgcaatggagaaattgatatcaaacattgtgaaactaggctgacgagtaactaaaaacagaaatactccaaatcataagcagttccataacatacatttaacccaaataaatcgagaaatcgtatcatatcccacaagtcagcgtaataccatccaaaccaaacgatgaagaaaacaatggagcaagtaagatacgcgggaacatatatagagttcgaatttcaagttaaagcaacgacgagagagctcccagaagaaccaaaattcgaagaaaatgaaaattgtagagagaaaaacttggcatgctgaaattaacagataggtcaagaacacgattaacgatcgaagacttacggatttcaacgagccttcaggagaaacaagcaacggaaatcgagaaagatctgaggatacttggaaatggtgtctgtgtaatgtggcaagaagtggaagacgagccaggtactctcggttcaatttactaatatacccttgtcttaaaactgctaaacgagagcaagcaagaaggttattattgtctatccatcttactcgtaaaaatgcaaagacgtttctgtttcaatctctccaaatataagccaaacaggatatgattttggttctggtggatcattctagtgggccgtatgatgggcctaagaataaggcaactaatctgggtcgaatacgggtagacccgggttgagatcccgacgtgtgcgcttcgctgttgtagtagtagtatatctcatcatcaatcaggcttttgagcctcggaaactcaatccttgtatattcaacggagagagatctgcgagagaaagagagatcagattccggtgttccaaggaagcacatattttaagatccagaatcgcctgagag

SEQ ID NO: 3384 - DNA, 3000 bp, Unknown
  misc_feature (1)..( 3000): cDNA_ID_1820655_gDNA_ID_1620644_Annot_ID_47550 3000 nt of promoter + ATG
aataataagtagaaacctctgattaattaaggaggaagtagattaagggttaggattacgcgttggtatcaaggaactagaagaagaagaagaaagggaagaaattatttaagattataaaaatcgctcctttaaaatctttttctacgatggaggagaagcttgagagaccagaagagacgacgaccaaatccacgcgccgagagtatcaaataagcatactttgctgtgacaaggcaaaatctgttaattactactttgagtaaatttctccaatcaattactttttttctttaattgtgtgttttgactaacgaaaattatgattaaagtagtacctaacaagaaatgtgtgtagtatgatttaggagaaaatattgggaagaccaaatcttttatagtggatatggttttgagttataagattgtttaaagtccattatatcagagaccattatcagacaaaaagaaaaatgatatcgactaaaaagtgaagacgaaagactcaatgccatctgggaggtcattgatgtgtctccctgaaacacattcgttgtcttgtttcctttgttttggtgaaaaagttttttttgtcacaatctttatatgatttcttggatcctatatctgattttttttcttcctttttttgacggcagctgaaatagttttaggcaacataatgtgctaagatttaggacgtgtgactatttttaaaagtaaaaatataaactaaaataaataaaaaagggggaaaaaataagagccacaaaaggaattaaaaaaaaagacaaagaggtgggtgggccaaatgtcaccagccatttaaaaaattggtggtcgagaagtagttgaaagcaactctcaaaactctactagtggccttggtttaatgttgtttttatttccttgcccatcttctcaatttcatttaactaacatcttcacaattatcttagtttttttttcttttcatcccaaagtttattctttctctcctccataaacattcttttgtagcttgttttatgacactttggcatttgtaaaatttgaaagaaaagttttgacgcaccctattcataaacacgagaatcaatatttgcataattacaatgttctcttctgttgaaaatatagattatggtttttataaaaaacagagcatccaaagaagagagtttgcctgccatgtgcatcattgctaaatgttgggctttacttgtaatgttgggctagatatccattatatttgttatcaaaatatcattatgaccttctgggccgggagaaaaggtctctcactaatgggctacgatgaagtggagtgtgaggtccacgtggcgggtttaaggttcctaattaagtttcaggggtaaaccggtcattaactacccaagccgagagagagagagtctgagaaaccggcgaatagaagaaaagagagaatctttgggaccaaatcaatggagtggtcccttcagacaaaagttaagaagaagaagacgacgacgactacgacgaagaacaaacaactaccaaacttgtaggcagtagcaggaggaagtgggtgggattaacattgtcatttctctctctttttcttttacaaatctttccgttttgttttcttttggttttccggtgagcactgttgtgtttccaattccggcactctttagggttccctttcagaagaaaacttcacattgttgtttctctcaaccgtgacatcttggattactacttctgactactttcctttttcatgtgccccaaaagataatagttactttttcaaaatctggttttgttgtttgggtttgtgtcattcattgataaagtcactaatggagaagtacaaaacaattgcaaaatttcgaatctgtgttgtcattgctgaattctgtagtggatgtttgcttgcagtttagagcttcggagtgcgaagagtgagacacaagaggattctttctggaaccgcattattccctttagaggaggaagaagaagacaactcactcacaaggtaaaaacagctcctttgcatgtttctttatcttgcttgttagagatgtagacaagacacgcactttatagacgcaaaatcttagtattctggttcaagattgagatgcattttgtgataatgattaaatgttctgttggtgcaattgataaggtttcattgagttttgactaagtaaactccaagttactttttttaacctttaaacacgcatttgtgactgaccttgtctccctctccattgatgaattcaaaaactacaaagctattatttttatgtttgattttgcgtgtacatatattataatccaagttacttttcaaagtttagagtatgataacttatttttttgttctctacactagatgtatatgcattttataaggagaagcatggtctgtgggaccatgcattacctctcttattcgattaaacaatgtttagatttggtaaaacgtgacttagtcctcaagcatagtgggtgaccattacagataaagtcggtaatctttgttttgtttttcttcttcttcttcttcttcagttgtggttgatcaccttctaagtaaactgtcttgtataatcctaatattataatgacaagaagtcttctcttatttgtgtctttgtggttcatataaaatgttcaagtgttctctttcatcacaacacagaagcttttccttctccaggcatgtttcatgttttagtctcttagttttagtttggtgagatcagatttctgagtttttccatttatttatggttgtgattagttggaaaataagggtccttcctgcttttgaagttctttcacaagtcctgaatatattttctgcagtaaatatgctaagactccaatcttagaggtcttaagtttgaactgtttcaggaaaacaaaggttcctctggttactctgaaatattcaaaccaatggtgagcaattggtagcacttgctaaagaagatg

SEQ ID NO: 3385 - DNA, 3000 bp, Unknown
  misc_feature (1)..( 3000): cDNA_ID_1820651_gDNA_ID_1620644_Annot_ID_47551 3000 nt of promoter + ATG
ttagcatatttactgcagaaaatatattcaggacttgtgaaagaacttcaaaagcaggaaggacccttattttccaactaatcacaaccataaataaatggaaaaactcagaaatctgatctcaccaaactaaaactaagagactaaaacatgaaacatgcctggagaaggaaaagcttctgtgttgtgatgaaagagaacacttgaacattttatatgaaccacaaagacacaaataagagaagacttcttgtcattataatattaggattatacaagacagtttacttagaaggtgatcaaccacaactgaagaagaagaagaagaagaaaaacaaaacaaagattaccgactttatctgtaatggtcacccactatgcttgaggactaagtcacgttttaccaaatctaaacattgtttaatcgaataagagaggtaatgcatggtcccacagaccatgcttctccttataaaatgcatatacatctagtgtagagaacaaaaaaataagttatcatactctaaactttgaaaagtaacttggattataatatatgtacacgcaaaatcaaacataaaaataatagctttgtagtttttgaattcatcaatggagagggagacaaggtcagtcacaaatgcgtgtttaaaggttaaaaaaagtaacttggagtttacttagtcaaaactcaatgaaaccttatcaattgcaccaacagaacatttaatcattatcacaaaatgcatctcaatcttgaaccagaatactaagattttgcgtctataaagtgcgtgtcttgtctacatctctaacaagcaagataaagaaacatgcaaaggagctgtttttaccttgtgagtgagttgtcttcttcttcctcctctaaagggaataatgcggttccagaaagaatcctcttgtgtctcactcttcgcactccgaagctctaaactgcaagcaaacatccactacagaattcagcaatgacaacacagattcgaaattttgcaattgttttgtacttctccattagtgactttatcaatgaatgacacaaacccaaacaacaaaaccagattttgaaaaagtaactattatcttttggggcacatgaaaaaggaaagtagtcagaagtagtaatccaagatgtcacggttgagagaaacaacaatgtgaagttttcttctgaaagggaaccctaaagagtgccggaattggaaacacaacagtgctcaccggaaaaccaaaagaaaacaaaacggaaagatttgtaaaagaaaaagagagagaaatgacaatgttaatcccacccacttcctcctgctactgcctacaagtttggtagttgtttgttcttcgtcgtagtcgtcgtcgtcttcttcttcttaacttttgtctgaagggaccactccattgatttggtcccaaagattctctcttttcttctattcgccggtttctcagactctctctctctcggcttgggtagttaatgaccggtttacccctgaaacttaattaggaaccttaaacccgccacgtggacctcacactccacttcatcgtagcccattagtgagagaccttttctcccggcccagaaggtcataatgatattttgataacaaatataatggatatctagcccaacattacaagtaaagcccaacatttagcaatgatgcacatggcaggcaaactctcttctttggatgctctgttttttataaaaaccataatctatattttcaacagaagagaacattgtaattatgcaaatattgattctcgtgtttatgaatagggtgcgtcaaaacttttctttcaaattttacaaatgccaaagtgtcataaaacaagctacaaaagaatgtttatggaggagagaaagaataaactttgggatgaaaagaaaaaaaaactaagataattgtgaagatgttagttaaatgaaattgagaagatgggcaaggaaataaaaacaacattaaaccaaggccactagtagagttttgagagttgctttcaactacttctcgaccaccaattttttaaatggctggtgacatttggcccacccacctctttgtctttttttttaattccttttgtggctcttattttttcccccttttttatttattttagtttatatttttacttttaaaaatagtcacacgtcctaaatcttagcacattatgttgcctaaaactatttcagctgccgtcaaaaaaaggaagaaaaaaaatcagatataggatccaagaaatcatataaagattgtgacaaaaaaaactttttcaccaaaacaaaggaaacaagacaacgaatgtgtttcagggagacacatcaatgacctcccagatggcattgagtctttcgtcttcactttttagtcgatatcatttttctttttgtctgataatggtctctgatataatggactttaaacaatcttataactcaaaaccatatccactataaaagatttggtcttcccaatattttctcctaaatcatactacacacatttcttgttaggtactactttaatcataattttcgttagtcaaaacacacaattaaagaaaaaaagtaattgattggagaaatttactcaaagtagtaattaacagattttgccttgtcacagcaaagtatgcttatttgatactctcggcgcgtggatttggtcgtcgtctcttctggtctctcaagcttctcctccatcgtagaaaaagattttaaaggagcgatttttataatcttaaataatttcttccctttcttcttcttcttctagttccttgataccaacgcgtaatcctaacccttaatctacttcctccttaattaatcagaggtttctacttattatttccacttctcatctctttcaatcgcaatctgagttctggctaaagattttgtcttgaaggtgagattcattgttccgaatagagtgagaaaaagacttataagattgaaaaagcaag

SEQ ID NO: 3386 - DNA, 3000 bp, Unknown
  misc_feature (1)..( 3000): cDNA_ID_3409035_gDNA_ID_1620644_Annot_ID_163163 3000 nt of promoter + ATG
ctttctttcctctatattcacgatcctgccattgtacacccaatcatacgctcctgagatcctcatgacttgttcttaccgtactccgcgagacatgcgattgatgattcttgactgtattcattgagaaaaactgttcgcaaaaaccttgagcttcatcatcgtccattactcacctttcagtttcagatgcccaagcaaaaagctccaaggaagcagctcaagtcctataaactcaaacacatcaacaagagtattcaaggtacgtctgacttgttcatcctcaatttgaaattcgtggatattgaaagtgaatcgttcgatgttgttttgtggttaaaaagagggagatgctgtgttgatgcggtcgtcggagcctggaaaaccgtcgtacgtagcgagggtagaggcgatcgagacggacgcgcgtggatcgcacgcgaaagttcgtgtgaggtggtattatcgccctgaggaatctatcggagggaggagacaattccatggagccaaggaggtttttctctctgaccacttcgattttcaaagcgccgatacgattgaaggaaagtgtaaggttcacagtttcagtagctacaccaaacttgactctgttggaaacgacgacttcttctgtcgtttcgagtacaattccactaccggcgcgtttgatcctgacagagtcaccgtgtatgtgttcctacgactctctgttactttattcgagaagaaaatactgattgaatgatggaactattatcggttgaattgaggcttttttggaaattagattgtgttgctttagtgtaggcattgattgttaataattcattgatttgtcatctaaattggtttcatgaagttgtttttgcaaagagaagtaatcaattgagtttaaattgattttttctgtttgcaggttctgcaagtgtgagatgccgtataacccagatgacttgatggtgcaatgcgaggagtgttctgagtggtaagtgttcacttatttgaaactctgttttaatcttcttgagtcacaatctggaattgctcgtatgtttttcgtgtatccatgaggtcctagttgatatgctattgaggttgcttgagatgaatgcttttgtcatgctttacttcggtgatgctcttccttactcatgttcatgttttgtcttatctgatattgtggaaactgcagatgaataggaacataagctgatactctagtctgaacgtttgtaatatctgtgattaacattctaatgtatatgttgcggattttcaaattttcttacacgttactgattgagtcgctgttaaggtttgggtttttctgcagcttcttagtttgtgccttgggtctttcacccatgttagcttgctatatgacacaagtaacgtaaatgaagtcatactgaaacaaatagtgatcgtttgatcttggaagttggaactgttaagtgttaagcttaatctttttacttttttttttgtaaagagaggattaaggttttttgtttcgaatgtctttgtcagttgcctttgatgttacagcaaactaacattggctcaggtttcatccttcttgtataggaacaacaatagaggaagctaaaaagccagataacttctactgcgaagagtgttccccacaacagcagaatttgcacaactctaattcaacttccaataacagagatgctaaggtatttctctatttctcatttcagaaaatatctttagtttttgagggatggtcaaacccgttgcaaataggcttgaataaatttaaggtatttaagttgaccgttcgttccacatataaagctagccttgccaacaattgtaagctcttggactgataaaatataccaacttaaggcagaataaacacataaacccaaagtatatgtgtcattaaggtcaaagacaaccttgtgaaatgttttgtcctaactaacaggtgaatggaaagcgcagcctggaggtaactaaatcgaagaacaaacacactaagcgaccaggttaacataaacttgtaaaggctatagatatctggttggtgagtctgagtatcaatcgtgtaatctacaaaggtggttttgttttctttccctctctagttttttctttcttaaaaaatgagggtttaggtttgttggcttgattgttgtataatttatatgtatagcgtatggtggtttctcatctcctttagttgtcacatataaaatttgggtaaaatggtttgtttataataagaaaacaaaacaaacaaacaaacaaagagagtgttggttccttatttgtttgttttcattgtgaactctagaaacccttcattctttattagtttttcattctttattaattctaaaacgcatattcaaagagacatatttgatcatcgtgtcttcataatttggttcaaagtacagccaaaaaccaggaggtacactaaaaatcaataaaattacattacaaattatttttagtacactgggaacataaataaatgaatcagagaagagaaacatggcaactaccgatcatgagcttctacatttgtctcagaaaaagaggaagatagaactattttttaaagtttttagaaaagagagaattaatattatccaagacaacacggcactgctaacaacaagttgaacctatcccattccattactccatacccattcaatgattaacacgtggttctacatcattggttaactctctcctttccccttggataaggcatcttaaaataataataaataccataaatatcttccgattttttctccgactataataatgatgacaacaatatcttttaaaattatcttaaaagaaaccgaaagctaatctccaaagggaaaaagacgtgtagcagagacctatacatacacctatacattcacgttgcgtgtgataatctactgagggttctatctatattaatccttctctgcttccttcaatctaattgcaaatcaaatg

SEQ ID NO: 3387 - DNA, 3000 bp, Unknown
  misc_feature (1)..( 3000): cDNA_ID_3093898_gDNA_ID_1620644_Annot_ID_163162 3000 nt of promoter + ATG
cctcaacttgtacctttggaccagtactatatagtagtgtttatgtagagacactcatgtgggtgagtgtatgtagaggttgatggggtataagtgtgggcaaaagggtaagaataatgtgttggctttatagataagcagcttaggtttcctttgtcttttttaactccttcctctcattttcttgatttgatagctactctctcctttgctttcaatgcccccaaattgacttgttttggttttggtttcacacccggtttgatctggtttagaattcagggaacttaaacaaaagcataccgggtatgtaagtcaattagtatacgttttaatcacaaattacattaaatttcggtttcatagaaggaggcagatattataattgataggaacttgacggtagtactagtatgattaagttagttaatttttgtttcatttaataacactgagaactattaattggtagttaagctcatttgtttctttagtttaaatgagtcttaaactcttaatgctttagaaaaatattatgtaatttatacgaatgtaaggaaaaacaaaaatgatgaatcagtttaattgtttcttttatattaccgaaataggtaaagaggcctagaagtgggaacttttaaggctcttatggaagaaaaagtgcaaaagtggaatttaatagtacaatctttttggtctaaaattcatctttttagtcagatgctagttaatctaattaatagaaacgacaaaaaaatcgaaataaaaactaattaaagaaatggaaaaggtgggggaactttgagaaatggccagctcttcatgccagcttttgtcttccatcatccatgtgtatatctacttccttttttttttttttttacctcaataaataaatatcgccgctctttttttttatatagattttatgtgtattagttgaacaaatagtataaattattgaatggcaaatccattttccaatcttcttcatacactcaacaaacactgccatgtatttgatattggtttcggtataaacctaaccaaccatagcttatttaaaaaccatagctttatgaacttcaatttattcttacagattttggttcagtttctattccggtggtttgtatcggttctgtctaacttgattgaaaatggtacaatatgctgtaatcgttataaagtggccttaatgaccgttgagaattgagatttagacatgatctaattgtattaacaggctagacatgatcatcgcttgttcatgtatctttttaatgaatgaaatttcttaaatgttctcgtagtaatcccaataaccaaacatactcgtattaatataagctttgcggtcatgtcggccatattgttcgaatttaaatgagtttttttttggtataataaacgctgaatacttttgatataaaataagtagagtggatctgatcttttgaagaataataattttagataatatataatttatgaggaagaagacgacaaaaaacacttttagaggaagaagatatggatgatctctctcgattctcgaatctttcccctcgttacttattttttttttgtcaacttcccttcttgcattaaaaatctatacattcattttgactgactctttgaagaaaatttttaagaatttttgagtttgggtttcaacgaagtaacttcgtcaggacttggtactaaaaaacgatattgttgatctcatttttttttttttttatccaagctgctgcgtggaatcatatcgtcttttggtttgcatttgatgtacataaagaaaaacaaacaaaccaggtaacaaatcgttttcaaagaaaaaaaagaaaaggttctttgcgtgattttaaaagagatcaaattttttatataatatttgtagatcttgagtcacatggatgtactactggactttttgaaaaggttcttcgtgcactttttagacattccttcttataaaatagtatgcatgggacctttaccaattaactactaccatcaattattcatcgatggactccaattaatttcaaatttgtttccatatttttgtgtaacctaacaaaatccaatcattcatcgatatatcactgtccttgttttgtgttaaataatgctaatttgctctgctaattgactattcttcgatttcgatatctattttcttgttaccaagtttaatctcgaattgtcacattaattttcatatttttgatcagtcggtgcgtcaatttttgtgagcggagtattaattatatcgtttgtctttgtctttgtcttaaatccaacaatgggttcgtggaccatttcctgacatgtttattgcttctttcaatcatgtccgtccaaatcccgtagatctcagtgtatattaatacgtacaatcccactttagcttttatttctgtcttcaaaggaaaataagaaaaagaaaaaatcgtatgagagcttttgtggtccaaattgtgactaatttttttgaaaatacgtttgtgtttacgttatatacacatttacgatttacatctccaattgttatatgctttcttgaaatttcgaccgggatattatatgccttgtccaagaaaaaagaaagagagacctgaatcttggaactaagttatttgggggtgtcactcatgggccaatattgggtccattttgaaaagcacatcactatttcaacccaattaatgagagtcccatactaacgctgatgttactattgtaccgaaccagttttgaagcccattaaaagcccaatacgaaagtacgtttgtaaatttgggagcccaagaggggtaaatatggaataaaaaatacgcgatgtggacaaaataatttacagctactatctctcctccgtcttggcttcgtggtggtctctctgacattatcgtcagacaaataatttctaaatatctctcctctcctctcgtttgattccaaaaaaaaaagctcatcgacgaacgaacg

SEQ ID NO: 3388 - DNA, 3000 bp, Unknown
  misc_feature (1)..( 3000): cDNA_ID_3093904_gDNA_ID_1620644_Annot_ID_163161 3000 nt of promoter + ATG
ccaccacgaagccaagacggaggagagatagtagctgtaaattattttgtccacatcgcgtattttttattccatatttacccctcttgggctcccaaatttacaaacgtactttcgtattgggcttttaatgggcttcaaaactggttcggtacaatagtaacatcagcgttagtatgggactctcattaattgggttgaaatagtgatgtgcttttcaaaatggacccaatattggcccatgagtgacacccccaaataacttagttccaagattcaggtctctctttcttttttcttggacaaggcatataatatcccggtcgaaatttcaagaaagcatataacaattggagatgtaaatcgtaaatgtgtatataacgtaaacacaaacgtattttcaaaaaaattagtcacaatttggaccacaaaagctctcatacgattttttctttttcttattttcctttgaagacagaaataaaagctaaagtgggattgtacgtattaatatacactgagatctacgggatttggacggacatgattgaaagaagcaataaacatgtcaggaaatggtccacgaacccattgttggatttaagacaaagacaaagacaaacgatataattaatactccgctcacaaaaattgacgcaccgactgatcaaaaatatgaaaattaatgtgacaattcgagattaaacttggtaacaagaaaatagatatcgaaatcgaagaatagtcaattagcagagcaaattagcattatttaacacaaaacaaggacagtgatatatcgatgaatgattggattttgttaggttacacaaaaatatggaaacaaatttgaaattaattggagtccatcgatgaataattgatggtagtagttaattggtaaaggtcccatgcatactattttataagaaggaatgtctaaaaagtgcacgaagaaccttttcaaaaagtccagtagtacatccatgtgactcaagatctacaaatattatataaaaaatttgatctcttttaaaatcacgcaaagaaccttttcttttttttctttgaaaacgatttgttacctggtttgtttgtttttctttatgtacatcaaatgcaaaccaaaagacgatatgattccacgcagcagcttggataaaaaaaaaaaaaaatgagatcaacaatatcgttttttagtaccaagtcctgacgaagttacttcgttgaaacccaaactcaaaaattcttaaaaattttcttcaaagagtcagtcaaaatgaatgtatagatttttaatgcaagaagggaagttgacaaaaaaaaaataagtaacgaggggaaagattcgagaatcgagagagatcatccatatcttcttcctctaaaagtgttttttgtcgtcttcttcctcataaattatatattatctaaaattattattcttcaaaagatcagatccactctacttattttatatcaaaagtattcagcgtttattataccaaaaaaaaactcatttaaattcgaacaatatggccgacatgaccgcaaagcttatattaatacgagtatgtttggttattgggattactacgagaacatttaagaaatttcattcattaaaaagatacatgaacaagcgatgatcatgtctagcctgttaatacaattagatcatgtctaaatctcaattctcaacggtcattaaggccactttataacgattacagcatattgtaccattttcaatcaagttagacagaaccgatacaaaccaccggaatagaaactgaaccaaaatctgtaagaataaattgaagttcataaagctatggtttttaaataagctatggttggttaggtttataccgaaaccaatatcaaatacatggcagtgtttgttgagtgtatgaagaagattggaaaatggatttgccattcaataatttatactatttgttcaactaatacacataaaatctatataaaaaaaaagagcggcgatatttatttattgaggtaaaaaaaaaaaaaaaaggaagtagatatacacatggatgatggaagacaaaagctggcatgaagagctggccatttctcaaagttcccccaccttttccatttctttaattagtttttatttcgatttttttgtcgtttctattaattagattaactagcatctgactaaaaagatgaattttagaccaaaaagattgtactattaaattccacttttgcactttttcttccataagagccttaaaagttcccacttctaggcctctttacctatttcggtaatataaaagaaacaattaaactgattcatcatttttgtttttccttacattcgtataaattacataatatttttctaaagcattaagagtttaagactcatttaaactaaagaaacaaatgagcttaactaccaattaatagttctcagtgttattaaatgaaacaaaaattaactaacttaatcatactagtactaccgtcaagttcctatcaattataatatctgcctccttctatgaaaccgaaatttaatgtaatttgtgattaaaacgtatactaattgacttacatacccggtatgcttttgtttaagttccctgaattctaaaccagatcaaaccgggtgtgaaaccaaaaccaaaacaagtcaatttgggggcattgaaagcaaaggagagagtagctatcaaatcaagaaaatgagaggaaggagttaaaaaagacaaaggaaacctaagctgcttatctataaagccaacacattattcttacccttttgcccacacttataccccatcaacctctacatacactcacccacatgagtgtctctacataaacactactatatagtactggtccaaaggtacaagttgagggagagagtgagaagaagcaattttgttatattcaagaaacaataaaaaataaagttatttttgtaatacagagaggaaagaaaatagaaagatg

SEQ ID NO: 3389 - DNA, 3000 bp, Unknown
  misc_feature (1)..( 3000): cDNA_ID_3071102_gDNA_ID_1620644_Annot_ID_163158 3000 nt of promoter + ATG
ggtttgggatgtcggagaagattgtggataaggtgagtcgatgaacaagacgctgacgctgtcactctctccattgcaccaaacactctctaactttggtttctggtttctttttattataataaaccctttcaaatatgattatttcacaattaagaccctaaatgtttgattatttagaaagtaatctcacctaagtatctcacggttcagattgcgccgtggttgttttgggtcgttgtataatgggccaaattaggcccaattcgacccatttaaaaaatgatattctctccttcttttttgttggtgggtcactcaacaatgacattctctactgttttgcacacgctttcctgctaaaacaaattaaaattggtacggaccgacacaaatcggagattgatgacgaatttttataaaacataatttaatatttgatagattgtctttttctagccttattaatttccatttcaggtatgtttaagctagtaatttactaacaccaccttttttttttgcttttactaataccacgtattgttttattttctcttttatttcgacattagcaagcaagggaatttaaagatcacaccacatggcacgtgagaaaagaaaagcatacacgtgagccagctgtgcaacgatgctcaaaaaggtcctatgacaactacttagcttcgagaagcaggcactatatatttatcgcataacggtatttatttcattcaataatctttttgttgcataaatttacaaaaatttgagtgtgtgatgtgtacatatttctgacgaatactttttgttgcattatccaaatttttacatgttcccgagccgagagtctaagacgacgatttccaaattattgtcgttgctgttattataattgttaataatagtaagaattattattattatttaggacacgcaagattccacatgatactgcttaagcactacgtcgagctaaaatgaaatactcgatttaaatgaactaccccattagttacttgaagatgaaacgaaacaatttggttttggtcttttggatcatatagttaaacgttatgtatcttactcagtttattttaatgaagtttgttgtttggtatatcaattagccttagatgtcaaatcaaaacgaaacaaaaacatgaaaattcaatttggcgttaaatcaaaataataattaatattccatggataattaatatacacttagcaaattaccgaagtacccttgctatctcgttgtcgtcaataatcaaaattacagtattaacccaattaagagcgtttagcgtctacgtgtaaagcggtatcaggagaaaggagcagcgatcacatgggtggcttaaatctatatcctccggttcctcaccggccaattattctcgcgcgtgtctccgctcctctctgatgcgcgtcactcaaaaagtttgagtcaaactccagtaatatttttgatttattttgtattttcaagaatttcttaaaaattgctgttacgtaatttacaatgcaatgtctcgcggtaaaggtagagccggaactcaagtcagatcaatctccgtgtatgattgtgttcgcatccaatgttaataatttcaggatttgtattttccaagttaaaggatactattgttaactaacgtatatgctgacaaaaaaaataaaaaaataacgaatattataaatttatatcagtcgcataatgaaatgtgtaatttcacccagacaaaaatatctctacagaacaaaaaaaaaacgtttgttatatatgtttattctgtatatttaaaatgtagtctaacgtttgttctatatgtctacaatgtgtatttatatttaaaacatattccatccttaatttgctttatattattgttacaccattcatagtaatggaagaaatatctattggcattctatactttatgatatatatatatatatgaaccaaagtattgtatgtccaactgggacattttatatgacggcggacgaataaagcttagcagatatatatgtacgtgctggtaactccatattcattattttggatttaagttgtaactccatacacaatacacattgatggattagcattgcattttttttatggcattttatatcaaaagattctcaatcaaaacttagatagattcctaaagcttgtaattaaagcatcaaacatatttgttaaccagttattatttttgaaatcgagtagtgttttgttgatgctacatattattccatcataaaaagaaaattaatgtgtgtgtaagtgtgtttgaaataagtcaatatcttagtacagtaattaactaattatacgaagaagaactataagggtaaaaacggtaattacagtatttggtcagccatagttattcccgctcgtctcttgaaaaaaattcaaaccggtaaaccattttggtcatacacgttacagtaacacggtggtctggtcttcaataataaccacgtcagcagcatacagtaaaaactactttaaatgtttttttttattctcacccaagaaaataatttatttttgttttgtcgttctccttcctaaataatttttcaactaccacaattaatttaaaaattaaaaatagagtatatttggaaaggcacaaaaaaaagaaacaaaattcaaaatctgaaatttctcagcctcctcgtttcttcacccagaggagagagaaatctgaggaattcgatcttcgcttaaagaagacgaaacaatctctctctctttctctcttcaatggtctcaccatctctgtctaccatctcctagccaaagaagaagacgagaagaagaagagagggtcacaacaatgctttattcttcttatgtctccagccatgtgagctcccactgacacattctctgcatcttcggaagttttgttttggtttgattcttctcaccgattcctgcgaccgagtttgaccctcgagtttcgaggttagtgg

SEQ ID NO: 3390 - DNA, 3000 bp, Unknown
  misc_feature (1)..( 3000): cDNA_ID_1820631_gDNA_ID_1620644_Annot_ID_163154 3000 nt of promoter + ATG
accacaaatttcaactatccctttacttctatttccattttaatattataatgtattaaaattcagcagaagaaatcatatgaacctaacacgctaggatggagtatatttttcaaagttgaagaaatacagatatttggtgcatgattcgtacatatatgtggagatagtttaaatgtttacgaaagcctcgtgcctatggttaagaaaactctcacctataatgtaaatatgtaatggaaagttacgtttgctgactcaatataattattattgactcacaaacaattactcatctcttaatacatacggttgctatttgacactttattatacaccaaaacatagtcttaatccaaaagtcgtagcagaatgtaggaagattagtagtacaaagttgtgatgaaaattaagggggattaattagagttttaatgaaaaatctttaattttttaatctacaaagcactaggtggaatgttttaattatcttggagttttatcatatatgttaaatcaaacacgtctacacatgtctatttataaatacagataaatatggcttattattaaatttggacttattgatgtaaaatgatatgtaaataagataagttattaatggacttttacgaattcattgaaagtaaacatttggtattactttgaaaatcttaaattattttctgtcatttgtcataatttaagaaatatattagttttcttgaaatgaattagtttgccaattaattcttaaagatcccaaaatatgcagttaattaccgagtcatgggcctcagtacgagaagaaactgatacgatggttcacgaaacataacgtacggatctgaaaacccaataacaaactaaacctaaatgaagcccattatttcagtagtctaattctacctttgcttttaggtccatgtctgtagaaatgaatatccacaatttgatacacataaaaaaaaagataacacacgcatgtgctgtgaggtcacttgtcgtgttccacaaggtacgttatggtaccaatgcaatgagacatagatttgtcagaattctaatattatcttataatgcctatacttattttcactaatcacttgtaatacatttctatatgagtatgacaccaattgtctattgtttatttaactaaaaaaaaaagttgacttttgttagtggaatcttaattaatttgtatcatatatatgattttcaaccaagttaatgttttggacattgtaagatcatattggtttatgataatttcctagggcagaaaatcatgtaagcgtaaagctaagatttttagaggaaaatagaaaaatggtcgataaaggataaggcaaaaaaataacggattattttgcttgtgaaaatggcaaagtcccccacaaatatacgttatattttatttttattttagtttacgtgagctttgtttcgtataaaaagtatgatgaattcatattttttgttttggtaaaatcatatatttgatatttctactcgcctaacatttaactaactacagttatatatatatatatatatgtttggtatgtaatattgacacttaatttttttgtgaaacgctccattagtcaatactttgatacgtacagatatagattagtaatatcatttactgaattattaatgtataaataacacaaatattgatctctcaaataaaatcgtattgtcatttatcaaagattggtttcgaatcgatccacaatgtcgcgacaccttctaagatcgatattcattagtggattcaagattataatgaattgaacactaaatacaaaggtctgatccctttattgtaattcaactggaaaagtgttttgtttttaaatatctcgttattctgagttttattttttgtaggtttcttatgtcgttttgtgttatcagtggaatcaaaaagttaattggttggctttacaagaaggctaaattatatggatgttgctcatatgaagataaagatggcaaagttaatttgtaaagatgagaatacgagagacagagtctttcgtggacgctaaagactaaatcattagaagcgaggcgctacgaacaaaaaaacataaaattgggtaatgttttcttagtaggtaactcatagaaaaaatatttatgtacacacaaacatagaaagattgtgaattttgtgtatactttcctttgcatcttaacgcttaaacgcaaagcccgaatcatgttacagtagcatgcaggtcccacatggtcacgagattctgattttttttttttttgcattatagaaagcagtctttttattatgctaatctcgtcgcttatactatcctttttctattatttttgtcgtcatactatcttttattcattattaaacctaatttacatttataattcccattatattcctaaagagacatgctcattgcattgctaaagagatatttaaaacagaaaatgaaaaaatttcgagcaaaaaccaaaagagtgacacccatgggcttgcttgcccgcgcgctcgcttcagtttcgtttgtcagtactcagtagtgctgccacacgcacaaatgacattattcagttcttattaaattagttgtaaataatatataaattaatccacgattgcaaagtactaattcctaatgcaacacttaaatatattttagttgcaatttttaattccattttctacgtattatccaagcataaatcgcataacaaaaagtactaaatcacataatgactcctttattatgttatactatactatattagtaaaaaaaatatgatctcccacttatatatataaacacatctcgtgacacactcgtagttgcaaacaccgatcagtcacagacagtagcctctcaccatcaccaccacggcggccgtcaccgacgccgatacaccatgaaattacatttacaccctctctcacttgtcttcttctttttcttcttcttcttccgaccgacaatg

SEQ ID NO: 3391 - DNA, 3000 bp, Unknown
  misc_feature (1)..( 3000): cDNA_ID_3071108_gDNA_ID_1620644_Annot_ID_163150 3000 nt of promoter + ATG
atttgacagaagaaagtaagttgtattaaacaacgaacagaatctttttttttttgtgcaaaacgaacagaatctaaaagtgagtatttttgtatcacttgattcatataatgaaagaaaaactaaaaaaagtattaacggatatataataagactctttttattttaaacaaattggggtataatgcaacttttgtcgatgtttaagctttctttaagaccaaccatatgttgaattttgactgtgtgttgatgaaataaaatgcagaaggacaaatacattaatgtctactgtcacacaatttgggatcacattgggccaataaaaagtatgaggcttttctgtaaatctaaaaatatttgggctattaataacaaaacaaaacaaaaaacaagtcaccacaaaaacggcatcgtacaagtttatccaaaattccaaacaatttaacgtcgtttactcttcagtttctcagagatttcaaaattagtttttcttcttcttctgaaaattagggttttttgggggattctcgtgtggataaaggttagtcatttccttaattggttaattgaattgaagtacccagtaatccattggacttagtcatggatttaggtgtgctcagaagaattttcgttttcctgcttacgtatttgacgtttatactctttgattcgattcgttatatatgtttattctgtgattcttgtgcattcgaaggtatttcacttttgttgttgatgcttctaaatccaattcacatccatgtaaccctagttttgttataattagtgattgaaattagtgtatttagtatcaatctggtatttttatccatcccgggatgtcttgtatatgttatccctgagttctctaacatctatcataacttcaaatctctgctttgttgtagccatggctgaacgagaagacgcagcagaggtttctctttcagtgagaaacgaggaagatctttctcctgaatgtgtagcttgggctgattcttgcatcatcagttttctagatgattcagacaacaataattggggaacttttagagatgctttaacagaaatcatcgatatccatcccgagatgtttgttttttcatcaacaacgggaacaagaggtgtcctgtctccagacgaggttatgactgaatccgagactattgatctacggagatctgaaccagcagctggttcagcgaacagtagaactaattcatcgaatgaagaagttagcgagattatctctatgctaacttttgaatcagacccgtcaaagaattgcttagaagattattattttccagagtctatagcagagaatggaaaccgtgaaccagcggacggttctaagacagatcttggaggtgttgaaagtatagaagaagatgggtcagtgagcaatggagaggctaaagaagaaaaaccagcgtcagtatcgtctcaagtattcaaggatgatttcatgagcacatacgttgaagacaatgctgaggattgtaatgttacagaggatcctgtcaaagtaacttcacaagagattttcaaagtgtgggatctagaggttgtgggggacaatgatgaggaagatgggttggtgctgcagctgaagaaggccctcgatgagtcttccactgtccagccccttccacagccactgaatgatgatcaagttgtatcagagaagagcaatatcgatgatctgatatctggaatatcggatctgtctcttgcagaaacttttaagtgaactatgtgtatgtgttttattttgacatcacaaactctcttttgctttactactccttaaccgacacaaaccgggtttgagatttcaaaatctgctactagaccagaccgaaaggtttactgggtcaatttggtgcctacacatccacttggccacctgttgtgcaatgatgacgatgagattgcagtgtctctcgactgatgatgtagacttcacaatctcttaaaaatcccagtacttaacctcagccttaagaaaacgcagggaactacgtcctcacaaaatctttctctttgagtgtaactttcagacgcatctttggctctaaattctaaaaaggaaaattttaataggttttcataatcatgggttcactggattagcatataagtctatggttgagaaacttgagacccagactaacgaaacctctttccggatccaaaggtcctcttgtgtagttgacgtggtaaactctctaccgtcaaatttagacattagctaatctgatcaataatctcggcagctcttaaaaattaaaaattagaaatgatacgaacctcataatttttctttctcttatcaaaacaccatctttgtatctttataagcctgttgccactatttttaattgaaaatgatgcgtttgtcttatgttttctgtcctggagttcaacattatgacaatatgtatagtaaattagtgatatacaagacgtttgcaattcaagaaaaaaacttataaactaattaatattatggtccacggtgctacatattaactcttgatggttttatacatcttttctacatgctaatatgcttttaatattgtagcctaacgttataatttgttttttcttaaagaaacagtatcttgaacgaatcttaactatttctgtacttattcgattttattcgatttttatccgtgtaaaggcaaacgattattatgtaacgacgggcataaaaagagtatcgatttcctattcggagaaaaaaaaaaagataaaaattggagtgtatgtatatttcttgaattgagagtaatacaagattacggtccaggtggcggaatattattggcaaggtcacaagaacctcaaataactgatctgaagagaaatataaatccaaaagagggaggagtgagagataagggtggtgtcataagcgtttactgtgagtctctcaaagaaaccaaaggcagagaaaagagataacacacacaaaaaaaaatg

SEQ ID NO: 3392 - DNA, 3000 bp, Unknown; identical to SEQ ID NO: 3385
  misc_feature (1)..( 3000): cDNA_ID_4262322_gDNA_ID_1620644_Annot_ID_163149 3000 nt of promoter + ATG

SEQ ID NO: 3393 - DNA, 3000 bp, Unknown; identical to SEQ ID NO: 3383
  misc_feature (1)..( 3000): cDNA_ID_3071112_gDNA_ID_1620644_Annot_ID_163145 3000 nt of promoter + ATG

SEQ ID NO: 3394 - DNA, 3000 bp, Unknown
  misc_feature (1)..( 3000): cDNA_ID_1825731_gDNA_ID_1620644_Annot_ID_163142 3000 nt of promoter + ATG
attcaattaccatggatcattccatcttccaagtaacggttctttcttgttagatctgattattttatccgccgcaactataagcttataatttgttacgttataataagaaataatttgttttgtttttctacttttttttttttggtcaaagtcgaagctttgctaaatgtcaagataagcaaacttcgattctctctaattcctggaaattgccacgtcatggtgagtccaataatgaaaattatataacatgtcccacaagcaagaaaatttgtcatctaacggatgtacaagaaaccacgtggtatgatcggcggaattgtcgccaagtttagtttggttttaagattgaagataagctaagtatgtggggtccacttagacttattcttatttaaggagacgaatactgttttttttaagaaaaaataacctacaattttaattattaatgttttttactaattcagaggagattttggttacatttacttttgttatggcatatgggtatattttgtgtgtttatatagtcatatatagttccgaacttcaagtaaataaagaaattcgtttggccaaatttgttgttaaaaaacttttttttctttatattagggttgaacttatttacagaaaagtatattaggtggattatatttgattattcaagttttttttcgtaagccaaatctgaagaaaacaaaagttgcttatcaaagaggcaaagagtatattcgttttataggagaatgtaatattccaaactttggatgtgcatggttatggatgttgtagcatttgcatttgccgagaattataaagatacgtataccaaataaaatacatgaatttctcgaaagccaaaataaaaatttgctctaaactcttaatttgtgatgcaggcataatattgtttgtgaaattaattcaaacgtgatcaagacgaacactgcccccacttatattaatctgattaatatgtttggcccacgtttagatcggtagatcatatccgttgcacatacaaactttacataattactcaatcaaacaattttatttcttaaaccaccgtggtttgatttttaaaacgtgcattatagtttcgttaatactccagtatagtgatgttattcggttcctgttaattaattgtaacacgaccatttatgatatgactacgacttaatccacgtgatttaacaccttaattacgactttcaattatcattttcacacgctgttctatgtcttctattaatttcttaaggaacaaaaatactagtagttcatttaaataagaaaatcattggttatctttgattattttgatgtcaaatctatatttgaaactgaatttttttacaaaaatagaaaatttcttaaaacgtgcattgtaatttgatttcttttaaaaaattaaaataaaaagaattgacgcaacaaaccgcgggtagtgcgactaaacacctagtaaaatactataatcgtagaatcaaataatgatatgtagatatttacgagaaacatggagggaggtggttataaagagtcaatatttgttgtgtggtggggttcatctaattaaaagcaaatgaagtatataattatattgataggtgaaatctagatcttagaaattgtttacaaagattgtaaactctggttaccaccgtttagaacatttttgcaccaagccttgaaacggttgatagattaatcaccaaaatgaacgaacctatctgtcatcgtccttacataaataaacgatgaagcacgagatcaacacagacgatctctaaaattcgtaaacaaagaaattattggtgtagacaaataagtcgggaacaaatcattcaatatggcggtccattacatattatttaaagaaatatataagtaagagaggcataattaaagaaaatacaaagaatggctttttacattgtacatgacaacataaggaggacagaatctttcgtctagacaagaatgtcaattgtggtcggaatagaattgaatctcaaatccatattcaaatcatcaaaaataaaaagaaacattttcgctaaatggttttaacttccatttcggatgacaaagaatattattcctaaaattcattttgtcaaaccagtaatattgtgaaactaaacaagttttagatctttatccaaaaaataaccgtatatatatacaatgtaatcatatgaatgaggaatatatatgttaaattcgtatttgatactcaatatacacagatttttacttaaaaaaacatttgaaataaatggctaaaaaataacaaatccaaatttatataaagttttggatagaattgcattaaatagaaaatcttgggaggttgtggtaaattcacgcgtcttgttgggtgtttttatatttcttctttttctcttacttctcatgaaatccgtgtcttttgtttttctttgttactagtactactttagagtttacactgtcttgctcgtgtcaaaaaagaaaaaaaaaagtcgtcgtctctatcgagtttttttttactattctctctcgagaaaaaaaaaatcaaaggggagagaaaattgcggaggaaaaaagaaaagaaagagaaaatggctctgtgattctccaatttctatagagagagagagaagaagaagattgattagataagtttcttaattcaacgttgagagacagagagaaaaaaaaaaaaagattttgtcattcttcaaaatacgttctcgccatttgcgccattgattaattcaagtgcgttgaagttagaggtaaccaccaacttgcattttactctccaaagctctgatttttctgtcaaattcttttgaaaactttgatgcttgttttcttctcatcattgattcttttttgatgataggttagttctacacaaagcttgatcttttaggggttttctctagttattggagagtggtgagaattagaaactgcattatccgatctaaaatg

SEQ ID NO: 3395 - DNA, 3000 bp, Unknown
  misc_feature (1)..( 3000): cDNA_ID_3071116_gDNA_ID_1620644_Annot_ID_163141 3000 nt of promoter + ATG
tctcttacttctcatgaaatccgtgtcttttgtttttctttgttactagtactactttagagtttacactgtcttgctcgtgtcaaaaaagaaaaaaaaaagtcgtcgtctctatcgagtttttttttactattctctctcgagaaaaaaaaaatcaaaggggagagaaaattgcggaggaaaaaagaaaagaaagagaaaatggctctgtgattctccaatttctatagagagagagagaagaagaagattgattagataagtttcttaattcaacgttgagagacagagagaaaaaaaaaaaaagattttgtcattcttcaaaatacgttctcgccatttgcgccattgattaattcaagtgcgttgaagttagaggtaaccaccaacttgcattttactctccaaagctctgatttttctgtcaaattcttttgaaaactttgatgcttgttttcttctcatcattgattcttttttgatgataggttagttctacacaaagcttgatcttttaggggttttctctagttattggagagtggtgagaattagaaactgcattatccgatctaaaatgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggtacaaatattgaatcttgactaacattaccggtttataatcaaatattctgatgtttaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcaggtgcgttgtttacaatgttataaaagcgcctagattggtcaatttttgttttgttctaacgatcttagttactgcattatccagcgcgatatgatggggttgacaaatcagaacaatgagcttaagttccggcttcaagcaatggagcaacaagcgcgtcttcgcgatggtatacatttctcttcacattgtatcaaatttacgatattattaacatgactttaacaaaaaatggaaccagatcctatatgctttaaaaaaatctccatttttgcgcttaacgaatgtgaaatgacgatttttttcccccgctttgcagctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatagagcagagaagttgttgcggtggatcaaagggttggagtttttcaacaagttacatatcaaatcaaacattatatttcatttatgtgcagagtcagttgaatttacatatatatcatataagtccaagaaatttaattttacaatatgttgttatcttagaaagaaaaaattcaatttatagtagatataggtatgaactatgaacacaagttatatgtaatgggattgattgagcttcagacaaaaagattctctgtttgttttgtttttagtttttaatttagtcttggattctgtctctttttgttggtttgtttattttaacattatgggccggtttttggcccattaaacagcatcccaaaacattgttgccttcttcgtctctctctgtgaataatatctaaaaccctaacaaacactatcactcacttcattttcgtgacgacggagcttgaccgctatg

SEQ ID NO: 3396 - DNA, 3000 bp, Unknown; identical to SEQ ID NO: 3391
  misc_feature (1)..( 3000): cDNA_ID_1820647_gDNA_ID_1620644_Annot_ID_47552 3000 nt of promoter + ATG

SEQ ID NO: 3397 - DNA, 3000 bp, Unknown
  misc_feature (1)..( 3000): cDNA_ID_1820639_gDNA_ID_1620644_Annot_ID_47554 3000 nt of promoter + ATG
gtattgattacttaccaaatgacccaaactacgtacgtgaaccagaagttgtagcatatattatgtgcctataaatatgaaccctaaagcccccaaaactacatatcaaaacaacgaaatctcaccaagtcctaataatttttaggaaaatgaaagcttcgatttaccttgtaaccgttttcatacttctacttctgcttctaccaacggcgatccctcacgactattccgatgctcttagaaagtcaatcctctttttcgaaggtcaacgctctggtcgtcttccaaaacaacaaaggatggcgtggcgtagaaactctgcactcaacgacggaaaaaacctcaaaaccgacctcgttggtggttactacgacgccggggacaacgttaagtttcattttccgatggcttttacggccacgatgcttgcttggagttctgttgacttcggacgctatatgtctcagcatgatttcagacataatctcgtagccgtcaagtgggccactgattatctccttaagaccgtttcacaactccctaatcgcattttcgtccacgtacgtcttaactcttaacccatcgtcgttttagtgtaatcgtgcatttggttttcaccatctatggacacaatagttatagtataatatatatatatatatatatatattttgtatattcactaatacataccggtatcaagaatttgtttcaccaattttgtcataataggacaggaatcaaattggatatcttccctgacaagataacaatatgtgttgattagtttcttcttctgtaattattctttttacgagaccacgatttttaatggaaaatattaagaatatctttttattatgtacacaccaacaacacaagattaatattgtataggtcggtgaagtacaaccggaccacgattgttgggaaagaccggaagatatggacacgccacgaaccgctttcgccttagatgcaccatatccagcctccgatttagcgggagaaatcgcagcagctttagcagccgcttcaattgcattcaaacaagcaaatcctaagtattccgcaatattactcaataaagccgtacaaacgtttcagtacgcagattcacatcgaggttcttacaccgataatccgggaatcaagcaagccgtttgcccgttttactgtagtgttaatggatataaggtacatcttgaacatatctcgaatattgtacaatgaaaattaattgggtttaatttcatataatcatcatgttctttcatatatataggacgagttgctatggggagctgcgtggttgagacgagcaaccggcgaagattcttatctgagatacttagtggacaatggtcaagctttcggtgaaagttccaattactttgagtttggctgggacaacaaagttgggggtgttaatgttctcgttgccaaggtttggtccaatttccaaaatcaaactgatgtatatatatatgataagtgtgaccgttaatcattttggttaaacaggaagtacttcagaataatgtgaccgcgatagccgcatataaagataccgcggagaaaatgatgtgttcatttttgccggaaaccaatggtccacatatgtcttacactcccggcggtctcatttacaaacctggaagcactcagctccagaacacggccgcactatctttccttctccttacctacgcagattacctctctacatcttctcaacagctcaattgcggtaacctcaagtttcaaccggattctcttcgccgcatagtcaaacgacaggtatatattagaatcataagatcatttttttcttccataattcttgtgttcgttagtctaagaaaaaaatatttgtgttttattttttgtaggtagactacgttttgggagataatccaatgaagttgtcatacatgattgggtacggcgagcggtacccgggactgatccaccaccgtggctcgtctataccgtctgttaccgttcatccggctgcctttgggtgcatagcaggatggaatattttctcatcacccaatccaaaccccaacattcttataggtgcggtgattggcgggcctgacgtagatgatagatttattggaggtcggacaaatgctagtgagactgagcccacaacctacatcaatgcaccttttgttggtgtctttgcgtacttcaaaagcaaccccaacttctcttgatttcaatttctttcccagatttgtaaaaataaataaatgaaaatgtacatatattgattgaggtaaaagtacgcatcaagagatatatatttatgtatgggaaattcttcaagtaaaggaaaacacatctttaaaccttttagtaatattcttaatggtacttacttattttttttaggtataatttataccgtataaacaatggcaaggtagataaaaaatttttataatgatttattcttatgcaatttacgttttcatgatacaaatttcttttgttttaccgttgtttatctttatgtcttaaagtatttatataattaataaaaattaaaagaatacatattataattataatatgtatttttaaaaaataaaataatatgtatttatattcaaacagaaaattatttattgcagatatggttttatttgtggtaatttagatgatgttttataagactcgataatatttttatcgctttcattcgtttttttttttgccaagtttacatatcctctttatctatagatcaaatttggaaaagaaaaactcgccaatatatccatttaaactaggacaaaaaaaacgatttaacagagaacaaaaagttcttgattgtgataaatcatggtgaggaaagtttagatataaaaatatacaaggagttaaaacatgcgggaaagtttccatagaaaaaaatcgaataaaagtttatatatatgcatcgtcttatttagtcatctctcataaaccctaaaagagaaaacaatg

SEQ ID NO: 3398 - DNA, 3000 bp, Unknown; identical to SEQ ID NO: 3390
  misc_feature (1)..( 3000): cDNA_ID_1820631_gDNA_ID_1620644_Annot_ID_47556 3000 nt of promoter + ATG

SEQ ID NO: 3399 - DNA, 3000 bp, Unknown
  misc_feature (1)..( 3000): cDNA_ID_1820627_gDNA_ID_1620644_Annot_ID_47557 3000 nt of promoter + ATG
taatacgtagaaaatggaattaaaaattgcaactaaaatatatttaagtgttgcattaggaattagtactttgcaatcgtggattaatttatatattatttacaactaatttaataagaactgaataatgtcatttgtgcgtgtggcagcactactgagtactgacaaacgaaactgaagcgagcgcgcgggcaagcaagcccatgggtgtcactcttttggtttttgctcgaaattttttcattttctgttttaaatatctctttagcaatgcaatgagcatgtctctttaggaatataatgggaattataaatgtaaattaggtttaataatgaataaaagatagtatgacgacaaaaataatagaaaaaggatagtataagcgacgagattagcataataaaaagactgctttctataatgcaaaaaaaaaaaaaatcagaatctcgtgaccatgtgggacctgcatgctactgtaacatgattcgggctttgcgtttaagcgttaagatgcaaaggaaagtatacacaaaattcacaatctttctatgtttgtgtgtacataaatattttttctatgagttacctactaagaaaacattacccaattttatgtttttttgttcgtagcgcctcgcttctaatgatttagtctttagcgtccacgaaagactctgtctctcgtattctcatctttacaaattaactttgccatctttatcttcatatgagcaacatccatataatttagccttcttgtaaagccaaccaattaactttttgattccactgataacacaaaacgacataagaaacctacaaaaaataaaactcagaataacgagatatttaaaaacaaaacacttttccagttgaattacaataaagggatcagacctttgtatttagtgttcaattcattataatcttgaatccactaatgaatatcgatcttagaaggtgtcgcgacattgtggatcgattcgaaaccaatctttgataaatgacaatacgattttatttgagagatcaatatttgtgttatttatacattaataattcagtaaatgatattactaatctatatctgtacgtatcaaagtattgactaatggagcgtttcacaaaaaaattaagtgtcaatattacataccaaacatatatatatatatatataactgtagttagttaaatgttaggcgagtagaaatatcaaatatatgattttaccaaaacaaaaaatatgaattcatcatactttttatacgaaacaaagctcacgtaaactaaaataaaaataaaatataacgtatatttgtgggggactttgccattttcacaagcaaaataatccgttatttttttgccttatcctttatcgaccatttttctattttcctctaaaaatcttagctttacgcttacatgattttctgccctaggaaattatcataaaccaatatgatcttacaatgtccaaaacattaacttggttgaaaatcatatatatgatacaaattaattaagattccactaacaaaagtcaacttttttttttagttaaataaacaatagacaattggtgtcatactcatatagaaatgtattacaagtgattagtgaaaataagtataggcattataagataatattagaattctgacaaatctatgtctcattgcattggtaccataacgtaccttgtggaacacgacaagtgacctcacagcacatgcgtgtgttatctttttttttatgtgtatcaaattgtggatattcatttctacagacatggacctaaaagcaaaggtagaattagactactgaaataatgggcttcatttaggtttagtttgttattgggttttcagatccgtacgttatgtttcgtgaaccatcgtatcagtttcttctcgtactgaggcccatgactcggtaattaactgcatattttgggatctttaagaattaattggcaaactaattcatttcaagaaaactaatatatttcttaaattatgacaaatgacagaaaataatttaagattttcaaagtaataccaaatgtttactttcaatgaattcgtaaaagtccattaataacttatcttatttacatatcattttacatcaataagtccaaatttaataataagccatatttatctgtatttataaatagacatgtgtagacgtgtttgatttaacatatatgataaaactccaagataattaaaacattccacctagtgctttgtagattaaaaaattaaagatttttcattaaaactctaattaatcccccttaattttcatcacaactttgtactactaatcttcctacattctgctacgacttttggattaagactatgttttggtgtataataaagtgtcaaatagcaaccgtatgtattaagagatgagtaattgtttgtgagtcaataataattatattgagtcagcaaacgtaactttccattacatatttacattataggtgagagttttcttaaccataggcacgaggctttcgtaaacatttaaactatctccacatatatgtacgaatcatgcaccaaatatctgtatttcttcaactttgaaaaatatactccatcctagcgtgttaggttcatatgatttcttctgctgaattttaatacattataatattaaaatggaaatagaagtaaagggatagttgaaatttgtggttttgtgagtcatcacttttctgtttggagatgaaagatatgttctctttaatctaaacggcattacgcgtaaaaaaatactttcccttaattttcatcacaacctttaattttattactaaacttcctatatatatagtagtcgatgctctatttctaatcacacgataaactttcttaaactttgaggagctctctctctattcagcccttgtttttactttaaaaaatcatgttcaagttacgtgaaattcgtctctttctccaatcactgaacaacaa

SEQ ID NO: 3400 - DNA, 3000 bp, Unknown
  misc_feature (1)..( 3000): cDNA_ID_1820623_gDNA_ID_1620644_Annot_ID_47558 3000 nt of promoter + ATG
ctccgtggtatgggctggtacatgccaacaaatagatctatgccagcataatcctttcattagtccttaaaataaatagtaaatatatataaaagataatgtaaatagaaagaaataacacaggacgttttagtataaagtaaaagcatatattaaaaatgatgtaatggaaacatttcttttttttttgggcaaaatgtaatggaaacataagaactagtatttctacaagaaagtaaaagtatataatgatgttattattgttatcgttgataagaaggaacagaaatatacaaacaactaatccttttgcctttgggctattaaaagtaaagctttgggtcatcacagcccattttcaacaaacgaattgctgacgccattttcactttcccctttagccagccaccagaagaagcttttgcttagtctacaaaatcagttttagcccgttaggaaaacgggaggttattttgatgtttgattttatattcttgtcggtattattggacctgcattgattttcatcataatttgaggacccccggcccaaagcttaaaattttatatatataaagattatgtattacaaaaagcccttttcattgaaaatattgaagggtcccggcggcgttaatcgttatttgagaatttattggcaaactaatccatttcttacatagatattttaacttttaagatatccaaaaatacacatttttgtgaatataatatcctctttctagatgtcattttataataatacaatctccaaatttaaaactaagttatatttatttctatttttacataaaatcttctttaaatataatagtctttggaatctatcaaattgaggtacaaagatttggtgttttgcttttgcatgtttctatgaaaaggttgaagcagagcgtaattaccatcaaaggatccttgaggttattgaacggctagaaggagaggtatatatatctccattggccacatctttctacaatgttaatccccaaatgacataatttccttgtatagatgagatttgagcaacaaagaatcgaagcaactcaaactccacaagtagagaacatcacatcttcgcctcctctttcatattaagaagccaatgatggagtcaatgcttctcaaatgcataatggaacatcagacgccatgggatatttcttaggagaggttggtgtactttaaaatgtcatcattttatggtcgcaagaacttgattaatctcttgagttgcctatctttttccgcacaggtcatgtttccatatcaagctgattcagattttgagctcagcttatcagttggagactatgttgttatcagagaggttagcattcaaatcaaagcatataagataccattctttcgcggctcaggacatcgaataacggaaagaatcttaaaactctttttttttttaatctctgtggactcattcacatgtctttatgatgttccaggtagtgagtagcgtgtgggcagaaggagaatgtaaaggcaacgcgggttggtttacttacatctacatcgaaagaagggatcgtgtcttcgcaactaaggtcatcgaggtcttctagtggcttcttttggtgtgtttcggtgacttttgttgccattgttgttctgtatctaactttttttttttttttttggtcaaaaattctgtatctagctagatttctttttcttcctctctttacttatacacaagatctgatcattgaagcaaaataaatctcatctccgatgatctaacaataatttccataattcaaatgctttcagaaaggatttctcaatacaggttaaaaatatcaatctaatctttgcaaactcattaaactaatttagttactttccttaactttaagaaaacaaatctcaaattttgtggctataccaccattttcattgaaactaactactcaattaacggtctgaaagaggacaaaaagattttcacaagtgtacaccaataaaagaaaatcgtttttttcccttataaaatgacaaaaattaccaagaaattaaatggaacataacttacgacgaaatttacctgacgattttttttccttactgaaaattaccaagaaatcgcgtggaagtcggaaatgttacatacttttctttgtaactacactgcgaaagcaaaaaaaaaaaacataaagtcaaccttttgggaaaattgtcgtctttgacatcagaagagattcaaactaaaatgaatgagtacgttacttgcgttatggttgggttttcctttttaattttagaaacttttcttacttatattttgaatcaacagttgataacacaagtataaattattattttcgccatcacactggagtcaagctcgagagagacttgtttcctaatttaattcataaacttgtttcgacagtgaatatatacatcttcgaagaaataacaccattgacttaaaaccaaaataaataacaatagtcttataatttatattattcacacttaaaattaacaatacaagtcttttcaaagtcttttaattatataaacaatagaagtctttttcattgtctctttttgactaattaataaagaccatgaaaagacttgtattgtaagttttgagtgtaaattgtaataaattactatggttttgtttgttttatatttctgccatctaaataattacattatatgataaaataattaccctagcgacaaatgacagctagaaatgtaataagaacaccaactaaataattatgcaggttaataatggagcaagtgatgttctttctatatactgtacattttctttttaaaaaattatgtaatttcgcagaagagaaaagaaaaacacgtggtgattagagagtagtataaagatagttggttgggttctgtttttttctgtatctcgaggcgccaaaaacaacaacaaaaaaaacttcagagcggtgatcagattcaccgatttttctcaaa

SEQ ID NO: 3401 - DNA, 3000 bp, Unknown; identical to SEQ ID NO: 3389
  misc_feature (1)..( 3000): cDNA_ID_1820619_gDNA_ID_1620644_Annot_ID_47560 3000 nt of promoter + ATG

SEQ ID NO: 3402 - DNA, 3000 bp, Unknown; identical to SEQ ID NO: 3388
  misc_feature (1)..( 3000): cDNA_ID_1820613_gDNA_ID_1620644_Annot_ID_47562 3000 nt of promoter + ATG

SEQ ID NO: 3403 - DNA, 3000 bp, Unknown; identical to SEQ ID NO: 3387
  misc_feature (1)..( 3000): cDNA_ID_1820609_gDNA_ID_1620644_Annot_ID_47563 3000 nt of promoter + ATG

SEQ ID NO: 3404 - DNA, 3000 bp, Unknown; identical to SEQ ID NO: 3386
  misc_feature (1)..( 3000): cDNA_ID_3409035_gDNA_ID_1620644_Annot_ID_47564 3000 nt of promoter + ATG

SEQ ID NO: 3405 - DNA, 3000 bp, Unknown
  misc_feature (1)..( 3000): cDNA_ID_1839193_gDNA_ID_1620645_Annot_ID_47569 3000 nt of promoter + ATG
gagtcaaaattgtgtacagtcagaaattgtaagtttgtgccctacaagatcaaaagaagcaaagacaaaaataaggatctggtgagagtactccgacagaaacaaagttcacttgaatcgtactagaacgaacgtgtaggaatatattacattttgcagattgtagcaatgaagtccaactctaccgaagaggattatatttggatgaggtcctccatattttgcaatgtcagccctttgtttaatgtagtatttgttataatcaaacttttcttctctctaaacaaaacacagaatctataagctttaaaatgcaaatatctctatgagtgatgagacctaaagttcatacatccacaatcaaatccaattacccgattagcccaaacatgtcgtgggatggaggatgaagattcttgtggtctctgatcttccagcttctcattactctgcgatggttcctcgaccaagtctctggcttcttgcttccacattccgttacccatttcttggcaaatatataaaccctatattaataaacttttaagagacttggaacttaagattcaaaccctaatttggaatacaaatctatgcgcgttaagccaaaccacatcattaattaagaacactgtcaatacacaacatgtgagcagcgaagaccacaacagagggaagtgattgagaacagcagatctaagctcatattcaacatgcatagaagaagaaaaccaattttgcatcaagagatactgaaaaatctttcattcataagagttccaagattccataaaaacaacaactatttggaagaagatgaaatggagacatctcaagttctgttccaatgtaaaatacagaccaactaagttcggtttcagaactcaccttcttcacctatgaaatttgacgagatcgcaagaagaatatacaatggattcagtgtttcgtaatcggtgagaaaaagacaaataaataagcttgatgatagcttgttagaccttagagaatagaagattgggtttaaaggctattctctcctttttctttttcatcgactcaactttatggactaatatatgcaatctcatctctttgttctaatttggacaaatacttttagctttttagacatttgttatatgtcacaatgcaattgataaagatataaatttgttgacaatgaatgcataggttcagaaccataaacaccttcaaattattaaaactcaaaaatagaaagtagaaacccaaaaggtagtttcatcagcacacaaaactcaatcctgttaatttaaaagtaacgaaataaagcaattgcaaaattatagtagtcattacaactccacctatatcatgattgatgaagcctccctaagttacatgaatctttctggtggtgagatcaaaactctacttgttcgaggccttgttagacagcttcttcaccggtttcatgcttcttcttgacggaatctgcctcgactttgcgacagtgaaagtagaaaaactgaagcagaataagaaaatcaagaacagcacatcctcctgaatcaactagccatggtagattcggttcgattttcgaccattcgacgctgttcactagtatgcttgcaacataagtcacattgccaatgaatgcaaagaagaacattaatggattcaatccctcaacatttcctctccttacattcatacatatttgaggaagccttccacccatgtaaatcgccgccattgcccaacccaaccacattccaatattgttgttttctcctaagttaccgctagagacctccaaaagctttcttgctcctgctcctccaactacaaacactctatctttccctctcaaatccatacttcttgaaccactcaatacgttgaatgatccaagaaacaagaacaccgagaccacacatagcaacgatttggtagaaggacgcttagcttcttcacgaagcaaaggctcttctacatcaaccatctgatgattccttcggtttttcatcaaccgcgggtaaatatgcccgtagtatatagattgaacatagagaacaagtgtagccagagtatacaacactgccgtgtagaattgaactggaagactagctggttccatcaagcagccaacaacattaaagatatcaccaagcatccatgttgttaagaaggttatagagactccttcaatggacttttgattgtagttagtcataatctgcggtatctcggcaacactccaactgataacactgatgataccaagagatagtgacaaatcatctcgaatcatcgttcttcacgtatgatacagccgaataaacctgttaaaaccctaaatacgaaattacaagtagctgaataatattgagcaatgaacaactcctcttataaaggtaagaagagagttagaagatgaataggaaaagggttttgaaactacaatgaccagattctaagaggaataggaaaggttttcagaattcagattggagaaaacgaatcctatgaatgaattaggttaaaatttttagtttctttctctatataattaaaatttgatatttatcaaaaacaaattaaataattaaaaggatatatccaaataattagaaaaaataagaatctaagtatatatcttgtttatacacgcaatgtttatctcttcaaagtctaggcttttgatcgagtctcctactatactaataccaccaaccaatttaaaaaaaaaacaagtagaaatttaacaaaagtctaacatcttccaaattttttccattttctaaaattatgttttgagtttgacgtttctttgttatttatataaactatagtatgctatcatcttcaatcagaaacagttccacagaagttttctgttttaacttttcctctgtttttgatttttctctctgaatctctccttcatttccccgggaaatagtaccagaaaggttatcatcgatcaaactcttcttggtggattcttcagag

SEQ ID NO: 3406 - DNA, 3000 bp, Unknown
  misc_feature (1)..( 3000): cDNA_ID_1820728_gDNA_ID_1620645_Annot_ID_47571 3000 nt of promoter + ATG
ttaactttctctgcttgctcagtttagtgattctcttgtcataagccaaaccctcccttacaaagttcttgttttcagttcaatcatctctttgttatttatgaaaaattaggactctgtatctactggctgcaaatgtcctgaaggtttccaaggcgacggtttgacgtgtgaaggtacataactcttaacttatcgattaaaatctcgaaagaaaccacataatcatattaccaacaatgtaattatgttttctgatttggctctattgcagatattaacgaatgtaaagagcgttcggtatgtcaatgtagcggttgcagatgcaagaactcatggggtggatacaaatgcagctgttctggtgaccggctttacataaacgatcaagatacttgtataggtaaaattttatcaatcaagatttaagagtactcaaattccataacagtatctaattaatatacattgatgattgtttgttacagagagatatggatccaaaacggcatggtggctcacattcttgatactggctatcgttgcagtagccggtttagctggttatatattctacaaataccggttcagggtactactactctttctgattccacaaaagcatttttgtacttaataacggttttaggattaccaaactaacttttctttggtgttcctattaacagtcttacatggactcagagattatgacgatcatgtcacagtatatgccacttgagagccaaagagctcgtgaagttccatcagaagccgagccttttacactctaatagtatatgaccaaagtaaccaaaactgtcatacacaaagaaatgtttgagatcaattaatgtacatatgaattatactgtaaaaataaaagagtgagatagagttgtgtatattttcatggcaaaaaaataaataatttggatgtaaagagacttttgaagaaaataaaacaaatattgctttcattgagagttgaactcaagacctcccgcttactaaacgggtgctctaaccaactgagctatgaaagcttcttgcaacatattattccaaataaattatatcgtaaactaagagttaaaatcttgaaaacaaaggataacgatcttcgtctccctctgctaaacccattttcttctgttgaggaatggcttcttcagtctctcttcagttcctgaccaacacctttatctccaaacctcaggttcttaatcttatctctctgtatcacctaatgtttctatgtcatgtgtgtgtgtgtgtgtctgtctttgtctgaattttctgagtactcctcatgttttttccggtcggacaaagggtttctgcaacggaattgtgtcagcaccaagacccagaagcaatttattaagagacagacaaaatggtgtacgacccatcaaagttgcgtctattgagacacaacctttccctctgtttcaatctcctgcttccgaagaatcttcctcgtccgaggttaggattttcagttttgagtgttttagggtttatagagttctaaaaggcagtacctttgacaattctttgcattgcccctatctgggagattgatttagagtacaaatgagttctaaaggtagtacctttagacaattctgttcattgcccccatatgtgatattgatttagggtacatatgagttcttaaggcagtaactttagacaattctgtgcattgcctccatctgtgagattgatataggggacttcttaaggcagaaactttagacaatcttgtgcattgccctcatctgtgagattgatgtagggtacaaatgagttctaacggcagtaactttagacaattctgtgcatttccctcatatgtgagattgatttagggtttttgtcttttgtttcttcactagctggagacagcagatccggatttctacaaaattggctatgttcgaagtgtgagagcttatggagttgagtttaaagaaggtccagatggttttggtgtctatgcttctaaggatatcgaacctcgccgtcgagctagagtcagtcttcttagttaaaaagttgacaactttttgttttgttcttctctttagattattttgttttcttttctctctgcaggtgattatggagattcctcttgaactgatgataaccattagacagaagcacccttggatgtttttccctgatattgtaccaattggtcatcctattttcgatatcattaactcgactgatcctgaggtagtaacacatttgtgctatttcgatatcatcaactcgaaagttcttatctttctcaaagtcctttcacatttgtgcttacagattgattgggatatcagattagcgtgtcttctgttattctcttttgatcgagatgatcacttctggcggctctatggcgatttcctgccggctgctgatgagtgcagcagcttgcttttagctacagaggtggattgaattgatatgattgccatttgaaactggtcacatttacttgtgtctttaaactaatgcttgatgatatctaattctgtgtgtttttctataggaagaccttgcggagcttcaagatcctgatcttgtttcaactatcagacaacaacagaaacgaatcctagatttttgggaaaagaattgggtaatgaggccttatatatgtgtttccagtatatcttgacatttggttattgctttgtttttcattggcaaattgtattccgtctcagcattcaggtgttcctctcaaaatcaaaaggcttgccgaggatccagaaagattcatatgggcggttagtatggcacagacacgatgcatcagtatgcaaactagggtcggtgctttggttcaggaattaaatatgatgattccttatgctggtaaggaagagcatgttgtgtagttattgataaattaagatttagtatcaatgaactttttgttgaggaactaaataagaatctcacgattgatcattctctgcagac

SEQ ID NO: 3407 - DNA, 3000 bp, Unknown
  misc_feature (1)..( 3000): cDNA_ID_1820724_gDNA_ID_1620645_Annot_ID_47572 3000 nt of promoter + ATG
ttctgtttcctctctattccttgacaaaagatggagaaatgagcaccaatgttacctaaatctgtggcaggcgagttatcgaggggcgatacttttgttgatggagcagttatcgctgcagcaagaacattacctacttggtcagacatagatcttcctccaataccgagtgcggaaagaaaagcagttaaagaattgcaagatgaatgtcgaaagatgcttgcggaatatcccacaacagcagagcaagaccagaagttgctaggtattacactaaagatatatacaccaatgtgttattatctattatcgctcatatactaaaacttaagctttccctcttgttgttgtgacagattcaatgtcagaagcaaggacaacatttgcaacagcggttaagtatagaatgcacagaaagatgttcatcggaaaaattatcaaggcacttgacatctatcaagaacggttactctattgattcaagcaaaaaataattatgagctgagtgagattcatacttggtgctcactcccttgagctacttagaaactgcaccatgtaattgaaaggttcctgtttttttttttgtttagtgtaaggttatgtatttgtatggaacagttagactaagtgtgttagtttgttttaatcgcaatcacaaacaaatcataacctcttcttttcttggctgctttaatgagtttgattagccaacaaacgctttggaatcatctgtgttttttttttctcttttgattaattcatgttcatgtttttagtccctaagcatgattagtgtctcaaatgttttagggtaattgtgtctcttacgccgaactataatgttgattagtctcaataattgattattacttatactatttattaaccttgtggttacactaatcaatcaaatcatattgcgtttcttctactctttgtctaacattactattttcaaaaaaagttacggtccaaaccaaacaaacctactctgagttatacagaaccataagcaatctatttcttacctttggctacttatttgatactttacattgactaacttgattcttaataattatcttcaatatgttgaatattttatttttgaagtaagaccactatgcgtttcataattcttgccatgcataatgaaattattcctttgaatttaagattaattaaagtataaatcaaccaaacaatagacaaaaaaaaataaaaaaaaataagcatcttgatctttttggtggatcgaagataattcctttgtctcattcttttggatttagaatctcgttcagtagaatattaacatttttaattatagattatcaattatcgaacaagttgttgtacgtaaacttgattcgatctagcgttattacagtcaaccaaaatttatataataataacaatttatgaaaatgacaatattattcgatgtattattccttttttcctataattagataggtgtgattaaattcaagctagattccgaatcgacaacaacatattatatctattattaacctcaatttttgaaggcaaaaaacacacgaaattattcaaaactcacgagttgattctttacttcgatgaacatataaattgggaaagtatcaccgaacttatttgggtaataaagaaaaagatggatgaaaaaattatgtttgcaaattttaataagaattatgtttgacttggtaataaaatatagggcataatcatatgatgccatgttaatgtacgatcataccacaactgctctccttgtcgtgaaaaggttgaagtgatgagaagctaacacactttgtgacataaccaaagccaaaaatatatacttcaaccaagtcattttctcaaccactcttttctccttgtccaaggtcaaagccatgcatcaccattttattttctattattcattattgttacttttcctttatataactaataaaaggtctattactaataaacaactaaacttttcttttctttttgataaaattaaacaactaaacttgtcgaaaagaaataggagaacaaagaactctaacttctcacgaaattgataaatcaaatgattgcgtatcacaaagacactaaaaagaaaaattaaggaatcgtgtagagttgacactctatacattcagagtagtaatcatgtgtttgatagataataaatagataatggaagtatgaaatgagaaaacttgttgggatcatttatcatttgtggaatcctctaaatcttttctaacttaactccaagtcgttagagtccaagagatatgaatcgatcggaacttcaatacagaatttaattagaatatagtggaacaacatccacgaatctaaatgtcataagttgttaattgatcaaacgaaatagaatgtacttattataagcttataattttacaagtttgatgtgaatgtaaagtgtactactccactatttatttatatattctgtggtttctaaagaagaccaaatgtttttttttttttctttcctaagaagaccaaatgttatgtcaaagtttaggcactgttttaattatataacatgtctccacggacgaataaatgtacacacgaacatcatagtacgaccgttgacctttgcccctccattgattgataaaaggctaaaagccgaaacattttcattctacgagccttcccattccatttccccacatctctcctctgacctctctttgacccctctctcctctctctctagatctctcaataaaacagtgaaatagcaaaaaagaaacacaaaaaagagagagagaaagaaactttgttctctctgcatttactcttctccaactcagagatagagtccctatgcaccgtttctaatgaccaatcatctttctccctcttcatcattctctacaacaagaatcacacaaatgccataaaacctccattcttcttcctcagtaaaccaaaccataagacgacgaagaagaaaac

SEQ ID NO: 3408 - DNA, 3000 bp, Unknown
  misc_feature (1)..( 3000): cDNA_ID_1820712_gDNA_ID_1620645_Annot_ID_47575 3000 nt of promoter + ATG
aagaaggtagaacgcgaagaaacgggagaaaacgtggaagaagcatcagtagagtttgtaaatgattgggatggaaacgaaatggaagaagaagaagaagaagaatatggagattattttaatggagatgatgattggattcacgatatatcgcggccacgaagttactgggaagatctaaggaaagaaaggtatcttgaggttctcaacactgaatcagagaagaaagatatttgcaatctcattgagaggtatatatttctatgatcattcatcaaatccctcaaaagcattaaacttgaaactttacttgacttttgatgtttagactaattttaattttgtataccgctgtgcagacgaacagtttccaactttttgactagtgatttgcgacaaaagattgataatttgatgatcactcgcgtgcaaagtcatataggcgtaccactcaatcaaatagaagaaggagacgaatatgaagaagagtgggaagttgagtgttcagcaagaaacgaggaagataatgaaacagaggaagaaccagagaagacaaatcttgaagctccaagcgatgtttgcagccaatcatcagcaaggagtagtaccatgatgtcgtggaatttcagagaccaggacattgacaaggataacgaaccgacaacgtctttgtctcttcctgaacctttagttcccacaaatcaatctgtgagttttgttcttgttttttttcgtcaagtttaggttacgtgttggtgaagtaacctgaaatcttaacttattagacacaggacatgcagacgataagtgatctcaaggaacaaatggagcaacttcaacgagaaatgctcgagctacgaaataccgttaaatcttgcatcgatatgcaacttcatttccagaaatctgtaactcaagatctgtctcgttctggtcagttttatcatcatcatcacattaaacacattttagatttattcgttacaaagaaatcaaactgattaataatcttttaggctcatcagcagaacaacgagtagacccgaagaaagatcctttgaaacgcaagtgttgcgtttgctctgagatgcctgttgattcgctcctgtataggtacttctgtttgatatatcgcaacttcaaatcggaaacgctgaaataataactggcggtcttggtcttccttttaacaggtgtggacatatgtgcacatgtctgaaatgtgctcatgaattgcaatggagcagtaagaaatgtccgatatgtatggctccaattgttgacgttgtgagggcttttcttgattcttaggacccaagaaaccacaaaacattgctagtttctccattgatttgaaaatgtgtcacatttgaatatacataataaacattttgtttgtcttcacgtgttatgccgacttctaaagactttattattctcctattcttctatgaagtgaaaccattactttgtagtaaattcaatttgttgagcaaaagctaaaagtacattaaagaggataataatgaatcttggtcttcttggtgatatggataaggataaacattgtagtatttggaggctatggatgtaagaaaatactttttcgaccgttttgagctttggaaaagttaaaaaaaaattataaagaatttgatttttatgttaaaatatataaaagaaattgaagaaaaggcaattgaaagtttgaaacgttagagagaagccaagcaaaaagacacgtctgcgccatgtgtcttacagattttggaagcttaaaacgaaactgcgtaattttaaaaaagtatacaaaacgatattaacaaacaaattatagaaaaccatattaaaaagccatgtaaatccattttctatacctgcaatgtcaccctcagaaaactcgaaattatacgccatcaaatttagaaacttacatggttaaagcaaactcattaaattgttacgacaatgccaaaaaaaaaaaaaagacacaatcatttgagaaattagctgtgtataccataagcttttcattatgtggttgatttttagtggctgctctgctaataattttctgttgttgattgatacatgacttggctttgagcacatgtcaactttgcgatacgaaatataatggttgttccatattattaaattatcatgaacaatttagattttgattctatgattatatactaaacataggaatcaatagttgttaatcatttttcataaagttgataatttggtcttcaataatagcttaaattgctctctctcttttattgtttacaaaatacactctccttttgacctgaccttcccttcactatacggtttcctctggtgacgtctgcaagtcaaaataatacagaaataaggaatgtgttattattcagccaaatgaagaaacataattattttacatgactagaatttttttttacttttcaataaaaaaagagacttaaatcaaaaatgaaaaaacagagattgaaattaagatttggcatagaattttttcatttaatcaaacacgaaagtcgaattaaaatagtacagaacaaaagaaaaatagaaataaagtaaacactcctagctaaaatctctcctttcataggaatgtctggtaattctacatatgaatggattcagtagttgtcttttgtaagtatcttttttcgttgtactcaaatagcatattaattctggaaatatcattgaacttacatattacagtaattaaaaaaaacataattaagttgtcaaaaaataacaaaacaaataaagaaacaggtgtgttcacactcaaaaaaatacagactagtagaagaattaaaaacgactcttctcgccgactcgttgaaaaagtgagagacacacaacttcggagcgaatctattcttcttcttcttcttcttcttcttcttcttcttcctccgtttttttcatcttcttctctgtttcgagagatccactagtgaaagagtcagcacc

SEQ ID NO: 3409 - DNA, 3000 bp, Unknown
  misc_feature (1)..( 3000): cDNA_ID_1820700_gDNA_ID_1620645_Annot_ID_47578 3000 nt of promoter + ATG
tggtcaatgtaagaagtaatatgtccctgaaagcaaaaaagtttcccctcatcaatgttcgataaatcatttttaacatattctttttaggttttgttaatatgtgctaccgtctaagatccgtatgattctgtttcaatactagttggtactgaaaagagtgattcctaaatttatttacatttaagagtaaatcataaacttatgaaatgtgatattcctaatattttgttcctttataggatgacatgaaaagagaatatgtcattacgggagtcaacacttatatgaagcaatatggtctaaccaaaatggaagctatcagagagcttcaaaacttagttgaatacaaccatacgataatgaacgaagagtttttgaagacaactgatttaccacgccaaattcggaaacaagtcatcaacgttgcacgctctctcaacgtctcctatactgaaggtgaaggatttacccataccaaaggaaaagtcgatgagtatatcacttctttgtttattaccccgattcgtatttgaggattttggaatactgtatcgctttaagttcatatgttaaaacgaatgtgacctttgttcttggtttctttcatagcgacgtttcgtttggtatttgtggtctaagctcagaagtcttataaacgatctacatgatttatgttgttataagttataaatgcttttttttttttccatctggcattgccaaaaagatttttttttttgtaactgttcgattgggaccagccacttaatttttcctttttgaatagaaaatggcaataatttttaacaaagatgattacagtgggtgtttaaaaaaaaaaggtatcaattaaagggtatttctacaatttctcatttaaatatggctaaatcgttaaaaccagtttaatgctaatctaaaagtctaattttgttatatttcacaaatatgtaatatttttcttttatttaatctcaatttgaaggtgtacgcgatattgtaaaaatatgtgtacaatgtacggtgataatgcataatattgatttaaaaagtagtatagggtatatgataatgtaaaaagtagtgtacaaacgacaatttatatcggtgtatatctacataatatgatggtatatgaagatgatataaaatatggtgtacatgatattaagatatacataacaccccatatacaaaagatagaacaatttttgtcaagtgacaatgtacaaaacaaagtttaaataatataatagtgtatgagattgatgtacattgaaatgtacaaactttagtgtactctacataagaatgtacaaacattacctttatttaatggtctacaccatcatggttaatttaatggtgtacatgatggtgtacattagtgaacacatacatatttttattaatttatgaacaattattaatttatttataaatatgagacaagtcggtatacttaacgatttaggagatgttgtgtagaatgatttggtgtataagtgttagtgtacaaaacaatgtttaaatgctagtgtacgaaattaataattgaatatatacaaatcatcttatatttagaagaaaatattaatattttttaaaaaaatattaatttaaagaaaataaataaaataatatgaagatgaaaaatgataattatgatataatagaagttggtcgaaatagttaaataccataaaataaattgggacccatacctaaaactttctcatataaaacaaaaggtatagtggtatttgacaattgtttttttttttgtcttttttagcttattacacataatctctatctcacaaaaataaaataaaaactaaaaaattatttcacaaatttcacaaatttctcaaattaatttttcaaaagtgtctactttgctgaaaaaactcttgtttttaataggtttgtaacgtttatgtttagcaaagtcttgttttttataggtttgtaacgtttgtgtttgtattgtacttttagatttgtaatatgcatcggattcgcttcgatgagatatctgtttttattccatgtgaaaattaggatatttgtaaattaaactgtggttgtgttcatagttttcgtttacagcactttgagtttctttttttggattaactataaaattatcaaagtaaacactaaacagaacaagtttaataatgtatggtatagaaaatctaaaccaaactttagtgtgattacaatatttgatactatataaatatatatacatgtgtgattataatttaataaagatcactaatactattctaattaaaatttggtaaatttcataatatatgagtatatgactaatagtttattaattacagatgtcaaaatattcaggacaattctttttagtaaagtatctttgaatcaatattttttcattgaagcaaatgaatatttgaacaaaatatttaattaaagtttttggagcttacaatatttgatatttttcttagttaaaatagaaatatatcatatgatacattattgttattaattagtaactattaatatcttgtgtttgtgaaaataaagattagaatacatatgatattgcatgtggtttacaaattttgatggtaaaattcactaattataattggtaaatttcaaaatattttactaatattatattacttagttaaaattgtcaaactgtttaggaacaaaaagaacataaggtatctctctatgagtcaaagattgtcatggaattttattaatgactacttaggaacaaaatatttcattaaactatattatttttactttccacaaaaacaattatattcatattgaagtctaataatatttgatattttgcttagttaagaagtttactatctgtgataactagttttacttaacatatttacgcataaaaatctagtgtttttaagataaaaagttatggtctataaattatgaaaacggattccataacattttgtagtgaacatg

SEQ ID NO: 3410 - DNA, 3000 bp, Unknown
  misc_feature (1)..( 3000): cDNA_ID_1820696_gDNA_ID_1620645_Annot_ID_47579 3000 nt of promoter + ATG
gagagggttctatcattcagctttcaaaggaagtcacgagaatctcacgtgcgtcgagctgaccaaaagtgtaacgaacagtgagggtcttttggtcaattctaattctctgtaccttatcttcttcatctctctcgagtttgttagatcggagagcatcacctccggcgagacgtagcgttttccggttaaggaaacgtgaactcgttaaatctttgtgtcatcgattctttacgtttctctgttgttcaatccattcacaaacaagagccgagtacgaatcgagtgattgtgagataacaaatctttacatctttattaagaaattttaaaggaaaccgaggatttatcaggaaaaagaacaatgaattgtaattttcttctctgtttaagttatattgctctggctcccaaaatctttggtacgttcttgttgtgttatagtctataagttatagatgacataaaaggtacagctgcacgggtttttggtggagtgagctatcggacagtgtaaaatttgatggtgaaaatggatttcatatcattagtagatacatggaagtcacattactttttggactaaaatttggatctcaactttctcttcgttcactgaccaatttatttccggtaaataaactctctcgctgatgaggttgcgaaggtttacaataatttcatcaacaacagacatgtcaatttgatccttcgttctgtctctatatatctcgatctcttgaagatatataagataatttcgacagtaatatttatcgccaatttaacaatgtaaaccagtatggtatgactcgagtttgcatttgaccttgtctctgttatgttgagggtattctttttttttggtcgaaaattaagggttttcttcaatgttgtaattatagaataagatcatttaactcgtaacataagaatctaacttcgtctttttgtatttccatgatataaatctcgattaaaatataattatattagatacttaacgtaaatcatgtgtatcttaattacttattattattattttttgaacaagttttacttattatccgcttcctctcttttttacttgggtgatggtctccacaccaaattgaaaggaggaagttcaacttgctaatatacaaggaccagatcaacacaaccatccgacatcgtcactaaacaaatcctaaacctaaagtgagctggttcattgaaaaagcaacccaataaattaatcttaagccaaaacaaactctagtgggagtcatttcaagactataataaaatttaccactagactaaaataattttgacaaactattatattcccatttaacgcatttcaaaatattcttaaagtctttacataggttggcattgtcgtcgtattcaccagattttgagcatattcttcaataatgtgatccataatttaaaggaaatttattccaactaaaaaacaaaagaaaacatcataggcaaaagttaagtaggttatcaaatgttgagaaggtctttttctattgatttcttgatcagtaatagtttttcctagccttttcgactcacatggcaggcatttgatatttttcaataattgttttttttttgctaagagagtaaatatcattagatgaaaattaggtgttacaaagatgaagacctaagagaaagcgccttgtcaaaaaaaagaaaaaaccaaggcgacaataaacagaaactgtaggattgcaaatccgttaatagagccagtgctgcataagacttctaaaattctttaggtgtcttcttgccgttatcgagttaatgatttgacggtctatatccttaaagatggcttgaggcggaatcctgatctgattgtgcatcaagttgttcctctgcctccaaacagtatacactaaagcttgggcaagcaaaagtctaagagttcgcggggaagaaagatttctgactctagtccaagccataagcgaatcccagatttctgtcttcttcctcttttgcaataattgtttcacatgatggatttggacagtgtgtgtatatgtgtatttgatatctcatatctatttacatatgatagctttgtttggtgccaaagttgttttctagacacgtttaatctgcagatctcttttgagaatttatatatttttattttctaaattttattgtatacataactttactggtttactcgctcgatgtgctctcagcatcacctccattgttggcattgacataattttgttaccttgtgtgagaatttttgatatatataattttgaacttcaagtgccgttttaaaaccgtctccaaaagttccttacccaatttactcagaaatatgctagtaacttccattgcatgtataatatctaatgttacatatttaacatctcgttgtcgataatgattgatctttggatagttaaactgaccagcaaatggagtatcactactaaagcgtttcgcgttatccatgtttaaccttgtaagaacattcttcaaatatttctcttgtgacagcatgagaccctttttgcttcttctaattgtcatgccaacaaccagctttgcttcgctcacattttccatggcaaacgcttctgggagtttcattttcaactttttagttttatgcaaattaattaatttgctccctctaagcggtctttaataccatgccaaatttaatctgaacgataaaatatcaaaattaacctacatgaactacctgacgttagcaataagcttcatgacaacaattaaattgcgatatttctaaatctttacttggtcataaaaatattatatatggcacatgtattaaaagcattttttaaattaacaaaaataattaaatgttaaggaaatgaaaattgttcttcccccctgttgagtttgtgaccacgacgctgttgtcgggtaagcaactacgatgtgcctataaatttggggtgaaatgtatccaaaccattgacagaaaaaatg

SEQ ID NO: 3411 - DNA, 3000 bp, Unknown
  misc_feature (1)..( 3000): cDNA_ID_2991149_gDNA_ID_1620645_Annot_ID_163208 3000 nt of promoter + ATG
atgatccgtagcaatttgcttcgttctaaaccctaatttgagatctcaattatgtgattttttcgtttaggttttaatcaggaatgaagcattcaaaggatccgtttgaagcagcgattgaggaagagcaagaggaatcgccaccggaatcacccgttggcggaggaggaggaggtgatggtagtgaagacggacgaattgaaatcgaccagactcaagatgaagatgagagacctgtggatgttcgccgtccgatgaagaaagctaaaacctctgttgttgttactgaagctaagaacaaagataaagatgaagatgatgaagaagaggaagagaatatggatgttgagcttactaaatatccaactagttctgatcctgctaaaatggccaaaatgcagtgagtctttgtagaattttgattgttcttcatgtttctttgatgattgattgtttgttgaattcttcagaaccatattatcgcaattcactgaggatcagatgagtagatatgaatcttttaggagatctgcacttcaaagaccacagatgaagaaggtatatatgttatatgatttgtggttatcaacattcttaattttgtttcattgcaaatatgaaccatttagcttttatgttaatgcagttattgataggtgtcactggtagtcagaagattggtatgccaatgattattgttgcgtgtggtattgcaaagatgttcgttggtgaactcgttgaaacaggtaagccagtgcaaaaatttccaatgattttgtttatgtgccaacaaagctcatttactgaacctcaatacattatctgtagctcgagttgttatggcggaaaggaaagaatcaggacctatcagaccttgtcatatcagggagtcttatcggagactaaagctcgaaggaaaagtgcctaaaagatcagttccacgccttttccgctagtcaacaagagccaaaagagaacttatatcagcctaagactggggaatttaccaatgctgctcaaggataagggtctacggcaggtttaagctggcgagatttgcctatcaatctcatcataaaggagaacttctttggcttccctggtggatcatattgttctttgatgttcttaactttgtgtgacaacttttgtagtaaatcaatctttggatacagaccctgaaatggctatcagtcttacggtttggtttttatttggtttacgtttccagttttcattttcaatacaagatcaatctttgactacagaccacatggcctaaaagtggcaatccggtttactaggttggattcggtttcatttccggttttatagaattcgaaatcaaataaaatcatttgtaatccggtttatttggttaaatttggctatacctaaaaattggttttagtattgattcgtttttggtcgaacattacaagaactgggtttataagttcaaattcaaattgtgtatttcttcggcgtgattgaaaaccgtcgcgatcagaattcggtctactgtcaaaattggtacggagacgttttgaatcacacaagttccggcgaaagaggatctagtgggcctgataatgggccgatctcgaaacgaactattacgtgaagagaagaaaacaaagtgggttgcgaattgaaagtctacagaaaataaaaggactggattggaaaaataaaaagaataaaagaagttttgacacaataacgcacccactatctttctccttcccttccgccttccttcttcttcttcttcttcttcatcctcctcactgtttaacgcagagcgcctccgtttcttctcttctcctcctctctcttttctctctacacaaatatttttcccttcttttttcattctctttattcaatataatccttttgattcgctggtgatcggtacgagaaacttagaatcacacgaggaagctgtgtttcgtttatcctcgtttaatcggaatcgaaatttgttctggagaagaaatttaacgaatcatagattcctgatacaaaaaaaaaactatcacagatcggaatcggaaacgtaaccattacataattcgaatctggttttcacttgggtataatgatgaggtttctcttcttcttcttctccgttcttcttctctctgtgttttttccatcttctctgagtttttctattttccactgatttggttttctgttgttttctggatttctaattagtttctatggatctgagtttgattgtaaaaaaacttgagattgactctaatgtcaaaaacttttgatctcctccagatttcgtcttctttggattcaccagtttttaactaatctcaatttgatccaataaccaaattgtttttcgccttttgaacaaaaacaaaataatctcagagcttctccgtcaaattctgatttgggttattttcaattaaaactcagaagaattttgagaagattaactctaaaatctcgcataaaacacagacacatttttacaatttttcacagttcaatcttccttttcgttttcatgattttgatctaattatttttgtgtttttgattaggtatcagagagtaagcccagattgtcttcctctcacaaatggaggtaagaagccttacttacgaccatcaccatcaagagcaacaaacgaagacaccaccaccaccaccgtcattaccacaacctcaatcgccggaagaggatttaacggcggatcatgcacaaccaccaccaacaacacctcatctctagacggagtccccaaaggattccgattcagatccactcaacagcagcaacaacaacaagatcctagtcctagccgtcgcggcggtgatgtactgttacagtggggacaacgaaaacgatcgagagcctctagagctgagatccgatccaccaccaccatcacaaccaccgccgatgattcttcgtcttcttcaggtcaaggtaagatacaatcaaacaaaccgcaaagaagatcg

SEQ ID NO: 3412 - DNA, 3000 bp, Unknown
  misc_feature (1)..( 3000): cDNA_ID_3091087_gDNA_ID_1620645_Annot_ID_163204 3000 nt of promoter + ATG
ggtggttggagatgcgtttccagctaagtatatgtggattgatgattggttttcaaatcggttcatataaaatcagttatgttcataatgaagttagatcagtcaaatctatctcagctccaacatatttaacctacatggtcaaaggagtgagccactaccggacctagactatgaaatcaagactttttttaactaatcaatataaaaccaaagatgtcagtattggattactccattccgtgaaaacatgtttagttctcatacacaagtagatagaaccgagggttgtatattcaaattcaaaaacccggcaaataatttacttaagtgtttttagtttctctaatttcattctgaaagtttcatatatatggaagaaaattaaaagtaaaagattgagacgttcattttagaaaaataaagtagaaaaaatcaactggtctttggcttttctttttcactttaggcgagtaaagttgatgggggagggcctcctctttgttcttctcaaattttaggcatcttaataatctaaaaacaaagcaaaatcgaataaactaaaaagagcccataaaattgctaaagatggatagatttgtttcagattttctctgttaaataaatcaacttaaggtattccatatcacacttttccacgccaagtactttcgaagttcaaacccttcttgctatcatatgaaagagatatgtattcttgctaattaatttgtcgactataattttataacccacaacatgaatttcttcaccattatacaacctggaattactttatctattttagatgtttttcttacaaaaataataatttccctttagatcacataccacattgatctgcttccctagtttatctaataaatctgatgagtccttttcatagaaatacatattaaaaatagaaaaggagaaaaacaatcgtaaaggggagattacgaaataattcgataataattgtagattggcatgtacatatactactatctttttgcaggttcatggtgtgaaaacttcgaggagtataagctgatgaaacattgggtacagaaacagaatccttgacagagaagttattaatttctttcttctacgacaacaaaaaaacaaaagtagctgcatgcacaattaccaaagattctagttactttggagtttggtttgtacttatttagtggttggacaaagacaatgcatggcctcttaattaaacctgatggattagattttgattttttagttaatggagcataaaacgttagagtgacataaaggtacgatgtttaatgcagggtaattatatgatttatagctagtacataaattccacccgaaataaaacaaaaatcgattcatgcgttcgacaaaatgataagagtgagacagatggaaatttaatatattaaaataaagtatttcagcaacatgtgatattgtgtgtttcttaattttatattttacgatttctaaggttttcttaaaacccttccaatatttttttgttttttttctttcttaataatgttttaaaattattttgctttattattttatttttctaataatcgaatagaaaaaataaatttaatatggttgcctttaatggactgaatagacattaatcacgtaagaaaaagcattgatcttcaaacaataagcttaaatagtagttattttttgattcgataaggtaatttggttttactttatttgttgtttattaaactcacaaattcattcaaatttggattgcttaagaatgtgtttttcatcttagttcaatttattcaaatttggatcacctatgtagaggatttccatatttctacaaagtacaaatcaaaaggggaacacaacaaatttctatgaattaattatttattaaaaagttatcaacgaaaacgtctcccaagcgtatatacaaaattagcatatgccataggtaaatttaaagcttgaaagtatcattttatttgcaggaagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 3413 - DNA, 3000 bp, Unknown
  misc_feature (1)..( 3000): cDNA_ID_1841067_gDNA_ID_1620645_Annot_ID_163203 3000 nt of promoter + ATG
acaaaatctgatagattgacgtcaaaaaaaaacatgataggtgtctattaataaataaaatgtcgatgaacaagacatcgaacatacaagtattgtgatgtatgtatatatacgtgtgttatatatgtgaaaaatgattaaatgaatgatatattgatatatcataagatcttgtataatgagatggttgtccattgttttgttcatcaaagacaacagatagtgaaggcaacccatgtgcatgtacactgtcatcatggccaccagtgtattaccatttcgaaaaccttataagttgtattcttaattaattacgataaataaagatagcataatgcatagttattggaaaaaaaagatatataaatgcagccgtcaaatttgtttttattttgtcaacgccgtcaaacatatatatacatacaagatcatgtgttttttacaagataaaaaatctcttaatttttatataaaagactcttagcaacctaattaaataagtggatcatcttctgattgattgttaaattaaattaagttatttgatgagtacagaactattaagaaaatcattgaaaaataataattataatatcgtcgtgaaccattgaggttcgttattttgttctctttatatgaagtgaattaagagtgtaaaccatgtttgatggcgatttcctagtttgataaagatattgagggtgggatgtttgtcttgtactataattaattatctgtaatcattttaatttaatataatttttttttgttttttagacagcctaatttctttcaaacagctaagccacgtgaaatactttccttaacttttcagtaagttttaactattttgatcattcggttttaaataaaaaccagtggtgtcaaactatcaaacctgatcaaatagtttcaaacctattttttgactaaaatcaaatccacaatttggttaaaactaaaaatatctcttcatagaaggatggaccattgaagaatactttctcttttctatttttatttgatttagaaaatcatattcattacaaaaggaaaaaaaaaataattttttgtatcctaaagttataacttacaattttccacacttcagtttggtagtattaatttatctatttttatcaaagtttggttttaggaaaaatgtatcttttcatataaaaaatatatagatcttcaaagaaactgaattgggttttcaactattttatcgtttgacactactttgacttatcaaaaagagttcaaaatagaaaaatagaatcgaatcacacgtttcagtgtaagagggatttgatattggtcgacattttaaagagttgttttgtttttttttccaatctgcatggtttttcgttccgttgaaccaaattcaacactttgtataaaccgaatagtaatatactagacgtacgccaataccaaaaataaaattaaaactcaattcacaaattgaatctacaccatatcatgcatatatatcagcaacctagaataatcaatgaaatttaatcgaggataatcaatatccaactcaacgataatcaaaagcctaataatagatcaatgaaatcaaataactaaacatagtaatatacattgatttgtgttaaacagaataatatacattataatagtatgaaaatatgaatataatgagataagaggcgtatatgttacaactacagatcaccatccacaattaacaatccgattggtgcgggccattgtttcgatatttgccaactgtgattgatgtgactgccagctggcatattttcccctcctgattacgtttttaccctttcctcttctgtttcaccgttaattcaattttactatttgtaccgctgtctttcaccttttttaagaaaacccaacccgaaatcataactataccgaaatcacatgtcttcatggtgacgtaacaagacttattttccggttgaatttggtttaacctattgagattgtgctaaccgaaaacagaaacggttatgacgccaacgaggcaagaggggtaaaacgagaaagaggggatggcagaaatcgtaattaacaaggaaaataaagggtggtttcacgataagtctgtctatatgacgcgaaagggtttcttaaattcagagagacaattaatcagtttcgtgtgtttggagaagaagaagaacagatcaaatacgaggagagatctctaaagagatttatcgtttcaagtaagtctctttatcaaactcttaatataaacaaatcaaaacatgaacacgtcgtgtcttcgtttcgattctagatacgattttttagttcatgtgaatgaactctgttttattactactagggttgttcaatatttttccgagaattaccagaggaacaaagttagtgattatattgatgcagagtatgaagtaattatatacataaatcatgttttgttctcaagcatctacgttgaaatatatataagaagtttttttttggtgaaaaaatatgtatgagaagttcatctttcataatagtgaaacaactctctttcataccaaaaaaaaaatttgaaaaaaaattagtgaaactctctttgtccgattaggttaggtttggactcagaatcaaaatacgattagcataacaaattttttggcatggcaattattgtctgcaggtaaaatataccaatagaaacatatttttaggagtagttaagattatgattgaagaaatactattacgataagcataaaattttcttttgctgttcttggtttttgtcgttttatagaacattgaatatgtacttttgttttttttcaccagtagatatgtactatacacacataagtaacatgggtagtttatatagagagagatttgatttttcgtatatttcttttgttgaaaataaatatgtgtaaaatttattgtttattaatttgacagatttgttcacgttgagaagtttaatttagattaaacaacaaaaag

SEQ ID NO: 3414 - DNA, 3000 bp, Unknown; identical to SEQ ID NO: 3410
  misc_feature (1)..( 3000): cDNA_ID_1820696_gDNA_ID_1620645_Annot_ID_163193 3000 nt of promoter + ATG

SEQ ID NO: 3415 - DNA, 3000 bp, Unknown; identical to SEQ ID NO: 3409
  misc_feature (1)..( 3000): cDNA_ID_1820700_gDNA_ID_1620645_Annot_ID_163192 3000 nt of promoter + ATG

SEQ ID NO: 3416 - DNA, 3000 bp, Unknown; identical to SEQ ID NO: 3408
  misc_feature (1)..( 3000): cDNA_ID_1820712_gDNA_ID_1620645_Annot_ID_163188 3000 nt of promoter + ATG

SEQ ID NO: 3417 - DNA, 3000 bp, Unknown; identical to SEQ ID NO: 3407
  misc_feature (1)..( 3000): cDNA_ID_1820724_gDNA_ID_1620645_Annot_ID_163185 3000 nt of promoter + ATG

SEQ ID NO: 3418 - DNA, 3000 bp, Unknown
  misc_feature (1)..( 3000): cDNA_ID_3071141_gDNA_ID_1620645_Annot_ID_163184 3000 nt of promoter + ATG
tttactgttgttttgtttgagttcaaagatttaaactttagtctgctatgttattagccaataggactttatgggttatgctgcaaaaatacattttgagcagaaagatatattttttttacaaagaaagattaaaagtttaatctctcaagtaatctttgctccattattggatgtttttaggttgctactttgccttaaaagcgtggcacgcgcagcaagcaggcgcggctgcagttcttgtggcggataatgtagacgagccattgttgacaatggattcaccagaggagagcaaagatgcggatggtttcatagagaagctaacaatcccatcggtgttaatcgataaatcatttggagatgacttaagacaagggtttcagaaagggaaaaacatagttataaaactagattggagagagtctgtgcctcatcctgataagagagtagaatatgagctgtggactaatagcaatgatgagtgtggtgcacggtgtgatgaacagatggactttgtcaagaactttaaaggtcatgctcagatactcgaaaaaggcggttataccgcgtttacgccgcattatattacttggttttgcccttttcagtttataaacagtccacattgtaagtctcagtgtataaaccatgggaggtattgtgctcctgaccctgaggataatttcagagaagggtatgaagggaaagatgttgtgcttgagaatctgagacagctttgtgtgcatagagttgcgaatgagagtagcaggccttgggtttggtgggattatgttaccgattttcattctcgatgttcgatgaaggagaagaaatacagcatagattgtgctgagagtgtcatcaaatctctgagtaagaatcttttttcttttcctttttagattttaaagaaagagagtcttctttgtttaggttatgaatctttaagacttttttcagatttacctattgagaagatcaagaaatgcattggtgatcctgaggctgatacagagaaccaagttctgagaactgagcaagtatctcaggttagtttcttaatctatctttatttagagttttgaagaaacatttcagaggtttggttactaactgtaactatttcaagattggccgaggaaaccggggagatgttacgatattgccaacattagtcatcaataacgctcaatatcgaggtttggtacttgatattttttcagtttcactctctctttatgaagatgctgaagtttctgttgttattggttgcaattgtgaagggagattggagagaaccgcggttttaaaggcgatatgcgctggttttaatgaaacatcggagcctgccatttgcttaaacacaggtctagagacaaatgagtgccttgaaaacaatggtggttgctggcaggatacaaaagcaaacatcactgcttgtcaagtatgtcgtaaaaccgagcttaccacatcacatctcaccactatattgaatatcagtatcaatttgtttggaattgttttgaaaactagagaaaatgtgaaaatctagagagatattttctagtcctataatacttgaatcttttttgtttgatcaggacacattcagaggaagactctgcgagtgtccggttgtaaaaggtgttcaatataaaggagacgggtacacttcatgtacacgtaagttgttcacacatttcacacaacatagctctcaaatgttgagaccggtttcttgaatagtctctggtttgtgattgagctttgcagcttatgggcctgcgaggtgtactatgaacaatggaggttgctggtctgacacaaggaacggcttaactttctctgcttgctcagtttagtgattctcttgtcataagccaaaccctcccttacaaagttcttgttttcagttcaatcatctctttgttatttatgaaaaattaggactctgtatctactggctgcaaatgtcctgaaggtttccaaggcgacggtttgacgtgtgaaggtacataactcttaacttatcgattaaaatctcgaaagaaaccacataatcatattaccaacaatgtaattatgttttctgatttggctctattgcagatattaacgaatgtaaagagcgttcggtatgtcaatgtagcggttgcagatgcaagaactcatggggtggatacaaatgcagctgttctggtgaccggctttacataaacgatcaagatacttgtataggtaaaattttatcaatcaagatttaagagtactcaaattccataacagtatctaattaatatacattgatgattgtttgttacagagagatatggatccaaaacggcatggtggctcacattcttgatactggctatcgttgcagtagccggtttagctggttatatattctacaaataccggttcagggtactactactctttctgattccacaaaagcatttttgtacttaataacggttttaggattaccaaactaacttttctttggtgttcctattaacagtcttacatggactcagagattatgacgatcatgtcacagtatatgccacttgagagccaaagagctcgtgaagttccatcagaagccgagccttttacactctaatagtatatgaccaaagtaaccaaaactgtcatacacaaagaaatgtttgagatcaattaatgtacatatgaattatactgtaaaaataaaagagtgagatagagttgtgtatattttcatggcaaaaaaataaataatttggatgtaaagagacttttgaagaaaataaaacaaatattgctttcattgagagttgaactcaagacctcccgcttactaaacgggtgctctaaccaactgagctatgaaagcttcttgcaacatattattccaaataaattatatcgtaaactaagagttaaaatcttgaaaacaaaggataacgatcttcgtctccctctgctaaacccattttcttctgttgagga

SEQ ID NO: 3419 - DNA, 3000 bp, Unknown
  misc_feature (1)..( 3000): cDNA_ID_3091075_gDNA_ID_1620645_Annot_ID_163216 3000 nt of promoter + ATG
attgtgtgataatttcatatacagagttgcaaaggagcctgcattagaggaatggtctttgatggctaaaatgaccgacaaattgcatgttccggtgtgttcctggtcctaccgtgacatttcaggtttagtttatatcactggttttcagctggtgactgacttcattatgttttgagtttataggtaagaattgctgtggttgggaaatacactgagctcttggattcgtatctttccattcacaaggtaaacctttgcaggatacatcaatcccaacaactttaaccacaaatctaaggcctttctatgatcgaactccacacaagccatagtctataatatctcactatatcaactgtggtatttaataaaaggaattcttgtgtttgatgatcaggctctcttgcacgcttctgtggctaggcgcaagaaacttatcatagattggatttcagctagtgatcttgagcaaggtgcaaaaaaggaggtatgtttacactttacactaaagctctattacttagacaacatatgaaacgtaagaaactgaagcaaaatgatttctctctgcagaatccggatgcatataaggccgcctggaagttactcaaggtctgaacattctttcattcccatcaaatgaatcctgatttcttgtgtcgagataggctttccgttgataggttttatgtaattattcttcagggtgctgatggcgttcttgtgccgggaggttttggcagtagaggtgtagaaggaaagatgctggcagcgaaatacgccagagaaaacagaattccataccttggtatctgtctaggtatgcaactcgctgtgatcgagtatgcaagaaccatactcggtttggcagatgcaaatagcactgaacttgatcccaacaccaaaaacccctgtgttattttcatgcctgaggtttgttgccttccacattttctgtttgagtttcagttacttcactctatataagtcgcgattatattccgtgtaatttttgtttgaagcaggggtcgaaaacgcatatgggaggcactatgaggttaggctcaagaagaacttattttcattctaaggactccaaatcagcaagactgtaagcacgaagttctttctccacccaaaagagtttcatctttatgcatctttgagcttaacctatatattatgatgcgtttgaatgtttcagatatgggaacaaaagttttgtagatgaaagacaccgacacagatatgaggtatttaagcatccgacacagttttgtggcagctctcagagtatacaaaaaaaacgcatctctttgacattttaagctaaaacaagatgctttcttacaggtgaatccagccatggttccacgttttgagagctctggactcacattcacaggaaaagacgagacagggcagcgaatggaggtaaaaacggatcttttacaccacaaaaaatttcatcttcttgattataattcttgacatttgaaaatacagatcattgaactgcctaaccatccgttttacgtcggagctcagttccatcccgagtacaaatcaagacccggaaaaccatctcctctgtttctaggtgaagagaaacataaaaataatgcaaaagccctcggtttctttcttcgtgtaagcacataccttaactaaaacctttttttgaattaaaaattgcaggactaattggagcagctagtggagaactagacactgttctgctacaaagctaccaagaaaccgtcgttccacgttctctacccaacggaaaactagagagagtttactggaaaggtgcagcgaagaagccagtcagtgttgtgtacagtttatgtgatcgtgtctactcgtgaacaccgtatctgcatcaacaatgacttctctctaaaaaagctatttatccggaatttttaacatggatttcttcacctgtggagggagagagaaggcaatgagtttgtacagtttgaagattggctttttatgagatgcttttcttaagattatgaagtagaagatgaacactaagcacaagcagcattaaaacatatattacctttgtcttttgtaatgggtagtattaaagagagtcttgggattgactctctgtctccgttgctgtgtttcttagattcttatgtagtagtattaatcagtagctttttccttttgctcttttttttttttgggttgttatggtttaaccatttccagagaagtaccgatgtttttccggtacatagtttgatttctctgtatgttaatgtagccttattctcatgttatttgaatggttataaaactagttctctttttacttgtgttttgatttcacaaaatggtgcatctctagaaggtcttgttgtatgtcctttcttgaagttggtgaaaatgcaagtttctcgacggttttgtttaatccgttggacttgtcgtgctaaaaatgtctagtttcttagcgaagagactaaaccaactcaaacaaagcgtttgagacttaagcgggcgtttctttttaagttgttatgggcctagtcttttttggtgatagcgcaggcccatatttaaatgcgcgcgctacttcggttatggcgccaatctggtgaatataatcgtcgcttctctgtttgatccaaatcttttggggttgaatattgtacaccaactgttcgatgaaatgtcttacagagatttcgtcctgattcatttacctcactaattgcgagccttcttgccgtcgtcacggtatgctacctaattggtgttaagggttgtcgtaatcttcaatcttttctcgcctagctctcgttttaggcttttgtaaagtttacttcagttttaggaaagagtatcgtcttctatgagtttgatatagcttgtacttggctcggctgaattatggctctttaacccttccttgggacttttgtcttattggtgtcagaattcgtagaaatttaggtttgctaaagcttgaag

SEQ ID NO: 3420 - DNA, 3000 bp, Unknown
  misc_feature (1)..( 3000): cDNA_ID_2135650_gDNA_ID_1620645_Annot_ID_163210 3000 nt of promoter + ATG
ctgctttttttaacaaaattgtgaaaatcatttgatcttttgtttatttatgtgatcagtttaatacactatatttattcagtcaaaacctgcatttttagtcttgttttttcaactgagtattgattaacaggaatggaaactgattatatattgaattgtaaatgcagcagcagaaacggagaggattgaaaggcatggagaatatggacaccgactccgagtaaattttttgttccttgtttcattttctttttgtatggtttacgatttctcttttgaggaaaacaaatatgaagatgcacgtgtggcttgcttgtgaagagcgtgcgaagtatgccaacagagaaccagcagagcgagctatcgatcgagaaattactctatttttattttaatatttactcttatttttccttcttttggtttttttttggggggttcctaaattctttttcttttgtttcgtgtacaaaaaaaaatggtggagatcccttcttcataaatcataattccccttttataattatgaagaaaataaaagttctctgtctctttgaagactctttattgcttaaaacctaaataaaattcgataagcaagaataataaagtaataatgaatcttataatccttaaagaagaataatcaatttaatgaaatatttctctgattacgtctaaacgttttgacttcgttatgttaggccggaccggtccggtctgatttgaaccggagagggtggttatgtggattttaatgtctttggccttttggttgaatcaatttttgaaaaaccctcgcttattctactaacccttttcttcctaacctatttgaaatacaattttacccttctcttttactttttttaattttttatttattttttactaccaaataatttattaaaatcaaccaatcatacgcattctctctcttatctcattaatcacttaaatctacaaaaaaaggctggacaactgaaaccaataggcacaactatgttgatggacttctacgaaaacatataattacatactgtttttttttttctttttgattttcaagttatagtcaaaaagacttcagtcatacgcattgcttataatggatactattaaatttttttgtcgtatttatacaaattaatatgttttgtattggtacaactaagtacaacccgcacaactaagatctattcactttgctagttttcagaatattataaaatatgaaaatttaaaacaaaactaagaaaacttaaataatgcatacacaatggtaatgaaattacataattagtttttgacaaaaatcatattttctaaattaatgaaactcttatcacaaaatctaacattcatacactaacaaccttatactttcatggttactttgtatattttaacaaaacaaattaaaaattttaaacacttgtatttagataaatataaatacaccgatacaaagtaatggtattttgatgggggaataccatatgttccacccataaaaattagttttgagttgataacaactagatttattatattctcgatattgtacaactatgagcaaaaatgtgcaaccgagtacaactgtacaactatgggcaatatatttttcagatatttatagatattttttaaatatttgtagataatttataataaaaattagctttatttttttgtgataaaaatgtttagttttttttttgtcatcaaaaatacttaattttatagttaaataaactatttttttccctttcaaacttttttttttcttctcaaaacactattgtttaataaaataaatactaacattcataattttttgtgttttgttttggatcaaaatacgttgatgtgtacattcatatttattttggagttttttttgacaaaaaatcttagattcatacataaactaagatacatagttttacatgagcgtaccagttgtacctaaacgcttagatgtattattttaaaacaaaaagacagccgaacaattgtatataaacccaaaaacccaacataattatatctaaaaatttagccacaattatacctaaaaccaaaaacacaacactacgtaataacttaaacaagacgccttcttcttctctttgtcattctccttctcaatttctttcttctcctccccttttcttctagtttttatcacaaactatctctaaggaacaaaattcaaattcattcgaatcccaattgtaatcctaaaaactaagtcataatggctattagaagaggcttttaaggaacaatttcgattttaaatcgataattaattcaaatttgaattgtaatcataaaaatccaaattataatcgaaatttcatccaaaatccatcattttcaaacaaaatcaaagagaaaaaagatcaaactatcaaatctaataaaaaataaaaccctaattaaacacaacaccatcaatcatcatatatagaatagagatggatttttggattgatagaaacaaatgaaaaggtaaaaaagatggatatttggattgatagaaagaatgaaaaggtaaaaaggagacgaaagattatatatggaatagagagaaaagagtaaagagaagaagaagaagaaacaaatcaaaaattttgtttttgttgaattgagagaaaaataaattgaagatgaaaaaaaattgatctgagaaattagatttttttttctgttgagaagaaaatatctaacattgttatggatttacatctaacatagagattgggttataaataagtgaaaaactctagttttacttgttttttactattattctgaattgaaatagataaataaacatatgttttttataagggggctaactagagaatgtttgaagctgagggggtggagtaagattaaaatactggttatgttacgttataaattaactcatcggctttaatttaaaccataatcttgtaagaaagaatcaaaaatctgaataaacca

SEQ ID NO: 3421 - DNA, 3000 bp, Unknown; identical to SEQ ID NO: 3405
  misc_feature (1)..( 3000): cDNA_ID_3071145_gDNA_ID_1620645_Annot_ID_163183 3000 nt of promoter + ATG

SEQ ID NO: 3422 - DNA, 3000 bp, Unknown
  misc_feature (1)..( 3000): cDNA_ID_1820684_gDNA_ID_1620645_Annot_ID_47582 3000 nt of promoter + ATG
tcaacaaagtagtctccatgctcatctcgatgtattttgccattatgttcaaaaacttgtcaatcagttcttgacttggttacacaaaaaatgatattattctcatatatctaaacatccataagctttttctttgacttaagagtgaagaggatttaataataaaccgtctgctatattatacaatgttttgtatatatttcctataatatgaaagtattagaagatattctttcaaccaattttgattcaaacaactatttaagaagctaattctcccacaccattccataagttcataaaatatgtttaactggacacaagaatggagtatggtttgtgatagaccgataaaagtcatcatcccagaaataaatgtcaggattacatatcgaaagttaaaaaaaatatacgctaaagtaatagataatgtgcttggaacaagtgccatttgcttagaggttcgttgttttttttttttttttttttttttttgataaacttgtaaatatcattaaggaatgaaatgttcaggcgttacaaaaagagtttgacctatactttactaccttgccaaaaaagaaataaaaaacaaggtggcataaaagacaaatgagaaaaaaagaaatcctcattgaagccaaagctgcatcaagcttgcaaactttctacggtttctcctagccgtgattgagttacgcactaagcgatcaacttctctgaaaaccatggaggagggaatgacttgttggttgtgtagaagattgtttctctgcttccaaatcccatagatgatagcatgagctactagttttctaagcagagtaggcgaacgatttgaagaacccttaacccaagatattagtgctgcccaagaagcaaaaaccatggacgtcatgccgaggcggctctgcgccatcgaaagactataagggcaatttaacaacagatggtctctcgtctcatcatgcacattacaaagacaacatgatttgggaatgttcattccccaagccacaagacgcatacatgttggtaacctatccaattgggcaatccacattaagaaaacaacaattacacttatattcataggagtaactctcagcaagattcttatggttggtacattgatggggttcggtgtaaaggattctcctctgcaaaaacttggtctgttttaagacctaaatataagttcgttgttttctataaatataagtgtaattgttatactttagcaagaaatataatttcatactcttcttctccaaaacatttcaagcttttcgacgaattgagaacccacgtgaaactatgtgtgaatcttatttcaacatatctacacaacaaaatgttatctaatttatcagattttcttcattttctaatgctaatccactttgagttcacgacgacgatgacaacaacaaaagcaaaactgcattttgatatatgccattgccaactaattaatgcgataagaaaatcacatctaagaataaacacgatttaactttagtagcaggctactttaaatggaaggtttacgcgatagtttgacccattattctgtcctactttatattttcttagtcttcttttgttccatactctaatttatctcttttatattttaatttagcgtagtgtttagttttacttttgtggcagacaatatatttctgtgtcaaaaaattaaaagaaagaacaatctttttccatttaaagttaatcgagggattatagcaacccatttcggaagacaagttgcttaaaaggactagggtcaccaacttttaaaaaaagttataggccatttttcttttataatagtctaataatactaaatcaacagtcattttagtagaaactgcctatctatctatttgacacataagcaataccccaaacttttgcatgtttagaattttctcaattaattaattaaaaaaatgtttcgaaagtttatttctccatctcctccacccacaatcccacgttctcttaattaggattcgttgacaatacttttgttttcatcccgtaaacacataaataattaattagtttctttttcttcttcttttgagatactatttgctgttcttttgagatactatttgctggaatttggatcaaaattatacttaaactggattagcaattgaaggtaattaaacatgcatacaaatacagatatattcaacgacaaaatctcttccagatatttcttattgatattttggtctatctctttgacagacttttatttataagtgattcaaaatttctagagttcacatgtatttattttaggggaaatagagaagattgttttggaattgtaatggtatgtgcatccgatcgtttatggctattggctaacaagagaaactgctaatatccaactaaatctatgtttcctctgtaagtatataaattcagtcattatgtttgttacttgagttaattcctattatccatatttgttcaaatatatgtatatagataactaaatttgatatttgttatcttttaaaatatatactaaaactaagtccctgcatagcaggagccataatgctagtgattatatatgaggaagggtcaccgatgtttttacttatttactaaaaatgtttatcagaaaatattataatataatatacatatttttgaaagctaaaactataaaaggggcatcttttattcttgatttgggtcactatttaagtatttttattggactagtttttggccaaatccgtcgagaatttttttaaatttgtctccttcccaagcgagatttcaactatagggcttaataacgcaaaatctttggagaatctaaaaattcgccacttacccaaaacccacttaagagaaccatctattttaatatttgatttgccagctaaaacgatgcgatcctaaaccctataaaacactcagtagagatatgctcaaatcacaccattcctaaataagcacaatatg

SEQ ID NO: 3423 - DNA, 3000 bp, Unknown; identical to SEQ ID NO: 3413
  misc_feature (1)..( 3000): cDNA_ID_1841067_gDNA_ID_1620645_Annot_ID_47584 3000 nt of promoter + ATG

SEQ ID NO: 3424 - DNA, 3000 bp, Unknown; identical to SEQ ID NO: 3412
  misc_feature (1)..( 3000): cDNA_ID_1820677_gDNA_ID_1620645_Annot_ID_47585 3000 nt of promoter + ATG

SEQ ID NO: 3425 - DNA, 3000 bp, Unknown
  misc_feature (1)..( 3000): cDNA_ID_1807228_gDNA_ID_1620645_Annot_ID_47590 3000 nt of promoter + ATG
aaaatgttgaatcactgaagtacttttctaacaatgagaatgacgactgatctttatctctatttcaaatagcattgttctggtatatcttttgaatgatttcaaccataaatattctagtaacatgtggaattctaactagctttatatatatatataatgtatattaaatacataatgtatttctgtactgtatgcatatatatgttaaatcatgaaatgcaaacatatgattctctttagttattgttattaacagaaaaaaatttacattttcagataattgtactcttctcatgtctttaaaacatcatattagaggaatatttatgtacggaggttcacgtaatatagtgtataactgtaacttttcccaaagttttataatttcaaaaccaaaaaaaaatggaaacttttggttggtagatttttttaaaaacaaatctgccaaatcgatactttctttgtttaatggaccagtgataaatagatttagagaaagaacatttttaatctcttttacatttttaatagttagttccacattaacatgttctgccaattaatttgggggttaaggactgttcttgattcaaatatattttttgtttaattgtttaataaatttttggtagaagtttacttttgtaccagtgataaacagaatagtaattttatattttacataaaatttggtaggcattaactattgtaatcaaatttccttgataagcacaacaagatcagatgcatgtggaccctcatgatcattttagcttagatctccaaaataccataactgccgctggttattattctatgctatttagcatttgtttctaaatcgtttttatagttgacacttaacacatgttgacactactttagtacatagaccatagtttcaggttatttattgatttttaacaatgtatattagtatgatttatgaaaccatatatatttctctttcaacagaaaacacttattgtacatgtgacatattttgtcacatcttcgatagaaatacatatttttaataaaaacaatatcctaattcctaattaagaaattccggagatccaaggtgactgagaattcgcaatagagtaccatgaatcataaggtctaaaacttgcaatatgcatcggccagaaaagatgacacaattactctagcgtttgtaatgatatcaaaatactaaagaaagatgggataattatgcattttacgcgctagaaatatgtgtagtataattattttttggatttactgttgtaaaattcgtcagaaatgcaagtcactaaacaacagcaacaccacagttgtattgttatatatcagtataaatttatattcatatgatataaatttagcttctagaaaagtagctagtcactaatcaataaaaatgcataaaacttacactatcaaatgatttcaatttgcataactacaactcatggatttcatggtaaagaaacttagaagctactacaatagaccgtggactatttctaaacaaatgcaataatgaaactgtttaaaagctattaccaaattttacccgcaaataacattatatttgtttctggagccaaaattaaaagtccatttcctatcttgatttatgcttgtacccatactatatcttcaatgtttcgataattagtaattactccaatataaatatatatttttttaaagtttttgtttttactattactttttttatgtttaaactttttaactcactaatcttttttcttacaaaacctaatctacttttactctctaaatcggtggactatatatatatatatatatatatattctcttcttctatgacaaatatttgtctcatttatatttactttgactaatagcataattacacataatataatagcacaaaagataacaattcacttgtgaataaaaaaaggaacgaccgcatcgcatgcattagttaataccgttgctggaattgcggttcacagggctctataagtcccgtatccataggatccgacacgaaaatatattattttcctatatataaaatagaaaataaagttgagagataacagaagaattaaagttgagaaaattcgaaataaaatgataaaaaaaacattaaattactacaacaactcgtgggtgaaaaatgactttaaaacatattttaaaacttaacaatatcctattttaaaatttcaacaaaaaaaataatatagatatgaaaatccgagcattacagacaattagcttaggaaagagaaacatagtcctaatcaccaaatgttaaacacagtgtaagagattttgtcttctttcttttgtctaagattttaaaacaaaataaaaataacaagagagagagagagagaaagattagtttaagaattaaactgctaattaaatacgaaacagtaatcttctcttcaaatgcttataaaaaggcccttcacaatctctcattcaattcacacttcacatttggatatctctctaagtctctctatactttcatttctcgtttcataatattaggtaagtctaattaaatatctcatctccttaatttttttattcgctcactaatctctctacacctttcagctaaacacaaaacaaccaaaagctcaggttcttgtgttttggtcctctgtttatttcttgctcaaaaaacaaccaagagctcacttgctcttaatcacaaactgagacttttctcagtcttcctctgctttaactagtttacttgggacagattctgtataacataaacttaaatcaggacatgtaactgaaacatgtcaagtttctaaatttaacttgagttctaaaaccgttaacacaaacacaaagctgtatgctttcctctctgtttctatgctctgttttccattttttgctctctgtcctctcttgcttagtaaggtctgtttttttttttgcaggaaacttgttagtgtttaaggaaacaaaaggaagaag

SEQ ID NO: 3426 - DNA, 3000 bp, Unknown
  misc_feature (1)..( 3000): cDNA_ID_1825700_gDNA_ID_1620646_Annot_ID_47591 3000 nt of promoter + ATG
caaaaccattctaaagacgcatgtgatgtttttagccaaatggcatacatcggttataattgacatgtcgatatactataaagtatccactcatatcttttgtttaatttttttagttctttccatagtttctgtaatatttcgcgatcatagctataaaattttaatcaaataaaatcttataatttgatcatctcatttatttttataaagtatatgatgctgtatggggcgcagtcactgaatctcaaatcttttacgtataaatcattactgttttattgataaagtaagctcagtctttcgcacgacatcaagattttatacgatatagagtttttggtaccacgatcgcaacgtataataagatagtactgtaactaacagtcacgtgatggaatttgaaattagttaaactctaaccaattaactatacgtacattttacacgtggtaaaacaaaactaaagcaagaagattcaattgtttcttttcttcacgcttgtgacactttataacccaatagtccttgtctttatagtttgattacttttgtccgttagtgttcaccttaattatggcgtttgtaaatttgcggagatggaaaagagtgaagtatctaatcttgacctacatgaaaatcatcaatccactataataaaatcctctagaccacacttaattagtcaaaatctaagtttaataagtgacatagttatgtttaaactaataaatattaatatatttgtcaattaatgtctatatatcaagaaaatattatggtcctaaatattaatttatagattttgtattgaatatatatttaatagtatttctttattagaatcatttcagttatgttctatgcaatgtgtctaaatattatattttattgcctctattacctatatagattttatttatataaatatatagtaattcacaatcgtgttttacttaatccctggatcccacccgcagtttcgtgtggccctcttcagtcttcactcatcagaccgaaagaaggaaaaaaaaagagagttaaaaagcataaaacccattttccaataagagttttctttttctcttcttcttacgtgtacgatcccaatctaacaacacaaaaagggttcagttttcttatctccattttgatcatgtcaaaaaccccacatgtccacccataattcctcctcagtctttttataaacaaaccattttcttgcttttgctcgcaaaactttaaccttaaaaaccaaaccaaaaaaaacaaactaaattaaacttatggatgtgtcaaatgagacagtggaaagaaccgatctccggacacctttagtagatccggcagacacggaggtgaaacctctaccagaggtcgggctcgagagcgtattaacggagagtagcttgtcataccggaggcgtgtgtacttaggagcctgtatagagttgaaagtacttttccggttggcactaccggcgatacttatctatttagtcaactccggaatgggtatatccgctcgtgtcttcgccggtcatgttggtagtcaagaacttgcggccgcgtccatcggaaatagctgcttcaatctcgtctatggacttatggtatgatttacgttaccgtacccatatgaatatgatatgaggagacatgttggtattatatatgaagatttatactaattattattttcatttgttataagcgttatcgtatatttagtgaagtaaatggtggagtaaattataagcattataatttagttggaaattaaggattaaagattttgattttctcgttttgtgtgttgacataacatataaaagtactcatatattattaacctaacctaaatggctaaaagcttagcaaaccacgtttattttgctaaggataacagcctgtaaacgatgctgtatttttctatcttatattcctatatcctaatttgttcttacaatttaatgattacataccatttattcggttcttttgtcttatgaatctttaccattttccttcaattttttaatttttattttggggtcaactactaggcacgattttaattttaattttcctactaggcacgatttcttcaggcgttgaatttactcgtattgatatataaactattaccgccatggtaactatgaatgaagttaactactcgatattcttagggatagaaacttacgtaatgcaactaattgcattaacacacgatcacgataagagtttttactagacgaaatcactatggtgagtttttgtgtgaaaaagttcaacttttggattttgtaagagaataatctttcacttccttagaattccgtgaaacgattcctttttcttgtcagctagtataacttaacgattaattgtaactgtcgttttgcttaataaatgatataattgcattttttgtcgaccaaaataaataattttttgtagtatcgtttgttttgcaagtcattcttttgaatattattgtatgcttatgatgagtagtcaattaaatatttatgattttctctttggattatagtgtaaaactgagctttctaatttttgcccatgtgagcaatttgtttgtttacctaatattaggactttctactgttttctcttactttatactagaatttgtaaagatcttctacgttagatttgttttcttttgtgtgcaacacgttctattgtttaatatgaataatctacaatatgtacttttttcttggatcatcatatcgttctttgttttattgttcatttaagaaaggaaaaaagatataaaaaaatagatacccattttcaataaaactttttcttttttaattatgtgtacaatctctatttataacacactaaagagcttcattttgattatctcaaaaaaaaccacacagatccttaaatctccaaatttcctcctcagtcttatcattatagacaaaacccttttctttgtaaattttttcccaatctatg

SEQ ID NO: 3427 - DNA, 3000 bp, Unknown
  misc_feature (1)..( 3000): cDNA_ID_1825696_gDNA_ID_1620646_Annot_ID_47593 3000 nt of promoter + ATG
tgatgattgagtttgttgagataagtatttatagcttaaatgtttgattgttaatattaaaaaatggatataaggctcgagggaaaaagattagatttgtacggccatgttgggagagaatacaaaggttgattagtctttacgtagaaggtcttgtttttcaaagttacgttgtaattagttgaccaaagctgtttcatcctcatccacttcttgtaactgatttacttccaaaacagaacacaaaaaaaaaaaattgtcgacatgaattacttcaagtaaattgcatcttacgtacaacttctatattaagatattggataacattttatttttcgtttgataatcttatccgaactcatttttgagattacgtgaaaaagtgataagatacgaaaattgaactctaaagttagataatacagtataaattcgtcttgaaaaaatgatgtaaaaagtaaaaacaaattagatttttttttgttgtcaacgagcaacctatcctatgaccaaaaaaaaaaaccttcaaactttatccctaatatttgacttagtgaattaatgaggaccgtataagagtatattcagagatgtaccacaaaaatttagtgtccactagctttttggtaatatataatttaataattaattataactttggaaagaaaaaaaatataaggggaaaatatcagttaactgatggaagttgatgggagtggacttaaaagttgcttagttcaaataattgtctattatgtcggccgtgcccttccaaagacttgcaacttacaacaatgattttagttgttttatattctaattaacaaaatattagttgttggaaatattagtattttttttgataaccattttggtaatttagtaactttattcactaacgttatattacgaggttgggacatgatggcatcgtcaaaagatagtgacttcgaatctcttacaagatagttaaataatatatttctgcgtggttcaacaccatggtaacaaaattgtgtatcaatacctgaatcaattttttcatggagggttacgccaaaaatagtctaattattttgtatggaaaatatgtagtactttttcacgtgataaaagaaataaaagtatgaaatggcgtctaatctatgggtaaaaattttggttaaaaaaggaataattatttttgtttctttttttgactcgaaatatatttttgattataaaagaaggaacgtgtgaagtgtcacactgtcagcttatctatttgcatgggaagggcatcgctttttgactttttcttgtcttactgattcctttttcacttatataatctctttctcttcttcctccaaattcacgtgtacaatattgtacagtatattgaaattttggtcatcgtacttagttgctctgcgtatgaacagaaccaggtcaaaactacgtattgcaaatttccaccaagaaaaaaatagaatacggtcaagtattttcatttttctcgtccattattttcatccattagatatacattcaaataccaatagcaagaattacgtacagtataactaattctatatggcattatgtcatttcttttataggcattatgtcatttcttttataggcccatattgagtaactgaaataggcctgattcacagttaaagtagtgtatcgttggggagcccgtttcccccaaagagaaaaaatcgttatataccaaacattgaactaaacaaatacgaatcgaccaggaaaaaaatgaactaaacaaataagaataagtcaataaactgttcaggacttcatgcttacaaaaggaattgagtatttttaaattctaatactagataaactatccgtgtatacatgcagattttgctcataatattttctatctcactaatagacaatcaaaatttgactaatttttatactttctttacatcttataggattagaactagatttaccgaaatttatttatcttctcatgacaagttagttgacacatggttttcttaaaatttgaaatattttttttgagaaagttcgtcttaatatatgagagatttgacacacatgaactgataaaatccaatcaatcatatttcatttgttaatggcttaataaattattacatatcaatcacttggacaatggagtatgggacatgcatgtcacgtgtttatggtataagattatgtaatgaattcgaatatgaatagtggaaaaacgataagagtttgagtaatcaattgattaataaaaacactaataattgaggcaaagttaaaaagaaggaaaggacagaacaatcatggaccacatgtagactttgctagtttagttcgtcggtctccatcgttagccattcactctccaatccaacaacaccctcgtcgagtccggtctcaatctgcctattgatgggttcagattagaccacgtgtcaacgttaatagacaaaattagttggacctgcttgcaatgagtgaacacgtgtcgaacagctgaactgcgacatatcttgtgtgctttcccatgcggagatatatatagaccccaccttcagctacagagaatgaaataagccaattatatgtttatgtaattttgtcgaatctgcaccatctctttcggatacatacaaaaataccaaaaactaaattcgggggaataaactatagtttctcatttcaaatctttttttcatgtaaactcaaagcatttgccattcatatatttcacgtatgcttggctaagcttaacgactattgtacatactaggacgtgcacaaatctctaaatggtaccatgattttagttatacttcaatactgtgaatgagggttttaaatgacaagaatatcagaagtttcacggactatatggattaatatagatttgatataaaattccttacttatcaaaattaatcatcgtgtgtctcacaaatctatattgaagctactgtagaaatgttgttagaatgcatg

SEQ ID NO: 3428 - DNA, 3000 bp, Unknown
  misc_feature (1)..( 3000): cDNA_ID_2027168_gDNA_ID_1620646_Annot_ID_47596 3000 nt of promoter + ATG
ggaatttccatcgatgtcacagatctctctcctttagagtgagtgaggagataacgtgtgagccacgggatccgaattaaccacaaaagacacaaaccttgtaccacaaaagaaaagccccactttgtctttaatcggtttctgttacatgatatgtaacttacatccagaacattggctcactggatatttgtgatgggcttcattgggcctttcaggcccatagttattactcaaattgggtatgattttgttggttaatgttgagatttgtgtgtttgggtggttttgtctcatatctctcttaagagggaagtgtaacctactaacctcctcagacaatccacacagtatctattgattaaatgatggctttaaatctactgaaagtaaaaaaaatggttgctaaattaactttacaaagagatgaaataaagctgtcacatctataactaaagagaaatgtgttatccgatcaaatcttgttcttataatgcttaaatccttcaactagctcatatcacatggaatttatacggtccttggaaccttctttgctatatatagcggttgctacttttaaagaagggaactagaagacatggcaactacttcagagttcatattcttcactatatcagtatatctggaaactaagaatttgagcctagattgctttaaaagtctggtgagagaaatatattagttaacgttttttttgtcttggtattgaatcttgcaggccccattgtgaatgcaacgttgaggacacggatgagtacagtgtccatttgtcagatgaaagatccatgattaactactaacttgtcttaattcaattttgataaccgggtttgtttggtttcctatacactggaacttaaccggttatcatcaccatgaacacaacagttttacatgttacacgtcaatttttagttagaacttgctaatcagtatttagtgtttagcactcgtggagccactgagctagagagtgacatcactagaaggtccccagagactcatttggcgacacttggataaggaaacaaagtgtcggtggtcacagttcattcatttttaattgaaaaaatcaaatttgttcatttaaaaaaaaaattggaaaatccaaatatccaaatttgaagtgaatttgaatctgcagattcaatgtgatcttggtaaaagcaccgatacttcccccagatgaaaaaaaaaaataaaaaaaattctaggattaagaaaagaagaagaatcgaattagtagtaatgtcctctcattttatagctctgttacatatttatttagttttaatcattctaaacaaaattagtcctttgttactgaaacgagaaacataatagttccgcaacaaataatagtggagcctttagcttttaattagatatctagtttacctctatgaaaattagttaagaatatgaaagataacataatttcagatttttcttaattttgcagggacatattagtatacctatttaccttcttagtttatgtgaaaaatatcaaaacaacgtttatgttaaaacataggaaaagttcaaaatgtactctaaactaaattcaatatttaacttcaacccacaaacagataaagtatagggaacactcaagagtgaagagtggtgaacgtgttttattacatcacatggatcaagattcattcaatatttgagaagactttacgatacgaatctactgacaattactacaataagtaaaatagttggatatataaataactacagaacaaaaagtaattgaatatgtacaaatggaattatatcttgaactaaataatcgaaatgtacttgaaaaaataagaatccaccttgagttcatcgaaaagaaagattccataacctaaaaggagcggtttatccgttgtattaaaaatttaacaataacaaatgtttcaggtaattgcaaatcgacccatgaatatattttgactttagctattccaccccataaatattatttgttatagccgccccctttgtgtgtattattaacaaaagaagcataagttttttttgtaagattctttttagtcataggggccactgatgccactcaatgagaccaaaatccaaaacttagtgattggttttttgtttgacaaaaaaatgtgaattgtttagttaaccaaaatactcttctaaatgaggtaaactatctaacaagccatccacattaatatctccaacctaaacttatttattttctcatagcactgtgtaggactctaactagcatgatctatggtcactcacccgtccttcgaaatagtaacaaagttgggttttagatttcttaccgaaattaaatttccagtagaacgtctagcatacatttgagtaatttcaatgaaactccacaaattaatttttatcagtttggaaaatatatgttttggcaacagtccatatgaaagttcatacattaaaaaaaaaaaacgtagaaaaactttgttattttttctcaaattcaaacttacactaatttagctgtcgcatcaattaagtatgatttttttttctgtttaaagcttataatgtgtctgcaatttgataaataataaaaaaaattacataagtttcttataataagtctacgcttttcaattttcattgaatatagattcttaatcacgactgaacggaacatacaattattgtagtcttataataatattgttggtttctcaaagtgaaaatgaataaagcttaatgatatatgatctgtcacgtacttaaacatatagaaacagtagcaaattcaccaacttgcctttaatttactataaccttcaaattaagcttcttttattttatgaaaaataaataaagaaaactccatttccctttatttaaggaggctgcattgcttgctcactgactcaactcaagagtggtgtagtgagagaagaaagatagagaaaaaaaatgggaggcaaaggtgtgatgatg

SEQ ID NO: 3429 - DNA, 3000 bp, Unknown
  misc_feature (1)..( 3000): cDNA_ID_3071158_gDNA_ID_1620646_Annot_ID_163256 3000 nt of promoter + ATG
tcactactcactatatatatatagaaaatgatatcaagagattcaagcattacaactaagcatatacaccacgagaaaatcaaggtttcgatgtttgttaaaataaattgatccataattcacgaatatttttcaagcttcaatctgaatttgtgttttttttaacgttaatccgaatttgttttgtgtggaaagttctcatgttttttcgatttttgtttttccggacgtggtaaatgtatggaaatgaggaaagatgttcaagaaactgtagaagcaataaaattatgggctgaactctacacaataaggcccttttcaaatagtcttcagctttatggaccaggctacacaaattcatcacatttgaagcaattggtccgatgagtttttttttcattcaatgaactttgtattgttttcgtagttgatttctatagtctcatttgcatttcctcgacaatgactttggcatgtgctcacttgatttgatgttgtgacttgtaaaatttatgtcacagtcataagttgtcatcagttgtgttgtgtatttatcgaaaagaaaacataaaactatggtttgagatagaattcatttggagctactaattaaactgaattggaagatatacattatacagagtatagaaaattcaatcgcatctttcgtttgtccttctcttatctttcagtgattttgatgcatcaacctacaaaaaatcgttaggatttacataattgaaaacttgtaacgttaatttaatcttttttgctacgtataactgtctgacttgattagctcaactactcatcaaaatttaagttttccatgtgatttataacaagtcttgttccaaagaagttaagatttcatgaaaatatatatacataaatagttaaaacttacaacagtaaccaacacactgaagttttttttctatataatgctcaattataaaatagatatacgttatttaaaataatccaatacaaggtcacgggatttcattccatggaataaagtctctctttcaatacattaaaaaagcaatactgattcttcctaataaccctcatttaccccacattgagttcatgtgtttttttttagttcacctatacaatacaaaagataagaaattatacgatatataaaatgtaaacgaatgaaactacatgaatgtgacaaagtaacataaaactacacgaatttatggtttccagtgtccggcgaattcatttattggtaagacgtaagagacaaattatatgattctaccattcaaattcaaatatcgttctaaactttgtataaaaacatatagaatgaaaaaccaagaaaaatctcgttctaaactttttttgtatcaaagatataatgaaaagatgaataaaatgggggaaaaaagttgatttaatatatcattgatgttctattctctgtcaagaacaagcgggcgtataagctattagccagattggatccacacatgatttcactttgagctttaagtagagtctcttttaaatgtgtattttactcattgattaacatgagaggaataatagttttcataagagtacaaaaaaataaagtatataacatgagaacaggccaaaaggtaacattatgctcgtggatttcatgagtggacaatactatcttttactctatgtagtctattattagtcgttttcacgaaactatcccacatttcttttgtccatctatatcctgtcgttttcctttttgctgctatatcattttttagaattctctcaaaatttacatttttttttgcaaaatacaaccttcacgtattcttttgtgtgttctaaattgtaactctgttttataaaacctcaatttgttttgtgtagttgaatttactagccaactaattaagccgagtgtttctaatcgtcaaatcatttttcagaaaaaagtcagccaacttactttctcaccaacaataagccaatttggttcttatatactcactcaatattcaactataatttacaaaatacttttactattatgaaaaaaactcatgcatagtgtcttcaatgtaagtatgtcctacaaaatgttttagagttggctggtcaataaatgatagattcagaattcgtaaagatgatgatatatagaaagagcttttacagtagcaagtacaaataattgataaccaaatgggtagaatttaactcgaagacgtggcagagaaggtgtactataaggaatttaagaacacaagtagaggattaacaaaagaagaaaaggctttggaaaaagcaaaacaaaactgatagcgaaagccaaatagcccaaaaagaacgcgagtcaaatgttgcctcccaaaatttactatttttttactctcatattaaaatcactctaaatatacatagaaaattgttctccaaaacattaaaatatgttgaaaaaataaaatgaaagcaaattccaaactcccaccgacaccaacacaaacacacaagtcagtaagtcagattcaattatcaaatatggtcaagaaattcaacaatctcatatcaatcacacaagataaagtataaaaagacttatataaatgattgaatcagtgatattaactactattaacaatcttgtcttatgagttaaatgaagtcttaaatacgttttaccaattaatgtgaatgaatctacggagaaacagaggtttttagtataataatcataaaataaacctgaattaaaatattatatactaaaaaatagtttctctctcttcataactcagagcaagcttggaatcaatctctcaatctctcactctctcactacctatccttttctttaatggcgatgtctctaactactactatccccaacacacactgttactcttcttcttcttctctgtcactgtctattctctcttttggacctttcatggctatgtttctctgcaatggaagtccaagctcgtgatcaccaacaccgacacgcta

SEQ ID NO: 3430 - DNA, 3000 bp, Unknown
  misc_feature (1)..( 3000): cDNA_ID_2049766_gDNA_ID_1620646_Annot_ID_163242 3000 nt of promoter + ATG
atctggagaaccatctagtggttgaggaatggttccatcaaggaaaccaaactttttcctagaccgcaacgccgtcttgaaaccacatgcccactcttcatagttatttgtcttcagtatcggatgggagatcacagctcccgaattgtcagctgccgttaagtcgtacggcaaaattgtgcgtcggacctcaattacagatggaggtggtggtggagcatcagccatagcttcagagaaaactcacttgaaatactcaattcgaaaaacccagattgcgctctgataccatgacaaacttaagacaagatgtagtttggtttatgttgtcttgtcttattaaagaggcgttaaaaccttacttatacaaagcaaaagatataacctaaagtattgcacaaaggaaatgactaaacaggacaaatatatattgttgactaagctaactaaaatattgacgagcaatagcttcaacacttttaatataccaaccaattaatactggaccctaccttcatttttactactatggttatgattgtttgcgagtaaatgatttgattaatatgtattatatgtatgtcgtatgtatctgtaggtacaagaaaaagttggagcttgactcgagatttctatctgatttttatgacgaaatcaaatgttgtgttcttatttaaagtgaaaaaatattttgttttactagccatcagtgtagagtttttctggatctatagttttcagtataacctgcaaatttgagattagctaactaaaaataaataacactttgaaaatggaagagaaattatgttaaatgtaaattgatgaactttaattaggaaattttgttgtatacaatttttttttggatgaagtatacaatttgttttcattcaactgtttacagatgaataatttgttatgtgatatgttatcataatgttgacgtgtaaattatctttttcttcttctttttgttgctgttgttgaagttgatgtataaattatctaataaactttataccttaaaccaaaattctactcccttaataaattagagcaataacatgttaccgtccgtttcttaggggtcgtcaagattggtccgccttggttttaggggtcaagattggtcgcgattataggccagatatatttagtaaatgaaaattttggaatgaccccaaaatgtaagaccaagaatacttggattgaaaatttgcataatgtttataatgtttgaacatctgcatcctcacaatttttataatgttttgtttaagggaagtttatcaaagtttttgggagtaatttcttttgagtttctaacctatttccacaaacgacctatcaataaataaaactataatataccgtagttatgattaagaaaaaatcaaacatactcatataagtataaataagtggagttgttatttttcttcaagaatatgatatttactggttattgacgagaggaatggattccatatgacttaatgaataattatgattagaagaagaaaagaacaggaaaaaagctaatcttagtttgtagagttcaacgttcagtttggaaaatggatcaataactacttcgaaaggtataaatgttacttgagattgtaagaaaatatatttcatttatttctcgtgaaatcgtacctctttcacttttatccctttgtttcaccttgagctaatttttcctcaaaaatccgattaatcatataacaatagatatttttcgagtacgtagaatataagttcaaaatccgaatcatcaatattataaaaacatagaatgtacatggtaactaaagtaaaatacagctgattttaacacattcccaacaaacttgactactccatatttttcttcgaagtctacacacttacgacaaatttgcattatatgcgtggcactaattttgtcttaaagactctattgcatgatctcatgcatgccaattaatatcgtatcccacttgcggtttgcacatgcaccggttaaatagttttaatatttgatttgtttatcaaagtatagatatcagaataatacacgttgtgactaaaaaatagaatatttcgacgatccttagatactttgtaaacataaaataaaaccttactagaagtttagatgcatgatttcatcaaaaaatgttaataatcattattgactcatggtttaacgctatgaattaaaacaaataagataaacttgacggctcgttttcatatttctttttttttgaagagaggaaagttaattatgtgagagagagaacgatagtcaaaatgctttttaataggattattactcaactttccagtttaagacaatggaaccatcaactgtgtcaatatcgccattacacagcctggtagaagaataattaggtatgacttctgcgtttcatcaagtaaaaggaggtggagcctaccttcttttttactagtagtatgttttggttgtttacaagtaaataatttgattcaagtataacataacaattaccatgttcaatgaacctagcatgttctgtaagataattttgatgagactttaaagttgaagttacaaattgagtagagcaaataggaaaaaaaaaattgaattgtcgaatttgattatacctactcttgttgtcatttcgtgatattgaagaatatttctaggtggtacatttattcaaataaaacaaattctaaaaattaatacttgaattcaacatcataaaaagtagaggtcagatattaaaatgaaaattcctaattgcaaaaccatcttaaaatagaaaacataagatagattcaaaaatatttctgtctttttgttgatgcgaaactttacaaacttcaacacataattacatcctttatacaagtaaaggctagattagtaattaattaatttctaatgtcccttatgtaatcactatatataacgtacattctcaacctgataatatcactgagcctcacatctcaaca

SEQ ID NO: 3431 - DNA, 3000 bp, Unknown
  misc_feature (1)..( 3000): cDNA_ID_2049774_gDNA_ID_1620646_Annot_ID_163239 3000 nt of promoter + ATG
gaggatgctagtgagaaagttgatgtctttcaagaaacagggtcgaatgttcttcagactatatattgtggagctatcagctattgaggctctttccttctagttttgagttgaggaagcgtttcctggagattgtgacaccaagcttgagtcaatacaagaggtcaaatcacaactctttttccttaacattgcaggttcttagctcttcctcgtcctagtcttattcgatacaaagattgcattgaaacagagagcaaccttgcaccactaggcgataaagactgtctcactaatgtccgaaagttatatgattctgctgttgcaagttactactcaatggagaacaaggtaagtttttgtttcacagaactcaaatttaggcttaccctgaagccactctgcatacaaatgttttgtggtgtttattgccgcgccagaaagactctaaaggaagcagcaggtttcattcttcgatctgatttgttagtcttatgatggaaacacaatgttattgcccccacaattttgttatataaaacagactctagtagattttatattaattttgttaaggtttatatatacatattcagtagacaatttgattgtgaatacaaactattcaatgttaaaagcaagactcgttctaaggaggcaacaacaagtgaaccataatttatacttttgaggatttagagattttactgattctaattggttgaccaaaatcgccacaggagaatccaacaactacgaactggtcattggtcaagagtctcttcctattggtcaaacattttctattcctctattgttcaccggtacatctcacaaactatatatacattagatcttctgctctttaggttcaacaaacaaaacaaggaacaccagaaataaacacaatcataatcaacaaaaccagaaaacaaaattctccagcaactagatcgatttaaaccggtgttgtctcctctatatatatcagatggcgtcattacaggcttcaagatttatgcttactacttcttgttcttcttgcacaagaacaagatccgcaatctcaatcccaaagttaccaaaatttaatgtctcgattccgcaaataccgatcaagaaccggaatttcagagtcgaagaaccgattcttcggttggatgggtttgctgaagatcttgatctttcgttgtcagagagacaaaggcaaaagaagagagggtgcgatgatcaggttttgcaaaggtcgcggctcatggcggttcttgaagaagttatagatagagtggagatgcacaagaacattggagagcaacgcaataactggaactctctcttgctcaattccgtcaatatgatcactctcactgccgctttgatggccggaatagcctctatgaacgccagtggaatagattccgtttccgcggtgagtatagcttctacggtgttgctggcttctgctacaggtttggctgccttgatgaacaagattcagccttcacagcttgtggaggagcagaggaacgcaacgaggctgttcaagcagctaagaaacagaatcgagatggttctgagggagaaaagtgaagatggaatcagtgaagaagacgtgaaagaagcgataaagagagtgctctgtttggacaaagcttacccacttcctctagttggcaccatgctcgagaagttccctcaagaattcaagccagcgacttggtggcctgaaacaaaacccgaacccactcattccagaacggaagctaacgggtggaactcggagctagagatggagatgagagaggtggttgaggtaattaagagtagagatgcagaggagtacgagaagttaggtaacgtggccttgaagttaaaccgggttttggcaatctctggaccagtgttgaccggaattgctgccgtaagttccggttttataggtcacggttcaggtttagctggagtagtagcaacaacgtgtgcttcattggctgccgtagtgaacacgttagagcacggaggtcaagtagggatggtggttgagatgtatagaaactccgccggattcttctctcttatggaagatacgatcaaaacagagagacgagagaatggacaagttttcgagaccaaagtagcgttgaaacttgggagaagcttgtctgaattgagagatctggccagaagatctagcttgtctaggttacaaggatcagccatagatgaatgcgcaagcaagctcttttaattagtctacatacaaattgatattcattaattatttttgtgtatagagaaaatgatagatgatttttgaatttctatacaaacctgaatataactatgcaaattagttttggttacttatcttttaatatattacgcttttactctccctgtgataacctagtgcagatcatacaaagctaaaacaaaagttttgtatatacacggttaatatttagacatgtaagttatgtaacaaatctataatccattatgctctgatattatcttattattcaaaattggatgtattccagaaatattgacatatgacgttttttgtgtaactaatataataatgaattactttatgcatgtatcttgtgtacgtatatcttgatttataaatttctacaaatagtaaatactgatttttgtgttgatgaaaatttatttataattataaaatagataacaaatttaacaataccgattcttatatttatgaaatttgtttatttttaatcttttataaataggtaacatatccaaaaattactatacacatacatatagattatggacatgaaccctattattgttttccaaaactcatataaagaaagaaagaattacatgttatataaagagaagatttatttgagaactttaacaaaaataaataatattctttgagaaatacttttgatgaactatccctctccaaggtttgatggatcaagctggtccaagcttccttcagatcttctgaat

SEQ ID NO: 3432 - DNA, 3000 bp, Unknown
  misc_feature (1)..( 3000): cDNA_ID_1820776_gDNA_ID_1620646_Annot_ID_163235 3000 nt of promoter + ATG
tgaatccaaagagagatcatagtgagagtgaacttgacacaacatttcttacaaatcaaacgcagattggttgaaatgttgttaaaagaagagtctttggagactaattcttgatttactacgcagaaatgtgatgcaaatggatctaaatcctctaaaattagggtttgataagctcaacgcaaggatttagtgactgggtttcgttaactaaacatcatcacaatcgatttcgattccaaatctaagcctctcgagtacgggagcaactaggttcatcaatctcttatagcttaatacgaatctacttagagatcgatacgaaacttggaatcggaatgagagaaagaacttacataaaattggagatcggagactgtgagagcaactttgagaacgcggcgctgatgaagaacgcagacaagggttgggttttttggcgttagtaaacccttttcctatttcttttttgttttctcacccaaattatttgtaattacttagtataaatattttaaaaatcatgtatatttccaaataaaattcagaagacaaaaaaagtataaatagtacaggttactctcacattctcactatacaattctaaactagtgtagtatttatatttaatttatacaattccatcttcaaaattttttttgcttaattttgattttgattttttaatatacaaatgcaatgtatttaccacgccttaaacttttactgaaataacttatatatactatgctagatatagcgtaaaatcattaaattacatatttgagtttttgaaaaaatgtaaatatatataaattaataagcttaattacaaataggaccgtccattgtgtatatagtattgtgattgcatagtctaaagtattatcttaaacgaaattgaaaaataaccaactttcttttttctagacgggtcacgataaatggttaatttttaatagatcactaatacagtaaatcactgtaaatctgataacttatttcatccataagtaagtttgtattgcatttgggctactacagaaccaaaggatacattattaggaataggtggagagagacaaaaaaagagtattactggccttcatggcctctttgtgaattgtggccttatatattaggtaatcaattggcccattccaaagaatgtttcgttcattcttatacattactactacattgctaagtgctaagccccccaaatagcaaattctagaataacttttacatgttttgccacttttttattccgacaaatcacgatttatccataggaaaagttgccaactcacccaaacaaacgctaacatccttagaaattaagcagttgatgatcattacatgtgtttttggtgtcatatgacggattcatcaaatcatgttagaatgatgatgttggaaaagaaacacgtaagtagatagcattgattgagatctaaaattgcatttagtaacgaagatcccgtcgattccgtcgtaataactaaagcggtgcatggcaatatgtatattattaatattcattgaggaatgaggaactttcctacacgtaacgaatatacaataatattcctagttagtccaaaatgttggataaatgttcattcatgagttgtgaaaaaaagaaactaaaataatttcaaaaattgttagtattattataattattttttaacaaaatgtttcggttggtgtcatattcttaaagaaaaaaccaataatcaccattacaactaattaagcttaaaacccataaatcacaaacttttcaaaggactgacttccttctaccgaaattatcggaactcattgatgacataaccagacttgcttttgtcgaatgtacctatgattacaaaacatgacacattatacattcacacatacatgagttttggttatttccattatgatatataatatcacacttcaaataacagactttttcttgtttgtctttttcttcaatctttgctaatggtgcagaatggtactcaagcacgtgaaaacgcagaaactcgtatcatccgcttcatttccacggtacaccctcaccttcataactccgatctgtgatctccaccgtccaatagcattgacttcagctcaatatttaatccggcggtccaactattcaattcaagatttaacagaagcatgtgattcttacctcctgacagctcacacgccgcgtttcaaaacaccttcacttgcggacaatacggagcaatggtcgatgtactcttgacccaaagaaggcccaaacatctttaaataaaattaattgtaaactttttgatgagtgagatctaaaaagagtaaaaagacagagaatcttatgataaatttaatatttgttttgctattgtatataaccaactattatgacatagtttgcaatccaaggtgttacaccgaatcggtaaataactaaatactagcttgctcaatctaatagctagagctaataagaaaaatgtatttcgttaggataaataaaaatatcattatgtttacttgaatatttgaaaaaaaatttggtacatgtaaacgaaatttcccaaacaatattctaaagtgtgaaaggatttaaaaatgacgttgactttaggaaaaagtctcttcagttttagttaaaacatattgttaataatgcaaatcaagctcgaaattcaaccaaaagtttataagtgtaaattacttgaaaataatataaccaaataaatttgatgattttgataacattcgaggatatatgttactacatttacgtattttcttaaaattatttcttcaatacaaaaaaaaaaacatattaattacgtcggtgccactgccactaatatttaagagggcatcattaatagattctccattccaaaatcctctgtatatggatctacacctctcctcagtctcatactcaaatcaataatccaaaccccaaaaaaaagaaaaccagagaagagagtttaaaaa

SEQ ID NO: 3433 - DNA, 3000 bp, Unknown
  misc_feature (1)..( 3000): cDNA_ID_2999737_gDNA_ID_1620646_Annot_ID_163232 3000 nt of promoter + ATG
tatatcgttggttttcaaaaaaaaaaaaaaatttgatcaagcaagattcgtaatttcttatgaaggacaataatatcacaagccttttcgagtaaattaacattgtcctcttcaaactttaacaatatctataactatagccaaaaaagattagaaagtgtaatttgaaaatggcttaggcaaaagcataatttaagataaagcaagtcttttcatatagtacatagttttttgtcttctagcatgaatcagactctatcaataattttggcaggtcttagtagaaatagtaccaaaggctaccactcctctatctaacccttttaattattatttatttttcacaaaatttaattcatagttatggcaccccaaaaaaaagtacgaaattattacagttttggaggtttctgaaacctctgcctattgtggaggcttttgattcctttgaagcaatcaatgacctctctgtctctcatttgccagcaaagagagattgtttaatgttgtttatggttcacatttttatacaatatcacattttcactgaatcttcctctgcgtctctcaggtaatttaattctctcttttctctcccatcactctgtctcttctctttattgggttttagataaaatgatggaataataatttcatggattcaggaggaagaagatcattcagttgaagcacacatttaaagggttttgttgagaggcaatggaagggggagaagagtttcaagaagaagaagtgtggtcagttttgagagaaagtgaaactcaaggtcctgaaatgaaaatgtccaaaagtaacaatctcttctcagcctcttcctcatcttctgcgaggtacattcctaaaggcaacgaggtctctggaggggcaaaacagtcatctgctccaatgaatattcctgactggtccaaggtttatgggtattcaaagaagaacacaagcagccacttgcattcatgggccattgacgatgatgatgaaggctcaatggttcctccacatgagttagtagcaaaaagacttgcaagaacgcagatctcatcattctctatgtgcgaaggaatcggaagaacgctcaaaggaagagatctcagcaaaacaagaaacgctgtcttaacaagaactggtttcttggaatcgaatatcacatcttcatcaacaacatcaccaccatagttttggcatggcatggagcatggctggatgatcaatatcacattcacacaaaaccctttttagcaccataccatatcattatcatgaaaaaaaaacctaaaaccttatggtatccacatgatttttattaaatatcaatgttattgtcgttatcaccatgtagggaatcatgacactaccaatatggttgagttctctttttttttttttgttgttgttgttgttgttgttgttaggtttttggatttttttagataagtatgatgacgatgaggatgacttgtcaatcccatgcatgggcccataccatttttctcatgttatgtttgtagttctcaatggtcttttaactctttagcagtgcttagtgagcttaaattatagtttagcaaaacaaaatggcatatactttggaacctttgaatgtgagaaatttgaaagcactctcgatctcttcaccattttggcctcgaccaagagagaaaaatgtagcgaataatgttaacatttttggtccgacacaaggttaaggggctcgttccatattgctcactacctttcacttttcaatgttatatagcaactagacatggtgttactaggggaatggggtatatgtatctgttatctatttcggtgtgttgatttaattttttacttcgtgtattcttgaaccaatctgcaactgaaaaagttgtatttgaatttggattaattcgtttcgttgctaaatatccatttcaagatatacataataaatatattagttaatttactatggtaagatatattttcaagaatgaagttgtataaataaaaatacttgtttcgataattttcagttttattcacgtcggtactatctcacccgtactaaatttgaattgccgacaaacaaaaaaaatgtcaagttcggttggattttttattttgtttggatctactcaatatataaatagtaccaatcacactataaacgaaatttactcatctttccttggccctagcaacggttcatgataatcattctttctttttacaatttactttttcgaaataaaaaattgtagtaaaattacagtttcaactaaaaaaaaatcttgtacagaggtgccacaaaaatgcaattcaattttatataaaaatacaacgacaacaaatttgttactttgtcaaagcggattatttggcacgaaaaattcgtgcggaaccgctacatatcatttttgtaaataattttcttcaaaattggctcgtttgagtcataaataacacctgatgacaaaaaaaaaaaaaaaatttttttgttactttgtaaacttttgctaaccaaagcctatataaaggcccaattagcccaaaacgacacaaaaatgtgtgaagaaataaacagatggtggtgacgtaagacaagtgtaagagatttcttgtaatccaatcaacaaataataataaacgaattccaagtggtttacttattccagaaacagttccgtgtaggcaaccattaggaaaaccctaactaaattccattattaatttcttttataatccctttctcttgacattgacttctctctctcgattcttcttctccagtttcaatcaaactcaatttcttctcaacgaaccctaatttccaacaaatcggattcagtttcttcttcgggtatgtttcttctcaccaataaattcgagatcttttagggttttctgggtttgtttctcccccgatctagcagacgatcgagtttattaattatgatctttgcttgcttgaaattcgcagagactaatcgaatcgca

SEQ ID NO: 3434 - DNA, 3000 bp, Unknown
  misc_feature (1)..( 3000): cDNA_ID_2027168_gDNA_ID_1620646_Annot_ID_163228 3000 nt of promoter + ATG
aacctaagcaattggtcccctggaatttccatcgatgtcacagatctctctcctttagagtgagtgaggagataacgtgtgagccacgggatccgaattaaccacaaaagacacaaaccttgtaccacaaaagaaaagccccactttgtctttaatcggtttctgttacatgatatgtaacttacatccagaacattggctcactggatatttgtgatgggcttcattgggcctttcaggcccatagttattactcaaattgggtatgattttgttggttaatgttgagatttgtgtgtttgggtggttttgtctcatatctctcttaagagggaagtgtaacctactaacctcctcagacaatccacacagtatctattgattaaatgatggctttaaatctactgaaagtaaaaaaaatggttgctaaattaactttacaaagagatgaaataaagctgtcacatctataactaaagagaaatgtgttatccgatcaaatcttgttcttataatgcttaaatccttcaactagctcatatcacatggaatttatacggtccttggaaccttctttgctatatatagcggttgctacttttaaagaagggaactagaagacatggcaactacttcagagttcatattcttcactatatcagtatatctggaaactaagaatttgagcctagattgctttaaaagtctggtgagagaaatatattagttaacgttttttttgtcttggtattgaatcttgcaggccccattgtgaatgcaacgttgaggacacggatgagtacagtgtccatttgtcagatgaaagatccatgattaactactaacttgtcttaattcaattttgataaccgggtttgtttggtttcctatacactggaacttaaccggttatcatcaccatgaacacaacagttttacatgttacacgtcaatttttagttagaacttgctaatcagtatttagtgtttagcactcgtggagccactgagctagagagtgacatcactagaaggtccccagagactcatttggcgacacttggataaggaaacaaagtgtcggtggtcacagttcattcatttttaattgaaaaaatcaaatttgttcatttaaaaaaaaaattggaaaatccaaatatccaaatttgaagtgaatttgaatctgcagattcaatgtgatcttggtaaaagcaccgatacttcccccagatgaaaaaaaaaaataaaaaaaattctaggattaagaaaagaagaagaatcgaattagtagtaatgtcctctcattttatagctctgttacatatttatttagttttaatcattctaaacaaaattagtcctttgttactgaaacgagaaacataatagttccgcaacaaataatagtggagcctttagcttttaattagatatctagtttacctctatgaaaattagttaagaatatgaaagataacataatttcagatttttcttaattttgcagggacatattagtatacctatttaccttcttagtttatgtgaaaaatatcaaaacaacgtttatgttaaaacataggaaaagttcaaaatgtactctaaactaaattcaatatttaacttcaacccacaaacagataaagtatagggaacactcaagagtgaagagtggtgaacgtgttttattacatcacatggatcaagattcattcaatatttgagaagactttacgatacgaatctactgacaattactacaataagtaaaatagttggatatataaataactacagaacaaaaagtaattgaatatgtacaaatggaattatatcttgaactaaataatcgaaatgtacttgaaaaaataagaatccaccttgagttcatcgaaaagaaagattccataacctaaaaggagcggtttatccgttgtattaaaaatttaacaataacaaatgtttcaggtaattgcaaatcgacccatgaatatattttgactttagctattccaccccataaatattatttgttatagccgccccctttgtgtgtattattaacaaaagaagcataagttttttttgtaagattctttttagtcataggggccactgatgccactcaatgagaccaaaatccaaaacttagtgattggttttttgtttgacaaaaaaatgtgaattgtttagttaaccaaaatactcttctaaatgaggtaaactatctaacaagccatccacattaatatctccaacctaaacttatttattttctcatagcactgtgtaggactctaactagcatgatctatggtcactcacccgtccttcgaaatagtaacaaagttgggttttagatttcttaccgaaattaaatttccagtagaacgtctagcatacatttgagtaatttcaatgaaactccacaaattaatttttatcagtttggaaaatatatgttttggcaacagtccatatgaaagttcatacattaaaaaaaaaaaacgtagaaaaactttgttattttttctcaaattcaaacttacactaatttagctgtcgcatcaattaagtatgatttttttttctgtttaaagcttataatgtgtctgcaatttgataaataataaaaaaaattacataagtttcttataataagtctacgcttttcaattttcattgaatatagattcttaatcacgactgaacggaacatacaattattgtagtcttataataatattgttggtttctcaaagtgaaaatgaataaagcttaatgatatatgatctgtcacgtacttaaacatatagaaacagtagcaaattcaccaacttgcctttaatttactataaccttcaaattaagcttcttttattttatgaaaaataaataaagaaaactccatttccctttatttaaggaggctgcattgcttgctcactgactcaactcaagagtggtgtagtgagagaagaaagatagagaaaaaaaatg

SEQ ID NO: 3435 - DNA, 3000 bp, Unknown
  misc_feature (1)..( 3000): cDNA_ID_2992970_gDNA_ID_1620646_Annot_ID_163222 3000 nt of promoter + ATG
aaagcacacaagatatgtcgcagttcagctgttcgacacgtgttcactcattgcaagcaggtccaactaattttgtctattaacgttgacacgtggtctaatctgaacccatcaataggcagattgagaccggactcgacgagggtgttgttggattggagagtgaatggctaacgatggagaccgacgaactaaactagcaaagtctacatgtggtccatgattgttctgtcctttccttctttttaactttgcctcaattattagtgtttttattaatcaattgattactcaaactcttatcgtttttccactattcatattcgaattcattacataatcttataccataaacacgtgacatgcatgtcccatactccattgtccaagtgattgatatgtaataatttattaagccattaacaaatgaaatatgattgattggattttatcagttcatgtgtgtcaaatctctcatatattaagacgaactttctcaaaaaaaatatttcaaattttaagaaaaccatgtgtcaactaacttgtcatgagaagataaataaatttcggtaaatctagttctaatcctataagatgtaaagaaagtataaaaattagtcaaattttgattgtctattagtgagatagaaaatattatgagcaaaatctgcatgtatacacggatagtttatctagtattagaatttaaaaatactcaattccttttgtaagcatgaagtcctgaacagtttattgacttattcttatttgtttagttcatttttttcctggtcgattcgtatttgtttagttcaatgtttggtatataacgattttttctctttgggggaaacgggctccccaacgatacactactttaactgtgaatcaggcctatttcagttactcaatatgggcctataaaagaaatgacataatgcctataaaagaaatgacataatgccatatagaattagttatactgtacgtaattcttgctattggtatttgaatgtatatctaatggatgaaaataatggacgagaaaaatgaaaatacttgaccgtattctatttttttcttggtggaaatttgcaatacgtagttttgacctggttctgttcatacgcagagcaactaagtacgatgaccaaaatttcaatatactgtacaatattgtacacgtgaatttggaggaagaagagaaagagattatataagtgaaaaaggaatcagtaagacaagaaaaagtcaaaaagcgatgcccttcccatgcaaatagataagctgacagtgtgacacttcacacgttccttcttttataatcaaaaatatatttcgagtcaaaaaaagaaacaaaaataattattccttttttaaccaaaatttttacccatagattagacgccatttcatacttttatttcttttatcacgtgaaaaagtactacatattttccatacaaaataattagactatttttggcgtaaccctccatgaaaaaattgattcaggtattgatacacaattttgttaccatggtgttgaaccacgcagaaatatattatttaactatcttgtaagagattcgaagtcactatcttttgacgatgccatcatgtcccaacctcgtaatataacgttagtgaataaagttactaaattaccaaaatggttatcaaaaaaaatactaatatttccaacaactaatattttgttaattagaatataaaacaactaaaatcattgttgtaagttgcaagtctttggaagggcacggccgacataatagacaattatttgaactaagcaacttttaagtccactcccatcaacttccatcagttaactgatattttccccttatattttttttctttccaaagttataattaattattaaattatatattaccaaaaagctagtggacactaaatttttgtggtacatctctgaatatactcttatacggtcctcattaattcactaagtcaaatattagggataaagtttgaaggtttttttttttggtcataggataggttgctcgttgacaacaaaaaaaaatctaatttgtttttactttttacatcattttttcaagacgaatttatactgtattatctaactttagagttcaattttcgtatcttatcactttttcacgtaatctcaaaaatgagttcggataagattatcaaacgaaaaataaaatgttatccaatatcttaatatagaagttgtacgtaagatgcaatttacttgaagtaattcatgtcgacaattttttttttttgtgttctgttttggaagtaaatcagttacaagaagtggatgaggatgaaacagctttggtcaactaattacaacgtaactttgaaaaacaagaccttctacgtaaagactaatcaacctttgtattctctcccaacatggccgtacaaatctaatctttttccctcgagccttatatccattttttaatattaacaatcaaacatttaagctataaatacttatctcaacaaactcaatcatcaaataaacacaacaaaatgggaaactgcatatgcgtaacggaaaaaacgacgacgtcgtggtcaggagacgataatggatcatataacaagagaaggagaagaagaagatccaccgtggttcacgacgacaacgacgacggagagaagctgctcggagaaacaagcaacgttacgtcaacaagttcgtcatcgtcttctgagagaagagagattaagataaggataacgaaaaaggaacttgaagatctcatgagaaacattggtttgaagagtttaacggcggaagagattctttctaagttaattttcgaaggtggagaccaaatcggattctctgcggtcgatgtgacgaatcaccaccaaccatggaaaccggtgttgcaaagcataccggagatggattagtgttatttttttatttttcttataaaaaaatagataaaaaaatctgagtgatg

SEQ ID NO: 3436 - DNA, 3000 bp, Unknown
  misc_feature (1)..( 3000): cDNA_ID_2999737_gDNA_ID_1620646_Annot_ID_47598 3000 nt of promoter + ATG
tattatttatttttcacaaaatttaattcatagttatggcaccccaaaaaaaagtacgaaattattacagttttggaggtttctgaaacctctgcctattgtggaggcttttgattcctttgaagcaatcaatgacctctctgtctctcatttgccagcaaagagagattgtttaatgttgtttatggttcacatttttatacaatatcacattttcactgaatcttcctctgcgtctctcaggtaatttaattctctcttttctctcccatcactctgtctcttctctttattgggttttagataaaatgatggaataataatttcatggattcaggaggaagaagatcattcagttgaagcacacatttaaagggttttgttgagaggcaatggaagggggagaagagtttcaagaagaagaagtgtggtcagttttgagagaaagtgaaactcaaggtcctgaaatgaaaatgtccaaaagtaacaatctcttctcagcctcttcctcatcttctgcgaggtacattcctaaaggcaacgaggtctctggaggggcaaaacagtcatctgctccaatgaatattcctgactggtccaaggtttatgggtattcaaagaagaacacaagcagccacttgcattcatgggccattgacgatgatgatgaaggctcaatggttcctccacatgagttagtagcaaaaagacttgcaagaacgcagatctcatcattctctatgtgcgaaggaatcggaagaacgctcaaaggaagagatctcagcaaaacaagaaacgctgtcttaacaagaactggtttcttggaatcgaatatcacatcttcatcaacaacatcaccaccatagttttggcatggcatggagcatggctggatgatcaatatcacattcacacaaaaccctttttagcaccataccatatcattatcatgaaaaaaaaacctaaaaccttatggtatccacatgatttttattaaatatcaatgttattgtcgttatcaccatgtagggaatcatgacactaccaatatggttgagttctctttttttttttttgttgttgttgttgttgttgttgttaggtttttggatttttttagataagtatgatgacgatgaggatgacttgtcaatcccatgcatgggcccataccatttttctcatgttatgtttgtagttctcaatggtcttttaactctttagcagtgcttagtgagcttaaattatagtttagcaaaacaaaatggcatatactttggaacctttgaatgtgagaaatttgaaagcactctcgatctcttcaccattttggcctcgaccaagagagaaaaatgtagcgaataatgttaacatttttggtccgacacaaggttaaggggctcgttccatattgctcactacctttcacttttcaatgttatatagcaactagacatggtgttactaggggaatggggtatatgtatctgttatctatttcggtgtgttgatttaattttttacttcgtgtattcttgaaccaatctgcaactgaaaaagttgtatttgaatttggattaattcgtttcgttgctaaatatccatttcaagatatacataataaatatattagttaatttactatggtaagatatattttcaagaatgaagttgtataaataaaaatacttgtttcgataattttcagttttattcacgtcggtactatctcacccgtactaaatttgaattgccgacaaacaaaaaaaatgtcaagttcggttggattttttattttgtttggatctactcaatatataaatagtaccaatcacactataaacgaaatttactcatctttccttggccctagcaacggttcatgataatcattctttctttttacaatttactttttcgaaataaaaaattgtagtaaaattacagtttcaactaaaaaaaaatcttgtacagaggtgccacaaaaatgcaattcaattttatataaaaatacaacgacaacaaatttgttactttgtcaaagcggattatttggcacgaaaaattcgtgcggaaccgctacatatcatttttgtaaataattttcttcaaaattggctcgtttgagtcataaataacacctgatgacaaaaaaaaaaaaaaaatttttttgttactttgtaaacttttgctaaccaaagcctatataaaggcccaattagcccaaaacgacacaaaaatgtgtgaagaaataaacagatggtggtgacgtaagacaagtgtaagagatttcttgtaatccaatcaacaaataataataaacgaattccaagtggtttacttattccagaaacagttccgtgtaggcaaccattaggaaaaccctaactaaattccattattaatttcttttataatccctttctcttgacattgacttctctctctcgattcttcttctccagtttcaatcaaactcaatttcttctcaacgaaccctaatttccaacaaatcggattcagtttcttcttcgggtatgtttcttctcaccaataaattcgagatcttttagggttttctgggtttgtttctcccccgatctagcagacgatcgagtttattaattatgatctttgcttgcttgaaattcgcagagactaatcgaatcgcaatggctaagagttccttcaagatctctaaccctctcggtttgtttcttcaaatccctttctcatcgaattttcaattacttgattttttgttgagtttctgaattctgttaaaacttgctttagatcgtgtatggttttgattttggaactcaattttgattggttttgggatcagatttaatctctgcatacgcttttgattcttcctttgttgttcgtttctctgtttttgtttctaagccaagctgtgagattttatagatatctctgtttaatgatgtacttgtcattaatcttgtggttatgttttgttaatcagaggcaagg

SEQ ID NO: 3437 - DNA, 3000 bp, Unknown; identical to SEQ ID NO: 3432
  misc_feature (1)..( 3000): cDNA_ID_1820776_gDNA_ID_1620646_Annot_ID_47601 3000 nt of promoter + ATG

SEQ ID NO: 3438 - DNA, 3000 bp, Unknown
  misc_feature (1)..( 3000): cDNA_ID_1820769_gDNA_ID_1620646_Annot_ID_47603 3000 nt of promoter + ATG
ggcgtggttgtggtagtttctacggaaaaggtgctaaaagatatggcggtggaggcggaggaggaggtggcggtggaggaggtggtggtgaaggaggtgatgggtatggccatggagaaggatatggtgctggagctggtatgagtggctatggtggtgttggaggaggtggaggaagaggcggcggagaaggtggtggcagtagtgcaaatggaggttctgggcatggaagtggatccggtgctggtgctggtgttggtggaacaactggtggagtaggaggaggtggaggaggcggtggcggtggcggagaaggaggtggttcaagtggaggatcaggtcatgggagtggttctggagctggagctggtgctggagttggtggatcatctgggggagctgggggaggtggaggaggtggtggcggagaaggcggtggtgcgaatggaggttcaggtcatggaagtggggctggtgctggtgctggagttggaggagcagctggtggagtaggaggagggggaggaggcggtggtggagaaggcggtggtgccaatggaggatcaggtcatggaagcggatccggtgctggtggtggagttagtggagcagcaggtggaggaggaggaggaggaggaggtggtggtagcggtggtagtaaagtcggtggaggatatggtcatggtagtggttttggtggtggagttggctttggaaatagtggaggaggaggtggtggtggtggaggaggtggaggtggaggcggtggtggaaatggatctggttatggaagtggtagtggttacggttctggtatgggaaaaggtagtggtagtggtggcggtggtggtggtggtggtggaggtagcggtggaggcaacggaagcggaagtggaagtggagaaggatatggaatgggaggaggagccggaacaggcaatggaggaggagggggagtgggttttggaatgggcattggatttggtattggcattggaggaggaagtggtggtggtaccacttatcaaaccaatcttaccggtgataaaaattctccctagtgagtagggacttactccatacatatcttatttgtcaactccatttaataaggattttgtttcaaattttgatatctagttattctatttgataaatcttatcgataaaatcatgtacgaattcgttttccataatgaataaaattacaatacgtttttgtatttttttttttttactgcaactaaaaccacaaaataaaatttagaaactcaccaagtagcaacataacataacgttttgaaaatttggttttgtcgtttaaaaaatattgtgatgttagccaaattagattagttacataaatggtttttagcttgtgtatgaatctgcacaagtctatgaatataccaaccgaaaacataatcgaccgtttcgatcccgcgaaatatgaaatgcttaatacaatactatataccaatggcccaataagttctttaaatgggctttatttaaaacccaaattagacccaattgtacattcttctcgccggacctctcttcattccatggcggcgcgtggctataaggtaaagaagaaatcggtttctgatttttccggcgtgggtacaagttatcagctttcttgttgggtattttacgatgttttgattgtattgatttggctgcaattagatgtgtaggctttagctcaagtgattgagtttcaccctaaagttgctagagtgtgtatatatacatgcttcgccttcggaattagattgaaacttgaatgttgctgcagctcgtgctcttatgttgaatggtttgagaatgtacttgtaggtggagtatcttcaaatggaactcagtgttttacataagctgaaagcgagtagaggtgctcttgatgaagatagccgccgaggttgatgttgtaatggaaagatgagaacaaacagctgtttatgttgttagatgagaaagaaggaaatgaagactctaatgttgaggatgctagtgagaaagttgatgtctttcaagaaacagggtcgaatgttcttcagactatatattgtggagctatcagctattgaggctctttccttctagttttgagttgaggaagcgtttcctggagattgtgacaccaagcttgagtcaatacaagaggtcaaatcacaactctttttccttaacattgcaggttcttagctcttcctcgtcctagtcttattcgatacaaagattgcattgaaacagagagcaaccttgcaccactaggcgataaagactgtctcactaatgtccgaaagttatatgattctgctgttgcaagttactactcaatggagaacaaggtaagtttttgtttcacagaactcaaatttaggcttaccctgaagccactctgcatacaaatgttttgtggtgtttattgccgcgccagaaagactctaaaggaagcagcaggtttcattcttcgatctgatttgttagtcttatgatggaaacacaatgttattgcccccacaattttgttatataaaacagactctagtagattttatattaattttgttaaggtttatatatacatattcagtagacaatttgattgtgaatacaaactattcaatgttaaaagcaagactcgttctaaggaggcaacaacaagtgaaccataatttatacttttgaggatttagagattttactgattctaattggttgaccaaaatcgccacaggagaatccaacaactacgaactggtcattggtcaagagtctcttcctattggtcaaacattttctattcctctattgttcaccggtacatctcacaaactatatatacattagatcttctgctctttaggttcaacaaacaaaacaaggaacaccagaaataaacacaatcataatcaacaaaaccagaaaacaaaattctccagcaactagatcgatttaaaccggtgttgtctcctctatatatatcag

SEQ ID NO: 3439 - DNA, 3000 bp, Unknown
  misc_feature (1)..( 3000): cDNA_ID_1820765_gDNA_ID_1620646_Annot_ID_47604 3000 nt of promoter + ATG
ttctgacgggacccaaagggaagaacttccggtatcaaacagaacagtgaaagtttggcctggattgccaatttggatcttcccatagtacagaaagtcctttacgttcttcaactgaactccatcattgtttgttgacaaggcatgatctatctgcaacgggattctcacaagcgcttctgacacagaaagaaaggaaaagatgaaaaatatactcgtatacattgttgagatgtgaggctcagtgatattatcaggttgagaatgtacgttatatatagtgattacataagggacattagaaattaattaattactaatctagcctttacttgtataaaggatgtaattatgtgttgaagtttgtaaagtttcgcatcaacaaaaagacagaaatatttttgaatctatcttatgttttctattttaagatggttttgcaattaggaattttcattttaatatctgacctctactttttatgatgttgaattcaagtattaatttttagaatttgttttatttgaataaatgtaccacctagaaatattcttcaatatcacgaaatgacaacaagagtaggtataatcaaattcgacaattcaattttttttttcctatttgctctactcaatttgtaacttcaactttaaagtctcatcaaaattatcttacagaacatgctaggttcattgaacatggtaattgttatgttatacttgaatcaaattatttacttgtaaacaaccaaaacatactactagtaaaaaagaaggtaggctccacctccttttacttgatgaaacgcagaagtcatacctaattattcttctaccaggctgtgtaatggcgatattgacacagttgatggttccattgtcttaaactggaaagttgagtaataatcctattaaaaagcattttgactatcgttctctctctcacataattaactttcctctcttcaaaaaaaaagaaatatgaaaacgagccgtcaagtttatcttatttgttttaattcatagcgttaaaccatgagtcaataatgattattaacattttttgatgaaatcatgcatctaaacttctagtaaggttttattttatgtttacaaagtatctaaggatcgtcgaaatattctattttttagtcacaacgtgtattattctgatatctatactttgataaacaaatcaaatattaaaactatttaaccggtgcatgtgcaaaccgcaagtgggatacgatattaattggcatgcatgagatcatgcaatagagtctttaagacaaaattagtgccacgcatataatgcaaatttgtcgtaagtgtgtagacttcgaagaaaaatatggagtagtcaagtttgttgggaatgtgttaaaatcagctgtattttactttagttaccatgtacattctatgtttttataatattgatgattcggattttgaacttatattctacgtactcgaaaaatatctattgttatatgattaatcggatttttgaggaaaaattagctcaaggtgaaacaaagggataaaagtgaaagaggtacgatttcacgagaaataaatgaaatatattttcttacaatctcaagtaacatttatacctttcgaagtagttattgatccattttccaaactgaacgttgaactctacaaactaagattagcttttttcctgttcttttcttcttctaatcataattattcattaagtcatatggaatccattcctctcgtcaataaccagtaaatatcatattcttgaagaaaaataacaactccacttatttatacttatatgagtatgtttgattttttcttaatcataactacggtatattatagttttatttattgataggtcgtttgtggaaataggttagaaactcaaaagaaattactcccaaaaactttgataaacttcccttaaacaaaacattataaaaattgtgaggatgcagatgttcaaacattataaacattatgcaaattttcaatccaagtattcttggtcttacattttggggtcattccaaaattttcatttactaaatatatctggcctataatcgcgaccaatcttgacccctaaaaccaaggcggaccaatcttgacgacccctaagaaacggacggtaacatgttattgctctaatttattaagggagtagaattttggtttaaggtataaagtttattagataatttatacatcaacttcaacaacagcaacaaaaagaagaagaaaaagataatttacacgtcaacattatgataacatatcacataacaaattattcatctgtaaacagttgaatgaaaacaaattgtatacttcatccaaaaaaaaattgtatacaacaaaatttcctaattaaagttcatcaatttacatttaacataatttctcttccattttcaaagtgttatttatttttagttagctaatctcaaatttgcaggttatactgaaaactatagatccagaaaaactctacactgatggctagtaaaacaaaatattttttcactttaaataagaacacaacatttgatttcgtcataaaaatcagatagaaatctcgagtcaagctccaactttttcttgtacctacagatacatacgacatacatataatacatattaatcaaatcatttactcgcaaacaatcataaccatagtagtaaaaatgaaggtagggtccagtattaattggttggtatattaaaagtgttgaagctattgctcgtcaatattttagttagcttagtcaacaatatatatttgtcctgtttagtcatttcctttgtgcaatactttaggttatatcttttgctttgtataagtaaggttttaacgcctctttaataagacaagacaacataaaccaaactacatcttgtcttaagtttgtcatggtatcagagcgcaatctgggtttttcgaattgagtatttcaagtgagttttctctgaagctatg

SEQ ID NO: 3440 - DNA, 3000 bp, Unknown
  misc_feature (1)..( 3000): cDNA_ID_1841509_gDNA_ID_1620646_Annot_ID_47608 3000 nt of promoter + ATG
atcagtatccacgactgcaaaccagggaaatctggaaaggtgaggagcagcccgacgcatgtcggtcaccgtaagggatcggacggtgatgccatcactatttttggttcgtcgaatgtttggatcgatcattgttacctagcgagttgtacggacggactcatcgatgtaatccatgcttccacggcaatcactatttccaacaactatttcactcagcatgacaaagtcagtttcagtttttcaaaatcattaacatagctatttaatgtcttgggaagttaatatcacattttgatatgggttgttatatatgtataggtgatgttgctcggacacaacgataattttgtgaaagatgtgaaaatgaaagtgaccgtggcattcaatcattttggaccaggacttgtggagagaatgccaaggtaattactatttaattttcctttcttttttcatctaaaaaactaaaattatttgcccaaaaatattagaataactattaagaatttttagagcagaattagaaatgtaatgatgagcataccaaaaagacatgtaatgatgtaaaattgtgtggtgggtgcagggtaagacgaggctacgctcatgtggcaaacaatagatacgataaatggataatgtatgcaattggtggtagcgccgatcccaccattttcagtgaaggcaactatttcattgcttctgataaatcttacagcaaagaggtaatttaattttatcctcctaatccaatattataattacatatttacccctcggatctgaacatgtaggctagtgatggatattattgctgttattgtatcaccatctatatattcaacaaaccagcatattgcaagttttaacgaagaaaaaaagatagattcgaaactcgactattaatactattttgacctacaaaaaaaagagtcatgttggtctttttagccgaaagtatttttggacattttggtcccaatttcatattatagattaattcctaaattgtttatgaaaaagaatgaatttagctcaaaaacaagaaaggtaagtagactttaattacaattttcttatccttttttatatattttaatatcggtttctaaggactgaataactgcttgaccattattattccaccaccaaaatttaatccgctgatttttccaaataaatgacggtagctaagctaaccatcggactgcctacttatctaaacttctagttttggttatgtaatgattaatgtctaaagatcattatgcacttatgattaattcatgaaaataaaatgctaagcataactaaaataaacaggtgacgaagagagaagtaaaaggaggatggaacaattggagatggagaacctcaaacgatgttttcaagaacggagctttcttcgtaccttctggttatggcagcattccgctaccgtacagttctgctcagcgattcacagtcgctcccggaaacttggttccttctttaaccgcagacgctggccctctaaactgcaaccgcaacggtccttgttattagtattcaatactcttttcacgagatgcatctaattattttctagtatagcacgttacttttcgtttttaacttagttgatctatatatgttgtggtctggatttgctacacatgtagcactggtgtactagttatgaaagatgataaacgtcaagagtttaatttgtaagaaataaattttgtgtatctatttgcgttttctctcgaacctgatttattgacggttttggttcagtccggattttttgatcatataaatactgcaatatatgattgagtacagcggacaacaaatattaaaacgtatgatcgttaaagtttatattggtgctgtgctcaaatccgttaaaatttcttattttatcatcttcttctcttctacgtgtactaagaaaaaagattttactacgtccgtctgtaggaatggatcagacacgagaggttacttcgtatggtcatttatggatttatacgagatagtaaagggatacgagtttagttttggattatactctgcgaatttcagtgattttcatcgtaagagaactcccaaactctctgctcattgttactctgcttttctcagtggcaacatcacttttcttggttctcaaggcatcacgcaattgcagaggaacttctcttcttcatcttcttcgtagtaatcttttgaatttagtttattctcatgaatctgattccttcagatttagcgaaaaccatgtgaattgtgccgaacgaaatctcatcttttagggagaaccctcagacctctctgttttactgtgtttgaattgcttgccgttttaaagtctatcatcctaattttgtttttccttaaaacggtatgctttccttgatctcacgtaatagtgggatttcttttttcttttttcacactgtgaccctaatgtattacataattttcaacacaccactcgctcatataaaattatttgtaattctgtttaatttaggtttggtatgattccatttttggcttgataccggttcggtttttgcttaaaagaaaactaaaaaaaaaaaaaaaagcaaacataagaaatggagtgtttgaagtaaaagaaacaaaaaatagtaatggattggtacacgtacataaaacaccccatcagataaacattatactaattaatgtaatgtaatacaattaactaaacaaaatacattaagactttggaattttccatccaacaagtcggcttgagaaatgttcgtggggaagcacgaacatgtgatcttgtgcaacaacaccaaagtctcaccaatacaactttgatctttaggccaatattaggaaaagatcgtgtttaccacaccttctaatctttccgacacaatctctcatctaaacacttccttaagtacttgcccatcttttctcttttcttagtatcgatccctactcaaaccataaacccacccaaccatg

SEQ ID NO: 3441 - DNA, 3000 bp, Unknown
  misc_feature (1)..( 3000): cDNA_ID_1820743_gDNA_ID_1620646_Annot_ID_47612 3000 nt of promoter + ATG
cttttttcccccattttattcatcttttcattatatctttgatacaaaaaaagtttagaacgagatttttcttggtttttcattctatatgtttttatacaaagtttagaacgatatttgaatttgaatggtagaatcatataatttgtctcttacgtcttaccaataaatgaattcgccggacactggaaaccataaattcgtgtagttttatgttactttgtcacattcatgtagtttcattcgtttacattttatatatcgtataatttcttatcttttgtattgtataggtgaactaaaaaaaaacacatgaactcaatgtggggtaaatgagggttattaggaagaatcagtattgcttttttaatgtattgaaagagagactttattccatggaatgaaatcccgtgaccttgtattggattattttaaataacgtatatctattttataattgagcattatatagaaaaaaaacttcagtgtgttggttactgttgtaagttttaactatttatgtatatatattttcatgaaatcttaacttctttggaacaagacttgttataaatcacatggaaaacttaaattttgatgagtagttgagctaatcaagtcagacagttatacgtagcaaaaaagattaaattaacgttacaagttttcaattatgtaaatcctaacgattttttgtaggttgatgcatcaaaatcactgaaagataagagaaggacaaacgaaagatgcgattgaattttctatactctgtataatgtatatcttccaattcagtttaattagtagctccaaatgaattctatctcaaaccatagttttatgttttcttttcgataaatacacaacacaactgatgacaacttatgactgtgacataaattttacaagtcacaacatcaaatcaagtgagcacatgccaaagtcattgtcgaggaaatgcaaatgagactatagaaatcaactacgaaaacaatacaaagttcattgaatgaaaaaaaaactcatcggaccaattgcttcaaatgtgatgaatttgtgtagcctggtccataaagctgaagactatttgaaaagggccttattgtgtagagttcagcccataattttattgcttctacagtttcttgaacatctttcctcatttccatacatttaccacgtccggaaaaacaaaaatcgaaaaaacatgagaactttccacacaaaacaaattcggattaacgttaaaaaaaacacaaattcagattgaagcttgaaaaatattcgtgaattatggatcaatttattttaacaaacatcgaaaccttgattttctcgtggtgtatatgcttagttgtaatgcttgaatctcttgatatcattttctatatatatatagtgagtagtgaccgaatcaaactggtctttacattagtagcatattagtgggctccagattcggaatcgaaataatccatgaacgtataatatggtcgtggccactcataaggtgaacgtatatatagaagctgcgaaaatctaatctccaaagttcaataattcaacaacttcctttttatttcgttgtataaatgactcaattaatattctgatttagtggagtatgaaagaaacaccgcatcttgcatgattattaacataaagttcacacagtatagcccaaaataattactcattttaagtattgtttatttgctttaagaagcaccactcacacgctccgcgagtgcactcattattaacctgtgtccccacgataagggcatgtctcaccaatcgttacgctagaatctctacaaaagtttgtacgtgcactacacaagctttagtttgtgcgtgatctgaaatgtcacaacattttctgcccgttacaaagttcatgttccaactaaccgttacgatactaatacctagctaccactcaataaattctcattattaaaatactatagttaacagtcgcaaggaagaagaacaacaacatacacatactcaagaaaggatcatcaatggtccattatttaatttgaaaattcgataaaaggaaaacacttactacaaagaaaatgatttttgcgtcaagatcacaattgattaaaagctaaaaacaaaggaagattcggaaaatactaaattaattcttatagaattatataatcaaccgaccaatgttctttgttttaggtgaacaaatttcacaaaagaaccaacggcactaagaataaaatattcgaaaatcgaattattaaaaaaacatgataaatattaaataaatacttttgataagccaatgagcgtaataataaccaaaaataaaaacctcagctcgtcttcgttcttctttttcttccttgcgactgtacgatctcctgatctccttcaccgcctactctcttaaatcttaacccttcgtccgtaactgcttctcttgtcagtttctatagcaacattatctcaaatagttctattgataaattttatatcaaaaaccttaaaaagtttcattggtttacaaattttaccttttttcgtttgtgtgttgcgtgtgttactaaatcactgaagagggtaaagagaaaaacaaaacaaaaagttcttagctttggatgaatctggaagtgatccaaaacactggcttattccactcctcttctctagggtttctctctaattctgaacttgctttctctgaatctcattatttcggtggagtaaatttggggttagctcacattttatggtctgagttgttttatgtctctgtaaaagattcgaacttgtttttggaatttagattgtgtggggttttgttcctaaagttttcacctttatggattttttcatgttctgtatataattagcaggggtttcacttagattccaacttgaatcacttcaaagatcacaaagcttcaatttttaacaaaatttggttgcttctttgtgtgattaacaggttgaattgttagttaatagatg

SEQ ID NO: 3442 - DNA, 1944 bp, Unknown
  misc_feature (1)..( 1944): cDNA_ID_2991550_gDNA_ID_1620647_Annot_ID_47616 3000 nt of promoter + ATG
gaattccagtattgtttccgcaagtatgtgtttatagaaaaaaaaacttttctttgttgttgaagggtatagttttgttaatgaaatgttttttatggaagtgcagtacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtaagattcttgaaacatctctctctctctctcattttcaacattttttcagatatttgattaggaatattttacataaaatatggagactgttttttaatctatgtatccatttcaggtttgagtatagactgagagtagcattgggacatgatggagatttgacgttaacatctcgtgttaagaatactgatacaaaaccatttaacttcacatttgctcttcacccctacttcgctgtttccaatatcaggtaatccaaggagtcataacttcacgttgatatctttttttttggttgtgttggtgtaagtgtcattgaatcagctggttgttgtattcagtgaaatccatgtcgaaggattacacaacttggattaccttgaccaacaaaagaacagaacacgtttcactgatcatgagaaggttataactttcaatgctcaagtaagcctctttccatttgccaattcaaatttcaacccttttattattttagtccatcactaaaaaaaaacacaccttgcaaaaaaagcttgacaggttgtacctaagcactccagatcaactaagaatcgtggaccataagaaaaagaagactattgttgtacacaaggagggacaagttgatgccggtaattacaaatttagatttgtaaacatacatagacatagacacagtcacacagaaacagattgttttagtagtactaatgatggatcacttgtaattacaatgtgcagtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttgaccctataaaagtcttgcattcatcatcctcatcctttaaaaaaaaaaacttaaaactgtctttattaaagtatacttaatgttcccgagagacatcacatggtgaacacaaagttagttgggttccaaactggactcttgaccagttttattgttttgtaactttagcattcatgaataaaaaaagtgcgttaattacaataattgttaaatgtaattaaataaaagtgcgttaactacaataattggatattggttatttgcaaaattcatgttcttaaatcatcagtctaaacaaaaaaattagattagccgaagatttcttcttctacccttgatgatactatttgggatgggcttgcttagatgtgccgaatccaattctcgtttttgggtctatctatatttgggctgggctttataagaggcgaagcccatgtcgaacaatcaatttttttttaattttatatttcttttgggagtctgttctgtcgtattgattaataaagtaaaaaatcttagccacaaaattaaatcatctccaagacgtatcaatatcatcatcaatccaccaatgaaaagttctctctttttttttcccactcttactctgttctcgctacagaatctcctgggaaaaaaaaaaaagaaacttgatccacccgaattccccaaatcttcacaatttctggaaactctctcgatcgtgaagcagaaaagtgaggttccaaatgggttctgtttcgggtcaaacccgaattacaacgatg

SEQ ID NO: 3443 - DNA, 3000 bp, Unknown; identical to SEQ ID NO: 3147
  misc_feature (1)..( 3000): cDNA_ID_1820858_gDNA_ID_1620647_Annot_ID_47619 3000 nt of promoter + ATG

SEQ ID NO: 3444 - DNA, 3000 bp, Unknown
  misc_feature (1)..( 3000): cDNA_ID_1807006_gDNA_ID_1620647_Annot_ID_163287 3000 nt of promoter + ATG
gtacacactgcagatttttgagaagaaaatgatacagagcttgagagaggtctaactataatctgtgtatatagggtttatatatatatctaagtcccctcctttttcctttgacaaggatgagactttccatcatatatatctcaagattatggcgtataagtcagagaacccattagagccaccagaaaacaacaatcactagtagcaagagggagaatcccatcgcctgcaacatcaccagattttcaatttttcatcattctctccaaaaacgtatacagtaatatgagatagagaaaaagagttattacagtgattgcggaagcagcaaggccggctctttctctaggatccttgcggtagtagttcccgaaatataaaagtgttgcatagtaccataagaaagggaacacaaaacccaagagaaagctgcaaaacaagaagatagcttgtaaatctaaactgaatatagagaagctgcgttgacttcaactcaaaaaaaacttaatactctctactcacgagaaccatccgattccacaaccaaagcatggaagaggcttgtcatacactccattttccacctcgtctacgtcttttacaagcgtatatcttcctttcccacacaccatagcatctatcatacaaagccaatgtgtattagcttatggaaaaggtgcaaaaatcaaagtgcaggagttccacacatgaacaaatcttttaaagagaaggcttgtggagaatagtggtagtagtacctttaactgcagagtaatatttagcaactggtctcacgagaccggcatgcttatcagctacggatttaaccagctctgcacttccatcaccacgctctttaacagctgcaaataacagataagatttaatccaaagaggactctacttggacatcatgagaaggtacagagttaacttaatgttatctcatctcaagaccatgcccccttgttcctaaaacaaaaatttatgatctttgactgttggtgaacaatcacttccagctagtcaacaacttagttgtgagatttagatgatcctctattctagtaacaagaactaacaaagcacatatcttttgaggactaatatgaatcgaaagagataaaaagggaggaagatgattactttctcccatacgttcttcagcagatgatgaaaatgctaagctcttgcttataagtttgtgtcgtgacccacaagatcttcaaattgcctgcaacaaaacattaacaatatgaatgaatttcagaaaggaaaacatagaaaacagagacgatttcagctaaaaccgtagcagcaatcaaaccaacaagaaattgaaatcagcgtaacagaagcatgaaaaagtctgaatcagattatcttctctatttggaaaaagaacatatatgagacaataggacttcaaattcatcggaagaatgaaatccacacgaaccggagactgctccgggaagtaaaaggaaaccgatggagatgaataacttaccagattataatttctagagcacaaattcgagaagagatttgatttcaagggcagagggaatataaatatcggatcaagaaatctggaagcgagagagtcgtcgtgcttcgtcttcttcttgtgctgcttgtttcaacttcgtcagcgtgataaatgcgtagagagcggaagatgcaagaaaaatgaaagtctattttttcttttgcctaaagcaagtttgtctcttttctagtactattttgcttaattaaatacttttaatgtcttaacaactatacgagtatttaattcttccactaatcttttgtccttttcatgatttatattatgtaatcaataatgatgtttttactcacataattttgtagtgaaattagctctaagaaattacaatttttctatttcttttttttttttggaaaaatgaatggacttttcttaaacaacactttttcaaaatgaaataaacattattttggtattatattttttatatatatttttttttgtaattcagaaagcttcgacactgttagatttagaccattctagatacgttaccagttaccacttaccagtagccacataacagtactagttcatatatagcataaatagttaccagattttgatgttttcaaattaaatatgcgactaaaactctaaaatcattcaaagttattattatttatgagtttagttttcttcttttcctttcgtacaagttagatatcatgtataattaaccaactgtccatcataatctcatatattctggatcaaatcgtccgtttaatatagttgaatatgtctctataattattttaaaatgttacttgtgttatttaagtaatacagaattatgtaatagataaaaaattgtttgaccaaaaaaaaaaagagattaaaaacaatgttaacttttcgtccaagtagacaccacataccaagttaccaacaacacttcacatttgatcattttagttgatctcttccatccatgtggtattaatctaaaatatccaatgattatgacatcttattttattttggcaacgatcgagtattaccattaattaaaatcaacatgctattaaataatccaaataggcaaaaacttcacaatcaaaagagaagaagaccattcgtcgaagaaaattactcacaagagtataaaactatatatatgatcagcctattcttaatgtgaacattgagaagtggggaggttaaaatgcaatgattttgatccaaagttattgttgacaaagacaattaaagaaggaaaattcaaaggagagatgagtcaaggacaagtcaacgaccatttcgtcttcgtcttcttctttatactcattagctacacgacgtcgacggttcgtcattcttcctctaagctttatctttctgatctctgaccttgtgtctctgtgcatgtgtgtttatctgctactgtgttttgtcggtttgatctccaaaaaccagac

SEQ ID NO: 3445 - DNA, 3000 bp, Unknown
  misc_feature (1)..( 3000): cDNA_ID_2049850_gDNA_ID_1620647_Annot_ID_163281 3000 nt of promoter + ATG
aataaggttctttgacgggcttggtatgtttcctttgtgatgggatcttcggttttggtctgttttgttttgtgggattcttctttcatctttgtaatcttttcgccaactatagtttgtttgcttcctttcgataggggtttagacttcacaaagtttttgtcttctgtgtgtttaagattgtatttcatcatagtattagaaatataattcagatgacaaaaagatgttagatttatggaattatcgtctgacatcgagactacagttataatggcatttatgtatttacgctataataataatattaaaaaattttacaagtctactcgttttattgtaaacacccaattgttactttgaaaacttaaaataaaaagtcaaaattgtaatttacttctaggtcatcatctttcacgaaaaccctaatcgccgtcagcttttctgaaaggctcttctttttggtactctgttttttttttcctataatttaatcacttatcttaaccatgaattctacaaatttatgataaatttacagatttctaaccaaaaagtaaaattctaggtgatttcccaatccgacttatttctttatggtcgaataaaagttatacactaacagaaatatagttttctccatggttgtacatagctttggtgacttaaacagttttaaattatcaatgaagataatgaaatacacaaaaagttgttttacaaagtactaataaaactgaacatgaaagaaataaagtcaaatcttaaagagatgcttcttcaccaaatacatgatgctgggagtttcataatcacttgatcgtctctattgcctcaactttcttctgcaactttgtcctccagtttgatctttgttgatcttatgagatttaccatggaattcttgatgatgtaatttaagccttttcttagtctcattcttagaatgaattaactctgtatgtacaaccaacatttgtgaagtatcaaacaaactattgcactttagacatataaatgaactgtctttctcaaacggcaggctatatatccaaccaccgtctttttcataatcgatttcgtcatgaatttcttcaaggacctctgttggtttacagatatatttcaccgaccgaccatttttatgaacatattgctcatgatagtgttttggggaggatgaaaatatatccaaatgctgacgacatgcatagtcttgttgcgaacaaaagaaatcgatgggtttaggtgtgaaggtttcatactgtttatcaaaatcatttggggggttaactgtagatttcaaaattggtggataagaagtcatgaaacggttgacacgatcattatcattttggacaatgaccatattgcttgtcggaataagagcatgatacctttttgcgatggtttgagtgataaaaacttgagaatagttaacaaaaccactagtttgagctatgaaaggcatactgaaaggagaaaccatgttggttctcaatgaagatgaagaaacttttgaaacatgggaactagtaaaaaaagaagatggatataaattagcatggtttttgttgttagaagtaacgaacattgatgaaaccattttagactggtgatttatcgaacttgagtttatttggatgggaaaatcactgtgattcatagtacaagggagcgtgtgttttaaatactttgcatatctatctatttatattagattattatttattagtataccttaataaaagggtaaattggtttttatattaaataaaaaagactaaagtggaaatttttaaaagaaagaaactaatttatacatataaggaaatgaatatttttgtggactgatatctaattttaatatctattactataaaaaaaatcttcaaatttgtaattttctatatttttatttggaaaacctctatttgttttggtagtatttggctgttatttcaaaattagtttatcactttattgtttttacttatttgggatgtgtaagttgagaatcatttattatatcgtttatcccattgatttccatttaaagtgcaactctcacaaaaaataaaaataaaataaaattctaaaaatttagttcaacagatttttatgtttcagtcaaaagttatggtaacagaggtccacttaataaatttcatttaattcatatcttaaattttggatttatatgttatattttttacttctaatcttcaatatgtagatatctaatatacgatgaaaaaaatgtatactttgaatataataaagaagaatataatatgatttttgttcgacgatacaaaaagtttagatataattagtttaataattaaaatattacaaaaagttcttttatttttttagcaaaaaaaaatagaatttccattgaaaaaccaatatgttgagtacatgatataatcttgtgatcatagatattacttaaaagaactatcacaattagaaattaacttaagaaaacaatgaacaaatagttaaatgacttttaaaaaatgtacacaatagaataataagagagtgattacataaaataaaaaattaaagtacaaaatacaatacaccggtcaatgtaaaaaaatatctcataacatgaatcggaaaaacaaaatttccagaaagaaaggaaaaaatatgtaaaaaaagcaagaaagatatatatttttttaagtaaagtaataattttattaataaaaaaacaaatattaatatttctcaaaacaaaataataaattgtataacaattttcatgttatccctttttaataagattttatttttttacatatctttttaattagataacatgaccattggattagcgattagcgtgtaggtgacatcgacggcccagaatgctcggcatatttaccaaaacatccttcgaattttaaacccctagctttttttccttttttcttcaatctccctcgcctttacgaattcgaaactcaaaaactcaaaatcatg

SEQ ID NO: 3446 - DNA, 3000 bp, Unknown
  misc_feature (1)..( 3000): cDNA_ID_3071196_gDNA_ID_1620647_Annot_ID_163280 3000 nt of promoter + ATG
tctccttctacgtgatttactgtgttcaaagctaattcgaatttggggatttttaatttctatttctagggtttcttaatcataagtaggaagattcttgagttgtgatcattaaagttgtgaacttttatcccctagttgtgcaatttgattactttatggttccaattatagtttgaagtgttcactaagttaattacttgctcaatgttatgttttaggtgttaatatctggtaaggaagaaccagaggcctacatgtcaccggcaatggacgcagtgttgagggtgtttagacgtgtttcagggttgcctgataatgatgatgatgatgttcaaaacgctggaagtgtcttctcttcagtgcgtttattagttgcttcaacgcaggcgattaatttgattggaaaacaaggatctttgattaagtctatagtagagaactctggtgcatcagttcgtattttatcagaaggtattatctatcatctgcagttttctgtttttacctaattgatctctttgtttgtgattgttaaagtttagtttttgctatttcaattcatgtctgtttttttttctaaaattggtgtctttgttgccagtttcttatttctctacttttttctgccagaggaaacaccgttttatgctgcacaggatgagaggatagtggatttgcaaggggaagctttaaagattcttaaagcattagaagccattgttggacaccttaggagatttttagttgaccatactgttgtccctctcttcgagaagcaagtaagcttgcttgtttcaatcgagattattcctttcccttttttttcttttctgaattattgttatcttttcttatcttcagtatctagctagggtctctcaaactcgccaggaagaaccgttagctgaaagcaagtcatctctgcatactatttcgtcaaatctaatggagcctgatttctccctcttagcacggagggaacctttgtttctggagcgcgattctcgggtggactcacgtgttcagccttcgggagtttctatctacagtcaggatcctgtactgtctgccagacactccccaggtcttgctcgggtttcttctgcttttgtgacacaggtagattcccttaaatacaacatcagctcctgaaaacgagtttagcgatatcatcttacttgttatgattagtcttccagcagtgattttgatcttaacacatctaacttgtttctctgaactagtagtgacgtttctataatggattctcttactaggtatctcaaacgatgcaaataccattctcctatgcagaggatattattggtgtagaaggagctaatatagcctatatccgtcgaagaagcggagctaccataaccattaaagagagtccgcatcctgatcaaatcacagtggaaatcaaaggcacaacttctcaagtacaaactgctgagcaactaattcaagtaagaacacattcgatctgtatatatatatatatactttctgcgacgtggcattgtataaacactaagattatgcttgctttgcatcctaccccgcctgcttcatcataaccgtattcttttgtttacgtgtgtgtaggagttcatcatcaatcacaaggaaccagtttcggtatcagggggatatgccagaatcgactctggatatgtacctgcatatcctcctcagctaagtaaccgtcaagagccgctcccgagcacctacatgggcacagagccggtgcagtacagaccaacagcatactctcagctggggggtccttctacctacacaccgaccctgactgggcaaacttatggttcggaatatagaccagcttctgatgttggtggctacagcagttataatctttgaattggttgctgtgtttaagtttatttgcagattaatttctctttagagaaaggctcatttataatataatagagagggaaaaggaacaagttctagagagccaatgtagttgttggaatgtgtaatgtaaatctaggtgccctttttttttttttttttcatacctcgatatatgtcacactacgtttctggtcaaataagaacatgttttttctttcttttttgtatgaatttgtttatcagaagtcagaatgattcagttttaagaaatttttagttaacgttttacaacaataacctgtaggagctttttcttaattgaataagtttaagctttctattttgatctgatgatgctaatatgaaagcattctccgaagaaccaaaccacatgagactttttgatttcaatgtccattcgtaactagtaacggaaaagatcagacagaaaaaatgtaccaatcattccatatttgtagttttacatgatatagtaatattctctaggtgtttaagttgtatatttcatgatttttacacattttaaaacctgattaaggcctgtttttaactttttatttcttcaaaccgtaagaaacaatccttgcaagaaacaatccttgcttcttcttctttttttcgtcaagaaacaatccttgctatattttcatttttacagcttcttgtttttaagagagcaaatataataaataaggacggctgaaaagaggtatatgtatcacaaaattaaacaaaagagaatccacctatcgacatagacgtggtatcctttcgatatcgacagaattatgttgaacgcagcaagttggccattaatcaaatctttgacgcgtggaatcattctattgtcaatgaaaacaaatattaaagaacaggtactacctatatacctaatagattcctctaacccgtcaaatgtcaatgtatcgaccgttacaattatgcacgtcttctaattgaaacattctctactttgccaatgtcttatccccaaaactacatataaatatgcatttacgggggcttagaatttcatcacaaaacttgcaagtatcattcacaggagagggaagggagagctcatcatacgaa

SEQ ID NO: 3447 - DNA, 3000 bp, Unknown
  misc_feature (1)..( 3000): cDNA_ID_2990640_gDNA_ID_1620647_Annot_ID_163279 3000 nt of promoter + ATG
tatccgtgtacgtggccggatctcattgcgtttgttagatttctgtgatgacgtggtgttttcctttacactaggaaacttcaatttggcattggaatgtaacatatggctaaagtaactttatctgcttaacatatttttcaaatatctaaaactatttctagaccgaattttagatatgtgactaagaagatttcttgatttacatcaaccaaaacaagagcaccatgtgctgtttcttatatggatataacagttcgaaataagttatcgtcttcatacatccctagaaccccaacgactggactaaaaccctcaacttctaaaataagacttattgtagaataataccaaattgtgaaaaaaaaaacaaatataaattattgactatagtttgaagtaagtcgtaattttttccgcaaggtaaattcattcaaagttaaaatgtggagagtgagagaaagagagtcgcgtggctattgggtaatgagaaacgattggacccatttggtatcattcggaagtgatatgtggcagagggcaatcatacgttttcgtcatagcgttagattttcttacagtttcttagagattatttcgattgtttgtgtcaaacgagtttagtatgttactgctattgaacagtagtattttctcatgtatcgatatgaatacgtttactctttttctttttttcacacaatcagatgaatatagggatgaatatacgtagttttgtctttgtcatatactagattatattcccaccagtcattttcctatgtatttaacaagacaagacgtagaaaaatgagaattttagtacttgagttaacatatttaaagattatattcccatcagtcattgaacatatgtgtacatatatatacgaggagaatctataacttagtaaggagggaaatatgagattttatttctatagagaaaagaaaggataaaacctctctctgccaacactggccaccgtctccaaagtccatcccagttaatttttattttttggaatcttcttatgttattactctttcttttcttatgacaacatgtcaacatgtgacctgtcgtcttctactttcttttcttcagcttttctccttttaagcagaatattcaatctatcttcaaattcatatctgagttttgtactataaaagaaaagcagacattaaaaaagatttgaatataaaacaaatgtattggagtggtaaagcacatcttcatcaaacatttttaaggagcatcaatctaattggtcgatggaaatggaagtaaaggaatagaagattgtttgtgttccatgatgatgtatatatatgcctaattaatgttactgttagttacctttggataacaaagatatttaaagcggtttaatgcttattaacggttgatggatgttaccttttctttttgacatcacggtagatgttacctttcataggtgttgaatagacagattggggacgttaattagtaatgatgtaattagttagagctaaatagtgctaataaatatatgtaagaaattgttcggaaagtaactaaaaaaagttcaattcatgcaagtagacacttcaaatgtgataaatgtataagtatgatgttaagcatgtgacccttgagagtcgattagggcactgtacaagattgacccaaatagttacaaactacaagtgaactctcttccattacatatctacgtgtattgaggggaccattatcgtacgtatacacgtatatatgttttgccctaaattcccaattttaattcagcatgggggacggactcattcaatagcatcgtctttcactttccttcttcggtttaaaatctcattttagtttctgatccaaaaaaaaatgtttgatcaaagatcaaaaacttagatagaaacaaactgtttttttttcttaaatcaagaaagtctaaaaaactaagatacaaaaagggactcgcagcggcagagagataagtatcttacgggccagcagataatttctatgttacgtccctttcatccccattgcatattgcatatgaagacaacggatattaactaaaatcttccaaaattacggtataatgaataataatacacttctgtctcatatagtattctattatattgttcgaaaatgttcttatttacatatctatttatattgttaattgattgcggctattactgtggatattcatcgtaactattttaatcaatacaaatcatgcaaaatagtgaatgacttagaaaagttgaaaccacatatgattgagtttagggggaaaagtataaaagaaagcatgactagtatgttactatgtagtaagcttcaaacatatatttaagaaaatactatatatagatacatatgatataacataacattaaaatatatggtgaaacattttttcttaatatcctaagcttcaaacatatacccaagtagagaagagttggagtattcattctttggttaaacatagacctaatacatagctcatatggacaatttttcgacaaaacaaaaatgatagcaaatgggctaaaatggtttcatatcgaaaagcccaaaccattaagccaaaacgacgtcgtacgatatgacagcggcgattcctataaccaccaccagaggttaaaaagtctctctctttagctatcttttttgtgttaccggttcaaatggccgccgtcgcagattccgttgagaacaacggttccataaacctccctgagaatgaaaaccttataccggcgggattcagtgccgccgcattgcttgacgaaaactctggcgctttccctgaattgaatcagcccgatagcttagctgctgctgagactaccttccccgatacgaacgattccgcggaggagaggtggccaggttggcctggtgattgcgtgtttcgtatgatcgttccggtgactaaagtcggagctattattggacgcaaaggtgactttataaagaag

SEQ ID NO: 3448 - DNA, 3000 bp, Unknown
  misc_feature (1)..( 3000): cDNA_ID_2990640_gDNA_ID_1620647_Annot_ID_163278 3000 nt of promoter + ATG
tcaacgcagatcaagttttgcaatatgaaaaaaaaattataatgtttgtgtaaatgttttttgttatattaatgaaatttcactatttctaacatattaatactaatgtatactgaatcatcttttcaagatgtaaaaaaacatataaatttaacaactgttttgaataatattgacaatcatttttgtagaatgctgagtggaagattagtatgtcattcatttaattacacttaaatatacatggataattaattaggataagttttcttatcaggcgttttcgtgggacaagtacataattaggttaatttcttatgggattctactctctttttttaaaaaaaaaatctagacatttccaaatgtcgatcgaaaacattataaccgaccacctgtataactttccgtcgatgtcccccgtatgtacaaaacttaacaggtcaccttatccgtgtacgtggccggatctcattgcgtttgttagatttctgtgatgacgtggtgttttcctttacactaggaaacttcaatttggcattggaatgtaacatatggctaaagtaactttatctgcttaacatatttttcaaatatctaaaactatttctagaccgaattttagatatgtgactaagaagatttcttgatttacatcaaccaaaacaagagcaccatgtgctgtttcttatatggatataacagttcgaaataagttatcgtcttcatacatccctagaaccccaacgactggactaaaaccctcaacttctaaaataagacttattgtagaataataccaaattgtgaaaaaaaaaacaaatataaattattgactatagtttgaagtaagtcgtaattttttccgcaaggtaaattcattcaaagttaaaatgtggagagtgagagaaagagagtcgcgtggctattgggtaatgagaaacgattggacccatttggtatcattcggaagtgatatgtggcagagggcaatcatacgttttcgtcatagcgttagattttcttacagtttcttagagattatttcgattgtttgtgtcaaacgagtttagtatgttactgctattgaacagtagtattttctcatgtatcgatatgaatacgtttactctttttctttttttcacacaatcagatgaatatagggatgaatatacgtagttttgtctttgtcatatactagattatattcccaccagtcattttcctatgtatttaacaagacaagacgtagaaaaatgagaattttagtacttgagttaacatatttaaagattatattcccatcagtcattgaacatatgtgtacatatatatacgaggagaatctataacttagtaaggagggaaatatgagattttatttctatagagaaaagaaaggataaaacctctctctgccaacactggccaccgtctccaaagtccatcccagttaatttttattttttggaatcttcttatgttattactctttcttttcttatgacaacatgtcaacatgtgacctgtcgtcttctactttcttttcttcagcttttctccttttaagcagaatattcaatctatcttcaaattcatatctgagttttgtactataaaagaaaagcagacattaaaaaagatttgaatataaaacaaatgtattggagtggtaaagcacatcttcatcaaacatttttaaggagcatcaatctaattggtcgatggaaatggaagtaaaggaatagaagattgtttgtgttccatgatgatgtatatatatgcctaattaatgttactgttagttacctttggataacaaagatatttaaagcggtttaatgcttattaacggttgatggatgttaccttttctttttgacatcacggtagatgttacctttcataggtgttgaatagacagattggggacgttaattagtaatgatgtaattagttagagctaaatagtgctaataaatatatgtaagaaattgttcggaaagtaactaaaaaaagttcaattcatgcaagtagacacttcaaatgtgataaatgtataagtatgatgttaagcatgtgacccttgagagtcgattagggcactgtacaagattgacccaaatagttacaaactacaagtgaactctcttccattacatatctacgtgtattgaggggaccattatcgtacgtatacacgtatatatgttttgccctaaattcccaattttaattcagcatgggggacggactcattcaatagcatcgtctttcactttccttcttcggtttaaaatctcattttagtttctgatccaaaaaaaaatgtttgatcaaagatcaaaaacttagatagaaacaaactgtttttttttcttaaatcaagaaagtctaaaaaactaagatacaaaaagggactcgcagcggcagagagataagtatcttacgggccagcagataatttctatgttacgtccctttcatccccattgcatattgcatatgaagacaacggatattaactaaaatcttccaaaattacggtataatgaataataatacacttctgtctcatatagtattctattatattgttcgaaaatgttcttatttacatatctatttatattgttaattgattgcggctattactgtggatattcatcgtaactattttaatcaatacaaatcatgcaaaatagtgaatgacttagaaaagttgaaaccacatatgattgagtttagggggaaaagtataaaagaaagcatgactagtatgttactatgtagtaagcttcaaacatatatttaagaaaatactatatatagatacatatgatataacataacattaaaatatatggtgaaacattttttcttaatatcctaagcttcaaacatatacccaagtagagaagagttggagtattcattctttggttaaacatagacctaatacatagctcatatggacaatttttcgacaaaacaaaa

SEQ ID NO: 3449 - DNA, 3000 bp, Unknown; identical to SEQ ID NO: 3145
  misc_feature (1)..( 3000): cDNA_ID_3594389_gDNA_ID_1620647_Annot_ID_163275 3000 nt of promoter + ATG

SEQ ID NO: 3450 - DNA, 3000 bp, Unknown; identical to SEQ ID NO: 3146
  misc_feature (1)..( 3000): cDNA_ID_1820850_gDNA_ID_1620647_Annot_ID_163274 3000 nt of promoter + ATG

SEQ ID NO: 3451 - DNA, 3000 bp, Unknown; identical to SEQ ID NO: 3147
  misc_feature (1)..( 3000): cDNA_ID_2049863_gDNA_ID_1620647_Annot_ID_163271 3000 nt of promoter + ATG

SEQ ID NO: 3452 - DNA, 3000 bp, Unknown
  misc_feature (1)..( 3000): cDNA_ID_2049808_gDNA_ID_1620647_Annot_ID_163305 3000 nt of promoter + ATG
ttcttcttctccttttaccaatctttgtacagttgaagctgaagctcaatgaaggaagaagaagaagaagatattaaaattgagagagcgaaaaaacgaattgttcttttgtgatcaatcaaaagacttggtttctgtctgattctcaccttctcctccaagttatgcaaatattattctccattaattagtggaagttaattaattagtatgattttaattttaatttctgctttcgctttattttatttgtcttgaagattcgaagttaggttcctttttaaatgtgacgattagactctgaattgataatgtatttttgaacgagtaaacaatcaacgacaaattacaaatctgaatctaaaaatgtatcgacgctggtctcttcgaaacacgagatacaatatcaattaagatgtaaagtgagctgaattacacttccaacaggaacttcatctgtgtgtgcatcaacacttgcttgttgtgagctctagagagtcgacagcatttacataacagtaaaaactcctgttgaggaattacttatgtgcttcgacggccttagagtaaaactcccatgactcgtgtgtctcagttatggcagtttgaccgaatggattctccgctacaaacttctgaacgttctccgcatccgctaatctttctagatacttccttagctcaccctcaggccctgtctcaagaaataaaacatcagtgtgctattatgcttaccattttattgaaagagaatgatgagtgatttaagactaacccaatgcagaatcttgacggtttgtgtactggtacgggctagggaagattccagtgtgtggctaaaagagaggaagagcaataccaacggatgttgaggttaaaagtgacacattcaatgcataagcctattcaaaggtgctcgagtacacttacaggattacacaaggccttgtcgggtgaatcgtcaactagcaaagtgtttgtctcatcatactttcgctttccacaactgatgcatgtcccaatatggtcccatactcttcgtaggtccttgaggaacaaaggtttatccttcttctcctgagttttaaacttcgttgtagtgcatatattctgatcctgtgtccataagattcattagctagctggtttttggaccaactattagaatgagttctgctcatacgtaagctacatatctcatagtcaaagaaatgcaaagttcacaaagattgtagactgtgtttctacaatctcaatctcaactgcatttctcataatacagtccttctcatataggaactgcatttctcataatctactctcaaagtcaagaaaatagctcatagaggttgcagggatcacttacaaaacagaacaacagattcctcgcatggtttttcatgacaatgttgatcatataatccaacccactagtaagagaaaaaggagagacagagttaattgaggaattaaacttcgtatatgtataagacacctaactaagaagagtcaaagacaatgcattttgggttttgaatcagttcaagaagctcacacacgtctggaagaccatatcgcaacatcaaatctctcaaagcaaaagtcgagaaaactaggaagaaaaggcctcctgaagactataaaaggacaaagaaattactctgcagtaaaagaaacataaaacaacttacaagtagcgacgttgaaattgattctttcttacctgatctgtatgatactttaccatctggaagaaatgtacctgtaaaaccctgaacaatatctgcaaggattccatttaaatcaaatataaccaactttctggtacgttgagctttacatgtgcatctaggtacatctccagtttctgatgaaataactccttgagctacgttatcattttgtattaagacagaacttgacaatgacgtttcaagcttttccctgtcaaattctggttcttcatctttcctaggtaatgaaacatcatccttcccctccatatcatcagttttatgatctaaagaattttttttcctcttgctcttctttgttttgacctcaaccttgctaacaccttctgctcccaaatcattctgatcaacttcttcctttttttcatttttctttatactatcctcctccatattgtcagttttatgatctaacaaatttttcttcttcttgcttttctttgttgtcacctcaaccgtactaacaccttctgctcccttggcatcctgatcaacttctccctttctatcctttttcctttttttggtatttttatcatcttgaacgctttcccccttagttgcagaatcttcaatgttactagccaaatccttactggcaatctccccatcagcattcccttcataatttttcacaccttctccattcgattgatacaacaaagactgtactgactcactatccatggtggcaactgattcgcagtttgttttgttttttatcttcctcttctctcttttgtgaccatcatcactaacaccttctgcgtcgagtgcatcctgattagattcaatatttttatcttttgtcatttctttacgttttccagatttctgaactccacttttctctctcgttgcagatttttcaattttaattgtcatatcctctcccccgaactcttgtccagcattcccatcaaaattttgcatgtctttttcgtttgactgattcaacaaacactctactgatcctgatggctcaaagacctccatatctgcagatgaagttttcttcttctttcccttccgttttttgctccttacatcacatacacctgctccaagaacgtcctctttaacttcagtgttttcatctgtttccttctctttagtttttccgagattctgaataccgttttcctccccatttacataattttccgtctgacttgccgaataactaattaactctcggccaccattcccatcattattttccacacgctctactggcccgcttttc

SEQ ID NO: 3453 - DNA, 2277 bp, Unknown
  misc_feature (1)..( 2277): cDNA_ID_3073773_gDNA_ID_1620647_Annot_ID_163304 3000 nt of promoter + ATG
ttcgccgcgcctcttcgtctccttcacagagatactcttcgtcaatttgaaaacttccaggtaatctcatctttttcttcttcttcttctccttctatttgtattaagcgtagcctgagaaatctcctggtcggttttgagacagtgccctgtgctctaatttcggttgataccttgacatgtccgtctcttcttcgagggtgatttttgtttttcaaattcagatttaagatgtgacccagttactaaaacttctggttttaaggttgccatcatttatgtggaatatcctcagctcgattgaatctggcagtttttcgtttttctcttgttaatggtttttgttaagaagcgttttggtgttttagtgaataagaacactgccaatcatcatttcacgaacaatggtattagaaagtgcataattttctggatggctgcttctttggttggaattgtttgattcacatttaatacatagtctctattgctcagtttccaatcacttaagagctccgtgttgggttttctagagctaccgtttgatggatttatgtgaggcatcttaatttatccgttctttgtgaatcatcacttcacttgtgctaaacttgagaaaacgtttcccttgatagttttgaactgcagctgatttccgactaaattaaaggagtaatggagagtgtttcagtggaaacactttcagaaactggaaactcaaatgacggtcaaacgaatccagaattgattgataagcataagaagagatcggggaaaaagaagagaaaatcgaggaaactggataatgaggtgaaggataatgattctcatatcagtagccaaattgggaacgcagatgaggccttttcatctcaagaaaaaaaagaaggggaaaatgagaaatccactagtgaaagtcaagttcggttatccgagaatcttttgtcttcattacctgcagagtcctgtcaacgagattcagtctcatgtgaagagcctagagctacactacatcatacagacccaatctcatgtgaagattctctaccagatgataataggaagggttctagtacaaaaaaatcaaaaaggagagagaagaagaagaagaaagaggacttgtcctgtgaagagaaattgttggatgaagttgaaaaaatcaccagcgaagaccaagtgcatccacccaacaatcctttgtcaaacggtatggtacaagaaaggtcaggtgaactaactcaggattcatgtgagaagcctggagcggcacaaatttgtacagacccaaatctgtcaacctgcaaagattcactgccagatgctactaatatgactagttcctcgaaaagaaagagaaacaaaaggagggatagaaatgtactgaaagaaagtggtgttgatattggtagcaccaatgcagaggttgctgtaactgacaatactactactgaagctgaaggatcaagatcgatgagtatagaggaaaactccgttgctagtgttttgataaatggttgtctgaaatccaaggttgatacagtggaacaactagatggcacagatgttcaaatcaatgaaactgtcttccaaactcagagtactaaagccaagaaaaggaagaagaaaaaaaccaaaacaatggaggcctgtgatccattaggaaatactctgccgacctccacggaaagcgggccagtagagtgtgtggaaaataatgatgggaataaggaaaaagatggaaacactgaagttaaagaggacgttcgtgaagttaaatacgatactatttctgaagctgaaggatcaaaatcgacgactaaagaggaaaaatctgttgctagtgttgtgataagtagttgtctgaaatccaaggatgatacagtggaacaaaaagagtgcacagatgtcaacatcagtgaaactgtggcccaaactcaggatcctaaagccaagagaagaaagaagagaaagaccgaaacaatagaggtgtgtgacccattaggaaatactttgtctacctccatgaaaagcgggccagtagagcgtgtggaaaataatgatgggaatggtggccgagagttaattagttattcggcaagtcagacggaaaattatgtaaatggggaggaaaacggtattcagaatctcggaaaaactaaagagaaggaaacagatgaaaacactgaagttaaagaggacgttcttggagcaggtgtatgtgatgtaaggagcaaaaaacggaagggaaagaagaagaaaacttcatctgcagatatg

SEQ ID NO: 3454 - DNA, 3000 bp, Unknown
  misc_feature (1)..( 3000): cDNA_ID_3091862_gDNA_ID_1620647_Annot_ID_163302 3000 nt of promoter + ATG
ttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtcatgtctccgacgacgacatcgttacgatccctaagcttctcgctttacgcttcttctaattctactccgatttctacaccaattgaggcccgacagttactgagttcatgcaatagattctacggtctgtcctcttcgagctcttcttcctcccttactacttcatctttgatcggaaatcttgttttctcatcaaggaatcagtctctctccgtaaaggtatacaatttcgtaaatttttgtgatggatttcaactttacggcctaaattcgagaacccatgttccacttattgagaaatctgcttaattcttatgtcacttgtagtcgattgggaaattagggatttctatatgtgccattgattgtgattactctttatgtggtctttttggtccatttgaagatgttttaagttaggtctctcagccacatagacgattacattagtcctgtgtttaagttcacactgtcttactttgattgaagctaggttgcgttaagggcttttaaataacatctaactttatgagtgtttggtgttgtcagtgtggctacatattgatgaaatgtatgtgtgttttgggataggtccaagcgttagctgctgaaaccgaacagccaaaatggtgggagaggaaagcagggccaaacatgattgacattacctcagctgagcagtttctcaacgcgttaaaagatgcgggagatagattagttatcgtagatttttacggaacttggtgtggttcttgccgtgcaatgttcccaaaggtaactttcccgttagctacttaacgattgtatctcttcgtgtatactcgatcatctctcatttcattcagttcgcgagtcttgaaccattatgtttcttaagcttgctcaaattatcggcttgcttattctaaagctgagactcttttcttattcttttccagctctgcaaaacggcgaaagaacaccctaacatcttgttccttaaagtaaactttgacgagaacaagtctctctgcaaaagcttaaacgtcaaggtgttaccgtatttccacttctaccgcggtgctgatggccaagtcgaatccttctcatgctctcttgccaaggttagttcttcttgtcccagctttctttaatttcaaacgtcacttgtctatcacgaaaccagagaatagttactgcattgtatagtcttgatggcgacctctaagtctaataagcgtctgcaaacatttatgcagttccagaaactgagagaggcgatagagagacacaatgtaggaagtatcagtaacatctcttcttcagcttctgagaaagttgaagattcaagtgaataatcaatgcctggttcagattgatcacagattattttgttaaatcgcttccctgtatatatgttgactgcattttccatgtggtgcatcataatttttgtacataaataaatgagtctgacttcgagttcatcgcctatcaagtatcagcttccctaaaccgagtaaaaccgggaagtgttgggtttcaaaattaacttggtgagttaacagttaacacacacatccaccgtttttagatagataagaggatgccctaataaaaccactgctttgtcttgggtaagaagaaacgttaacatgttagttgtcctacaaattcattcatctataaacgttaaagtctgtattaacgaatgaaagtaatcaaaagctacatatttattacacaaacaaaaatgcatcagttgcatctcgtctaagaaagcattttttcttcactcgaagaaaaataacaagaagttgaagccttaggctcacgagccaactcctttaacatgtcgagtttctaatccgagtaaaggatttgtatttcgtcgagaaagttgccgcttcttcaaatgtttggcatttgttaagttgcaacttgtctctcttcttcacgttgtccattgtatccttcccactggaatctttgtaggtggaataacaaacaaggaggaacagaaatcggtttgctaattggcgggttaatagttttgtaaaatggtagattaaacatgcgctctatcctgtaacatttctgagcttgagaacttgtagttgaggagaattcagtagcaaattcgttagtagcttccaccgctcgtttttcctagtattgtagctccaaatgtacatcattaatagatcatataaaagaaaattataatttcaaaaaaggctcaagttgaagtatccaacggtggtcaatttaagactataccaacgcctgtacttcaaaagtttctgcaagtattcattagcagtgacgaattcaaatttgaaaaaaaaaacttttatctgtaaattctccatccttaacggtcaaatttagtcgggcagcagacaaactctcaagtccgatcaggaaacgaaacgagaacaaaagaaaagagattggattttggtgacggcgtttccttcgccgtcgtgttcacc

SEQ ID NO: 3455 - DNA, 3000 bp, Unknown
  misc_feature (1)..( 3000): cDNA_ID_2051606_gDNA_ID_1620647_Annot_ID_163300 3000 nt of promoter + ATG
ttgatattgtatatatacatcaaacaagttaaataatggttttatccatattttctaaattctcctaattaactctactagagttaatatgtgtgtatatagtcacacatatacacaaacatttgtttctgctcgtggtctatatattgccttttaaaagggtcaaacatagtatagcttggatccttctttacttgtccctgatctctcctaatctctcgtcttccctctcttttgtgcttcatcgatctctatcggtcatgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgaggtataatttcaaatgaatttcatgtcaatatattaactcttgatccttatatatatggtttatattcatatggaaatttcagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaaggtattaatcacacgtctgttaattacacatatatgcgtaagcttttttttggttttaatgttaaaagtagatgcctaagtaatgtcatatatactcatattgattattagaagctcacgaagaatatgtctttttatagtactaattaatagcaaatgaaaagtaaatctacaaatctctaactggtaaaaacaatttcatgtagcattataagttggtttaaacagattaatctttgagatcttctaaaattcatgttacaagataattaactaaattatcatgttttttcttgttttgttattacagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgattattttaagtattttaattataactcgcatgcttaagaaataaaatataaaccataccataagccctcatagctagtaatatctagattatttgatacatgaaattttgttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtcatgtctccgacgacgacatcgttacgatccctaagcttctcgctttacgcttcttctaattctactccgatttctacaccaattgaggcccgacagttactgagttcatgcaatagattctacggtctgtcctcttcgagctcttcttcctcccttactacttcatctttgatcggaaatcttgttttctcatcaaggaatcagtctctctccgtaaaggtatacaatttcgtaaatttttgtgatggatttcaactttacggcctaaattcgagaacccatgttccacttattgagaaatctgcttaattcttatgtcacttgtagtcgattgggaaattagggatttctatatgtgccattgattgtgattactctttatgtggtctttttggtccatttgaagatgttttaagttaggtctctcagccacatagacgattacattagtcctgtgtttaagttcacactgtcttactttgattgaagctaggttgcgttaagggcttttaaataacatctaactttatgagtgtttggtgttgtcagtgtggctacatattgatgaaatgtatgtgtgttttgggataggtccaagcgttagctgctgaaaccgaacagccaaaatggtgggagaggaaagcagggccaaac

SEQ ID NO: 3456 - DNA, 3000 bp, Unknown
  misc_feature (1)..( 3000): cDNA_ID_1820805_gDNA_ID_1620647_Annot_ID_163293 3000 nt of promoter + ATG
atcagcctttgtatgtcaaggtaattgttaatgagaaagttttacaaaccattttactaaactcaatgtagatctgtgtatactctttttgcttatgtttacttatctgcagcagtgttagttttctatgtgcatcttaatgaattctacttggtatcttgtaatggcacagcgttatgagattgtgaatggcactactgaagttgaactggctccagaggatgataccaaggtggaccaaggagaggagaaaactgcagaaggtaacttcatgagcactatgtcttctttgtttgttgttaatctttttggaaagacaaaaacaatttaacatttttctctgtttttcattgcagagaaaggagttccaagtttctggctgacagctctgaaaaataacgatgttatttccgaggaggtagcctatatgcagttttggtgttcgttttataaacactccaatcataaccatggaatatgagcataacttattgtcatttatgtcaggtcacagagcgtgatgaaggggctctcaaatatcttaaagatattaagtggtgcaagattgaagagcctaaaggattcaaacttgagtttttctttgacacgaatccgtattttaagaacactgtcttgacaaagtcttatcatatgattgatgaagatgagccactgcttgagaaggctatggggtaactacttatactctcttgcaattgttgtatacttttaagtatattctgcttattagctgattgcattgagctgcttattttttttcttcgcttatattgcaaatggattcttattctttcaccattcattttcaggacagaaattgattggtatcctggaaagtgtctaactcagaagattctcaagaagaagcctaagaaaggttcaaagaatactaaaccaatcaccaaactcgaagattgtgaaagcttcttcaacttctttagtcctccagaagttccggatgaagatgaagatatcgacgaggaaagagtaagataacgattgttagaaaaacctgtcatcatttagttaatgtatttagtaactctttctcgttctttgatgcaggctgaggatcttcaaaacctgatggaacaagattatgacatcgggttcgtctttttctaaacacactttctctgttgattttatgggtttgcttttgagtcatgggactactttatcactgcaatcaaggtggttaccctttcattattatctgatcacaagtactttttactttctgcagatctactattcgggaaaagattattcctcgtgctgtctcatggtttactggtgaggctatggaagcagaggattttgaaatagatgacgatgaggaagatgacattgatgaggatgaagatgaggaagacgaagaggatgaggaggacgatgatgatgaggatgaagaagaaagcaagaccaaaaagaaggtataaagtgccccaagtatagttgtttcttttttttttttttttcttcatgccacgttagttttttactaatcctttgaaatcgcttaatatttttttttgcagccatcaatcggcaacaaggtatgtaacctttcagaactaaagtttatttgattttggaactccaacattcaaataaccaaacacaagaagtttcaggctgagcattgtgatgaaaatagaaattaatatcggaaatgtaggctctagaggcccatgaatcatacagattgctgaaagtaactgagcaatcctaaaaagtatgaatcagtaaataggtagttacgtagaagactctgagaaggatacatgaatgacacagcagagactaaacaagctctttaatcatggcatgggcagtacgagatagaaccattctcatgaattcattttattactatagtagcaaactagcaatcagtgtctatgtttgtgataaatgtgagaatcatctgcttaatttttttttcctcttggactgcagaagggagggagatctcagatagttggtgaaggtaaacaagatgagaggccacccgaatgcaagcaacagtaatcttttactacgctctaccagacataaaaggattgcgtgaaaatataattcaggtcattctctgttcatcaagaatgaggattgagaaaaggttttgggatttttaaaagtgaaattcatcttgtaggagtttcgttcgtttttctattggtgtgtttattttctctaaagcactttaataatataccttggtatttaatttatgaatcaagcatcatcatccctagtctctgcattcactacttcatcccctacctaaactttgtcgacgaaagagattttaataaccatttagatagtaatgggtagtgggaatgatcattattcttttgttcaccgtcctttgattttcaatggtaaccattttgttgtgtaagactacaaaagatgaataattggactatgaccatattatattagtcaagtctaaatcggtcgaaatcagttcacctttaagatgagtaatttgactaaatgcctccgcttgttcaacactaattataatttaaattattgtagaaggaaaacacaaagaaagtgaggttccgaacatccacaatttggactaatcacatactacttaagaagtttaatgcatcattagagctaaatgaggggaaaaaaaagctagctaaataaacttgagacacttgtttgtgtttggtgttatgaaaaacaaactcaaaagtcgcaacactgtttggtaaattggagacatgcgaagaggggaccgcttcgttaccattcagagtatttgacgtaatatattccgttttaagaaacctatctagtttccaagaaatttactaataaaggtgcttgagaaagaccgttgttgatgatacgtttttttatttgctaatgaaacgattcggtcgttgtttcttgaaattccactgttattagactcttgactctgttttgtttcccgccgatctcgtgatg

SEQ ID NO: 3457 - DNA, 3000 bp, Unknown
  misc_feature (1)..( 3000): cDNA_ID_1820809_gDNA_ID_1620647_Annot_ID_163290 3000 nt of promoter + ATG
agtaaaatggtttgtaaaactttctcattaacaattaccttgacatacaaaggctgatacagcgtttgatacttggcttcaagaatagctctctcctcacggaattttgcctctagttcatcatgttggctctgcgtggaaagaagtcatcagtaatcaaaacgcaacaccttacttttgaaactttaaattcagataagcagggagaaaactcacacaaaacaaaacaaaccccattaaacgatatatagcacacatagtttggtaaaatgtgaaagaaatttcgctaacctgtatatccctcaaggcatcaacgcgctttctcacattgggagtcagattctcgagcacatcagaacgctgaccagccagattctgcagcttgttctgtgaattaataacaatgtattaacaactcataaactatcattgtactagaagaatgacattgaaaccaaaacactaaacaccaagacacggcttatagtatctaaacaatcagaggaaagtaactcaacatcctccatatctttcaatagcaaatgctcacgggacagtttacagaaggggaaaaaaactcacctttagagcattgacaaggccagctcgatcctcgtccttaagagctgcaaaaaaacagtaaacaaaaggaacaccagtcagataacagaggaaattagggttaaagcagctctggcttaagaggcggagaaagagataagagtaatcgtgagtaggagtattttaccagcagtaagatcggagacgttgaagctatccttgtcgttgctcatcttctgaggatttggtgaagagagagattttgaagaagaagaagcagaagagactagggacaagggttttggggaggcgactcgtaacccttaaatcctctttgtttttttgtttttttctctccctccttttcacaccaaaattataacaaatgccattttagttttttctctttttatatatacttttctttctctaaaaattgatgtttaatgttttaaaaagcaaaattaagtttattgaattaaataacatgcaaaactttacatacatatatatatggataatgagaactgacttatatatagataattaaagtttatttatgaattcaatcaattataaatatatataactaatatataaactttaattatctatataattaaaattttgcatgtaattatattaattatctatatacttatatatatatatatacacttatatatatttgattcttcaccaaatacagtacaggttagtgaactttaatgggatcaaatagaagatttctgaatctgttagtactaaggcccatcccaagaatgagccttccaagcccaatacactgattacttcttttgttcacatacactgtacatactaattaaaaacaaaaaacagtccacaacaaaaacaaaaaaacagtccacaacaaaaagtcatatcccaaaaggcacaaagatctttagtttggtttaagctcatcccgagttcaaacgaattaaacgtactctaatctagattagctcatcacgacattttcaatttgaagtttcaaccttttatacgtctgaccagaaacacaataaagaagcctcacgcgtagcatttttttttaaccagaaaaccatgagacaaattcaacctaatcagataactgtaaatcatttcattcatcctattaaaagcaaaggtgaaaagctttttgtacctccacgactcccacttaagagaaacattttgtagagctttcaagtcacgcgtagcaaacacacctggtaagtggtcaatctttttatatcatatagccatcataagagtatcattaatagtagtttcttagcataatcttaatagttcttatgaatatttttataattgattttgaaaattttgaagttaagaatttagttaagagattgaaattttggcaatatgcaatggtggactcttaacttgagttcttaaaaaaaaaattggaaaaaaagtagaaacattataattttaaaaaacttaataattattacaactcaaaaaatttgaaacatacataacataaaattttaaacaaatatgacaaacaattagatttaatacttaatttatctaagaattaagattaattgaattaaaacattatatttaatacctaatttatctaagaattaacctaagaaacattagatttggctcttatataagagtcatttttaacaattaattgaattataacattaaatttaagacctactttatctaagaactaaccttataaactatgaataatgatggtctaagcgcgcttgttgttgaaactctcaaataaaccggataattttaaaaccaggtttagtttagttggtagattcggctcaaatagtagtatttttgtggatttaaagatgctcagcatgtatatacatatgtgttctatagatgttttacacattttttctattttactattctgcttgccataatcattagattgtttggttgaaccgaagcatagaaaccaaaccgaacatagcacacagcaacaaaaccggaatcattcagaggtaaataatttttttacattacccgcaactgcaaggaaagaggaaaaaaaaaaagacgcaaactttgagaaagacatcctcatcgttttctgtccatcgaagctctttttttttttttttttttttatcttcgtattcaattcttgagaggagagagagagagagaagcatcccagaaaacgacattctgttcatatggagttttttcaccagatcgagagcacgaagaagatgattactgggttttgatttagtcggcgaaaaatccgtaatctcattgttcgtgatctctgggttgtttttctggattgctggtgcggctgattctagtcaggattgtttttggggtccctttcgctctatttgaatctgcgtctgggttgttaagattgtacaaggggtttcgtggttatttatg

SEQ ID NO: 3458 - DNA, 3000 bp, Unknown
  misc_feature (1)..( 3000): cDNA_ID_1820817_gDNA_ID_1620647_Annot_ID_163288 3000 nt of promoter + ATG
accgcactaagccactctctggcacgatttgagcagcttcgtccctctagaccgtcttgttggatccgtaaagtcaggtcatcacgtatggccttcaagtcaccgatggctgtttcaagatcagtgatggcttgtctaagatcagtcttatgtcctcttctctccgccatattcatagattcacacaacacctgagcacagccaacgataagagatgagatgaaatccatttcgatgatttctcgctctttcttttacttgtctgagctaactaactaataaagatgaggtgttgactcataaagattaaagtaaagtcaactttaataaagctgtcttgcttgcttgtatgacttggttcaagaaacgagtagagagagataggaatcttcctcgaagtctcgaactgttgtttgcatgcttgtaatttctactggccaagtgaaggcccgataacaaaattggccctctaagagccttttaatgcctatagggtttttttgttgggtcaacaattccaatgatggtgcattttttttatgttgaatatatacaagatttgttgcatattaaaaagactggtcaagtaaagtgtttcaccgaaaatgggagacatcaagtacttatgaatgatgatatatgtaccgttctttagaattagttctgtgactttattacgagttagaacaaacctacttctacttctcttatccactttgcccgcaatcgcaaggaaagctaacaaattcaattaatcacacattaaacaaaataaattactagtgttcatatttgtctcggctttcttctcagtttatctaaaagaaatagctttcaataaaaaatcaatgttttttctacttttgtaataatttgtaaaaaaaaaacggtagatgattggtacattgtatttgaggtgtcttgggtattttgtctcttgcccatcatccaaagcccactttcacacatctcccatatgaataacatatcattacacattgtccaaagaaaaccgcacaagtggcatcaaacatatggaacatgaataaatacttcttttttatctatctgttgacgaataaatatttattgagatattagagaaaatagaataataatgaggagaggaaaaaagagagtttaaagacaagatatttacggaatttaatgggacgaaagaaaaataatataaaagggggacctgtctttgtcagtgcaatgaacctttttttctttcgatcaaatctctcccgccacccaactaacacatcttaaaccgtacacgtcaccctctctccttcccattttcttcgtctacgtgtcgaccatccaccggtttttgttttctgctaaacgtgggacctattcacatttttattttattttaaaaaattggacggattctttcatgttctttgggtcgttgcataattatgtccatgagtctatccatcaaaataccttcggaatcatctttttattttatatatatactgcgacaacaataattttatgttttgtactgtcttttctggtcaataaaaaaaactaaaaatttggtcgaatttaatggacttccatgaccaactcttcatttcccttaaggataaattgagaagaaaattatatactggaatttgaaaaagctttatataattgtaacgtatttttataattgcacgacaaatctcttttcttgattttttgtatgaaactacaaagaccaatttttctaacaactaagattcagttattatttttggtcacataaataaatgagacgataacttcataatggttttggttttgagtttgaccaaaaatggttttcaagataaataattagatgaataatgaaacgtaccccttaaataacaattatttagatattttaccggtggtctttcatttttcccgaatataaaacattgaattcttatctaaaggacaaagtattgttcttattctgaaaatgacacaaatttaaaatttttatttaaatctatgaatatctaaatggtatattatgtttggtgttttttagtccaatgattaggaattacgaataatgttttcgtaattcaaactctatttatttagattgaaaactatatgacaaataaaataattgcaaaacaatacaagatttaactcggactacgacacgtcatttaatgaaagtcatctttatgaaaatataaaatccattaaactgatgacctaactaaagttaaaagcaaacatattttattttgtttgacaaacaaaaaagaaatatatttctcccaaagaaaaaaaaaaccaaaaaactttatgtttgttaaaaaaataagaaatgataaaagcattttttttaaaaaaaatgttgaatataggaagtctgaagcaagtgtctttttatgaattaaatagtttaaaatttcaagaacgaaacatctccccttattacaaaaaataaataagccaaaaaaagtatcactttaataatgtaataaaataaagtgatatgtatataagtatacatacataaatagtagattcgaagcaattgttgcattagcctacccatttcctccttctttctctcttctatctgtgaacaaggcacattagaactcttcttttcaacttttttaggtgtatatagatgaatctagaaatagttttatagttggaaattaattgaagagagagagatattactacaccaatcttttcaagaggtcctaacgaattacccacaatccaggaaacccttattgaaattcaattcatttctttctttctgtgtttgtgattttcccgggaaatatttttgggtatatgtctctctgtttttgctttcctttttcataggagtcatgtgtttcttcttgtcttcctagcttcttctaataaagtccttctcttgtgaaaatctctcgaattttcatttttgttccattggagctatcttatagatcacaaccagagaaaaagatcaaatctttaccgttaatg

SEQ ID NO: 3459 - DNA, 1908 bp, Unknown
  misc_feature (1)..( 1908): cDNA_ID_2991550_gDNA_ID_1620647_Annot_ID_163268 3000 nt of promoter + ATG
gaattccagtattgtttccgcaagtatgtgtttatagaaaaaaaaacttttctttgttgttgaagggtatagttttgttaatgaaatgttttttatggaagtgcagtacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtaagattcttgaaacatctctctctctctctcattttcaacattttttcagatatttgattaggaatattttacataaaatatggagactgttttttaatctatgtatccatttcaggtttgagtatagactgagagtagcattgggacatgatggagatttgacgttaacatctcgtgttaagaatactgatacaaaaccatttaacttcacatttgctcttcacccctacttcgctgtttccaatatcaggtaatccaaggagtcataacttcacgttgatatctttttttttggttgtgttggtgtaagtgtcattgaatcagctggttgttgtattcagtgaaatccatgtcgaaggattacacaacttggattaccttgaccaacaaaagaacagaacacgtttcactgatcatgagaaggttataactttcaatgctcaagtaagcctctttccatttgccaattcaaatttcaacccttttattattttagtccatcactaaaaaaaaacacaccttgcaaaaaaagcttgacaggttgtacctaagcactccagatcaactaagaatcgtggaccataagaaaaagaagactattgttgtacacaaggagggacaagttgatgccggtaattacaaatttagatttgtaaacatacatagacatagacacagtcacacagaaacagattgttttagtagtactaatgatggatcacttgtaattacaatgtgcagtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttgaccctataaaagtcttgcattcatcatcctcatcctttaaaaaaaaaaacttaaaactgtctttattaaagtatacttaatgttcccgagagacatcacatggtgaacacaaagttagttgggttccaaactggactcttgaccagttttattgttttgtaactttagcattcatgaataaaaaaagtgcgttaattacaataattgttaaatgtaattaaataaaagtgcgttaactacaataattggatattggttatttgcaaaattcatgttcttaaatcatcagtctaaacaaaaaaattagattagccgaagatttcttcttctacccttgatgatactatttgggatgggcttgcttagatgtgccgaatccaattctcgtttttgggtctatctatatttgggctgggctttataagaggcgaagcccatgtcgaacaatcaatttttttttaattttatatttcttttgggagtctgttctgtcgtattgattaataaagtaaaaaatcttagccacaaaattaaatcatctccaagacgtatcaatatcatcatcaatccaccaatgaaaagttctctctttttttttcccactcttactctgttctcgctacagaatctcctgggaaaaaaaaaaaagaaacttgatccacccgaattccccaaatcttcacaatttctggaaactctctcgatcgtgaagcagaaaagtgaggttccaaatg

SEQ ID NO: 3460 - DNA, 3000 bp, Unknown; identical to SEQ ID NO: 3146
  misc_feature (1)..( 3000): cDNA_ID_1820850_gDNA_ID_1620647_Annot_ID_47621 3000 nt of promoter + ATG

SEQ ID NO: 3461 - DNA, 3000 bp, Unknown; identical to SEQ ID NO: 3145
  misc_feature (1)..( 3000): cDNA_ID_1820846_gDNA_ID_1620647_Annot_ID_47622 3000 nt of promoter + ATG

SEQ ID NO: 3462 - DNA, 3000 bp, Unknown
  misc_feature (1)..( 3000): cDNA_ID_1820838_gDNA_ID_1620647_Annot_ID_47624 3000 nt of promoter + ATG
ttgtatcttagttttttagactttcttgatttaagaaaaaaaaacagtttgtttctatctaagtttttgatctttgatcaaacatttttttttggatcagaaactaaaatgagattttaaaccgaagaaggaaagtgaaagacgatgctattgaatgagtccgtcccccatgctgaattaaaattgggaatttagggcaaaacatatatacgtgtatacgtacgataatggtcccctcaatacacgtagatatgtaatggaagagagttcacttgtagtttgtaactatttgggtcaatcttgtacagtgccctaatcgactctcaagggtcacatgcttaacatcatacttatacatttatcacatttgaagtgtctacttgcatgaattgaactttttttagttactttccgaacaatttcttacatatatttattagcactatttagctctaactaattacatcattactaattaacgtccccaatctgtctattcaacacctatgaaaggtaacatctaccgtgatgtcaaaaagaaaaggtaacatccatcaaccgttaataagcattaaaccgctttaaatatctttgttatccaaaggtaactaacagtaacattaattaggcatatatatacatcatcatggaacacaaacaatcttctattcctttacttccatttccatcgaccaattagattgatgctccttaaaaatgtttgatgaagatgtgctttaccactccaatacatttgttttatattcaaatcttttttaatgtctgcttttcttttatagtacaaaactcagatatgaatttgaagatagattgaatattctgcttaaaaggagaaaagctgaagaaaagaaagtagaagacgacaggtcacatgttgacatgttgtcataagaaaagaaagagtaataacataagaagattccaaaaaataaaaattaactgggatggactttggagacggtggccagtgttggcagagagaggttttatcctttcttttctctatagaaataaaatctcatatttccctccttactaagttatagattctcctcgtatatatatgtacacatatgttcaatgactgatgggaatataatctttaaatatgttaactcaagtactaaaattctcatttttctacgtcttgtcttgttaaatacataggaaaatgactggtgggaatataatctagtatatgacaaagacaaaactacgtatattcatccctatattcatctgattgtgtgaaaaaaagaaaaagagtaaacgtattcatatcgatacatgagaaaatactactgttcaatagcagtaacatactaaactcgtttgacacaaacaatcgaaataatctctaagaaactgtaagaaaatctaacgctatgacgaaaacgtatgattgccctctgccacatatcacttccgaatgataccaaatgggtccaatcgtttctcattacccaatagccacgcgactctctttctctcactctccacattttaactttgaatgaatttaccttgcggaaaaaattacgacttacttcaaactatagtcaataatttatatttgttttttttttcacaatttggtattattctacaataagtcttattttagaagttgagggttttagtccagtcgttggggttctagggatgtatgaagacgataacttatttcgaactgttatatccatataagaaacagcacatggtgctcttgttttggttgatgtaaatcaagaaatcttcttagtcacatatctaaaattcggtctagaaatagttttagatatttgaaaaatatgttaagcagataaagttactttagccatatgttacattccaatgccaaattgaagtttcctagtgtaaaggaaaacaccacgtcatcacagaaatctaacaaacgcaatgagatccggccacgtacacggataaggtgacctgttaagttttgtacatacgggggacatcgacggaaagttatacaggtggtcggttataatgttttcgatcgacatttggaaatgtctagattttttttttaaaaaaagagagtagaatcccataagaaattaacctaattatgtacttgtcccacgaaaacgcctgataagaaaacttatcctaattaattatccatgtatatttaagtgtaattaaatgaatgacatactaatcttccactcagcattctacaaaaatgattgtcaatattattcaaaacagttgttaaatttatatgtttttttacatcttgaaaagatgattcagtatacattagtattaatatgttagaaatagtgaaatttcattaatataacaaaaaacatttacacaaacattataatttttttttcatattgcaaaacttgatctgcgttgagtttgctttctttcaaaattcataatctcagaagaaaactacattaggtctctcttccccctagagccgctactccctctcactttttcactttttgacctctctgttttcgcatcaacaaagtgatgatatttcactaatcaatcaaacagagagactcaacttatttgactatataatgtttgacaaaccctaacggatcttttctcttttctttcttacaccatctcgtgcttctcccaatccaatcactgccccctctctctctctctctttggggaattcttacttccatgacctctctgcctctctctaatcttaaatgttctcttcttttttctgtaggagtttcctttttagtatactgaatcttaccttttccccatttaagttttaacctttttgctatatttagtaaacaagattttgtcatagggtttagggtttaacaatagacttcatacgaaaactttctgactttatatttttccttttcttaaaaaacacacactaactttaacctcaaattcaacagtcatcaagatttttctcggattctaatcaaacgtccacaggtgaaaatg

SEQ ID NO: 3463 - DNA, 3000 bp, Unknown; identical to SEQ ID NO: 3446
  misc_feature (1)..( 3000): cDNA_ID_1820835_gDNA_ID_1620647_Annot_ID_47626 3000 nt of promoter + ATG

SEQ ID NO: 3464 - DNA, 3000 bp, Unknown; identical to SEQ ID NO: 3444
  misc_feature (1)..( 3000): cDNA_ID_1807006_gDNA_ID_1620647_Annot_ID_47632 3000 nt of promoter + ATG

SEQ ID NO: 3465 - DNA, 3000 bp, Unknown; identical to SEQ ID NO: 3458
  misc_feature (1)..( 3000): cDNA_ID_1820817_gDNA_ID_1620647_Annot_ID_47633 3000 nt of promoter + ATG

SEQ ID NO: 3466 - DNA, 3000 bp, Unknown; identical to SEQ ID NO: 3457
  misc_feature (1)..( 3000): cDNA_ID_1820809_gDNA_ID_1620647_Annot_ID_47635 3000 nt of promoter + ATG

SEQ ID NO: 3467 - DNA, 3000 bp, Unknown; identical to SEQ ID NO: 3456
  misc_feature (1)..( 3000): cDNA_ID_1820805_gDNA_ID_1620647_Annot_ID_47637 3000 nt of promoter + ATG

SEQ ID NO: 3468 - DNA, 3000 bp, Unknown
  misc_feature (1)..( 3000): cDNA_ID_1820801_gDNA_ID_1620647_Annot_ID_47639 3000 nt of promoter + ATG
aagaagttcaaacatacaaaaacgtaggctctagacctttcttttgacagaaccaagtaagggaccatgcgaattggtttggatgtcttttcttacaaactctcatatataattgaacataaaagctgcctattgtaagatcaaagatgtatgattatggaccaagtaaaggtaacatatgtaattttcagaagaggaaaaaaacttaatactttatttaactcgcgcgcggtccgtttcagcgggtatccatcaactactataagccctagtagcacccattgaaacaatgctaagggcaagagggaaacatacacaaagaacagaatctgaatcacaataaatgaagtaagaatccgatcagatagatatgtatttaggaaaaaaacagaagtggcatgagaaaaataaacgatagagagatgggatacgtatgcggcatagggatcacaaattctctcaccctagtgacactttgagaggaacaagacacatatttagacatacatatgagactgtatgtatatctatatatgtgaatgtcagtgaaattggggttatgtccaacattttggtacttttcatgacttgtctcttgttttggtttcttctatataataaaatttcccaaaagggaccattacctctctgatcttcaccaccgtatcaatctgtcttgtgacatatattgatctgtgtgatgtgaactttctttttcttcgatattatcatctaatctttacatgcatcattatcacaaatatacttttcattcattagatcggattttctaagattttcttagctatatagtccagactaatcttcaacgtacgcatatatagatatatattaattatgtggtggtcaagcatatacgtccccaaacccaaacccaaaccctagaaaccctagaagataatctctgaagaataaatgcgtcgccgtcgctatcttgttgtctacaaaggaaaacggtttagaacagccgaattttatccaggtttggttcggtttggttaatgatctggtttggtccatgtttgcttctatcccattattttgttattgggctgaaaaaaactgggcttttaaaagggcatctgtttgttcgaattgaaacatataattttcccattttttctcccattaagagaagaaacaaaagataaaggtggaaatgggagtatgggacaatatattttgtctttagaatttactttttctttttttttggttttaatgttaagacagaagttacttttaactagattaaattcgtttttcgagcacctaaccaagttttaatttacaacaatgttgatagtgtgacacactataccaacacaaaacttctctcttttcacttgtccagcagaataacttatgattagttagagcattgttatttcattttagatttgttcaatgacctcctttcctctgtcttttcatacagaacgcgaaacgtaggagacgtcaaattaagcattagaaaccaatttgtttgtttttgtattgtgaaaatccaaggtttcgtatgctcctaactactttgatacgctataataaggtgatatttctcccgttccaattgcaatttcataacagtaatctaggtttatgataaaagaatttccaacttatttgatttttcttttcgaactcttcactttaacatgcgatttgttttgtttttcaaaatacatgtatagttttttatgaacaaagtaagtgtacacggtattattatatctgtcacaatggttagttggtgaacgttgggggattggataggggggtgttagtaagatttggttaatagagccaggtggcattctttgaatggttagtgggcgtcgaaggtaaagctttgtagtcaacgaagttaagtcataagatgcggcaacttgactttatcaacgaaccaatgtgtcaactaaacctcatttcatcacttcaattattgaattatagattaacacaatatcctactatagttcacgaggcctacatttgattaatccaatatcctaacgagttaaatatttaacatttaacagtcaaacaaacaatgcaacatttcttaaagtttgcctaaaatttaatttattaacataatttacattcatataagaaaatatatatagtttgtcatcaataaatatgcattgcacgatcgacttttactatggtgttctacatgttgtctacttagagtcacggaccacacaacttccaatatattccattttcaaagattcattatggtctattaaatgttcaagaataatagatacagtatgttttaacatataagttaacataaatctcataatatgaaatcagtatgttgaaaatctacatactttaattttacatctctctaaatatgatgtaatactcaatcttgaaaccaaacagacatgttagagacaaatatttaatttggatttttttaatgaaatttgatagatttcatatctaagtgtgtttggttatttaactactcaacaagaaaaaaaaaattagaaaatgggaaaatggatcttaaagaaataggaaaattgcaaattactcaactggtaactggcaaggtaccaagccaagggtttaaagtcacccgcccaaatgaagtaaactgggtcccactaacttccgattaaaatttgtaaatgacaatgagacaaaaataatacttccataattcaaaatcattattggcaataggagaattataaattgttatttatccatgattatattcttaattactctcccaaatgttctcattttggtgcaagtactctaatactccttaagatagtataataatgagatgacatgtgtgtcaaccttaatctataaatagcttcaagaacctcataactccaaacccaataatacccaatacataacattttcggtggaatcttcttttctccacacacaccaaagaaaaaaaaaacatccaaaggtttgcaaataaggaaaaagatg

SEQ ID NO: 3469 - DNA, 3000 bp, Unknown
  misc_feature (1)..( 3000): cDNA_ID_2051606_gDNA_ID_1620647_Annot_ID_47641 3000 nt of promoter + ATG
atgtactcacgtgaacctcttaatttattacttttggtttgtgttttcctccacagtttgacaagggcgataaatattttttattcacaaaataactatagataagttttagatctcagccgttgtagttcgaattaagcaaatttaaccagcagtgcactagtagttcaatcggttatctaaactttagtatagatctcagctgtctataatctatccgttaccattatctcttacaatctctaacgatatcattttttactagcaccaatattcagacagttgattgctcttcatcagtctctaaacatggccatataatccttgcgtaagtttatataacactggtctctgccctaaattttcgagggatccattttcctaaaaaagatttaattgtatagatttttgttagtgagcaagacacttgttaataatgctatgtactacatatatatgtatctttcaccaaatcagtttttcaaatttataaacataaaaagtaagaattgaacccccaaaaaaatacaagaagtaaatataactaaacttctattcttcttttttttttcttttttgttgaagaaatggtatttgtatttcttaatttgtttttctttttgcttaataacttcttttttatacattagatttttgatattgtatatatacatcaaacaagttaaataatggttttatccatattttctaaattctcctaattaactctactagagttaatatgtgtgtatatagtcacacatatacacaaacatttgtttctgctcgtggtctatatattgccttttaaaagggtcaaacatagtatagcttggatccttctttacttgtccctgatctctcctaatctctcgtcttccctctcttttgtgcttcatcgatctctatcggtcatgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgaggtataatttcaaatgaatttcatgtcaatatattaactcttgatccttatatatatggtttatattcatatggaaatttcagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaaggtattaatcacacgtctgttaattacacatatatgcgtaagcttttttttggttttaatgttaaaagtagatgcctaagtaatgtcatatatactcatattgattattagaagctcacgaagaatatgtctttttatagtactaattaatagcaaatgaaaagtaaatctacaaatctctaactggtaaaaacaatttcatgtagcattataagttggtttaaacagattaatctttgagatcttctaaaattcatgttacaagataattaactaaattatcatgttttttcttgttttgttattacagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgattattttaagtattttaattataactcgcatgcttaagaaataaaatataaaccataccataagccctcatagctagtaatatctagattatttgatacatgaaattttgttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtc

SEQ ID NO: 3470 - DNA, 3000 bp, Unknown
  misc_feature (1)..( 3000): cDNA_ID_1820791_gDNA_ID_1620647_Annot_ID_47643 3000 nt of promoter + ATG
cgagagttaattagttattcggcaagtcagacggaaaattatgtaaatggggaggaaaacggtattcagaatctcggaaaaactaaagagaaggaaacagatgaaaacactgaagttaaagaggacgttcttggagcaggtgtatgtgatgtaaggagcaaaaaacggaagggaaagaagaagaaaacttcatctgcagatatggaggtctttgagccatcaggatcagtagagtgtttgttgaatcagtcaaacgaaaaagacatgcaaaattttgatgggaatgctggacaagagttcgggggagaggatatgacaattaaaattgaaaaatctgcaacgagagagaaaagtggagttcagaaatctggaaaacgtaaagaaatgacaaaagataaaaatattgaatctaatcaggatgcactcgacgcagaaggtgttagtgatgatggtcacaaaagagagaagaggaagataaaaaacaaaacaaactgcgaatcagttgccaccatggatagtgagtcagtacagtctttgttgtatcaatcgaatggagaaggtgtgaaaaattatgaagggaatgctgatggggagattgccagtaaggatttggctagtaacattgaagattctgcaactaagggggaaagcgttcaagatgataaaaataccaaaaaaaggaaaaaggatagaaagggagaagttgatcaggatgccaagggagcagaaggtgttagtacggttgaggtgacaacaaagaaaagcaagaagaagaaaaatttgttagatcataaaactgacaatatggaggaggatagtataaagaaaaatgaaaaaaaggaagaagttgatcagaatgatttgggagcagaaggtgttagcaaggttgaggtcaaaacaaagaagagcaagaggaaaaaaaattctttagatcataaaactgatgatatggaggggaaggatgatgtttcattacctaggaaagatgaagaaccagaatttgacagggaaaagcttgaaacgtcattgtcaagttctgtcttaatacaaaatgataacgtagctcaaggagttatttcatcagaaactggagatgtacctagatgcacatgtaaagctcaacgtaccagaaagttggttatatttgatttaaatggaatccttgcagatattgttcagggttttacaggtacatttcttccagatggtaaagtatcatacagatcaggtaagaaagaatcaatttcaacgtcgctacttgtaagttgttttatgtttcttttactgcagagtaatttctttgtccttttatagtcttcaggaggccttttcttcctagttttctcgacttttgctttgagagatttgatgttgcgatatggtcttccagacgtgtgtgagcttcttgaactgattcaaaacccaaaatgcattgtctttgactcttcttagttaggtgtcttatacatatacgaagtttaattcctcaattaactctgtctctcctttttctcttactagtgggttggattatatgatcaacattgtcatgaaaaaccatgcgaggaatctgttgttctgttttgtaagtgatccctgcaacctctatgagctattttcttgactttgagagtagattatgagaaatgcagttcctatatgagaaggactgtattatgagaaatgcagttgagattgagattgtagaaacacagtctacaatctttgtgaactttgcatttctttgactatgagatatgtagcttacgtatgagcagaactcattctaatagttggtccaaaaaccagctagctaatgaatcttatggacacaggatcagaatatatgcactacaacgaagtttaaaactcaggagaagaaggataaacctttgttcctcaaggacctacgaagagtatgggaccatattgggacatgcatcagttgtggaaagcgaaagtatgatgagacaaacactttgctagttgacgattcacccgacaaggccttgtgtaatcctgtaagtgtactcgagcacctttgaataggcttatgcattgaatgtgtcacttttaacctcaacatccgttggtattgctcttcctctcttttagccacacactggaatcttccctagcccgtaccagtacacaaaccgtcaagattctgcattgggttagtcttaaatcactcatcattctctttcaataaaatggtaagcataatagcacactgatgttttatttcttgagacagggcctgagggtgagctaaggaagtatctagaaagattagcggatgcggagaacgttcagaagtttgtagcggagaatccattcggtcaaactgccataactgagacacacgagtcatgggagttttactctaaggccgtcgaagcacataagtaattcctcaacaggagtttttactgttatgtaaatgctgtcgactctctagagctcacaacaagcaagtgttgatgcacacacagatgaagttcctgttggaagtgtaattcagctcactttacatcttaattgatattgtatctcgtgtttcgaagagaccagcgtcgatacatttttagattcagatttgtaatttgtcgttgattgtttactcgttcaaaaatacattatcaattcagagtctaatcgtcacatttaaaaaggaacctaacttcgaatcttcaagacaaataaaataaagcgaaagcagaaattaaaattaaaatcatactaattaattaacttccactaattaatggagaataatatttgcataacttggaggagaaggtgagaatcagacagaaaccaagtcttttgattgatcacaaaagaacaattcgttttttcgctctctcaattttaatatcttcttcttcttcttccttcattgagcttcagcttcaactgtacaaagattggtaaaaggagaagaagaagatccattaaaccgtatctatcttttctctctccacttctatttccatg

SEQ ID NO: 3471 - DNA, 678 bp, Unknown
  misc_feature (1)..( 678): cDNA_ID_1820787_gDNA_ID_1620647_Annot_ID_47644 3000 nt of promoter + ATG
ttcgccgcgcctcttcgtctccttcacagagatactcttcgtcaatttgaaaacttccaggtaatctcatctttttcttcttcttcttctccttctatttgtattaagcgtagcctgagaaatctcctggtcggttttgagacagtgccctgtgctctaatttcggttgataccttgacatgtccgtctcttcttcgagggtgatttttgtttttcaaattcagatttaagatgtgacccagttactaaaacttctggttttaaggttgccatcatttatgtggaatatcctcagctcgattgaatctggcagtttttcgtttttctcttgttaatggtttttgttaagaagcgttttggtgttttagtgaataagaacactgccaatcatcatttcacgaacaatggtattagaaagtgcataattttctggatggctgcttctttggttggaattgtttgattcacatttaatacatagtctctattgctcagtttccaatcacttaagagctccgtgttgggttttctagagctaccgtttgatggatttatgtgaggcatcttaatttatccgttctttgtgaatcatcacttcacttgtgctaaacttgagaaaacgtttcccttgatagttttgaactgcagctgatttccgactaaattaaaggagtaatg

SEQ ID NO: 3472 - DNA, 3000 bp, Unknown
  misc_feature (1)..( 3000): cDNA_ID_1820979_gDNA_ID_1620648_Annot_ID_47645 3000 nt of promoter + ATG
atataacgaacgatataaaaagtatataagaattggtcaacggaaatggttgttaatttctctacaattgtgacacatcagtgtaagtaatgtgaacacttgatagcatacagtgatagaaacactccttttcaggtttcgaatttagagcaaataagactttagttatgaaagaaactggtccaggtagagggtatcgtcgatatgaggaatcgtctccataaacccatatttagtatcctggaccttcatgcatgtcacgtgccgcatggctctacttccacacaacaattttgtttgattttgatcttttaatatatatcgaagtattactgttaattaggatcgaaattttatagatcatcatcatataatcaaatccgacaagaagaatggattaggccgatgtttttggcatcaagttatttcaggaacacaagtgtttaagtggtccgttcaacagcgaattatattattttcaaagtttggtgggtcttgatcaaatctcaatgattaaatctagtaaacttaactacatacgaagactcgataagaattgtaatgtatgtgtgaaattttaggtagttagttcttggtcaatacagtcaaatcaccgcatcaaaacattcacatgaatagatttgacgttttcttgtcttcgaatagtatttgactaaacagtaatcagaaaagagaaaagaaacaatgattaagaaccgcgtggataataaagttatgagatgctctcactcatatgaaattatgaattgagtttggtttgacatcaaaactttaaaaatcaaatttagaaaccatcaacttagattcactaggcatttaagtaccctaaaatacatccgtagagtttaatctcgattttttttttttaagttgattgttgaccaacaacattacaaaattaataagtgacctagacgtcttagattttatatatatatatatatatatatagatatatatatatcaaaaatacgacgaataaacaacaaatgagtacacttctcgagaatgacctactatttggatttatgtgatacggtgtcgtatagtgtctttattttttaattaagctaatagtttgataaaagttttaagataaaaaaataaaaaattataaacatgtccgctctggccactggtgcggctcgcctagacgtattagatttgttaaattcaactaatgagctacaaaaattaagttattacttgtataagatggggttttggataacctaattatcataatttatctatctggtttattattccttgagatttatccttttgtcgaaagagattattccaaatctaaagtttaatgaaataggtttattggaacttggagctgtgataaataatacgtgtcgttgtgaattcaattatttaaattcaagtttttggacggtgttctgctggttcattgtctttatacgttggttattaccaacatttaagtctatatattcaatcatattgaataaaataacgaacaaaactaacaaatgaaactatatacagttacataaatggttcctgttacgtaatttgttttttctaaaaatcaattttaattatgtaaactcctctcctatatgaaagaatacaagctaagtaccaacagtagttgttgttgctctaaaacatatacaaaagtataaatagagcatatttacacacgtaaattgtcacttctccatagtatacttttatatatatgtgtttcggtgcggcacatggaacataaagaaacaaccaaaatcttctgaaacatagggaatgtgcaaagttaatttgtaaacatacaataattagaatactaagataaaattttagtcctaatttagtcttagcagtagtatgtcagtatctttttgttatgtcctaaaatgttagatacctccaaatcttcatatatatacatgttaaccacattattcaaatcttgaagatattagttattattttcataaaaaatttaaccacaatattcagatcgtgaagatatagttatatatatacagacaaaagacacccatcttttttacctaggaaaataaatcataccactttgttagacgtgctttaaactagagccgtttgaaattaatctttttacataattgaccactatatatatacacgtgaagcatccaaatactccacatatatgtgtgaatcagtgcatgccatgtacgttaaaaagctgttataaaaaacaggtgtaagaagatatggaaataaagtgacaaaaaacacattaaataaaagagagaaacatagagataaaaatggaccgactcaagacaagagaattgaagcagagtgcacacacatactcagtaataggccgctgctacggtctctgaataaaggagatcatcttcgcagttcactctcgttcatttattatgtttccttatctcttactgatcacattcaattccaaccatacaaaaagtttttttcaccccgataattttgactgcgcgataaaattaattacaactactatctaatctcgtctttaatacagtactaatatcaactaatagaacaatttcgactgtaacaagctacaccaatgattcggagcttgagttaataaaggcaaaaaagaattacaattacatttgtagactcgtagggtgattcagtctctagaccaaaagccaagcagtaacttttaaaataatttacagttttttagagaacattttttgtttttcatttatcttcagaaaaatcttgataatcccaataatcaatctttacaatacaactttaattgtgaaataaacaaaagtaggccacttttattaaaaaaaactcaaaccccaccattttctcttgttcttctttatctatctctatctctccactctctgtcttacattaaaacctcaaaaacatttcctttcctctcatcaatctaaagttgaagtcactacgaagaaatagtaagtaaagaagttgaagatg

SEQ ID NO: 3473 - DNA, 3000 bp, Unknown
  misc_feature (1)..( 3000): cDNA_ID_1820975_gDNA_ID_1620648_Annot_ID_47646 3000 nt of promoter + ATG
tgatcatttttttaagattttggcttctggattctaaaggtattgactttgatcttgtttttgcagaccgctagggttattgagaatgcggaaggaagtcgaaccacaccatcggttgttgctatgaaccaaaaaggggaactccttgttggaacaccggctaaacgtcaggccgtgaccaatccaacaaacacgattttcggttctaaacgtttgattgggagacgttttgatgatccacagactcagaaggagatgaaaatggttccttacaagattgttaaggcacctaacggtgatgcttgggtcgaagccaatggacaaaagttttctcccagtcagattggagctaatgtcctcactaaaatgaaggaaacagctgaagcttacctcgggaaatctatcaacaaagctgttgttaccgttccagcttatttcaatgatgcacagagacaagccactaaggatgctgggaaaatcgctggtcttgatgtccagaggatcatcaacgaacctacagctgctgcactatcatatggtatgaacaacaaggaaggtgtcattgcagtgtttgatcttggaggtggaacctttgatgtttctatcttggaaatctcaagtggtgtttttgaggtagtcccttgtttcttcttctgctatgttatttttttttgaattgccttttctcttttgtgggtatatgattatttttctcttatcaggttaaagcaacaaatggagatacctttttgggaggagaagactttgacaacaccttgttggagtacttggttaatgagttcaaaagatcagataatattgatctgactaaagacaaccttgccctccagaggctgagagaagctgcagagaaggccaagattgagctctcatcgacaactcagaccgaaatcaacctgcctttcattacagcggatgcttcaggagctaagcacttgaacatcaccttaactaggtcaaagtttgaaggtttggtgggcaagttgattgagagaacaagatccccgtgccaaaactgcctgaaggatgctggagtcacaattaaggaagttgatgaggttcttcttgttggtggaatgacccgtgttcccaaagtgcaagagatagtttctgagatctttgggaagagtccttgtaaaggtgttaacccggatgaagcggttgccatgggagcagccattcaaggtggtatcctccgtggtgatgtgaaggatttgcttcttttggacgtggttcctctctcattgggtattgaaacattgggtgcagtcttcaccaagttgattccacgaaacaccactattcccacaaagaagtctcaggtaatgaatcttgacagagtacaatatcagagtgcgtctgaaaactgttgctgacttttatttttgtcattgtgatttggttcttaggttttctccacagctgctgacaaccagatgcaagtgggaatcaaagttcttcagggagaacgtgaaatggcggctgacaacaaagtgcttggagaattcgaccttgttggcatcccaccggcacctagaggaatgccacagatcgaagttacattcgacattgatgcaaatggtattactactgtctcagcgaaagacaaagcaacaggtaaagagcagaatatcacaatcagatcttcaggtggtctctcagacgatgagattaacagaatggtgaaagaagctgagcttaacgcacagaaggatcaagagaagaagcaacttatcgaccttaggaacagtgctgatacaacaatttacagtgtagagaagagcttgagtgaatacagagagaagattccagctgagattgcctctgagatcgaaactgcagtgtctgatctcaggactgctatggctggtgaggatgtcgaggacatcaaggctaaggtcgaagctgcaaacaaggcagtgtcgaagatcggagaacacatgtctaagggatctggatcatctggttccgatggaagctctggtgagggtacaagtgggactgagcagacgcctgaagctgaattcgaggaggccagtggttcaaggaagtgaggttgccgctaaccggttccatacagaaatcaggtttttcccaaaataagtttacatgcttatctcctccctcacaaatttgattagttttgtgtatttaaaaccttatttgagaggtatcatctcttcgaaacctattgagagtcccggatgtagtttgtttgattggttattttcatgaagtttacggttattatcttgaccggttaaatgagtcaatttcacataagattatgaccttttaagtttggtttatggatgaagaatggcgataattgaattgttttgtaacccttggaactttgaaagtaaaacagtttataggaaaatctgggctttgtcggtttttgtagtgcaaagaagcttgatgaaaaagacttggtcatgttgttggcgttgtcgttgtaaggcctcaaattcaattacttgtggaacttacctttgtccatgaacggagacaaagttagcgaaaatgtcagcaaattatggacatgcattttgttcctcgaaggtcgataatcttatgatctcacgcaatttccacctttttaaaattgttggaacgcatattcaaatgttgattaagaaaattaaattataacgacatagaagaaacagttccatacttaaagattttaaacttttttttaattcctcctggtcagaggggtaatatcgtaattttctaaaggcaaagaacaccgctataaatagtggctgttgaagtcgtcttctctctcaaacaaaattcaagagtcagctttatcagagaaagtttcccccattggtacagtttgattctctcttattcaaactttttcaaaagcgtgttcttttgcaagataagaagataaagaccaaaactttgggtcaattatatagacttttcattttgtattttgcaggtgaaaatttgtaagagatg

SEQ ID NO: 3474 - DNA, 3000 bp, Unknown
  misc_feature (1)..( 3000): cDNA_ID_4262366_gDNA_ID_1620648_Annot_ID_47647 3000 nt of promoter + ATG
cgtcgatcactacgaggtaacgataacaataaacgaacgaaacattcatctaaaagttagactcatttcaagaagaccttataatattgtttttgaacagggagcaccattaacggagtacacattgagattgataggatcggacgtagaacattacataaggaagatgttgttcgatggagaaatacaatacaatatggatgcaagagttcttaatttcagtatgggaaagcctcgtgtacaattcaataccagtaacattgaaggtggtggagatggtcagcctcaagaggacgcttagtgaaacaaactctattttataatcatgtaatgggaatataaatatattgtagtatgctttttaattttgtctatcacaaagtaacatatgtatatatcatgacatatgctataattatttttgtaataatcaatcttaagtttctttgtcttttcttgttaatgtaaggtcttaaggtcatgtgaatatgtaatgtcaaagaaactcaattctggtcttgctcattcatgttccttactccttgcctctttttaaaaagatttcaaactgatgcaaaacttgttagttttaacatttttacccaaaaagttatattaagtttttgaatttgtcaacgtttactaattatttacaattaaaaccctgttcttcttatcctctggtgtttctcgttgttcgtcaccaagacgaactttgtgagggagaaaaaatggcgaatttactggaaacatcaatctttttctcctctgctgataaattactgtctttcccgcctaagaattctcaaacccatcatctccctttctctgctttcatcaatggaggaagaaagatacgcaaaagctcaactatcacctttgctaccgacactgtcacttacaatggcactacaagtaagctcataaaccctaaatctctaatctttctgtctaattaccaataaattctatttctttagattccaatttgtattaattgtcaccattagataagctaaacccttttcatagactaggattcgtctagttagagaagctttttttattgaagatagaaattttgtgtttaggtgcggaagtaaaaagctctgttgaggatccaatggaagttgaggttgctgaaggttacactatggctcagttttgtgacaagattattgatctcttcttgaatgagaaacctaaagttaaacaatggaagacgtatttggttttaagagatgaatggaacaagtacagtgttaatttctataagcgttgcagaatccgagctgataccgaaactgatcctatattgaagcagaaactggtatctttggaaagtaaagtcaagaaggtatttatagtgttgtattttgtgtttattagtgaactcaggttagtttattgttgttgttgtgtacttataggagtgagtattgttgcagatagataaggaaatggagaaacacaatgaccttttgaaggagattcaagaaaacccaacagacataaacgcaatcgctgccaagagacgcagagactttacgggagagtttttccgctatgttactttgttatcagaaactcttgatggcttggaagaccgagatggtacttaaaacattaatcatgttgcttacttattgattcccacagtttcatgattgttttgttatttttgagcagctgttgcgaggcttgcaactagatgtttatctgctgtgagtgcttatgacaacacgttggagagtgttgagactctagatactgctcaagcaaagtttgaagatattttaaactctccatccgtggattctgcttgcgaaaagatcagaagtttagccaaggcaaaggagcttgattcctcattgatcttattgatcaacagtgcatacgctgctgcaaaagagtctcaaactgttacgaacgaggtaatagccattggattacaatcttctttaatattcttcacaatcttctcaaatcgatatcgtattttttgaacaggctaaagacataatgtatcatttatacaaagctacaaagagcagtcttagaagcatcacaccgaaagagatcaaacttttaaagtacttactcaacataacagaccccgaagaacgattctctgccctagctacagcattctctcctggtgatgaccacgaagctaaggaccctaaagcattatacacgtaagtaacataaagatgcacactttagtgtttcatctttaaccacaaccattgattctaaccaagctgatgacacaggacgccaaaggagctgcataagtggataaagataatgcttgatgcttaccatctcaacaaagaagaaacagacattaaagaagctaaacagatgagccaacctatcgttattcagcggcttttcattctcaaggacactatcgaagacgagtatttagacaagaaaacaatcgtggctgatgaaactccaaagaaggaagaagaagatacgactattgaagattttttgaactgaaaattgtgaaatccatgaacacactctgtttacaattagtaccttttatgtaatggggaaaagagtaattttgtagaattctcagctataattgcaattacgactaaatgtgaggtctaatttgtaattaatatttttggcaaaggtcgggcctggctatgagatcaataagcccatgtagggtccaggttagtaagaaaagtcaacataatacttgtagcccacgaatatttttgattggtattcctatattaccccgtgtaatctatgttactttataaaaacaccataaggttataacagtcattttgagtttaatcaacctttattataaggccttaaaccctacgcgtaagcagcagccaaaacatttcttgttcatctctccgaccttaaaccctccgatccaaaaatctccaccgactctaatccaatcaaatggcctccgtcgcgcttctacggtcttttcgtcgccgtgaagtccaaatg

SEQ ID NO: 3475 - DNA, 3000 bp, Unknown
  misc_feature (1)..( 3000): cDNA_ID_1820955_gDNA_ID_1620648_Annot_ID_163329 3000 nt of promoter + ATG
taaaaaataatttactgacgcaggtagacgataagtacatgtactcggtggaaaacaaagacaacaaagtacacggttggatatcgtcggaccaacgtatcggtttctggatgatcacgcccagcgacgagttccatgcatgtgggccgatcaaacaagatctcacttctcatgtgggccccaccactctttcggtgagtacatacattctttttcaaaaaaaaaaaaaaaaaaaccaatttctagttttaattgtaaaatgttactaaaaatttaaaataacagaaatgtgatatatggtttggatgattgtgggtgtggcatgattgattcgatgtactattgattttattgagtctacattgtgtatttctgtttatctcttattcaattctaagaatattgtgtgttttagatgtttacaagtgtacattacgcgggaaaagatatgaacacaaattataaaagcaaggaaccgtggaagaaggtgtttggtcctgtctttgtttatctcaattctgcttcttctcgtaatcttctctggaccgatgctaaacgacaggtcttttacctatcaatgaccccattctttcattcgctttaatatcatcatcattattgtttacgtaaaactaaaatgttttagaaactatatatatatatgtagatggtttccgaggtccaaagctggccttatgatttcgtgaaatctgtagattaccctcttcatcaccaaagaggaacagtcaagggtcaattatttgtcatagacaggtaaataaatctatcattttcttagaaaggtttacttacaattacatgcaattgtatatcgtcaaaataatgtttttcaatccatatgtgagttattacaaaatgttgcagatacatcaaaaacgtgacgtacttattcgggcaatttgcttttgtgggattagcattacctggtgaagctggttcttggcaaaccgaaaacaaggtagtacactactactatatttgaaatttgtaaatatataccattacattgccatgacaggtacatgcaaaagagagtgatttttgtcatgagatttgtaaaacaaatttactgttactttcatgctacacaatatatatcgtccgtttaggtgatcgaaagtactcatttgctccgatttaaagattgatctatgaattgactatgcggatgaagtaacgatcttttttgccaaatggactaaactaacggcttttaataatcttttacaataaaatctggacaaagggatatcaattttggacacgagcagacaaaatgggaatgttcacaatagcgaatgtgagaccagggacgtatagtctctacgcatgggtttctggatttatcggtgactataaatatgtgcgtgacattaccatcacaccaggtacgtttcttttatttatatcacatcttttagtataaacattacacaacatgaaatgtgtgttccgtgtcccgttgatccaactacagacgcattaatggccattatttggtccatatgtttttatgtaagggttataattgttatgtgccacagctgaagatgtaataaggcccattactaggcctaagtatcgtggtgcatataattatgtatgtgtttggtttggccgataggtagggagatagacgttggacacatagtgtacgtgccaccgagaaacggcccaacactgtgggagatcggacaaccggaccgaaccgcggcagaattctatatcccagatccggacccaacccttttcaccaaactttatctaaattactcaaatcctcaagataggtaacatattaagcatctaattaaatattatttacaatatacttttattttaatatactaaatggtgttttatttaatttatgtaataatacagatttagacagtatggtctatgggatcgttacagtgttttgtatcctcgaaacgatcttgtttttactgctggagtgagtgactataaaaaagactggttctatgcccatgtcaacaggtaataatttttatttttatttttttgatgattcaaagtgttgttgtataaatcactgatctctctcgatacaaaaactatatattttataatatataggaaagctggaaatgggacatataaagcaacgacatggcaaattaagtttaatttgaaagcagtgattcaaactagaatatacacacttcgaatagctttggctgcagcctcaacaattgatctactggtttgggtcaacgaagttgattccaaacctctattcataactgggctaatcggtcgggataacgcgatcgcgaggcatgggattcatgggttgtacaaattgtacaatatcgatgttcatggaaagttacttagggttggtaataatactatttttcttactcatggtcggaactctgattctttttcaggtgtaatgtatgattatcttcgtttggaaggtccttccggagtttgataaactaaatacatatattaatgtgtaagtaataggagggattatatattttaattagtagtcaaaagtctaaaatatatatagaaaaaaattgtttgacaattaaatttgttacttatttggcctattttagtttttcttttgttattaatgtaaaactaatcattcgataagttcatcaagttcttcatactttagagtatttttaattaaaaacaaaaaagtggccaaaactgatttataaagcatatagttatatcaaatagtacaataatcacgatgcatgatatatttgttagtatatgaacattataagtaatatgtttatgttaaatatgttaagaaaaaatacatatatgtaagtcaacttctgattggtatgagagacctaaagtcaaaacgatatttctcaaacgaaacgtcagcgtttagccccatttatgttctcactcttttctatataaaaagaaaggtactctagctcgcttaattgttcgaaacaaagggagtgagag

SEQ ID NO: 3476 - DNA, 3000 bp, Unknown
  misc_feature (1)..( 3000): cDNA_ID_2156699_gDNA_ID_1620648_Annot_ID_163328 3000 nt of promoter + ATG
aaagttaacaatacaagcttaggatttaattttggtttttggatataggattttgatattatattttaattaaatttcttacggtttaatagaaaaaaagcggtcactgaaaatgaagaatatgagcacgaaaaatttatagaagttttgaaattcctttattaaaattcctagaatttttttactaaaaaaaaaaaaaaaaaaatcagaccaagcgtcacacacactgaaccaacgtatcaataggtaattgttgttagctttaatatataataaaccatagtcaataatgtgcatttaataaacaaagcagtcgagatcaacggtaacactagttgaaaatgtcatcatagctcactatattttgaattttcatttttatataatgattcatttttcgttacatgtagttcttaaagtaatccgggggatatcagagcatgatttaaagcggtagtgtgttgcataattggggtatagctaaaaaaggaattgaccattaattttactaaagagtggccaaaatttatttgccatttacaatcaaataatttaattataagatccattattcgttacaatagatgccctctatattatgcgtatgtatgtacgaatctaattttattgatatttgcaaagatgtttatggacttgtgccatgattcgatgatcagttcgtaagaccttccttattattctgatggcccaaaccagaagcccactaaacaaagagtttttttttttttttttttgaccgcgaaccattatataacgaggcttaaaccattagattcagattctactagtactgacgtctccattaattgatcaaacatttggtaacttcttcctacattagaggcgtttattggttcatggattttaatggatttaaatattttctaaaaagttttaaaattatgcggattttatttatttaaaatcaaattaaatggatttgaaaatcatacaacatggatttcaaaatctaacatctagataacttttatgataaaacaaaaaaatagcatataaaaataagaaataatctctagtattgctggttttttggatgctttgttctaattatgttaaagacattgttgggaatttttttgctgtatcccacgcttacagactactacaactaccatccttgaatctctctcttctcttagctatttattattaaaaaaataaagttgctctacgagacacatgcattctaaaaaatagaaaatgttgatattgtcatttctttgcaaatccacccaaaaataacgtggtggaactagggattttcacctctttattgttaagaaaaatatattttcaaatccattcaaatttattgtgaaatcaaatccatacccaaatctccaatattgaataaatgatgattttaactaatatttaaaaatcatagaaccaataacacatgatttttgtaaagattctaaaatcaatgattgattaacacatgatttacttgaattttcaaattcattataatatatgggccaataaacccccttcaattatctaatggcaactttattctaataggaatatttgcacctaatgacacttaaagaacattagttatcaatgtaaacactttttgatttttaaagtgtatatttttaaagttacatttatttatgtatattatttaatgataattaaaattgaggtcaactcatcctaacttaatcaaattaaatgtaatctttatatttttaaattgtttaatattttcctacacattaatatattatttaaaatatatcaatactacctttttttgtctaaaatatcaatattacctctctttagtatattactaagataattgttttctgaattgaattcaaatttattgcatttgactgaataaaaagttctgtaccttttctttgatgaaacatcttaaaattcttaaagtcaaatttcaaaggctttgaactcaaatacattattacttattagcaatgatttggtaggttcatcatgtccattaaaacttaattaataatcttttctcttaaattacataactatttaatacgaaatttcctatttggaatatgcatttctcttaataatgtgacatatgtggttcttatcaataaaaaccaaggagtctttaattcaaaacacacataaactctattagtcaaaagttattatggagttatcccttataaatatgatattatatataaacacggaatttcttacatgtgtaggaaaagtagataagagatttaaagtaacttgattttaaaagaccctatattttcagaatcaggtcgtcttaatgtcaaatagtgtaatttgacccaaataaaaataaatcatgaagcacattgaagtttcgaaaaagatgatgtaaaatttggaaaattaagataatctgaacctagtttatacacatcaaaaaaatctgaacctagtttattaacttaccccccatttcacaaaattaaaaggaataatatttgaggaaaattaattttatttatcatatatatatatatatgataccacaaatacaaatataaatgaatacatacctcctccgcctttgtactgatcgagcataaaaggttatgatctcttcttcttcatttttgttaataagatggtaagatacaatattttacgagagatataactttcttcagtggagagagctcctcttatccgaggaatcaaagctgcaaaggaatccaacaaaggagaagataaaccgttaaagtgtctaagtcaacgtaagtgtttatatatatatatatgattttttttgtagtgttatatattgaacgtgtaaggaggttatatagacattaacgtatagatctagatctacgacactgtcttcgctgattacagtttatacaagaggtttgacgtaatcggtctatagaccatgtctaaactaatttcagtttctgttttattttttgtcggaggtttagcgaattggccaaggag

SEQ ID NO: 3477 - DNA, 3000 bp, Unknown
  misc_feature (1)..( 3000): cDNA_ID_3071266_gDNA_ID_1620648_Annot_ID_163327 3000 nt of promoter + ATG
agggtaatctacagatttcacgaaatcataaggccagctttggacctcggaaaccatctacatatatatatatagtttctaaaacattttagttttacgtaaacaataatgatgatgatattaaagcgaatgaaagaatggggtcattgataggtaaaagacctgtcgtttagcatcggtccagagaagattacgagaagaagcagaattgagataaacaaagacaggaccaaacaccttcttccacggttccttgcttttataatttgtgttcatatcttttcccgcgtaatgtacacttgtaaacatctaaaacacacaatattcttagaattgaataagagataaacagaaatacacaatgtagactcaataaaatcaatagtacatcgaatcaatcatgccacacccacaatcatccaaaccatatatcacatttctgttattttaaatttttagtaacattttacaattaaaactagaaattggtttttttttttttttttttgaaaaagaatgtatgtactcaccgaaagagtggtggggcccacatgagaagtgagatcttgtttgatcggcccacatgcatggaactcgtcgctgggcgtgatcatccagaaaccgatacgttggtccgacgatatccaaccgtgtactttgttgtctttgttttccaccgagtacatgtacttatcgtctacctgcgtcagtaaattattttttaccctttttaacttcaacggtattattactttttttttccagaaatagaacttttcttaaatggacccctaaatgggcttaaagaggaatccacagtcgagtgattttgatttgactttgataattatgatgaatttttttattttatttttccaacaattatgatgaaattttgagtgtctttttttggtagtccggtttcatatgaagtataaccggtgtaaaacaaaactcatatgattcgtatacgaatgtttttcagtggtggatcaatattttatcgtatatgaataaaattatatgtaatacctgccctttaagcatatgattttgtggatttatcaaatgaacagcttctttgtaagccaatggactggcacgacctttggtaatgtctcgatctgtatcaaaaggcattattttttgccgattatcggaaacagccatgaaatcgaatctgcaaacaaaataaaaattttattttctcaattataataacaatagttaaaaatatgataaacacacaataattactttgttgtgttaagcttgaagacgattctgatttggtccatgtccacgtcaggccaacctattaacctctccaatacagcgtacatgtatattccggatacacctcttcgaataatatatctttaaagaaacattctcgattatatgataatctatatgatttaacttctccaataaaaaagaaaagaaaataagtagtgactactcttttttttcggcaaattgacgtaccgtttgtctacgtttaatgggattcctgagccccgttgagagaacgttctcgaaaatgaaatttcaatttgttcacttgtttgatttacaatatcgaattttgttcctactaaactgttagaacataaaattaatataaaaaaataaaaataaatatttagtaggtatgattatgaaatatatatatatatatatatatatatatgaacgaaaagatacaaagagagatttgaaaactcactaatcagttgacgatacttgtcctggtttgtaccatactacgtcccagtacctatgtataatgataattttatatgacgaaactcatgtttatgatacttttctcatcacatgctatataagttaaggtataagtactgtacccccgattttcaatttggtcgttcaacacattgtttaagccattgtacttgattctagttattaatccttgtggactcgagaaggtaacatcgatgataccgttatcaacgaccaccttaaattaacaacaacaacacaagcatgcatatctcatatataagttaacaatattcttggaccggaatattttaatatataaaagaatataacgttatacgtatagacatttgaaccgtacttggttatcaccaactttcttaagcgtaaccgggggagatgcaagtttatgtcccgcttttgcgatgttgaatttgtttctgtaataagaagaattacaaattaagagagagagaaaaaaaaaaaaatgttcacttgaattgacctatgtgtagatattcatctgtgtgatagatacaaactggaaataaatctaatatgtttaacatttacattttaaaatttaaaattttaaaataatacgtacaggatcgtggcataggaccaattcaataaacacaaatattgcgaggaaaaaaaaaaagattttatttcttttaagtttcaacaatcttttacacatattttgtaaagctcgattcagtgaaaatacatagaagttaagagcacataccgtgatgtttgagaatgaacaccttgaagaaggaaaactagaacgaaaagtggagttagaacccggcgaccagccttcattcccggagctccgtattccatctccttggccaattcgctaaacctccgacaaaaaataaaacagaaactgaaattagtttagacatggtctatagaccgattacgtcaaacctcttgtataaactgtaatcagcgaagacagtgtcgtagatctagatctatacgttaatgtctatataacctccttacacgttcaatatataacactacaaaaaaaatcatatatatatatataaacacttacgttgacttagacactttaacggtttatcttctcctttgttggattcctttgcagctttgattcctcggataagaggagctctctccactgaagaaagttatatctctcgtaaaatattgtatcttaccatcttattaacaaaaatgaagaagaagagatcataaccttttatg

SEQ ID NO: 3478 - DNA, 3000 bp, Unknown
  misc_feature (1)..( 3000): cDNA_ID_1820967_gDNA_ID_1620648_Annot_ID_163325 3000 nt of promoter + ATG
attttgtatagctcatttcattatgatattgaacgcgagttgctttgagtagaaatcaagcattaagccatcgaaagtaacagacgttatatagttatttgatattaaatttcttgccatatttggaaacttacgacaaaacaattaatatgatgaatctccgcaactccaagtccctgtctgacacgtgtacttgatatcgtttaaaatcatttattaattgacacaaaaataatttattcatttgtatttctaccgaaagccatatggactaatatatgttgtactagattaatactgtatgtttttgttcaatccattctcttacttttttgggtaaatatcttttggacagatctaattaatatagtataagttttcctatgaccataataaagggccagaatatttttaattttcttttaatcacctctaaaagatactaattaaattaagtaaagcagcatataaagcaagagggttttgtcagagaaacacagtcctgtgatgcgcccattcactattttcacatgacatttgaaataagacttaagaataaattataaataatgtacggacatgttaaaaaggaaatattattgataatggaaatttacctaactcacactaagtttaatattatttcactcctttttatctaaacaattccattaagtttccactatctcccgtaataaacaaactataaaaaagaatcagtgattaaagttgtatatatgacacacatttaagctatatctatatattctcttaacctaggaactttataagaacttctctctatttcattggtttgataaaatcatacacacaaatactaattttggactagaaatttagtacttttctatgtattaaatctacccaaaaatgtctcaaactgagaggtgagtgtgtatgtgtgtgtgtgcatatgcatatatatacttagtttattcctcgaatagattgttgactcttggctcaaccttcctctctctctatttctacctttctctttctccttattcgttcatcttcatattcccttcccttttgggcttggtaagatctacaaaaaaaaaaaccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccaggttcttcttttaaaattattcattctgaaatctttatatcttcttgattttgtggatgtacatctacggagatgttgtgtaccactgtatgcatataattttatgctacggttttgtttattagaaggcttggtgatattcactgagatatatgtagctgtgggatctattcaaatatagtggaattttttcgcatctggcggtccgtagaacatgttacattaattttcccgtatgtacaataagatgtgtcttgtatagccgacaaacagttttcttacaacaaagaaagattaaaaatgaggtagaagttttaaagaagagtaatatttttgaagctgaaaaaataatttgaagtagtttctttgcttcatatttgggtgattatatgtacccatcatcagtatgttttgaagtactttcctaacatatgtttatgtgtatggacattgacttataactaactaaggctcattgtttgcattttccaaatttagatatgtttcagaaatagatgagaaaacaagtgtgaatgcccaaacatcactattggaaagctaaaaaagaattataattggagaccacgagttagaagattggtatgtagaggacttaatttctcaaatccaataaactggaagctgatttagtttaacccactaacaaaatgatctatttatactcgtaaacataaacatgtttttgatatttatatataatcatatatattattactaaacgatcagattactctgtatatttaactttatatctgcaaaatcgttataattgtctattttctgagtaagttattctttgttaaaagtttgattaatataaaaaaaatatagagataaaaaactaattattagaaaacatatataaacatgtaattctaaatcatataatattttgattatatattttgaaaatttatataatttcatatttatcaattaaaacaaccaaataaaagagtatggtaatgcgaatttttgtttttccctattttccttgaggaattttatattagcatcaaccttaagcattattaattcttcacgtttgtcttttgataacatttctcatgtatcatagggtttacgaacctcttggtaaatgaaattacttagcatatttagtcaagtttatataccattcttaaaactaactaacaccatgttattgtttgcttggatttaaaataaagtgtgccatgctaatgcattacatttatgtcattttgtttatagcttagaactggattcctttaaagttcttgcttatctacaccctagaaataacatttaagcatttgtttttgttacttattgaaaaaagaaactaacatctacttactttatatatagtttatctagtttgtgtaacaaattcgtattactgctgagttcaagattatatacattatgtgaaatgtatgtatgtgtacatatataagcgtgtgtaaataatgttgccaatgcaggaaagtctatattgcacaaatttctaggctatgagttttttctttacgtatgaaagctttttaatggagtacttggaaaaacttcacgatcgaaaattaatatcttttacgtaatttactctaagagatgatatgatatgagtgaattatataccatgaacaaggtatactaatattaaatattttgaatagcatg

SEQ ID NO: 3479 - DNA, 3000 bp, Unknown
  misc_feature (1)..( 3000): cDNA_ID_3071268_gDNA_ID_1620648_Annot_ID_163324 3000 nt of promoter + ATG
ttttgatatttatatataatcatatatattattactaaacgatcagattactctgtatatttaactttatatctgcaaaatcgttataattgtctattttctgagtaagttattctttgttaaaagtttgattaatataaaaaaaatatagagataaaaaactaattattagaaaacatatataaacatgtaattctaaatcatataatattttgattatatattttgaaaatttatataatttcatatttatcaattaaaacaaccaaataaaagagtatggtaatgcgaatttttgtttttccctattttccttgaggaattttatattagcatcaaccttaagcattattaattcttcacgtttgtcttttgataacatttctcatgtatcatagggtttacgaacctcttggtaaatgaaattacttagcatatttagtcaagtttatataccattcttaaaactaactaacaccatgttattgtttgcttggatttaaaataaagtgtgccatgctaatgcattacatttatgtcattttgtttatagcttagaactggattcctttaaagttcttgcttatctacaccctagaaataacatttaagcatttgtttttgttacttattgaaaaaagaaactaacatctacttactttatatatagtttatctagtttgtgtaacaaattcgtattactgctgagttcaagattatatacattatgtgaaatgtatgtatgtgtacatatataagcgtgtgtaaataatgttgccaatgcaggaaagtctatattgcacaaatttctaggctatgagttttttctttacgtatgaaagctttttaatggagtacttggaaaaacttcacgatcgaaaattaatatcttttacgtaatttactctaagagatgatatgatatgagtgaattatataccatgaacaaggtatactaatattaaatattttgaatagcatgaagtcggttattgatagatacaacaagagcaagatcgagcaacaacaactattgaaccccgcatcagaagtcaaggtatacatatagatatagcgacaactctaaagatatgtgattatatattgattgatgctttagcatgatgtttgatttttgaaatgagattttggtttactgagctgttcaaagtttgatgagttatttgtgttgtgtgttacagttttggcagagagaagctgctgttctaagacaagaactgcatgctttgcaagaaaatcatcggtatcgccttgaacttttataacattttgtattaagaattagtctttgatcaaaatatagaaggcatgtaaaggaaatgaagaaacttgtagttatggattgcggtatgtttgctatgaagcaggcaaatgatgggagaacagctaaatggtttaagtgttaacgagctaaacagtcttgagaatcaaattgagataagtttgcgtggaattcgtatgagaaaggtacataaatacatatactctaccttctattatatgctttggagtgtattactcaaaagattgactatagaacacaacggaaatcaatagaacgattgcttttccggattcacaggaacaactgttgactcaagaaatccaagaactaagccaaaaggtcactatgatgagatatatatatacacacactgacacacacaaatatcccctaccaaaagttacaattctaattttgggatttttgttgatcgtggtgcagaggaatcttattcatcaggaaaacctcgatttatctaggaaagtacaacggattcatcaagaaaatgtggagctctacaagaaggtaacaaatcatgttttacaaaaactccattttctttggagtaagagcttcgaagtgatatggcttcgactttcaggcttatatggcaaacacaaacgggtttacacaccgtgaagtagctgttgcggatgatgaatcacacactcagattcggctgcaactaagccagcctgaacattccgattatgacactccaccaagagcaaacgaataacagagaggtaaacttttttaattgatcttgatgtttcacaaacatgcatgcaccatttaggcattttatatattttatgtaactcgttaaaaactttcacagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatcctcaaaactctctcaaatatcaatattcttagatcaataatttgtttaatatatataaccatgcacttggtaattctaaaatgttaaataaacattttctgttaagttttttgttttgttggttttattttgtaaattcaccataattctgttaatcttattcccccaaactaaccggtttggaaactatataaattaaattgatgtgtgataactgaatcggttatcgttgactgcactgaccagaaaccaataaaggttctgtcttaaagggaaacaaatcatcgtcgtcaccaaatcatcacaattcacaaaggttggtgtagacagggacctgagagataacgacaaagaaacaacaaatataaaataaaaatcagaagaaaatataaataaaaaaagagggaaaaaattcgaaaatttgctgcaaccaccaaaagctcagccaaaagcagaggccacaattctctcaaacaagataaacccaattttgttatttttgttctctcttctctctcgttcatgtttcaaatctgtttctagggtttcacaaaccagagatagagagaggtttagcgaaaaatg

SEQ ID NO: 3480 - DNA, 3000 bp, Unknown
  misc_feature (1)..( 3000): cDNA_ID_3071272_gDNA_ID_1620648_Annot_ID_163323 3000 nt of promoter + ATG
tcagaagtcaaggtatacatatagatatagcgacaactctaaagatatgtgattatatattgattgatgctttagcatgatgtttgatttttgaaatgagattttggtttactgagctgttcaaagtttgatgagttatttgtgttgtgtgttacagttttggcagagagaagctgctgttctaagacaagaactgcatgctttgcaagaaaatcatcggtatcgccttgaacttttataacattttgtattaagaattagtctttgatcaaaatatagaaggcatgtaaaggaaatgaagaaacttgtagttatggattgcggtatgtttgctatgaagcaggcaaatgatgggagaacagctaaatggtttaagtgttaacgagctaaacagtcttgagaatcaaattgagataagtttgcgtggaattcgtatgagaaaggtacataaatacatatactctaccttctattatatgctttggagtgtattactcaaaagattgactatagaacacaacggaaatcaatagaacgattgcttttccggattcacaggaacaactgttgactcaagaaatccaagaactaagccaaaaggtcactatgatgagatatatatatacacacactgacacacacaaatatcccctaccaaaagttacaattctaattttgggatttttgttgatcgtggtgcagaggaatcttattcatcaggaaaacctcgatttatctaggaaagtacaacggattcatcaagaaaatgtggagctctacaagaaggtaacaaatcatgttttacaaaaactccattttctttggagtaagagcttcgaagtgatatggcttcgactttcaggcttatatggcaaacacaaacgggtttacacaccgtgaagtagctgttgcggatgatgaatcacacactcagattcggctgcaactaagccagcctgaacattccgattatgacactccaccaagagcaaacgaataacagagaggtaaacttttttaattgatcttgatgtttcacaaacatgcatgcaccatttaggcattttatatattttatgtaactcgttaaaaactttcacagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatcctcaaaactctctcaaatatcaatattcttagatcaataatttgtttaatatatataaccatgcacttggtaattctaaaatgttaaataaacattttctgttaagttttttgttttgttggttttattttgtaaattcaccataattctgttaatcttattcccccaaactaaccggtttggaaactatataaattaaattgatgtgtgataactgaatcggttatcgttgactgcactgaccagaaaccaataaaggttctgtcttaaagggaaacaaatcatcgtcgtcaccaaatcatcacaattcacaaaggttggtgtagacagggacctgagagataacgacaaagaaacaacaaatataaaataaaaatcagaagaaaatataaataaaaaaagagggaaaaaattcgaaaatttgctgcaaccaccaaaagctcagccaaaagcagaggccacaattctctcaaacaagataaacccaattttgttatttttgttctctcttctctctcgttcatgtttcaaatctgtttctagggtttcacaaaccagagatagagagaggtttagcgaaaaatggcgatggccatggctcttcgaaggctttcttcttcaattgacaaacccattcgtcctcttattcgatccacttcatgttacatggtaacaaccctaaagtttcttccttttatctccgaattttataatcggattggaaattttcgattttttttttttttttttctgatttctgtttgttccgttgcagtcttctttgcccagtgaagctgttgatgagaaggaaagatctcgtgtcactgtgagtttaagcgcctttttgtatctcttgtttgtttatagttttccttgtggttgaagcaatggttttgattgttgaagttctatgtctgtttcaaattgatgtatggagttctatttttggtgtgactgaatctaatgaaacttatgtctttgtaaacgttcgtttcagtggccaaaacagcttaacgcacctttagaggaggttgatcctgagattgctgacattattgagcatgagaaagctagacaatggaaggttagtttgtctctgagattactatctcttaaatcttgttccttgattgattattataagttaggctgatgtttgtaacgcttgtgttattatagggacttgaacttattccatctgagaacttcacatctgtgtcggtgatgcaagctgttgggtctgtcatgactaacaaatacagtgaaggctatcctggtgccagatactatggaggaaatgagtatgttcaggaattttcaatctgacacatttagtttcaggacatgattgcttgaccaatctctgtaataagaattgaaatctcaagtaccttttgctttgtaggtatatagacatggcagaaaccttatgccagaagcgcgctcttgaagctttccggttagatcctgaaaagtggggaggtaaattactactttcatgtatatgagaaacaagaaatctgattagtcctttgatggcttatttgactggatcttacagtgaatgttcaacctttgtctggatctcctgccaacttccatgtgtacactgcattgttaaagcctcatg

SEQ ID NO: 3481 - DNA, 3000 bp, Unknown
  misc_feature (1)..( 3000): cDNA_ID_2156691_gDNA_ID_1620648_Annot_ID_163322 3000 nt of promoter + ATG
ttttgtatctcttgtttgtttatagttttccttgtggttgaagcaatggttttgattgttgaagttctatgtctgtttcaaattgatgtatggagttctatttttggtgtgactgaatctaatgaaacttatgtctttgtaaacgttcgtttcagtggccaaaacagcttaacgcacctttagaggaggttgatcctgagattgctgacattattgagcatgagaaagctagacaatggaaggttagtttgtctctgagattactatctcttaaatcttgttccttgattgattattataagttaggctgatgtttgtaacgcttgtgttattatagggacttgaacttattccatctgagaacttcacatctgtgtcggtgatgcaagctgttgggtctgtcatgactaacaaatacagtgaaggctatcctggtgccagatactatggaggaaatgagtatgttcaggaattttcaatctgacacatttagtttcaggacatgattgcttgaccaatctctgtaataagaattgaaatctcaagtaccttttgctttgtaggtatatagacatggcagaaaccttatgccagaagcgcgctcttgaagctttccggttagatcctgaaaagtggggaggtaaattactactttcatgtatatgagaaacaagaaatctgattagtcctttgatggcttatttgactggatcttacagtgaatgttcaacctttgtctggatctcctgccaacttccatgtgtacactgcattgttaaagcctcatgaaagaatcatggcacttgatcttcctcatggtggtcatctttctcatggttatcaggtgccttcaagttaactttgtatgtcatttcggaactctctgactctgatgaataacagtttctttcttcttatttctcatcagactgacaccaagaagatatcagctgtgtctatcttctttgaaacaatgccctatagattggacgagagcactggctacatcgactacgatcaggttcttaactcttctattaagcaatcatagtaacttataactaacccgcttcataacaatacataagtctttaattttgatttgcagatggagaaaagtgctactcttttcaggccaaaattgattgttgctggtgcaagtgcttatgctagattgtatgactatgcccgcatcagaaaggtaatttcagtctcatatccaactacagaacagattattgtaatcagtagtgagttttgattcgaactcttttcccaggtctgtaacaagcaaaaagctgtaatgctagcagatatggcacacatcagtggtttggttgctgctaatgtaatcccttcaccgttcgactatgctgatgttgtaaccaccacaactcacaagtcacttcgtggaccccgtggagccatgattttcttcagaaagggtgttaaggaaattaacaagcaagggaaagaggtaaaaaagaaaaagaagcaaaatttgaaccaaaatgttttagatttatgtataatctttcacgtcattcatttgttgtcttgaaaggttttgtatgattttgaagacaagatcaaccaagctgtcttccctggtcttcaaggtggtccacacaaccacactatcacaggactagctgttgctttgaaacaggtacggtgaggcacggaatggaactaacgttgcttattggatttgcggtttctgtaaccttcaaatggtttgaaaatgcaggcaactacttcagagtacaaagcataccaagaacaagtcctgagtaacagtgcaaagtttgctcaggtactaatcccgtgaaggaaagaaaaacacatatggcgtagtatctactttgattatatctctacattgttgtttcgtgcagactctaatggagagaggatatgaacttgtttctggtggaactgacaaccatctggttctagtgaatctaaagcccaaggtcacttgatctttttttgtatataatcttcttttatatttcttagttaaaactcattttttattcgattttgtttgcagggaattgatggatctagagttgagaaagtgttggaagctgttcacattgcatccaacaaaaacactgttcctggagatgtttctgccatggttcctggtggaatcagaatgggtaaaaatcacatttaaccatttttctttttggtattcgaatggagttcttcttgatatcctctgccattgttattttcaggtactcctgctctcacttccagaggctttgttgaggaagactttgccaaagtagctgaatacttcgacaaagctgtgacaatagctctcaaagtcaaatctgaagctcaaggtttttacttctctgatcacgatgctatgctttccgttcttatatacaatgattgaactcatttgttatgtttctaaaaccaggaaccaagttgaaggatttcgtgtcagcaatggaatcctcttcaaccatccaatccgagattgcgaaactgcgccatgaagtcgaggaattcgctaagcagttcccaacaattgggtttgagaaagaaaccatgaagtacaagaactaaactgtttcaccccacaagtgttttctgttatgctttgaattcccatggaatgtatagatgatacatgtaaaactctattttcacgctatgcgaaaaataatgatctgttaaattttctctctatacatcaaaaagaaatatacttagacaaaaaaaacacatacaacaaaacagtgaattccctaaagaagattgtctttagctcacaagtgacttaagagtaaccacaaaataccaacaaaacgagaaagggataaataagaaactagaagttgggagaggctcatccacaagctgtggtcatttctcaacctcatcaaatctctttacaagaatatggttctgtaaccggacaacatctcaaaacttgttctgttttttttttttcatttcttagacagaaaaatg

SEQ ID NO: 3482 - DNA, 3000 bp, Unknown
  misc_feature (1)..( 3000): cDNA_ID_1808991_gDNA_ID_1620648_Annot_ID_163321 3000 nt of promoter + ATG
gctagattgtatgactatgcccgcatcagaaaggtaatttcagtctcatatccaactacagaacagattattgtaatcagtagtgagttttgattcgaactcttttcccaggtctgtaacaagcaaaaagctgtaatgctagcagatatggcacacatcagtggtttggttgctgctaatgtaatcccttcaccgttcgactatgctgatgttgtaaccaccacaactcacaagtcacttcgtggaccccgtggagccatgattttcttcagaaagggtgttaaggaaattaacaagcaagggaaagaggtaaaaaagaaaaagaagcaaaatttgaaccaaaatgttttagatttatgtataatctttcacgtcattcatttgttgtcttgaaaggttttgtatgattttgaagacaagatcaaccaagctgtcttccctggtcttcaaggtggtccacacaaccacactatcacaggactagctgttgctttgaaacaggtacggtgaggcacggaatggaactaacgttgcttattggatttgcggtttctgtaaccttcaaatggtttgaaaatgcaggcaactacttcagagtacaaagcataccaagaacaagtcctgagtaacagtgcaaagtttgctcaggtactaatcccgtgaaggaaagaaaaacacatatggcgtagtatctactttgattatatctctacattgttgtttcgtgcagactctaatggagagaggatatgaacttgtttctggtggaactgacaaccatctggttctagtgaatctaaagcccaaggtcacttgatctttttttgtatataatcttcttttatatttcttagttaaaactcattttttattcgattttgtttgcagggaattgatggatctagagttgagaaagtgttggaagctgttcacattgcatccaacaaaaacactgttcctggagatgtttctgccatggttcctggtggaatcagaatgggtaaaaatcacatttaaccatttttctttttggtattcgaatggagttcttcttgatatcctctgccattgttattttcaggtactcctgctctcacttccagaggctttgttgaggaagactttgccaaagtagctgaatacttcgacaaagctgtgacaatagctctcaaagtcaaatctgaagctcaaggtttttacttctctgatcacgatgctatgctttccgttcttatatacaatgattgaactcatttgttatgtttctaaaaccaggaaccaagttgaaggatttcgtgtcagcaatggaatcctcttcaaccatccaatccgagattgcgaaactgcgccatgaagtcgaggaattcgctaagcagttcccaacaattgggtttgagaaagaaaccatgaagtacaagaactaaactgtttcaccccacaagtgttttctgttatgctttgaattcccatggaatgtatagatgatacatgtaaaactctattttcacgctatgcgaaaaataatgatctgttaaattttctctctatacatcaaaaagaaatatacttagacaaaaaaaacacatacaacaaaacagtgaattccctaaagaagattgtctttagctcacaagtgacttaagagtaaccacaaaataccaacaaaacgagaaagggataaataagaaactagaagttgggagaggctcatccacaagctgtggtcatttctcaacctcatcaaatctctttacaagaatatggttctgtaaccggacaacatctcaaaacttgttctgttttttttttttcatttcttagacagaaaaatggttgcagcattctcttacactgcctgcaccaagctttctctattacatccttctatggttgctcaaatccgaccaagaacaacacaaaaggcgttcgtggtgacaaatccggaacaagacagtactcttgaagtacaagaaacagagacactcaaagaagagcaatcaacagagaagatgaagaagcagccaacaccattgagaccagtggagaaacagctgaacgtgaagagcaagggtatgggcgattttggtggtcagtggctaagcagtgtcacacgtcacgttaggatctacgctgcttatattgatccagagacttgtgagtttgaccagtcacaaatggataaactcactttgattcttgatcctactgaagaatttgtgtgggatgatgaaagctgtaacaaggtctattcttatttccaagaactcgtcgatcactacgaggtaacgataacaataaacgaacgaaacattcatctaaaagttagactcatttcaagaagaccttataatattgtttttgaacagggagcaccattaacggagtacacattgagattgataggatcggacgtagaacattacataaggaagatgttgttcgatggagaaatacaatacaatatggatgcaagagttcttaatttcagtatgggaaagcctcgtgtacaattcaataccagtaacattgaaggtggtggagatggtcagcctcaagaggacgcttagtgaaacaaactctattttataatcatgtaatgggaatataaatatattgtagtatgctttttaattttgtctatcacaaagtaacatatgtatatatcatgacatatgctataattatttttgtaataatcaatcttaagtttctttgtcttttcttgttaatgtaaggtcttaaggtcatgtgaatatgtaatgtcaaagaaactcaattctggtcttgctcattcatgttccttactccttgcctctttttaaaaagatttcaaactgatgcaaaacttgttagttttaacatttttacccaaaaagttatattaagtttttgaatttgtcaacgtttactaattatttacaattaaaaccctgttcttcttatcctctggtgtttctcgttgttcgtcaccaagacgaactttgtgagggagaaaaaatg

SEQ ID NO: 3483 - DNA, 3000 bp, Unknown
  misc_feature (1)..( 3000): cDNA_ID_2999395_gDNA_ID_1620648_Annot_ID_163366 3000 nt of promoter + ATG
agaaaatgtttgataaagattcatggaagttcagtttaccaaaagaaaggaaagccaagaataactggttatgaacaagttcaaaggttataaatctgtgggtaaaaggactcttacggatttgtttgaaggtcgttgattggttaagatattcagaaacgaattgcagatctctagagaattgcaggttttcgaaactaagttgcagatcctagaataagttgcaggattctgaattattatgttttttagggctgagtaagctaagaagaggttattggagtgattcagtgggattcttagaagaagaaaatggaagagacaagtgcaagtgctgcatgaactgtctcaaggctactcacttcaataatgtgaaagtgtcatgtatctagtttgataaacgacacatctcaatgctggtggcagtggctgaaaagaagctctagaaggaagcaaatgcaagaaatttaaactgcatttagaagacagtaactaaggagtttgagttagctgtctgcatcatgagaagattacataagtaactactcaagggaaattcactcgcaggttagtcaagtgaacggtttttcaaagtatcagagaatcataaagaagacaaaggctctagtaccaatttttctgttatccacctgttttatatatagatttgaagagatgagatttttaaattgctacaaaagagagagtctacaatttcacaagcttgtaccaatttcagcaaaatgattggacaaacttgtaccaatatatttaacatgtttagaaaatattcaactcacttagtttgatttcttcagctgcgattctttgaatcaagttttcagttataagcttcaacctgtaaaaatggctgcagaacaaaatgatgaggaaattttttagtatcacaaagtccagattcaagttttttttcaattgtatctaaaacacacacaactttcagattgaataaaatctgaatttcattctcagcaggggctaatataaaaatgacaaaaggagaggaggaggataggagctatatgtctactatttttagttttttagccaatgagagagctccacttcataccccacttttaccgatcgtgccatttcacagtcactctcacccatgtcgcgttgagcgcgtgtctacgatttctaaagggggttaatccacaaaaatcattcatttttcgatccacgcacctcattctcaaaaacccgtcgcgtgtcttatttttttttgttttcttctctaaaccaaagtaaaccgaaccaagatcaatttgaatttcaaaaccaatgtaaacccataaaacccatcgctgtttcactttcactatccaattccaacgaaccagattgataattttgattcgattccacacagagatcataatctaaaccaatgcgattaataagagagccaaatcttacagtatagcttaaaatcttagctaaatcccaaaaacacgagattctaggcgaaaagagaagaaaaaaaaattgccagaatgcataaacagcagaggccagaggcctccattttcaccggagtgacaaattccgggattacttcctggtcggaggtgaagagtcggagtgaaacggcgacgtttatacgtgggccataaatgggctttgacggaactcaaattatattaaaagtatatttagcattcaagtaattaatttagaaattcatttgtttctgtaaaatatatatatttgctgtaaacaacgattgtgattctggtttctggatacttataaagcttttagaaggaaaaaaaattcaaataaattgtaaaaaaaatatatgtaaatgatatttatccttttaatatttttgagcattatggctcagatttatatggaaataattagttagagagaactttaattagtggaaattctcaaacgattatattctatacataaatcgtgtgcattaataacctgacttcaaagttcaaagtcttaacacttgccataaatgtttcgatagtaatatcaattttatattaggagaaaaactaaaaactatgttaaatctgtgtcagaattataataatccctttatcttaccatacatttagttgactcacatttttacttcatcacccaactgttctcagagttttactgaaatttctcatcatctctaatcactgcattgtagattctcagtcacatgacatcatctccgatgggaaaacacggcgggtcaaagactagaaccaccgtttgtttatcagatggtgttatctttctcgccggagctttcatgtctcttaccctcgtctggtcttacttctctatcttttcaccttctttcactttcaccttcaccggtttacgtcacggctgcgaatcggttcaatgttccggtttaaacatgcaattagaccctcccgagcccggtttttacgacgatccggatctaagctactcgatcgagaaatcaatcacaaactgggacgagaaacggcacgaatggtttaaatcacacccttcattcaaacccggttcagaaaaccggatcttaatggtaaccggttcacaatcctcgccgtgtaaaaacccaatcggagaccatttgttactcctccgatgtttcaaaaacaaagtcgattacgctagaatccatggtcacgacatcttctacagcaattctcttcttcatccgaagatgaattcgtattgggcgaaacttccggtggttaaagctgcgatgcttgctcacccatttatggattgaagctttaggtaattttctcaaacacatttatggattgaagctttaggtaatgaatgagctgaatttgcatataaaaaatcgatactttcattttccagaacaaaccaagatttagcataaatgttcaaaattgaaactttgattcctaacttcttggaatgattcatattgagctagatttagatctgtatgattgatatgatgggtttggtttgtttatgagtagagagaaa

SEQ ID NO: 3484 - DNA, 3000 bp, Unknown
  misc_feature (1)..( 3000): cDNA_ID_2107046_gDNA_ID_1620648_Annot_ID_163365 3000 nt of promoter + ATG
aacctgagagcggtggtcgaggctgctgctgatatcaatctcggtgagccagattgggagctggagcgtagcgagtttatcgaggatggctctcatcagcgctacgtttggcgtcgtgaagtgaccctcgagaccgattccgtccatccttatgccgtcgtaccgttggagttccctcaccctggcgatgtattcgtcaaccgttgacttctcgtcgctgcaagtctccaccacgttgaaatcattgaagaacagagtcgccaacgagtcaatctcacgaaccgcggcgaagaacccgtacgacgttcttccccagtctgctctcgtagaagtcgaagtgaagcatctcgttgctcacgtcccaatgcacgaactctcctctgtaccgagtcattagactcttgattcgccggttaaccgccgaccggagatcttcgccggttagattacgaacccagtcgggattgtatttgggatcctcccagaatatgttgtggccgcgagcgatgattctgttagctctgacgagattcatcatcttatcagccaatgtgtagttgagtttgccttgatcggactccgtcgcgtaccatttcagctcgttctcgaataccgtggcgtcgaatctcttgacgaaccattcctaccaaaacagaatccgtttaaagaagcaaagacattgttgttttagtgtagactttagcgagtgtgttttacttggtaaggaatgtttccaaggatagttttggagatggcagatccaatggggaagtctttagagatctgctctactgtcacctctgctccttcaacgctctctccgttttcttttgacacgtgaattgtcactgctcgttttctcgcttgaaaatgagtgttaagagggaaccacataaagaatacagtttgcgattttgatgttagaaatgagtgtgtgtattatgcaacatggtaaactattattgtgtcgatagtcttcctagctagaagagttaggcagcgtgtcctgtttatcttaacagcggtacaagacaagtatgagttgcatttcagctacaagagagtacaagagattgtctgagattaaggcattgttttgtgatacatcagcttaagctatatcatcatcaaaacatgaagaatgctccatgtaaagagaggacaaggttgcagttattaaagaaaagttcttggtggttcttttgggaataaaagaattagattgagtggctacatgaagaaaggagatgtgtcacacgttttggcacactttcttaagagttatgtcacagaaactcattcggatacattagaacgtgtgagtgaatcaaagaaacagtgaagagcatgcagcataactcatagaagagaagctgagcttacaaagacaaagtgacatccttttttttagtttctggtgaagctatgttcatggaggttgtcttaggtatgtagctcaatggatgagtcaaaaggctgcagaaaatgtttgataaagattcatggaagttcagtttaccaaaagaaaggaaagccaagaataactggttatgaacaagttcaaaggttataaatctgtgggtaaaaggactcttacggatttgtttgaaggtcgttgattggttaagatattcagaaacgaattgcagatctctagagaattgcaggttttcgaaactaagttgcagatcctagaataagttgcaggattctgaattattatgttttttagggctgagtaagctaagaagaggttattggagtgattcagtgggattcttagaagaagaaaatggaagagacaagtgcaagtgctgcatgaactgtctcaaggctactcacttcaataatgtgaaagtgtcatgtatctagtttgataaacgacacatctcaatgctggtggcagtggctgaaaagaagctctagaaggaagcaaatgcaagaaatttaaactgcatttagaagacagtaactaaggagtttgagttagctgtctgcatcatgagaagattacataagtaactactcaagggaaattcactcgcaggttagtcaagtgaacggtttttcaaagtatcagagaatcataaagaagacaaaggctctagtaccaatttttctgttatccacctgttttatatatagatttgaagagatgagatttttaaattgctacaaaagagagagtctacaatttcacaagcttgtaccaatttcagcaaaatgattggacaaacttgtaccaatatatttaacatgtttagaaaatattcaactcacttagtttgatttcttcagctgcgattctttgaatcaagttttcagttataagcttcaacctgtaaaaatggctgcagaacaaaatgatgaggaaattttttagtatcacaaagtccagattcaagttttttttcaattgtatctaaaacacacacaactttcagattgaataaaatctgaatttcattctcagcaggggctaatataaaaatgacaaaaggagaggaggaggataggagctatatgtctactatttttagttttttagccaatgagagagctccacttcataccccacttttaccgatcgtgccatttcacagtcactctcacccatgtcgcgttgagcgcgtgtctacgatttctaaagggggttaatccacaaaaatcattcatttttcgatccacgcacctcattctcaaaaacccgtcgcgtgtcttatttttttttgttttcttctctaaaccaaagtaaaccgaaccaagatcaatttgaatttcaaaaccaatgtaaacccataaaacccatcgctgtttcactttcactatccaattccaacgaaccagattgataattttgattcgattccacacagagatcataatctaaaccaatgcgattaataagagagccaaatcttacagtatagcttaaaatcttagctaaatcccaaaaacacgagattctaggcgaaaagagaagaaaaaaaaattgccaga

SEQ ID NO: 3485 - DNA, 3000 bp, Unknown
  misc_feature (1)..( 3000): cDNA_ID_3071232_gDNA_ID_1620648_Annot_ID_163362 3000 nt of promoter + ATG
ctcaggatgtgaacatagttgcgacatacagtgaccattacggcaatatacgccttggtagggtgaaaatgggggatctttcaccttcttgggttttggagaatcctgcctatcaagttagccgcaaaacaaaaggttcgcaggtaccaaacatttcatgttctggtttttagttttaatgagatttgatcatcagtttaagaatagaactgtatatcctatgggcatatggagttctatagtagaaaacttaaagtgtgtgaagtgattacttaccactcttctcaccgagcaaaaaatacctctcatgaacttcatttgttctaaccttgtgtttcttgaatttatccttaagcttgctcatattctttgttctctagttgctgacatttttttgtatggaattagctagttataccacgggattcatttcaaaatgatactggaatggaagataatgcaagccattctacaactaatcagactgatgaaagcgaaaatcagtttccaaacgtggattttgcaagcccagcaaaactgaagcggcaggtgatctgtcaaatagccttcttttctaatctctggatgccttaacactatatgactgagattgtaacaactgtagaccctttcagattttacgtcaggaaaggagaggtcaacgaactttagagctgatccgacaagaaaaggaaactgatgagcagatgcaagaagcagccattcagaagtcaatgagctttgaaaactcagtcatagggaaatacagtatatggaggagagactatgagagcccaaatgctgatgctatcttgaagcttatgagagaccagatcataatggcaaaagcatatgcaaatattgccaaatcaaaaaatgtaaccaatctgtacgttttcttgatgcagcagtgtggagaaaataaacgtgttataggtaaagcaacctctgatgctgaccttccttcaaggtacttttttacattcctcttgtcagcaatctttgtgggacaacaatctttgttgaaactttttccatcccattttctttgctagcgctcttgatcaagcaaaagccatgggccatgcactctctcttgcaaaagacgagttatatgactgccatgaacttgcaaaaaagttccgggccatccttcagtccactgaacgcaaagtagatggactgaagaaaaagggaaccttcttaattcagctagctgccaaaacatttcccaagccattgcattgcctgagtctgcagctagcggcagactattttattctaggtttcaatgaagaggatgcagtgaaagaggatgtcagtcaaaagaagcttgaagatccttcgctctatcactatgcgatcttttcggataacgttctggctacatcagtggtggtgaactccactgtcttgaatgcaaaggaaccgcagaggcatgtgttccatatagtaactgacaaactgaattttggtgcaatgaagatgtggtttcgcatcaatgctcctgctgatgcgacgattcaagttgaaaacataaatgatttcaagtggctgaactcctcttactgctctgttctacggcagcttgaatctgcaaggctgaaagaatactatttcaaagcaaatcatccttcatcaatctcagctggcgcagataatctaaagtaccgcaacccaaagtatctatcgatgctgaatcatctcagattctaccttcctgaggtttatccgaagctggagaagattctgtttctagacgatgacattgtggtgcagaaggacctggcaccactatgggaaatagacatgcaaggaaaagtgaatggtgcggtggagacgtgcaaggagagcttccacagatttgacaagtacctcaacttctcaaatccaaagatttcagagaattttgacgctggtgcttgtgggtgggcatttgggatgaatatgtttgacctgaaagagtggaggaaacggaacattacagggatatatcactattggcaagacttggtaaggcattggaaatttctcaaaagaaatacatataaatatttttggatgatgaatggatgtgtcaattaatatatgattgatgcagaatgaagacagaacactgtggaagctgggatcgttgccaccggggctgataacattttacaacctgacgtatgcaatggataggagctggcacgtactagggctgggatatgacccagcgctaaaccaaacagcaatagagaatgcagcggtagtgcattacaatgggaactacaagccatggctgggtttagcattcgccaagtacaaaccgtactggtccaagtacgttgagtacgacaacccttatctccgacggtgcgacatcaatgaatgaatgaagagatggtggaggtagtatacatgatgaagcactcaaaggaaactaaataagtaaaaattgttttcagtttaccataatactaggaatcagcagacaatcacacatgacgattaattaaatagaatctcttgtttttctcaaactcagaaaaactcaccaaaggaaactgaacaatcttttcactcggagtgttgttcttcacttgtttttttggtatcaacgtgactgaaaagcatatgggccttagaatgcgatgctttgtctatatacagtgtgtacagtgagtaaaactgccccgtgaatgcacataatgggccttacactggcccatcattgctttactctcctctctagctagcgacgagatgagtaaaacgccatctctcggagcggaacggctctgctctgctcttatcctctgtctgatccgtctccatcaccatctccgttctacaggtaaattgttttgcttcgcgctcctccgattgattattcactgatcagattctaataattataatcctgagtcctcgtttggttgatgttgaagcaccgcagatcctctttgaacttgttatttgtaagcttcttcttagtttctccttaatcgcagtgaa

SEQ ID NO: 3486 - DNA, 3000 bp, Unknown
  misc_feature (1)..( 3000): cDNA_ID_3071236_gDNA_ID_1620648_Annot_ID_163358 3000 nt of promoter + ATG
gcatagcagtatttctgtggcaatcgcatccgctgtacccttttcttctatttctcaacagagatgaagatcacaacaggtgattcaatcccctctgtaatcgtttcctttgatgagattgtactaatcttttgtgtaaattgtcaagggcgacagaggcgctgcgttggtgggaagacggagagacggtgggaggaagagaccttgttggcggcgggacgtggctgggctgcacgaggcatggccgtctggctttcctcaccaatttcaaggaagcctcctccttccctgctgctaaatcccgtggagatctgcctcttcgttacttgcaggtctacaccaccacctaatatgctttagattgtctctcatgttagagactgagagtacttttaacgttttggtgagaacagagcgaaaagagtccggccgagtttgccgaggagatccaagacgaaatttcactctacaatggctttaacctggttgtcgctcatgtcttgtccaaatccatgatttacattaccaaccgaccaccccacggtgacaagctcgtgacgcaagtctctcccgggatccatgtcctttccaacgccaacctcgactccccttggcccaaggtaagtaaatgtgggccatttctccctttatttaccttttgcagactcccccaattgcgtgtttttgtctctgcagtgtctgaggctgagggagggtttccaacagcttctggctgagaacgggagcggtgaattcccggtgaagaccatggtggaggaggtgatgaccaatactgtcaaggacgaagaaaccgagctacctcacgttttcacaccagagacggaataccatctcagctccatcttcgtcgacatgcagagaccaactgtaaccttccttttttagagtacattgattgtttgtttaacactttccataaatattcagtctcactcatggagatacaggggcgttatgggaccagaagcatctctgcgatcatcgtcaagtcccatggagatggtggtggtgatggtgagatttgcttctacgagaggcatcttgaagaaggcgattcatggaaggaacacactcaacagtttgtaataatacaaaaccaaagcatttgattagctagccaggcttatttcgcgagcttcccttgcttgtaacattgagaaatcaaaactctcacatatgttgtacatgtaaacacaaaacagaagacagagctgatctcttttattccaaaccatcaaaatacaaatacaatcacagttactcttaaaaccacaaccaattccatatacataattgcacacaaggagagaaaaacctctccaatctctgacttcacggacgctcacactttgacagagaagatctcactcagggaactccaagttcccgacacagcaagaaccacacctagtaccacaatcgctgtgtctgaactccattgcagccaccccatctcttccttgaacaccaataaatgaaacaatgcaggtaacacaaagcctaacacacagcaagtgctgctgccaaccaatgacaaaaaatctgcaaagtttggcacaaaaagagccaccagagtcactgctaagacgagtacccatctgagccacgcagagtacatcccgcgtgagaaacgcctctccactatctcaaacactggattcatcatcaaggggaaggtgaagaagaggttgatgcacagtccaagctggacaacagtgctgacaagtcctgcccccaagttagcagtgataatgtccatggtgtcctcaccaaaagccaagtaacctaagataccaaatgcgatgtatatgagagagatgaatcccatgccgagagccaagactttgccaaacttgtccttgtccttcatctccgattcaagaggcaagaccattccaacgccttcgaaggaatagacagcgacgcccataccatacaagaagagggacataccaccaaaggcaaccacgtcaggcctttgcttgagtataatcatggaatcctcaacaatgaccacagccatagcgccaagatcaacaatatcggcgaagatgctgagaggagccaagtgagtgagcgtcttgatcgaattcaaaccgagctgaaagggaaagcatccccatatgtagagactcttagaagacacgcccaggaattcagaacccagccttgtaaactgatgcctcagactggtgggcgattcaggatcggatagattagctaaagtagtgccgatgaagataagatatccgacacaaaaaccagcttgagacagaatgataaataagtcaacgacgatcctccccaaggagccgcagacggcgaatccaaggtcaccaaaagagccgatcttggagatgccagcattgaaagagtcgagcttgcggcgggtatagacaagaagcatcatacagtgatgggtcaaaacagagacggagacgaggaggaggacacccatgagccatccggttcgcttgaaggcgtaaggaagaccaagaacaccagcgccgacgacagcgatgaagacgttggcgaaggtcttaaactggctggagaggggaggtcccttgccgagaagaggcgagtcctctctggccggtggaggtattttaagggtataagaggaggagctagcttcgttctgaaaacccatctgatgattttcgaccgaatctcagaaatcgaagaagatggggatggatattggcgaatggcgacagcaagataattggatgaattgcgtgtagagttggtggactctcttttttggtttgttgtcagagatttacagaggaagaagctcggctctatttatggatgaaatgaaatggtcatcttatcatttttactgggaaacggtaccgtttttgttataacgcacgacgccgtttcaaacaacttccttattagctagctccctcccggcggcaaacaccagaagatccaccggttttgatctggttgtttgtcgtcgatatg

SEQ ID NO: 3487 - DNA, 3000 bp, Unknown
  misc_feature (1)..( 3000): cDNA_ID_3071240_gDNA_ID_1620648_Annot_ID_163357 3000 nt of promoter + ATG
cgaaggtatatccccttcttctttcctcattgggacttgtggaatcctagatgaccatggttcttggaacctattgaatactatacaaaattaactttctaaatggagtagaagacttatacattgatttctgagtgtcttgtagatatgaagaaccgccaggacgaagaacttgtgcagcttaaggatctaatccagacgtttgaaagtgccttactatcacctgtaaaactcattttcttgctttctttttattagtttttctactaatgcttattttcttcctccagaaaaaggaatagcaaaactcactcaaggtggacaggtctggataagaagatgcctttcttcgtatttgtaactgctatcacttgctatatatatacatctaacctgtttcttgttttttatttagcagatgcctgtggctgctgtagtggttatggcctgcagtcgtgcagactatcttgaaaggactgttaaatcagttttaacgtgagatactatactgatttaattcttataccacattttgattgaactatctaatggctatttctttttttatacagatatcaaactcccgttgcttcaaaatatcctctatttatatctcaggtacttaatttgcagggtggtggtctcttagactgttttatattcaacgaattactaaccatggtcttttccaacgacatattttctgacaggatggatctgatcaagctgtcaagagcaagtcattgagctataatcaattaacatatatgcaggtaatttaatctagcgtgatttttctcctcactgttcaagtagataaatgaggatgaaggctcgttttccccttttcagcacttggattttgaaccagtggtcactgaaaggcctggcgaactgactgcgtactacaagattgcacgtaaggactggtttctcttttctctgcgtccctccagctccattactgaaacactttttaatacaggtcactacaagtgggcactggaccagttgttttacaaacacaaatttagtcgagtgattatactagaaggtggcgctttttaacctttcacactcatcgtaccttgctgttgtattgtttaagaggggctgtctttaccttgtggagtattgcttaagagaggttatcttgtctctttaacagatgatatggaaattgctccagacttctttgattactttgaggctgcagctagtctcatggatagggataagtatgttacctactgaagctagactcttatagtataagtttccacagagtatacaaatgtttttattactgtttctcattcttttctggtccaaacatgtgttagaaccattatggctgcttcatcatggaatgataatggacagaagcagtttgtgcatgatccctgtaagattcttcttcttcttcttctttaccttgcttcctctcttgcctgttctttcaatacctcattatgtctagctcatgcgagctaaaataatctgcagatgcgctataccgatcagatttttttcctggccttgggtggatgctcaagagatcgacttgggatgagttatcaccaaagtggccaaaggcatatccttatatgcttttttttctttcaatctcgatgactatagtttgacgcttcttaaattctaaaaaaaaaaatagtttgacgtttctaagacttttcttaacaaatatccacttactgggatgattggctgagactaaaggaaaaccataaaggccgccaattcattcgaccggaagtctgtagaacatacaattttggtgaacatgttagtacccgattatgctatcctatatatcatagttttacaagtctgtttttgtaatgctgttaaattgacctatgttcgctgcatatgacttctgctttctgtatgaaaaatgtattattgcagcttcgtcctatagtttcccgacacatggatgtagacagtcaataccacataatatatttttgcatttcatacttatccataaccttgttatattaatttggcaggggtctagtttgggacagtttttcagtcagtatctggaacctataaagctaaacgatgtgacggtaagcgtaagtgtgttttttacccccttttgttgcatcactagttttcactggtttcctatttcattcataaaggttgactggaaagcaaaggacctgggatacctgacagaggtaacatttacagaactccggccttttttttttataccattttgcatgttttgagtggagaaatgtagtttttaacctgttctctcatgtctatcaaagggaaactataccaagtacttttctggcttagtgagacaagcacgaccaattcaaggttctgaccttgtcttaaaggctcaaaacataaaggatgatgttcgtatccggtataaagaccaagtagagtttgaacgcattgcaggggaatttggtatatttgaagaatggaaggtaaatttgagatgattgaactataatcttcaataattgtaggtccaaatgggtcactttttttgtacccctttgattgtgtaggatggtgtgcctcgaacagcatataaaggagtagtggtgtttcgaatccagacaacaagacgtgtattcctggttgggccagattctgtaatgcagcttggaattcgaaattcctgatgcaaaacatgtacttctccaaccagcatcatttacatcttaaccattgcttacagttctgtgctaaccgggtttcacaagcagatgaaaggaaaagaagattttggaccgcatgcagcctccttctagcagctgttaggttgtattgttatttatggatgagtttgtcgagcggtggggttaactttaacagcaaggaagctctggtgacctggctgattggcttagaagttatgggaaccccttgaaagggtcagggttaaatatatttcagttgttttattagtgattatcttgtgggtaacttatacgaatg

SEQ ID NO: 3488 - DNA, 3000 bp, Unknown
  misc_feature (1)..( 3000): cDNA_ID_3093746_gDNA_ID_1620648_Annot_ID_163356 3000 nt of promoter + ATG
tcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgacatggaagagatcagagacatcaagaaagaaggtcagtgcgtcaataaaagcctggtaggtggtgatatggaggccgtcgatgtggggatagggcagcctgggcctggtggtggtggtggtgggagaagagaggaaaacgtactctttgaatcctcctcctgctccggtggcctgagcgacgaagcccatggtggacatgattggttcaagctcctcgtgcgtcataacaggcttgaaggttctcgtgtgccacaaggccagtttcctcatactgcactcctccatcatctctctcgagatccacaagtgagtgagtgtagggattatggttacaattagtttggtttttctttcttttgcccttgttatttcatttattcaccaaactgccattcctttctgccacgtggccttcttcatcccatttgtgagcaattcaatttagtaatccatttgctgctctgtagtggaagtagttgttgttgttgttgcagaagaatccgaatccaattcaatgagtcttcttcgtcttctcctcgttgttgttgttcttcatctttctgcggtggccggcgacgacgccatcgtctccagattccaggagtacctccgaatcaacacggttcagcccaacccggaatactacaaagccgttgactttataatatctcaggcgaaaccactgtccctcgaatctcagacgatcgaatttgtaaaaggaaagccgcttctcctcctcaaatgggttggctccgacccaaccctacctgcctttctcctcaactcccacaccgatgtcgttcccttcgaggactccaagtggactcaccatccgctccaagctcacatggaccaccatggcgacatctatgccaggggttcccaggacatgaagtgcgtcgggatgcagtacctcgaggccatacgcaagctccaggcttctggcttcaagccactccgatccgtctatctctccttcgtccccgatgaagagattggcggccacgatggcgcagagaagtttgctgaatcccaattattcaagagcttgaacatcgcaatcgtgctcgacgaaggtaaacactcttctggatttgattcttgattataacagccaagcatcatcttatacaacaaagtgaatcaggcctgccatcgcctactgagagttacagagtattctatggagagaggagtccctggtggctggtgattaaggctaaaggtccacctggccacggtgccaagctctatgacaactctgccatggagaatctgctcaaaagcattgagagtattcgcagattcagagcttctcagttcgatcttctcaaagctggtgggatagctgaaggcgatgttgtctctgtgaacatggccttcctcaaggctggcacaccttctccaactgtaactacttttttcttcattcatattatgtatgattccaaagttgatgtctttatctgagaatctggctctttctttatcctcaagggtttcgtaatgaatctgcaaccatctgaggcagaagctggtttcgacattcgtgttccacccagcgttgatgctgaagcactcgaaagacgtttagtggaggaatgggctccagcagcacgaaacatgtcctttgaggtaatttcttggccacctgtatctctttctcaatgaatttgaagaaactgtccagtcttgaagccaagtagcaacacaaagtcccctttttttatgaacaaagtctactcgacaactttaactaattaagatgttagctggggcagttcaagcagaagcttacggggaagcaattccttacagcagcagatgattcaaatccttggtgggggctcttggaaaatgctgttaaggaagccggaggtaggaccagtaagcctgagattttccctgcatcaacggatgctcgctactttcgcaaggctggcgtgcctgcctttgggttctctcccatatcaaacaccccgagtctgcttcatgaccacaatgaggtacatacatgttgatactcactttgctcattgttggaggatcatcattcatgttgtttatctgtgttgcagtatttgggtaaagctgagtacttgaaaggcattgaggtgtatgtttcaatcatcaaagcttatgcatcatatgaaagcaaaagtggttcacgagatgagttatgagggtctcaacacagcccattcaagtcttcctttcgcaaatttgtacaatcaataagatctgaatccatcctgtgtttgttgtggtaaatcagagacatcttgttcttgttgtgagacagttggcattggcaaattgtattattcattcctgctttttcaatgcttcttcttttttctccttgtgtttcctcgtcgttgatgggccgtacaaattaggcccattagcatgatccagtacgaaatccatttaatgtaaacccaaccagtcctcctatctcttcgttcgtgactctctctgctctgctcccaa

SEQ ID NO: 3489 - DNA, 3000 bp, Unknown
  misc_feature (1)..( 3000): cDNA_ID_3071244_gDNA_ID_1620648_Annot_ID_163355 3000 nt of promoter + ATG
gtctaatagcaacaaatgtgaagtatgaaaatgttaaaaataacatattgaaaaagccatacaaaattgaatctagcaatgttatagtctctaattttgccttgctccagaataatgatctaactccgtctctcactactgtattttctcctgttttcaggtagtgacggatctctaccgaatccatcagcagtcattgttggcatcgcacgttactgttatactggagatactctcatcaatctcatcacatgcccaccagttaaattctgatttgatattgcagaagaaagtgaggagagcgtgctctatcctggagctctctgaacctcccatgcttcatttcgaaaatgacacgtttcagaactacctggacattcttcaagccatagtgacaaataatccaggagtgtcgttggagctaaacgtagagtctcagctgatgacagtgtgtatgcaaatactgaagatgtacctgaaatgcactttgtttcagggtgatgagttggaagaaaccaggcagcccaaaaactggattctacccatgggagcagcctcgaaggaagaagcagcagcgagatctcccctagtggttgcagtgctgaaggctctgagggaactgaaaagagattcattcaagaggtatgcaccgaatttcttcccattgttggtggagcttgtgcggagcgagcacagctcttcacaagtcccacaagtcttaagcacagtgttccatacatgtatgggtgcaatgatggatgaataatagggtggttataagtgggttttgacattcgagcacctgaaggatattgattaacaagcagacacaaatcactcttttcttcttttgttttttcttctcgacggagatgcgagatttacaggttttgtgctgttgattgatagtgctgatataaagtaattgattactgtttgtagaaactaagaaaagaatggtgagattaggagggtcattgcattttgtctgcaatgcctattttcttccttccagtcgtgatcaatgtgcataatatactctcacacagctaaatgcggtccaagtaaggattgtgaaggatatattatataaaaagaaaaaagaaaagagaagacaaagatgagccactcgtggaaagtcatttatacctccttgaaatgaagtgatgatatctaatgactccaaagtcataataaagtcaccgaaagtgaatcatgatttgaagaagataaaggagtcaggagtggaactgctttccttggtatgtcattccgaagcgccaatacggaggagccacatcataagaggcaatggttttgccgcctttgagagtaacctcgaaagagagagactgtccgatgagatcgagagaggagtgccagttctgtccccagtttctggccattgggatccaagccgttgtgtggcccttcactttcacaccaaccacttccccgtcgaggcccacattgcttatcaacacctggaaaaagtgggagctcccgctcaagctgaatctcaacccgcctctccgcccacacttgaccctcctatactgtataggtatcatctcagctctggtttctgcgatccctgtgaaggcggcatgagatagttccaagtgttcctttgggaagttgcaccaacctccgtaatcggaggagagtcccgaattgggaggacagaaatcggtggcggtgaccaccacggaggggctgccttgaagacaccaacggatgtggttcacgcaccgcacttctagacaagctccgcagctgcttcccctgttgaacagcttcccgctcaggcctgcgctgtagccggcaaagctgctctgcctcagatctccatacccacaagcgcctcctatcagaaccaattagtctagttagtcctgatgaaagaagaaagaaaaataggggggagagagagaaaagagaaccagtagcgacggaggaggagccgtctctgtctctagaaagcgtggctgtggctatcttccagtcatcttcggcagtggcttgaaagaggcggcagagaatgaagaagaggcacaatgcgagttgctgaagcccagaatccatgaacaagaagtgttgttgggatcctcacagtcagtcacaggtggcagacaaaagtgatgcgtttgagagagttttgggggttccttttgatcatcaggctccgcttttcaagacttgtggggatgcgacaaaagattgctctgacatgttttgactttgacagtccgtttcagaccaattataataaaaaaacaaaaaagggaacaactatacgttttccaggcccatctcattcggaggcccactttcaatacgacacagaatcaagacaagagacgcaagacgaacttcttgagcccttttgttaattcaatgggccctcactaagaagcccataataaaataaaataagttctattttcaaacattgtactattactttttgtaccggccgtgtttattcaattctcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgac

SEQ ID NO: 3490 - DNA, 3000 bp, Unknown
  misc_feature (1)..( 3000): cDNA_ID_1820885_gDNA_ID_1620648_Annot_ID_163353 3000 nt of promoter + ATG
agatccgcaaagctagcagcttctgccatagcttcaaaggatagaagagctcctccatcatcagaaagatagcatgacaccttctccaccggataatcaacggccaatatggacagaatcgtgttggcggtgacaaggggcggctctttctctggatctgccgttgacacaaaaaggtcaatacctgggagatccgacctccctgttgggttggagggagaaggcatgtcaaatttgtcacgaagaacttccaggtcagtggaccggtttattggacacaacttagggatctggtctagaatccatgaaaatccaaaccaaagctcgcatattatagacatgagccataaccatattgcgtcttcgttaggatttcggatcctccaagttagaaaaaaacatagcacgacaaaacgaatgacgattagtaatctgtaaggactaatgatggcggctggaatagggattcgtcggctcagtggccgccatggcttgtcagctgtttccaccatgccgcctctcatcccttcatccatatcatcgccatacatttcgtcttgaggccaatacgcattaccgtacccatatgtgccttgcgtctcgaatagccatctgttgtgatcaaattcaccgttttggttcctcttcatcatagacatgttgttgttgttcccacgttgatctttccctggagctggtaaggggagagcaccactagaatagtcaggcgtatcgtcatctaggtccccgattttgtattgttccttgcatcctggacaaaggcctgtctctttctgggcgtccatgaagcaatccctacagatcttaaacctacaaagacaatcatcaccacgtttgttggttagttagaattaaacctcattttcttgtgcaacaagtaaaagatatcaattagtgtttattaatatataccggcattcacatggcatcacgtcctttcctctctcgtctttcatgacatttccgtcgcaagcaggcatggcacacgaagagcctttagcgccagccatctgagggtgtgtgacatctgaatcgatcactttgtccataagatgtgcacgtgttacactgttgaaaccaccagtaaataaagaatttgacacgtattgctcttcggctttggtggccatgggctgattgtccggcgtcggaggtatgtgcaccgtatagttagaataatccccggagagctcgcctgataattctatattatctcgagataaactcacatatcttccgctagatgttcgtcttgcaaatttgacggtttggccgctaccggaattgttacggacctttttagaagtttgaggaggcgtggacgccattgtgaagccaaacaaaggagcttggtttctgcaatgtgatcatgcagtataaagatgaaacgtgacttttttaccttcttgttgattttggcaaaacagagagaaagataaggaggagagaattatcaggacacaaaactgtttatgccatggattcctatttttgggcttctatgtatcatgcactaacctattttaggaagctcgagggttttgttgtttattctattttgggattttaacatattctttcttttaactcaaatgatttattctggaaccccattcttcgctcatacaagccgatggaaaatttcctacttttttagttaacgcacagtccatattttttttattattcaactactaactatagaaatgatccttatcgtttgattttttttttttttttttttggcaactattctcgttactaatttaaaatgtggattactgcataatttcatattgaataagattagatatccttaattcgtcttaacactacgcttgttttcaattttcaacttgtttgcttgttttttccaaatttagataattggacttagcttcaaaaccgatgatcttaatgtgaattaatcatctaccattacttaataaggaattgtgttaattagtattgtactatacttttactttggaatttgaagaacttaacccaattagactaatttcaaatacaatataaaggagctaacggttaaatggcagatttctaatactaatagttttggaaattgatatgtaagagctatattataaactaagaatgatgcatgatttactgatagctaaatggatggacttagtttttgtataaacacatacaaacattgtttagctacacaatattctactagcgtattactaattgacagtacaatagtgaaattgaagaagcatcaaaaatatacttgcaatacatagaaggttcagtgtaacaaaggggttatatttggggactagctagagagacggtgataaaattgttggacgtctgtttcagagtacacgggaatatcccaacgtccacaaacgcaaatatgttaagatctagctaggcttatgcatgtaaaactggcggtagaaaatcacgataacatatctcgtaggcttgaccagatcaagaagcaccatccaaaactcgtctgatgatcccatgctgtctagtgaggttgaacagacaatattgggaagtatacataagagaagctgactcgtgaggttgaatagataaagtgtaacgtactagtgtttttttgttgttgttgtaatagtactgttgatggattttgataacgttcgttaaattatgtttatggatttactagttggaaacgagttatttttatatggaatcaaagaacatcttgttaacgatgttaaaaaccacttaaatattttttgttaactttaaaacggtgaatttaaacgataacattatgttaaattgagatttaaatgattttttttcctatgggctattaaattataattaatcaaatacaaaacgctgaaaggtaagaattaagaatgaaagaaacgcagcgtttcgtttcgacaaagtccccgggttctgggttggccttttatcattttgaatcgccgtgagaagtcgaatatgcgttag

SEQ ID NO: 3491 - DNA, 3000 bp, Unknown
  misc_feature (1)..( 3000): cDNA_ID_1820889_gDNA_ID_1620648_Annot_ID_163352 3000 nt of promoter + ATG
tgtcaatgattaggtttgggtcgtggcaaatgttctcgagtaagctgagcacggtcattttctgcacgaaacttggctggagaacattttcaaggacccggaggacaagcatcggaaagaatatacctacttctgatttcatacccgatctatatttccgtagtaaggttgtgaagatagcacactgaagttgaaaaatagacataaccgaaagtgcgctattctttaacagcgacaagcagagcaactgcttgatggcatttagaaacctgcatattttttggggagggagagtgagctcttggagttcattactactgagagacgactagactaacctgtgaaatgaaagataaaacaacttgcctttcgtcagagagccaaattgggccgccgttatcaatgatgactttgagcaactcgagagacaaagtcttgcctctcacaagaatctgatcgtcggtgttctcttgtgacgagaacttcatagacaacttacagagatttttgaagagaaggaaaccgtcttccctgatcttgctgcctgtgccttcatcctcagttgaagaagcaccttcctctggtggttggactagcgcgaaatccggaggaggagctgcttccccggccgtaatgacgtcgttaatgaatccctgacaaatatgaacagagttcccttcgttgacattcttatccgtgatggcaagcaagtcgttgacattaaccgttttgagtgatgcatccatggaattcgcctcggatctggtgaagacgatgagcatgatctgagccagcacagatttagcgcagatctggttggtcccgttgaatccgccgagatacacattgtagcaggtcctgactagatggagcaaacaatcgccacggattaggatgcgaggagatctgacggcggcgaggaggacacgaaggaccgccagctcaattgactcctcgccgatgccgcaaaccttgcagatcgcatggatgagcttgtagagaagagaatcaggggacgaggagcagacctcgccccggaggagggagagagagaagagcttgaaagagcaatcgagagcaggctcaataaccttagcatagccggtatcaagagagagaaggagtggctgaagaacggcatctgcatcggaggtagtgagaccgaagagaggcgacgaaggatcgggagaatcggagagagcttcgagcttgtcgagtacagacttacaggcggaaacaaggaaggtgtgcttgcgccaggcggcattttttatgatcttgtccaaagatggcccaatcacccggccgcatctggtggcgccaccaaggttctgcgacgacgacatctaacgcatattcgacttctcacggcgattcaaaatgataaaaggccaacccagaacccggggactttgtcgaaacgaaacgctgcgtttctttcattcttaattcttacctttcagcgttttgtatttgattaattataatttaatagcccataggaaaaaaaatcatttaaatctcaatttaacataatgttatcgtttaaattcaccgttttaaagttaacaaaaaatatttaagtggtttttaacatcgttaacaagatgttctttgattccatataaaaataactcgtttccaactagtaaatccataaacataatttaacgaacgttatcaaaatccatcaacagtactattacaacaacaacaaaaaaacactagtacgttacactttatctattcaacctcacgagtcagcttctcttatgtatacttcccaatattgtctgttcaacctcactagacagcatgggatcatcagacgagttttggatggtgcttcttgatctggtcaagcctacgagatatgttatcgtgattttctaccgccagttttacatgcataagcctagctagatcttaacatatttgcgtttgtggacgttgggatattcccgtgtactctgaaacagacgtccaacaattttatcaccgtctctctagctagtccccaaatataacccctttgttacactgaaccttctatgtattgcaagtatatttttgatgcttcttcaatttcactattgtactgtcaattagtaatacgctagtagaatattgtgtagctaaacaatgtttgtatgtgtttatacaaaaactaagtccatccatttagctatcagtaaatcatgcatcattcttagtttataatatagctcttacatatcaatttccaaaactattagtattagaaatctgccatttaaccgttagctcctttatattgtatttgaaattagtctaattgggttaagttcttcaaattccaaagtaaaagtatagtacaatactaattaacacaattccttattaagtaatggtagatgattaattcacattaagatcatcggttttgaagctaagtccaattatctaaatttggaaaaaacaagcaaacaagttgaaaattgaaaacaagcgtagtgttaagacgaattaaggatatctaatcttattcaatatgaaattatgcagtaatccacattttaaattagtaacgagaatagttgccaaaaaaaaaaaaaaaaaaaatcaaacgataaggatcatttctatagttagtagttgaataataaaaaaaatatggactgtgcgttaactaaaaaagtaggaaattttccatcggcttgtatgagcgaagaatggggttccagaataaatcatttgagttaaaagaaagaatatgttaaaatcccaaaatagaataaacaacaaaaccctcgagcttcctaaaataggttagtgcatgatacatagaagcccaaaaataggaatccatggcataaacagttttgtgtcctgataattctctcctccttatctttctctctgttttgccaaaatcaacaagaaggtaaaaaagtcacgtttcatctttatactgcatgatcacattgcagaaaccaagctcctttgtttggcttcacaatg

SEQ ID NO: 3492 - DNA, 3000 bp, Unknown
  misc_feature (1)..( 3000): cDNA_ID_1820909_gDNA_ID_1620648_Annot_ID_163346 3000 nt of promoter + ATG
gccgtcgatgtccgcaacacgctttctctcaacgggcgacaatggtcaagtagacgagcagcagaaccctccagagcccttacccaacagacccttgcgaggggagagatcttccaactctcacagagaaccacccgctagacaagcccacaaccttggaaagagtgatactactctgtctgacgatggcttcctcgaacagttcaagcttggagtcaatcaggattcacgggaaacccccaaaccggaacaatacccgcaggagcccttaccgccgcctgaggattccgatgagatcttcaagaagatgaaggaaggaggtctcatccctaacgccgtcgccatgcttgacggcctctgcaaagatgggcttgtacaagaggccatgaagcttttcggattgatgcgtgacaagggtacaatccctgaggtcgttatctacactgctgtcgttgaggccttttgcaaggctcataaaattgaagacgctaagaggattttcaggaaaatgcagaacaatgggattgcccctaatgccttcagctacggtgtgttggttcagggattgtataattgcaacatgcttgacgatgctgttgctttctgtagtgagatgcttgagtctggtcactctcctaacgtccccactttcgttgaattggttgatgccttgtgcagagtaaagggggttgaacaagcccagtccgctattgataccttaaaccaaaaaggatttgccgttaatgttaaggctgtcaaggagttcatggataaaagggctccatttccgtctttggcttgggaagccatcttcaagaagaaaccaaccgagaaacccttctgatttacttacgcagtgctgttaagtatgccgtctcagtaagatgttttcttgacttgtaataacaaccttgaaagtgaaaatcaatatgagtcttcctttttctgcttggagtcaggtatcgagtttttttttttttcctatgtcctttaaaaatgtgtagttgtagatgtagttccctgttttcatgcattctaatattgattgcaagttcaatgaatagcgttgtgttggcggtatagggtgtcaaattatgcttgacgcttatcagtcattaccaatgatgtatgtgactgtctattgcaaatgtggccgacttcatgaacaaatatgaacaatagtatcattggttacatacaccaggcataaaactacatcatcctccaaaggcactgctgatctcagggacgtggaggtctgttctgtagaagctggcgctatattgaatacaaaatgcgtggagtcaacattaaaatagtttttatgattcactcggagatctttacttgatttggtcggctgtattatattcgtgaactcggaagtcaaggcctgtcttgatggaagaatgactccttacttttaatatatatataaataatacactggatatgaatgccatcttttgtttgtttacttttggcgtcatgtgattcttgtattgtttactattgttaaatgcaagtatcaggtagtgcttaagatggaagcatgtgcatctcgtatgttgaccataacctctccaagagttttcttggagttgggagaatcgctgacttgattaaagaaaaacaacaaaagaatataataagagatgggaggtggggtcggcgccgtccctactcgatgatattagtctataaaagagagggaaggaatgaggtaaagaagcagaaagctggagaaagatgatttcaatgttgtttccgcggtcgcctttgtgcacagcagccatagtattctacacatgtgtgtgcattcccttggggaggttgaagaagaatggtggagatgcggatgcgcatgatgatgacggttacaacctagtgggagtgatgtttggggacaaggaaaaggaggaggaaatttgctgccccatatgcctggtggagtttgaggctgaggatgcggtgacccatcttcccagatgcgctcatctcttccatatcaattgcatagaaccttggcttctccgtggccacctcacttgccctctctgcagatcatttgtattggctccaactcctcctacacaaaatgtcaataatgcacactcctcttccaccttgtatctctctatcttcttctttttctgtatctttctccatctacttggatacttgtagcctagcttccttgttaacacacccattctttatttaacatgtattttgtcttagtttccaagcacatattgtctccatctccttttcaatcaagattttgtggattactcagttttatgatatactgtactaaacagagacaaaagcagcacgagtttagttttaccagccttgcctagtgcctactgctgctctagtgctctgtttcctaattgatttgttactctgcgtaagaccattaagtaaacgggctaaaggcaacttaataggccttatttttaaaacacattaaaagtgggcctcattttaaaccataacagattaaaagtgggcctttccattataaactgaaagtagaaaaagttggaagagaagagtaagtaggctacagtttcagtcagaggtgaaagaaaatctgaaagcaaagcagagagcagctcccttcccctcggcgaggaggaaggaagaagaaagccagagagagagagagagatcatcgcagcttctcctccgaccatttgactgcgactgtgattacaacacaccgttgatcctacgaaaaaggtcagtcagactctcttccttgtctgcgtgattccattttccggcgtctgtctagcctcgccgtcttttaatatctttcactcgccttcctgtctcttctgcacactagatttgattttttcgtaacttaaaaaaatgttgttgttgtcattcaaacgcgtccatggctcagctactccgcggctagggtttagttatcattttttaataatataatttttatggatcggcgtgcgtgcagaggtaatg

SEQ ID NO: 3493 - DNA, 3000 bp, Unknown
  misc_feature (1)..( 3000): cDNA_ID_2156727_gDNA_ID_1620648_Annot_ID_163345 3000 nt of promoter + ATG
atggatactggcggcaattcgctggcgtccggacctgatggtgtgaagaggaaagtttgttatttctatgaccctgaggtcggcaattactactatggccaaggtcatcccatgaagccccatcgcatccgcatgacccatgccctcctcgctcactacggtctccttcagcatatgcaggttctcaagcccttccctgcccgcgaccgtgatctctgccgcttccacgccgacgactatgtctcttttctccgcagcattacccctgaaacccagcaagatcagattcgccaacttaagcgcttcaatgttggtgaagactgtcccgtctttgacggcctttattccttttgccagacctatgctggaggatctgttggtggctctgtcaagcttaaccacggcctctgcgatattgccatcaactgggctggtggtctccatcacgctaagaagtgcgaggcctctggcttctgttacgtcaatgatatcgtcttagctatcctagagctccttaagcagcatgaggtttgtccacctgcaccgttttgatatatgctagggatggttatgtcgtttctgaatctctaactcttcctctctcgtttgcagcgtgttctttatgtcgatattgatatccaccacggggatggagtggaggaggcattttatgctactgacagggttatgactgtctcgtttcataaatttggtgattactttcccggtacaggtcacattcaggatataggttatggtagcggaaagtactattctctcaatgtaccactggatgatggaatcgatgatgagagctatcatctgttattcaagcccatcatggggaaagttatggaaattttccgaccaggggctgtggtattgcaatgtggtgctgattcattgtctggtgataggttggggtgctttaatctttcaatcaaaggtcatgctgagtgcgtcaaatttatgagatcgttcaatgttcccctactgctcttgggtggtggtggttacactatccgcaatgttgcccgttgctggtgctacgaggtactttcttctgttcattttatgctgctctagctttgcattgaaatttccttggtctctgtaccaaggttagccctctgtgacgcctctctttctttgaatttattacaacaaactgtttatatgacagactggagttgcacttggagttgaagttgaagacaagatgccggagcatgaatattatgaatactttggtccagactatacacttcacgttgctccaagtaacatggaaaataagaattctcgtcagatgcttgaagagattcgcaatgaccttctccacaatctctctaagcttcagcatgctccaagtgtaccatttcaggaaagaccacctgatacagagactcccgaggtatgccacttgagcaaatcatttgaagtgtgttggctcctttatttctgttgcccattctttcttgcatttcctcatgggttttggtgagcttatctaagtgtaactgcagttacaataagaattttctaatttaaacagctgggctggtaaataatgttcgtccagttagatatgtataagtattccttgattgatgactctggttgttaccaatcttagttttgtaaaatatgccttctatgtaaattataggttgatgaagaccaagaagatggggataaaagatgggatccggattcagacatggatgttgatgatgaccggtatgaaatatatatgtttcctcccctttttatttttggttcgagtcagcggtgtaatgtttacttaatgtgggatcgcattgtgcagtaaacctataccaagcagagtaaaaagagaagctgttgaaccagatacaaaggacaaggtactacagcattatctcttaattgtttcgatttctcagacactttttctggtacaaacatttgaagtcattagttcatctaggtttacagcattttccagaacagcacaatgtgctctgataacattacactttttctcatcccgagacccaaaacctaaagattccagaatgagtctcattctgacattaagtcagttagtttaagctggagatacattcacatgagggtagcgaatctttagctacggttaaatcatttagcctaggctatttatttagtatgctcccagctccaacaattgacctgattagatagtgtgaccgtctagccaagctgagctgaatcatctctgcctctcaattcctaaagccgtctccttttcttccgagattaatttatttatcatggcatgttgttcgtgcaggatggactgaaaggaattatggagcgtggaaaaggttgtgaggtggaggtggatgagagtggaagcactaaggtaaaatgaagcagtggacagggctgaaaagggtgggaatggtggttttctaaagtggttagttttgattgcaggttacaggagtaaacccagtgggagtggaggaagcaagtgtgaaaatggaagaggaaggaacaaacaagggtggggcggagcaggcgtttcctcctaaaacataagactcggagcttctaatttcttgctactttttctgtctatcaaatgttgctagttaagtttctggagttgttgttgttgtaagcactcctctgttttagaggattgagcacggatatgtatttattcgttgcatgtctgaatgatgatatgatatgacaagacgagctattccttttgctatatatttattgattgggccgaagagatctgcgtctgcccaccccaaaaaaataaagaattgatgtgctaaacgcagcaatgaacatcatcaactagtgaagtgggtggagaagatgttttcctgtaacacaattgatttctaactctaaattaaaaaaatgtaaatccctttaagactattaagcgtctctctgtctgtctctcgtcgttctcgtttttgattgcttagttttttcccgggagactgaaacatg

SEQ ID NO: 3494 - DNA, 3000 bp, Unknown
  misc_feature (1)..( 3000): cDNA_ID_1820933_gDNA_ID_1620648_Annot_ID_163336 3000 nt of promoter + ATG
tcgtacggccaggctttgacttctttttcggactgaaaattgatataactaaaattaatgacttatctttgtaaattactttaaattaataaagtaaaagacaattaaaaaaataacctgttgtttagcatcttcccataacaaatcttgaggcttattgttgctggtagaatcagagtttaagtaaataaaaacaggtcccaagacctttttccacgcttcaccaggtctgtaatgtgcctccatgtccgcaccaacataatgtccgcttataaaagtctgcatatgcaaatcagttaagtaacgaaaacattaatactactatatatagtaccaaaaatgtaatctatgcttaatagctttggacgatgtctttaccgtgatggccgtgggtccgacgtgagacgtgagctcttgtttgatcggtccaccggagcgatattcaccgcttggtgagatgatccaaaagccgacacgggacttggttgagatccaaccgtgcactttgttgtctttgatctcacatgtgtactggtacttatcatccacctaatatatatcattcaaattaacgatcaaaattcgagacttcggatgcaagaacaattaaatattgcatccaaaaccgtatgcaaaagactaggtacctggtttttgaacatggagttatgaggatgagtcaattgtacagcctctttataaccaagagccttggcatgaccacgtttgatgtcacggtcatcttccgttggcatttctctttgtcgattatccgccaccgccatgtaatgaaatctacaaacatattttgtgatagtttagataaactcttttttttttttttataaaaacaaataattaacaaaacattggaatcgtataagatacctctcagggttgagtttgaaagcgattcgaattaaacccatgtcgagttctggccattcgggaagtctctcgaagattccgtacatgtagattcctgaagtatttctacgtatgatatacctcttgtctacgtttaatggaatatgaccatcctcccatgttctagagaacgatatctccacttgttcttgggtttgagtgatgattctaaaatttgttccttcgattctgaaccgaaaaataaatatgagtttataaattagaaaagattcattaaaattataaaccctaagataagttagatacttgctctataaatgtgaacgtgtgtatgttttattaaataatttaaactgacaaatcagacgaagtattaagtaactaacctagtttaattaccgatctaagccgccttggcgaatgtttgttccttgccatgttatgtcccagtacctacataaaatcaaagtaataaatcaggacaattttatgtacttacattacataagctttttgagaaataataattgattactacaatattagtttactgaaaattactcaccctctatctcggagatgtggatgaagaacattatcaattcctttgtatttgatcccagttataagtccttgaggattcgagaaactgactctgattatcccattgtccactatcacctgaaaattattagttttatatgtacgttagaatgtataatcatccgattattgattaaaaaatactattgaattatcattaaccctatatacctctctagtcccatgatgtctgcttcttatctgctgcactgttggagctcttgcacttattccatctaagttcctgtacaattttaataattacgcataaataaagccaatgcattgaatactgaaaacgcacacttataattaaattaattgtaaggcaaagagagggagttgaagtttgtttctaaaaaacaagatcgattgttacaagttaattaatacacacgttatgatcctaaaaacaaacttcttaattttatatgcatcaagaagttttttttcccttgttgataatcaaaaattttatgtcaaaatctagaattacttcaaactcatacgagagtcatcacaattgctagctaaaaacaccaatgaaatatgtatgagaatcgagaaacatgtgaattttgtgcacatacaacgtatatgtggatatgtgtttcatcgcaacttgtgaagaaaaaaagaaaaaaaaaactgaccttgtcggcttggaaaaggagagtggaagaagaagcaacagaaggaaacaaataaataacgaagcgatcttcttctgcgataccatcttttcttccagaaactcgagatttgaaataattaatgtttaagaataagatctttgcttctatgcatatattttatatgcgtgtgtgttgttaaacaaagtccaagactaaacgggaatagtaggtgcaccaaaacctaactaggagttactttgacttgtgaatgctgacattattagaacattagacttctaatatgacttagattcatagaagataatacgtaaaagatttagtttctggtatttttccatttttttttttgtgtatttccttttttttgtttaatagaagtaataaagaatacggaggataataatgacaatattcctgatgagaaagttgataattttctaaaagtttcacaaatcttgagcatgtatatattgtgaagtgttgtgttcattgtaacgtcggattgattgcatgaattaaatgaatatgacaaactatttgagaatgtaaataatgttttcttgtcctacgtatgacattatatcatctatacatgaatgacgtccatggcggttatatttgaataattgaaaaatacatgattttgcttcaaaaatagattgacctaagtccatgattttgctttaattaagagttaagacaaacaaaaactacaatctaaataaataatgataaaaaataataatataaaaatatttttagtaaattaatcaaaaaaaaaagagagcatgtgagctcacacataagacagcaaaaagagctaaatgcagagagcttcagatccgaccaaaca

SEQ ID NO: 3495 - DNA, 3000 bp, Unknown
  misc_feature (1)..( 3000): cDNA_ID_3071262_gDNA_ID_1620648_Annot_ID_163335 3000 nt of promoter + ATG
gaacgcagtgctatctttgaatatggttgtaacctttctactagctttcatactggacaacactgtacctggtagtaaggaagagagaggagtatatgtgtggacaagagccgaggacatgcagatggaccctgagatgcgagctgattactcattgccaagaaaatttgctcagatttttggttgcagatgttgttaagtagatatttaagctccaatttcagtttttcaatagcttccccacttgttcttaatatatggaagaaaaggttctcatggaaaaagagttgcaggtttgtgggataagaatatcaaatctttctggaacaatatcatagtgatagacccatccagtgttgcgtttgcgtttgttggggaccttataaagaagctggctaattcacaggatggaacagagtacacaatacacaaaaataatgaattttcctcaaagaatgaaatgttgatgttccgtgttactgtcataagctatgatatttaaaacttacaagaggtgtacatgctagctttttttggcttgggaccgtatctacgcggttgaagaaggaaaaaaaacaaaaaaaaaaagtcttggatcagtacttgacgacatggtggcgtaaccatagttcatacatgatcatgtgaaatgcgtcgaatttgactggaggtgagttccattgaaaatgcttctgcacctgcacaacaacaaaaccaatcagcttcttgtatacaatactggataagatggtgaaattctctttaccttgaccaagttgttatgcaacgaaacaaactctgagtgaggtatgttcttgaggatctgcttaaggttatagacatcttgctctctgagtacaaccgcaaattttcgccaattcaggatgtcgttgaaagggaggtcgtagtagtctgataatatgactggccaaaaacaaatgccgacaaaataacaagatgcattagttcagtttctttgaaggtatatcgttttgacgagtgcagaaagagtataagaacatgtaccaggaatacatccgtaatggatcgagtccgttatgcgagcgctgtttacttgagaaccaccagggcatatgcagaatttagtccggtagaatctcttctgatacaccaaatgccctgtagctctgttaattctgttgtttgaaatatcaagctctgtgtcgttttcccacacatgagcaagtataacccgtatcttagaatttcgatgaccagcccaaaaaccaagagtcgtcctgtaacaccaccatttaacagtattagtaacattgagccaacaatacaactccaggatctaccagagttcctaataaaagagggaggacttagtttaccgattctcaacatcatttccaccagcagggagagcaaatggctgaagaacttgaggcaaagcaacatctttgtgaggaatgaaaccaacattgtagctaggtgagcacacaaccctaatagtattcttaatcagaagcggagatccctcaaatgctctaacaccaacatcatgacatgtaacaaagaagtgatctgctcctaaagttctattccaataaggatacttagctatcaatccatcaacatagttttgaacaatcacagtcatattttcatatgatgttccctgcacaacaaagatcatcacaattcaatcatcaaattcatgaaattgcaaattctcagtgaatcaaaacttgtaaattcttactttgcctcgcatcttgtgacaagagattggaatgaagaagagatctgcttcatctggatctagggttcgaaatcgactctctctaatgttctggaagaagtacccctcactagcgtatttaccggtgactttcctcggcgtttgataaaacgtatttggatcgccgtcgggataaatataaaccttgaatctcttctccatctcggcgtaattcaatcggaaagcctccggtgagtgataaacatcggagtaggtttcttcttccatcgtcggtgtttcgttatcagtcttatactcattcacgaaggtatgaggaacatgaatcggtgttaccacgatgacaggagacggcggcgaagtgcgtaaggaattgagagagaggtagaagagggaaatgaaagtgagaatagcgacggtgaggagtgagcttttgagtgaacataacggcgaagatccgccgccggagaatgagaactgcgacggtttaacgatcgtcattgtttggtcggatctgaagctctctgcatttagctctttttgctgtcttatgtgtgagctcacatgctctcttttttttttgattaatttactaaaaatatttttatattattattttttatcattatttatttagattgtagtttttgtttgtcttaactcttaattaaagcaaaatcatggacttaggtcaatctatttttgaagcaaaatcatgtatttttcaattattcaaatataaccgccatggacgtcattcatgtatagatgatataatgtcatacgtaggacaagaaaacattatttacattctcaaatagtttgtcatattcatttaattcatgcaatcaatccgacgttacaatgaacacaacacttcacaatatatacatgctcaagatttgtgaaacttttagaaaattatcaactttctcatcaggaatattgtcattattatcctccgtattctttattacttctattaaacaaaaaaaaggaaatacacaaaaaaaaaaatggaaaaataccagaaactaaatcttttacgtattatcttctatgaatctaagtcatattagaagtctaatgttctaataatgtcagcattcacaagtcaaagtaactcctagttaggttttggtgcacctactattcccgtttagtcttggactttgtttaacaacacacacgcatataaaatatatgcatagaagcaaagatcttattcttaaacattaattatttcaaatctcgagtttctggaagaaaagatg

SEQ ID NO: 3496 - DNA, 3000 bp, Unknown
  misc_feature (1)..( 3000): cDNA_ID_1820951_gDNA_ID_1620648_Annot_ID_163331 3000 nt of promoter + ATG
gtccctgggtaacacaaattttctttactcaacaaataacattatttcatattaaaataaactataaatgctagcaaacgtgattgttactatttcaaataatatcaacctatatctaagattttcttgcatattttaccggatgagacatgttaattcataccattgttattgtaaaatcaaacaatggattgcacaaaaaaaaaaaaaaaaggctctaatgatgacatttaatcggaattaaattgtttcaggcatgagattgtgggcgtggtgactgaagttggagccaaagtgaaaaaattcaacgctggagacaaagtcggagttggctatatggccggctcgtgcaggtcatgtgacagctgcaatgatggcgacgagaactactgtccaaagatgatcttaacgtccggagccaaaaactttgacgataccatgacccatggtggatactccgaccacatggtgtgtgctgaggatttcatcatccgtattcctgacaatctcccattagacggtgccgcaccactactctgcgccggggtcacggtctactcccccatgaagtatcacgggctcgacaagcccggtatgcacatcggtgtggtgggactaggcggtttgggccatgtagcagtgaaatttgctaaggctatgggtactaaagttacggttattagtacttcggagcgtaagagagacgaggccgttactcggcttggtgcggatgccttcttggtgagccgtgacccgaaacaaatgaaggatgcaatggggactatggatggtatcattgataccgtatctgcgacccatccacttcttccgctgcttggtttgcttaaaaataagggaaaacttgttatggttggtgcaccagcagaaccgctcgagcttcctgtttttcctctcatctttggtatgaacctatttgtcagtcatctttaaacattatcaacaatatagccaccaaatttgcggttatagtaacaaatccgtatacttttccattgataattaaatctagtgattattttgtcacaaatctaatcatatttgaagagtaaagccactaaacgttgagaatatggtcttcttctttttgtgtgtgtgtggttgtatacataaagggcggaagatggtggtgggtagtatggtaggaggtataaaggagacgcaagagatggtggatttggctggaaaacacaacatcacggcggatattgagctcatctctgcggattatgtcaacaccgccatggaacggcttgcaaaggctgacgttaagtaccgatttgtgattgatgttgccaacacgatgaagccaactccttaactagaaagcttaagaattgaatatccccaaagcttttttcatgtttttgcttgtttgtttgatgttgtttgctggcgactttgtgtgtagtattaccacactgcatgtactttatcagttgaataaacttgaatattgtatttaataagctatctacattagattttggggaagtttgattaaaatttattccgattgaagattttagttggcgatattgtaagattacaaacatattaaggttgaaatgtgatgggttcgaatgatagaaacagttttgtttgaccgacacgagaaagtaatgagaacacactgatttaaattgatgactagaaactaccaagatatttattggtcagatttcgtaggactaatcaaatcaaaaactacttcttttgagacaaagtgcatgtatcttagaaaattttcaatgattccgatctttaattagcaatgtaaacacatttttactatggaatatgttacgtggacggaactgaattgagtttccgaatggaaaaatatggaccacgtgaacagatacatatatggttgagttgagcaaagttcaaaatggtccgtacacactgactaattgtcagtattctaacaacgttaatttcgtggtgcacgaaaacaaaatgacgatgtggttgcacaaggtccacgttcttgtatattgttttttaatgtgctaattgtgcgctaaaataaatttaattgtataaaattagtatagtttatatttttttaatatgtatatgttcattcaaaacatttggataatatatgtttactatgtgatagactgatggtggaacattttatccatcttatatgcatatgaataaaaattattcaaaatgtttgttgttgttcagattattaattattaaagaattagaaaattttggaattacaggtatatatgtatgtgttgtatattgtatatttaaattattatgtatatttatatttaaatttttctattttcataaatcgttagtatataattgtgtcacatctaatattattagaagacaagttggacttttcataataaaataaaacatatcttttatcaaattaaccttttcctttaggtgcccaaatccgtagcaccatcaaatacctaagatatactttttatttccaaaaatcctttcgtttgatctaatattaataatataaacgatcaaacaaaacgatttttagaaatcaaacgttcaagtttgatcgttggtcgtcgctaatttaagtttgatcgactgctcatgttccgtgacaatgttaaaactgaatacatgaaacatgttttttttttgtgcatttgattttaataattttttaaaaactgataacacccgaaaaaaacagcaagaaactaaacaaggaagaaaagaacggtcggtgaggaactctcgtgaaagtcttcaaaagacttttaacggaaaaacaaaaaacaaaaaacaaaaactcttgtgaacgtaagtgcatggaccgaattgcacccgatcacgtcggttccacaatcctctcctatattaaggccttcactgctccttatcatctcaaacttctcatttattaataagtgtcattcaaaagaataaaatcaaatacttacttttgaatccgtttttttcattgtttgatcgatt

SEQ ID NO: 3497 - DNA, 3000 bp, Unknown
  misc_feature (1)..( 3000): cDNA_ID_1807550_gDNA_ID_1620648_Annot_ID_163330 3000 nt of promoter + ATG
agatggagagattatcaggagagaaagagcagagcgtagaggcgtttggatgggccgcgagagactcctcaggccatctctctccctttgtcttttctagaaggtaacggtgactgagtgatgatgaggatggtgttacatgatggatcgatgattattatagccattatgatgatcacgatatgtgcaatgtgcaggaaaacaggagaagaggaagtgagagtgaaggtgttatattgtggaatatgtcatagtgatctccattgtctcaagaacgaatggcattcctctatttaccctttggttcctgggtacgcaaattctttttctttcaataacattaactttcataaattttcagttatgttcaaaataattatatgatcattgtgtcgcttacattatagtactcccagtaatttttgtttctatttgatgtttaagattatatctacaagtttgaccactctagaattcacatggcaattataaacaatgtagattttgatcccgaaaaactcgagtcaagaaaatcgaacttttgcttatggttatttaaatacccaaggattaggtatatattggtgaaatgaagttaacatatgtttcatgaaatattaaaaacaaggagttgtttggtaaaatgcttaattattagagatcaaaatataactgagtggaagtaaatgtggcaaattcttgtttgtccactgtttatagtggagcacttacttagttcttttctttcggctaaattaaatatacagttgaataaaaacacatttaggcagatttattactctcaaataagttctgcaaaaaaatgagagcactcaccgttcattattaccatcattacttaaagttgactattgttagtttccactctctttttttttttttttttttttttttttttttttctgttttgacaaatgatttctcatatagtgacttgtcttttttggttaaaataatataactttattatattataggtaaatccacgaacacacagatcaatataagtgcaacacaaactaaatacatggggcactctttttatattgtttcaagttcaaatgtataaaagttttaaaatattttttaatataaataagataagataaacattaattattacttttattttgttattaatgctagttacattgccagattaatgttagaaatactatattaacgtatggttacgttgtttagtacagtcacgagattattggagaagtgagtgaaatagggaacaaagtaagtaaattcaatcttggagacaaagtcggtgtgggatgcatcgtagattcctgcagaacttgcgagagttgccgagaagatcaagaaaactactgcacaaaagcaatcgcaacctataacggagttcaccacgatggaacgattaactacggtggatactccgaccatatcgtcgtcgatgaacgttacgctgtcaaaattccacacacattgcctctagtttcggccgcacctttgctttgtgcaggtaattcaaatcaaatatggctatatatttaaaaccaaaaaaaaagtgtggtagttgttaagattatcgatatttacaaattacaaacatgaaaaaaaaaaaaaaaaaagaagaaattatctacgtttctatcaatttttacttttcatctgatgatcatgaatatgatttcaattaatataccgtttgtaacgtaacatataggcatctcgatgtacagtcctatgaagtacttcggattgaccggaccggataaacatgtcggaatcgtggggctaggtggtcttggacacattggtgtgagatttgctaaagcatttgggacaaaagtcacggtggttagttcgaccactgggaaatctaaggatgctcttgacactcttggagctgatggattcttggttagtactgatgaagaccaaatgaaggtacgtaatcttaaaccattcattaattatgcgaataaaacgtaaaaaacgttatcaggtttcaactttatttaggctgcaatgggaactatggatggcataattgatacagtttctgcatcgcattcgatttcacctttgattggactactcaaatccaacggtaaacttgttctactcggtgcaacggagaagccatttgatatatctgcattttccttaatattgggtatgcatatataaccctacgtaatagaacgttatattagtctttcacatctagactatgtatcgagtatgatgaaaccatgatgcgacaggacgaaaatcgatagcgggaagtggtattggaggaatgcaagagacacaagagatgattgactttgcggcagagcatggcataaaagcagaaattgagatcatatccatggattatgtgaacaccgccatggatagacttgccaaaggggatgttagatatcgatttgtcattgacatttctaatacattggctgctactcgatcttaattaaagtcgatgttctatatgtattcaaaataatctggatttcaatcccacaaaacttaaggatatatatatatatatatatatagtctattttatataaatggagtatagtcaaataaatatgcattatcaacgatatatagtcttctattacatagatacgtgggagttcacccaacgtagatacgttcggttgaaacaagtcaatttcatcaatgcctcttccaaaaaaaaaacaaattgcattattgatgaacacatgcatcattatcaaataggttggttaaaatgaccaagatgactaaagccaatcacactactaccagatcgagtaaccattagggaccattaattcacgtggacgtagtgaatatggtccttgtgaattaatgagtacgtaattgtcctcattcatatatggatcggttccacaaacatttcctgtataaaattctacatctttcctctcattattatctctacacttctcatctctcaatcccattcgcttattatttatccat

SEQ ID NO: 3498 - DNA, 3000 bp, Unknown; identical to SEQ ID NO: 3474
  misc_feature (1)..( 3000): cDNA_ID_4262366_gDNA_ID_1620648_Annot_ID_163320 3000 nt of promoter + ATG

SEQ ID NO: 3499 - DNA, 3000 bp, Unknown; identical to SEQ ID NO: 3481
  misc_feature (1)..( 3000): cDNA_ID_1808991_gDNA_ID_1620648_Annot_ID_47648 3000 nt of promoter + ATG

SEQ ID NO: 3500 - DNA, 3000 bp, Unknown; identical to SEQ ID NO: 3479
  misc_feature (1)..( 3000): cDNA_ID_2999381_gDNA_ID_1620648_Annot_ID_47649 3000 nt of promoter + ATG

SEQ ID NO: 3501 - DNA, 3000 bp, Unknown
  misc_feature (1)..( 3000): cDNA_ID_1820967_gDNA_ID_1620648_Annot_ID_47650 3000 nt of promoter + ATG
tagtttcttataactccaataaaagaactatcatttttagcaatttataaaaccaatacaccataatttctctttattatttttagttatctttggtatagtatcgaatcttaaattaattactatcagaggtatacactaaaaatgaaataatggccacaactttggaacatttagtacaatttccaccagtcttcaagttccaaggccatcttttaaactcgacctttgcagttacatactaaaattattattatcttcggaaatctgagaacatgtttaaattataaactttatggacccaatatgtgggatttaagttttaaaacatcaaaagggacaccaccttatctccttttcttggtctgatcaataatctaaacaaggtttattatcattcacactaccactctgattaccctctcacgtgaattctatagcaccaaccagaaaaaaaaaaactatactttatagaaccaatatctattatacattttcacttaacatatttttttgtcaaatggtagacgactacttatgaagaataatggagactaattatgaagaataatgaaacattacggtattcaaatgggaatataatctctgttcttgactaaactaattggacataaacgcatgatgaaaagttaaatctaaaatatagcattaattatatacttaacatgctttgttggtgtaaagttccaagaatcacctgaaaaactatattctatatttataacaataggtgtctgtaatataaatctgctacttgaacaacagatagtcagtagtatgggtgtattatttaaactctatagtaagcaatttaatttggtaaagaaataggtcatctgtgaaacctattactctttggtaactagctcttatggattacagattctatacatgtgttagatatttggtttagtcattacaaaacatttcttaagaaataggtcttatatatatacacagcaaagataaacacacacaattacacaaaacaaatattgttaaaggggttttaagaaccaaaataaacaaagattgtgataattctagattgtttatgttttagacttgaaaaatatggaaaacgtagacaataggcttgaaacgtaaaagaaagagtggtataaacccgtcgaactaaagataataatgattataattggtaaaatcgaaatgattcgctgatgattgacacctggcgtgaatgagactgaatcttttatcttaagaggacgataattggggatttggtcacttggaagttggaagcaactttaagattctttgttaatagaaaaagagccaaatctgaatttgagtttgagattcgagatgtgattggttcgaagcagtccagcccacgtggtcttaatagatctttaattatcatgttatctatctggggcccacctaaatcttatacatcaacggtataaaatcgaacttggttattagggtttgagcttggtttagttcggtttaaaggacatttgctacttttaaatcaaattcaattgatggatacattcgcgctaggggtggtgatttatggcaagtttgagggttggtcaaagttaaagtttagacattcaaagaaactaaaataaacacacaaaaatagttagtaatgaaggatcaggtgtacggattctgcggtggagcgtgcgaagacttccatcaattggtgttctcaggagctgttcctgcttctcccacgtgtgcctgtcacaaatgcatattacattttagattgtatatttgcaatatgcataagcttgaaatataagttacggtttatatatatatggccttctgagtgaaaatattctatatataagtgaaaattttgtatagctcatttcattatgatattgaacgcgagttgctttgagtagaaatcaagcattaagccatcgaaagtaacagacgttatatagttatttgatattaaatttcttgccatatttggaaacttacgacaaaacaattaatatgatgaatctccgcaactccaagtccctgtctgacacgtgtacttgatatcgtttaaaatcatttattaattgacacaaaaataatttattcatttgtatttctaccgaaagccatatggactaatatatgttgtactagattaatactgtatgtttttgttcaatccattctcttacttttttgggtaaatatcttttggacagatctaattaatatagtataagttttcctatgaccataataaagggccagaatatttttaattttcttttaatcacctctaaaagatactaattaaattaagtaaagcagcatataaagcaagagggttttgtcagagaaacacagtcctgtgatgcgcccattcactattttcacatgacatttgaaataagacttaagaataaattataaataatgtacggacatgttaaaaaggaaatattattgataatggaaatttacctaactcacactaagtttaatattatttcactcctttttatctaaacaattccattaagtttccactatctcccgtaataaacaaactataaaaaagaatcagtgattaaagttgtatatatgacacacatttaagctatatctatatattctcttaacctaggaactttataagaacttctctctatttcattggtttgataaaatcatacacacaaatactaattttggactagaaatttagtacttttctatgtattaaatctacccaaaaatgtctcaaactgagaggtgagtgtgtatgtgtgtgtgtgcatatgcatatatatacttagtttattcctcgaatagattgttgactcttggctcaaccttcctctctctctatttctacctttctctttctccttattcgttcatcttcatattcccttcccttttgggcttggtaagatctacaaaaaaaaaaaccctaaaaaagagaagaaccagaggagattcaattagaggataaaattgatg

SEQ ID NO: 3502 - DNA, 3000 bp, Unknown; identical to SEQ ID NO: 3476
  misc_feature (1)..( 3000): cDNA_ID_1820963_gDNA_ID_1620648_Annot_ID_47651 3000 nt of promoter + ATG

SEQ ID NO: 3503 - DNA, 3000 bp, Unknown; identical to SEQ ID NO: 3475
  misc_feature (1)..( 3000): cDNA_ID_1820955_gDNA_ID_1620648_Annot_ID_47653 3000 nt of promoter + ATG

SEQ ID NO: 3504 - DNA, 3000 bp, Unknown; identical to SEQ ID NO: 3497
  misc_feature (1)..( 3000): cDNA_ID_1807550_gDNA_ID_1620648_Annot_ID_47654 3000 nt of promoter + ATG

SEQ ID NO: 3505 - DNA, 3000 bp, Unknown; identical to SEQ ID NO: 3496
  misc_feature (1)..( 3000): cDNA_ID_1820951_gDNA_ID_1620648_Annot_ID_47655 3000 nt of promoter + ATG

SEQ ID NO: 3506 - DNA, 3000 bp, Unknown
  misc_feature (1)..( 3000): cDNA_ID_1820941_gDNA_ID_1620648_Annot_ID_47658 3000 nt of promoter + ATG
agatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaattatcaattatcatttactctctatttctctaaatattgtagctagcatgcagaagctatggctgataaaactagtaataatttcccctttgtaatttttagcataataaatttgcttaatttccaagagaaaaaattaacttattaaatttactcattcctaattataaatcgctgaatcaagaatttctgtgataataatcatgtaccaatgtaactgcatagacattataatattatacacgtataataaggtgaagaagcaagaggaacgtgaagtagaagaggacaagttcagctttaggcagagacatgtgagaaactcatgaactctcttatgtatgtgagacattcccatacatgatgaattgatgatcatgtcatagatacatcatacatccatcatcattggtctaaagtcataaacttctctatataacttgatcctggaaccttcgagataccttttaccttcatcaacctcctgattctcgcaacatcatcccatcttctattagcagcaaaaatattagacagcaacacataaacaccactatcttcaaactcaatatctaaaaaactatctaatatctctttaggaagctccattaatgtccctctattcttacaagcactaagaatagctccacatatacgtacatccggtttaaccggcattgctttgacgagttccaatgcttcatctaacaatccagctctacaaagcaaatcaatcatgcatccataatgttctagcttaggaaatagattgtattctctgcttttcattttatggaaatatcttctcccttcatcgactaaacctgtgtggcaacaagcatttagagccgcgagaaaagttaccaggttcggcttaaaacctagcttaaccatttcttcaaagtatctaagggattcaagtccatgcccatggatagctaaaccacctaacagagcattccaagtaaacacattcttacttctaattccgttgaaaatctccaaagctgtttcgatgtagccacattttgcatacatatcaacaatggcagttccaatatgcgtatcccatttgattccagcggttaaaatatactcatgaacccatcttccgtgatccacagctcctaagctagcacacgcagagagaacacttgtaagtatatgcccatctggctttataccagaagacgtttgcatcagagaaaacaagtcaatcgcctccttagatctttcacagtgaaccaacccactaatcatactattccaagaaactttatctttcttttccaactcaccaaaaactctcatcgcatcagacaattgctcacatttcacatacatatctataagagcattaccagtctctaagctgatcaaagatgccctttttaagatcaacccatggattcctttccctaaacttaaacaccctacccgcccacttgagaccaatacacaaacatacgtagccaaattaggctcaacatccatctttgaaaacgtatccaaagcttccttatacaacccagtcctcgtgaaaccagttataatcccagtccacgaaacaacatctctcacaggcatttcaccgaacactttacatgcattccttgattctccacacacaccataaaaatgaacaagcgagttttgcacatagatatcatcgtaaaaacccatcttcgtaacaattccatgaatctgtttcccttctctgatccctgaaaacttcccacaagccttaaaaactggaggaaacgtgaacatgtccggtgaaaacccattactcacaaatgttttgtaagcaaaaatcgtcactcttggtttatcacaaactgcatagcttgataaaagcgtgttgtatgagaaagagctcaacacagaacggatactgtggagaattacagagctgtaagatgcaaaatctgcggatttgcccagaaaggtcacgactttgttgatgattaagtcatcacgaagaagatcacgagtaatcaattgagtctgtatctgtttgaaaacgcgaagagagctgcatcggctgatcaattccagaagaactgatttctccggcaaatacatctagtcgcaaatagtgatcaaacaatcacatgggggttctatgttaatctgcatttgtagaacgagttcgattcacagaaagaaccaaatttgcagattcatagacggagaagaagcggaagactgaaacagagagctaacctgaggatgacgaagagggtttaccgttaaaaccacttattgggcctattattgggcctatctttttaacagattgggcttttctataaaattcttagacctctctagactctaggcttcaccggagaaagaagagaaatcaatcggattagttgcagaagtgca

SEQ ID NO: 3507 - DNA, 3000 bp, Unknown; identical to SEQ ID NO: 3495
  misc_feature (1)..( 3000): cDNA_ID_1820937_gDNA_ID_1620648_Annot_ID_47659 3000 nt of promoter + ATG

SEQ ID NO: 3508 - DNA, 3000 bp, Unknown; identical to SEQ ID NO: 3494
  misc_feature (1)..( 3000): cDNA_ID_1820933_gDNA_ID_1620648_Annot_ID_47660 3000 nt of promoter + ATG

SEQ ID NO: 3509 - DNA, 3000 bp, Unknown
  misc_feature (1)..( 3000): cDNA_ID_1820929_gDNA_ID_1620648_Annot_ID_47661 3000 nt of promoter + ATG
agttgataatatagataatagattccccggacaagttaaactagattcagtttgataagactaattcccacgttattacgatgaagcaaaagccaaatcaaattgtgtggtcaactcaaaatcaatctttttgttaaagaaggatattatcaataacgactaaacaaaacaaaaattaaccaacactatttctagaacattcatgaaagtattatctccgtataggctataattaaattataaagtctttcttatctctaaatcataagatttccctagtaatctccacgagctaaagtcagaagaaccaaaggcagatgagtacgccacgtgtacataacttgagcctcatacacacgcaaaacgattggataaaatagaacacatcatcatcatcaatttttgtacggttgtaagaagccacttgtcaaagaatcaacggtaaataagaactcttctccttcttttcgtatcttaaatttatataacaaaaatgttttaatatttgagaaactccatcaatcaatcataattattttagtttaatgattggagagaccgatcgtgaatttgtggccgttggatcaaaacttaatccaaaagattggagaaatcgatttataaattgcagaagaagacgactagctgttgagtacaagggacgacgaatttggtcggagggataataatggaaggagatgatcgataatttgggtttttagggttcctcttctctgatccttttgataattttcaccgtttttttgggggttttaaaatttcttcaaattctagttgatttcattttcaaattctggtgaaacattatttgtgtttcaatggtgaagcttagatcttgagctaagagttaagaaaatttcatctttttcctgtgaaagttttgtcctttttagattttgttttttttttattctttaaaccgttcattgatttcttctgagtcattagaggttgatttattgcaagcaaaagggttttcaattgtgtgttggttgctgtgatctttgaccagattttatggtggaatttctgaaaaaagtatcaatccggttcttgaaatgatgaagagaccgatcccaagttggccatggtggttattaggaagtagaaaagagaaagaaactgaagctcttaagtttcctacaaagatagctcgagtaaataagaggaaagagcttgaacttgagagctttggttcgtctggctctgaatctgtagatgttgttgctggtgatggacctgaatggtctgttggatggactgagccacatggacctgatttccaaagtgatgatgaaggaaatgatggtggcttcttagtgttggttccttgttatagagctgttgttgaaggctctagtaataataataaccagctcttgagtgctgtcaagaatctccccaatggtttgcctcctggtatgaatcacccctaatttgtggtcttggtttggtgtagtgaattaccatagccttctctcttgggattgatggtctattggatataatgcttgtggttttggtttagtgaactaccaaagttgctctctttagaggtttcttttcacatttgatcccatgtgcaaattgtccacagtctttgctatttgatgtttcaacagtttttgtcctaaaccaaagtgaaaacttttctgaattcattcttatcaaatttgcagatgggaagaattacatggagcaatggctttcatctctgcaaaaactttgaccaggtctcttccttgtgtagttagttagtagtaagtagttttaatacgctctgaagaatcattttggttactacatttatcctgaaaaccccaaaaaaaggagaaaaagggaatagaaaagagggaaccaaaaaaaaaacacaagtagttttatggtttagattaagatgatgggtagttgcttacattgatcctggaaacggatcaagtccaagaaaaagggaagaaaaaaatagtaaaaagaagttgtggggttgggaaagctatggagaagaagtagctttaagattggttacattcagaaaacagatcaaaatccaagaagtgaaggtggatatcaaattacattgatcctggaaaaggattaaaaccggaaagaaaggaatacgaaagcagtgctaaagatttttatcaagatgatcaaattgatggtgtgagtgggattcttcaattggtttggaaattcatgtaaagtcttgtaaatacaaaaaaaggagagtgatgtatatactcttgtaatctatcgtgtcctgtatcataacctcctcaagactgagattgtaagtgattgtagattgtatgtaatattaactaccattgatccttttattgtatgtagaaagtagaaacactatttgccattgtaatcctctttaaacatcctctgtatatctatccctttatatatatttcaattggagaatcagaaatatattttttgaattctgaatgtccacattcttagtagtgagtaagagatattatgctttggatctattttatgatttcaagagtaacaaaagggtacaaattttgataaaagaaaactctgtttttgttgtacatatatatcaatgggtcggaaggagactaaaggactcaggggtccatatctcggaaatatggtagttaagcatccaccgtcaagttctaaatacatcattaagcagctaatattgaatacttagtcttaaagcaaactttattattggctttaatcatgtatataataagatattttcatacatcataaggatagtttagtcatttagttgaggtaaagacaaaccgctgatgtcgacatgagtgagaaagtgaaataacgttacgctctgtttctcacttcagagagccaaaaagttagcaaaaaaaggaagaaaaagaagctggaaaatgaacttacagctcaagttcacttcacaagcttctctagtctttcttaaattttgagtctttgttggaaacaatg

SEQ ID NO: 3510 - DNA, 3000 bp, Unknown; identical to SEQ ID NO: 3492
  misc_feature (1)..( 3000): cDNA_ID_1820909_gDNA_ID_1620648_Annot_ID_47669 3000 nt of promoter + ATG

SEQ ID NO: 3511 - DNA, 3000 bp, Unknown; identical to SEQ ID NO: 3491
  misc_feature (1)..( 3000): cDNA_ID_1820889_gDNA_ID_1620648_Annot_ID_47675 3000 nt of promoter + ATG

SEQ ID NO: 3512 - DNA, 3000 bp, Unknown; identical to SEQ ID NO: 3490
  misc_feature (1)..( 3000): cDNA_ID_1820885_gDNA_ID_1620648_Annot_ID_47676 3000 nt of promoter + ATG

SEQ ID NO: 3513 - DNA, 3000 bp, Unknown
  misc_feature (1)..( 3000): cDNA_ID_1820881_gDNA_ID_1620648_Annot_ID_47678 3000 nt of promoter + ATG
accaggcagcccaaaaactggattctacccatgggagcagcctcgaaggaagaagcagcagcgagatctcccctagtggttgcagtgctgaaggctctgagggaactgaaaagagattcattcaagaggtatgcaccgaatttcttcccattgttggtggagcttgtgcggagcgagcacagctcttcacaagtcccacaagtcttaagcacagtgttccatacatgtatgggtgcaatgatggatgaataatagggtggttataagtgggttttgacattcgagcacctgaaggatattgattaacaagcagacacaaatcactcttttcttcttttgttttttcttctcgacggagatgcgagatttacaggttttgtgctgttgattgatagtgctgatataaagtaattgattactgtttgtagaaactaagaaaagaatggtgagattaggagggtcattgcattttgtctgcaatgcctattttcttccttccagtcgtgatcaatgtgcataatatactctcacacagctaaatgcggtccaagtaaggattgtgaaggatatattatataaaaagaaaaaagaaaagagaagacaaagatgagccactcgtggaaagtcatttatacctccttgaaatgaagtgatgatatctaatgactccaaagtcataataaagtcaccgaaagtgaatcatgatttgaagaagataaaggagtcaggagtggaactgctttccttggtatgtcattccgaagcgccaatacggaggagccacatcataagaggcaatggttttgccgcctttgagagtaacctcgaaagagagagactgtccgatgagatcgagagaggagtgccagttctgtccccagtttctggccattgggatccaagccgttgtgtggcccttcactttcacaccaaccacttccccgtcgaggcccacattgcttatcaacacctggaaaaagtgggagctcccgctcaagctgaatctcaacccgcctctccgcccacacttgaccctcctatactgtataggtatcatctcagctctggtttctgcgatccctgtgaaggcggcatgagatagttccaagtgttcctttgggaagttgcaccaacctccgtaatcggaggagagtcccgaattgggaggacagaaatcggtggcggtgaccaccacggaggggctgccttgaagacaccaacggatgtggttcacgcaccgcacttctagacaagctccgcagctgcttcccctgttgaacagcttcccgctcaggcctgcgctgtagccggcaaagctgctctgcctcagatctccatacccacaagcgcctcctatcagaaccaattagtctagttagtcctgatgaaagaagaaagaaaaataggggggagagagagaaaagagaaccagtagcgacggaggaggagccgtctctgtctctagaaagcgtggctgtggctatcttccagtcatcttcggcagtggcttgaaagaggcggcagagaatgaagaagaggcacaatgcgagttgctgaagcccagaatccatgaacaagaagtgttgttgggatcctcacagtcagtcacaggtggcagacaaaagtgatgcgtttgagagagttttgggggttccttttgatcatcaggctccgcttttcaagacttgtggggatgcgacaaaagattgctctgacatgttttgactttgacagtccgtttcagaccaattataataaaaaaacaaaaaagggaacaactatacgttttccaggcccatctcattcggaggcccactttcaatacgacacagaatcaagacaagagacgcaagacgaacttcttgagcccttttgttaattcaatgggccctcactaagaagcccataataaaataaaataagttctattttcaaacattgtactattactttttgtaccggccgtgtttattcaattctcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgacatggaagagatcagagacatcaagaaagaaggtcagtgcgtcaataaaagcctggtaggtggtgatatggaggccgtcgatgtggggatagggcagcctgggcctggtggtggtggtggtgggagaagagaggaaaacgtactctttgaatcctcctcctgctccggtggcctgagcgacgaagcccatggtggacatgattggttcaagctcctcgtgcgtcataacaggcttgaaggttctcgtgtgccacaaggccagtttcctcatactgcactcctccatcatctctctcgagatccacaagtgagtgagtgtagggattatggttacaattagtttggtttttctttcttttgcccttgttatttcatttattcaccaaactgccattcctttctgccacgtggccttcttcatcccatttgtgagcaattcaatttagtaatccatttgctgctctgtagtggaagtagttgttgttgttgttgcagaagaatccgaatccaattca

SEQ ID NO: 3514 - DNA, 3000 bp, Unknown
  misc_feature (1)..( 3000): cDNA_ID_3071240_gDNA_ID_1620648_Annot_ID_47679 3000 nt of promoter + ATG
taatttaatctagcgtgatttttctcctcactgttcaagtagataaatgaggatgaaggctcgttttccccttttcagcacttggattttgaaccagtggtcactgaaaggcctggcgaactgactgcgtactacaagattgcacgtaaggactggtttctcttttctctgcgtccctccagctccattactgaaacactttttaatacaggtcactacaagtgggcactggaccagttgttttacaaacacaaatttagtcgagtgattatactagaaggtggcgctttttaacctttcacactcatcgtaccttgctgttgtattgtttaagaggggctgtctttaccttgtggagtattgcttaagagaggttatcttgtctctttaacagatgatatggaaattgctccagacttctttgattactttgaggctgcagctagtctcatggatagggataagtatgttacctactgaagctagactcttatagtataagtttccacagagtatacaaatgtttttattactgtttctcattcttttctggtccaaacatgtgttagaaccattatggctgcttcatcatggaatgataatggacagaagcagtttgtgcatgatccctgtaagattcttcttcttcttcttctttaccttgcttcctctcttgcctgttctttcaatacctcattatgtctagctcatgcgagctaaaataatctgcagatgcgctataccgatcagatttttttcctggccttgggtggatgctcaagagatcgacttgggatgagttatcaccaaagtggccaaaggcatatccttatatgcttttttttctttcaatctcgatgactatagtttgacgcttcttaaattctaaaaaaaaaaatagtttgacgtttctaagacttttcttaacaaatatccacttactgggatgattggctgagactaaaggaaaaccataaaggccgccaattcattcgaccggaagtctgtagaacatacaattttggtgaacatgttagtacccgattatgctatcctatatatcatagttttacaagtctgtttttgtaatgctgttaaattgacctatgttcgctgcatatgacttctgctttctgtatgaaaaatgtattattgcagcttcgtcctatagtttcccgacacatggatgtagacagtcaataccacataatatatttttgcatttcatacttatccataaccttgttatattaatttggcaggggtctagtttgggacagtttttcagtcagtatctggaacctataaagctaaacgatgtgacggtaagcgtaagtgtgttttttacccccttttgttgcatcactagttttcactggtttcctatttcattcataaaggttgactggaaagcaaaggacctgggatacctgacagaggtaacatttacagaactccggccttttttttttataccattttgcatgttttgagtggagaaatgtagtttttaacctgttctctcatgtctatcaaagggaaactataccaagtacttttctggcttagtgagacaagcacgaccaattcaaggttctgaccttgtcttaaaggctcaaaacataaaggatgatgttcgtatccggtataaagaccaagtagagtttgaacgcattgcaggggaatttggtatatttgaagaatggaaggtaaatttgagatgattgaactataatcttcaataattgtaggtccaaatgggtcactttttttgtacccctttgattgtgtaggatggtgtgcctcgaacagcatataaaggagtagtggtgtttcgaatccagacaacaagacgtgtattcctggttgggccagattctgtaatgcagcttggaattcgaaattcctgatgcaaaacatgtacttctccaaccagcatcatttacatcttaaccattgcttacagttctgtgctaaccgggtttcacaagcagatgaaaggaaaagaagattttggaccgcatgcagcctccttctagcagctgttaggttgtattgttatttatggatgagtttgtcgagcggtggggttaactttaacagcaaggaagctctggtgacctggctgattggcttagaagttatgggaaccccttgaaagggtcagggttaaatatatttcagttgttttattagtgattatcttgtgggtaacttatacgaatgcaaatcattctatgcagtttttcttcgtcccacttgttttggcttctctattgctagtgtacatatctcttcaaacatgtactaaataatgcgtgttgcttcaaagaagtaacttttattacatctttggcgagtagccaatcaaggcactcgacccatcttctctggtataacccgtcaactagaatctgaggccatgggatcattaaaggtttgttccgatgcgaccaattggaggtcttgatttgtctcatgtgaagtaggcctaagaaaagagccttgtggagttcccctgcatttttagaatattctaattaaagagacagatctgttgatgactattaatcaaagatatcttcttcttttgttatttttagtcaggatgtggagacgttggcgagaatattgcaaaaccatgttcaacaatgtgtatcatcggatctgcaccaatctgacttaattttcatccattcttatcatctttgtctggtacacatccatctcttcctctaattcccctgttttgatgtctctccttattattgcgatttctttatgctaaattcgtataatgtttcagatcttgctatgggacttgctctgttttcctctgatggcaaactaatttggaaggggaggtgaactaacttggtaagggatttgtttgatgggcaattctttacaagccaaaccacttctaatacattttgtctttcaacgatttgtttcagcacacaaactggcaaaagacgcccccaggaagaagccacaatg

SEQ ID NO: 3515 - DNA, 3000 bp, Unknown; identical to SEQ ID NO: 3486
  misc_feature (1)..( 3000): cDNA_ID_1820873_gDNA_ID_1620648_Annot_ID_47680 3000 nt of promoter + ATG

SEQ ID NO: 3516 - DNA, 43 bp, Unknown
  misc_feature (1)..( 43): cDNA_ID_1821058_gDNA_ID_1620649_Annot_ID_47681 3000 nt of promoter + ATG
gaattcaagaactgagggtcattttgtcactcctaaagtgatg

SEQ ID NO: 3517 - DNA, 3000 bp, Unknown
  misc_feature (1)..( 3000): cDNA_ID_3439905_gDNA_ID_1620649_Annot_ID_47682 3000 nt of promoter + ATG
gttggcccggtatgatcaaagtacttgcatggaatttgtgaagaatgggactttcaatgcggtcacatggcatttgtttcagttcacctcatctcttgactcatgggtgaagctagggaagcagaactgcaagctttcatctaccttgatggttgaacagctccggttttggaaggtctgtatccatagtggctgttgcgtatctcgcttcccagagctattcccagctctgtgtctgtggttgagttgtccatcattcgaaaagctcagggagaaaaatctcatcagcgagtttacttctgtgtcaaacgaggcctacctggtccttgaggcttttgccgagacacttcctaatatgtactcacaaaacattccacggaatgaatctgggacatgggactggagctatgttagccctatgattgattcagcactgagttggataacattggccccgcaattactcaagtgggagaaaggaatcgaaagtgtctctgtatcaactactactctgttgtggttgtattcaggtgtcatgcgtacaatttccaaagtccttgagaaaatctctgcggagggagaggaagaacctctaccatggctaccggagtttgttccaaagattggccttgccattatcaagcacaagcttcttagtttttctgttgcagacgtaagtaggtttggaaaagactcttccaggtgttcctcttttatggagtatttgtgttttctaagagaacgatctcaagatgacgaactagcattagcttctgtgaattgtcttcatgggttaacacggactatcgtgtccatccaaaatctgatagaatctgctagatccaagatgaaagctccgcatcaggtaagtatttccactggagatgaatctgtgcttgcaaatgggatactggcagagtctctggctgagctaacatctgtgtcgtgctcttttagagattctgtttcatcagaatggcccatcgtgcaatcaattgagctacataaacgaggcggattggcccccggcgttggacttggttggggagctagcggtggtgggttttggtcaaccagagttctgttggcacaggctggtgccggtcttctgagtctctttcttaacatctctctgagcgactcgcagaatgatcagggatctgttggctttatggataaagtaaactccgctttagctatgtgtttgattgcaggtccaagggattatttactcgtggaaagagcctttgaatatgtccttagaccgcatgctttagaacacctggcctgctgtatcaagtcaaacaaaaaaaacatatcgtttgaatgggaatgcagcgaaggggactatcatcgtatgagcagtatgcttgcttctcacttcagacatagatggttacagcaaaagggaagatcgatagccgaggaaggggtcagtggggtaaggaagggcacagttggtctggagactattcatgaggacggtgaaatgtcaaatagttcaactcaggataaaaaatcagactcctcgaccatagagtgggctcaccagagaatgcccctacctccacactggtttctcagcgccatctcagcagtccacagtggtaaaacctcaacagggccaccagaatccacagagttgcttgaagttgcaaaagctggagttttctttcttgcaggacttgagtcatcgtctggttttggatcgcttccctctcctgttgtgagtgtaccgttggtttggaagtttcacgctttgtctaccgtattgcttgttggaatggacatcatcgaagacaagaacactaggaacttgtacaattatctgcaggagctttatgggcagtttcttgatgaagcgagactaaatcaccgtgacactgagcttctgaggttcaagtcagacattcatgagaactactctacttttctggagatggtggtggagcagtatgctgcggtgtcatatggtgatgtagtgtatggccggcaggtctcggtttacctgcatcaatgcgtggaacactctgttcggctttcggcatggacagtgctctccaatgcccgtgttctcgagcttctgccgagtctagacaagtgcttgggagaagcggatggttacctcgaacctgttgaggtaatttacaaaaataataaaatgttgatagtggtgaataatggcatcttgagcatccaactaagataaaatggtgaattgatattgcaggaaaatgaggccgtccttgaggcctacctgaagtcatggacttgtggggcattggacagagctgcgacgcgtggatcagtagcctatacgctggttgtgcatcacttttcatctttagtcttttgcaaccaagccaaggataaagtatccctgcggaataagattgtcaagactcttgtcagggatttatcaagaaagcggcatcgtgaggtaacttgaaatccctcatctcttgttcaatgtcattctggggactgaggatgataatgaaacgtggaaataatgtttcaggggatgatgttagatctcctgcggtataagaaagggtctgcgaacgccatggaagaagaagtgatagcagcggagacagagaaaagaatggaggtgttgaaagagggttgcgaagggaactccaccctcctcttggaactggagaagctgaaatcagccgctctctgtggaagaaggtgaacgagagaatgagaggaaagaaagtctgtgtgtttctttctctgttttgaggttctcttacagatgaaaagctgtgtaattaaaaatcgatgttcttcttctgttcttgtaagattttggatttttccaatttctgacaaagttcaattaaaaaacttgactgacattttgaaagcgacgtgtctgtcttagaaatcaatcatatattggcacttcctatcaagagagtttggctgaacccaattttactaaattatcattatctcaaacacaacaaggatagatcatcctcataggcg

SEQ ID NO: 3518 - DNA, 3000 bp, Unknown
  misc_feature (1)..( 3000): cDNA_ID_1821046_gDNA_ID_1620649_Annot_ID_47685 3000 nt of promoter + ATG
taaagcagcaaattaatttgcagatgaatgataatgagcctctgtatttgtttgtgtgttgctccccttattcaattgattttgatttcctttgtaagttgctgcaccacactatctctatctcaaaaaaaaaaaagcttttaatgaaagaaaaaactcttcatttagcatcaaagcaaatgcacccaaaaatagaaaaaaaaaaaaaaggctcacgccgaagcaataaaaccaccacaaaaagtcaaaagccaaagtcaaaagagaggcttcgtgggccctaaaagggatacactttggttctctgtttctgttcttcttctctaataagtttttctctagtcgttcaatattacttaacgataaatcagactttttaaactcgatctggtggggacgatgagtggaaggccggcgaaaaggccgaggaccgaccattccgtcgtgaatgtctgggaaagggagctgggtctcttacccaatcgcagtttctcaaaccgtttttcagcatccgaggtctattgattcactctttttctttctttctttagggtttcgttgaatatattgcgttactttgctcctttgtttatgtttaacagccacccaatgcgttacgaacaatatgctactcaatgaacgtttttagattcttcttctcaattgtctttaattttactctaattgctttcagaagaatgtgtttgcaaatgataaaatctttattgtccaaatgtctagtgataggaaaccaaacaactatcttaattagatattgatgattttacaaaagcaggatctattgcggcgtcttggacttgacaagaagcttgataagcataagggatgtgtaaacacagtgagtttcaatgctgatggagatatcttgctttctggttctgatgacagacaagttattctttgggattggcagactgcttctgtcaaactctccttcgattccggccacttcaataatattttccaagccaaatttatgcctttctctgacgatcgtaccattgtcacatctgctgctgataagcaggtaccactctgcctctcctcttcatacctcctaccgcgaaccacacctcttgatagctcctcatgttacaactagcttatgttgatttttgtaacaggtccgctattccaagattcttgaatctggacaggtagagacttctttgttgggtaagcatcaaggacccgtccacaaattggctgttgagcctggaagtcctttctcattctatacttgtggtgaggatggggctgtcaagcatgtgagttgtatttttcattttgttttcttatcgtctgtttttatacctaggccgcctaaaacaacacgtattttcagtttgatcttaggactcgggtggctacaaatcttttcacttgtaaagaagcaaagttcaatttagttgtctacttgcatgcaattgcagttgatcctaggaaccctggtcttcttgccgtggctggaatggatgagtatgctcgtgtctatgatattcgtagctatcgctccgagggttggtataattttacccaacccatagaccacttttgtcctggccatttgattggagatgaccatgtaggaataacaggtctggctttctcggatcaaagtgagctccttgcttcgtatagtgacgagttcatctatcttttcacccctgatatggggcttggcccaaccccatatccatcttcaactaagactgaggagaggatgacgcctcaggtttataaagagcacacgaaccgtgaaacagtcaaaggtgtcaacttttttggacccaagtgtgagtatgtggtaagtggttctgactgcggccgaatattcatctggaggaagaaagacggagagcttctccgtgccatggaagcagacagacatgttgtcaattgtatagagtctcatcctcacatgccactgatgtgtagcagtggaatagatactgatatcaaaatatggactcctggaggaaccgagaaacctctgtcgccaggaaatgcgaaacaggtaatgccacatctattgctaacctcgtttgcttcttttatttttggtgtttgaagactcggaggatatgctttagttaacaagaatgtaactttggatacaatacatgtgactggaggctgaatttggttttggaaggcaaactaaatgtttgtatgtttgcttcttggaaacaggcttcgggttttggtaacccacgatggttcgacggatattatgtggatgacgatgatgattctgacgatgaatctagtgaagagagttcagatgatgatgatagttcggaagaggaggagaatggtgaagttgatgttgagattacgaaggatgatgataatgatcatggggatgatgatgatgatgatgatgaggatgatgatggggatggggatggggatgagggatgagatttgtatagacatgtatttatctaaacacaaaataaaacagcatatggtaacagtaccaaagaaaggattagttatagtttagttagatgtcatcatcgtggatacaaaatactattcaatagacattttcattcttaaccaaatggatcacatacataatcagcttctgtaatgtcagattgtcagtttcttcaatgaactagaatttccaacaatccaaattccaaagtaatttaaaatgtaaaagatgtcattggtaaaatgggtttataatccaggaaactttgagcccaaaaaaggcccatagatcatcgaaggcctttgatatctgcgacggcgagatcagcttcgtcttcctccaacgctcgatttagggaggatggtggtttctccggggctgctctcaactgtttcaggtcactattcgctccggttgcttcttctatatactttcccactgctttttgatattgtccttagtaatcatctagcttcgattttggttcataggcgtaatccgattggctccgtcacaccggattctaagacgcg

SEQ ID NO: 3519 - DNA, 3000 bp, Unknown
  misc_feature (1)..( 3000): cDNA_ID_2158388_gDNA_ID_1620649_Annot_ID_47686 3000 nt of promoter + ATG
gaaaggattagttatagtttagttagatgtcatcatcgtggatacaaaatactattcaatagacattttcattcttaaccaaatggatcacatacataatcagcttctgtaatgtcagattgtcagtttcttcaatgaactagaatttccaacaatccaaattccaaagtaatttaaaatgtaaaagatgtcattggtaaaatgggtttataatccaggaaactttgagcccaaaaaaggcccatagatcatcgaaggcctttgatatctgcgacggcgagatcagcttcgtcttcctccaacgctcgatttagggaggatggtggtttctccggggctgctctcaactgtttcaggtcactattcgctccggttgcttcttctatatactttcccactgctttttgatattgtccttagtaatcatctagcttcgattttggttcataggcgtaatccgattggctccgtcacaccggattctaagacgcgatgggttcggacccatttgcttcaagttttctggggatttggtaatttacctttctttctattgcggcttaacagcttaagaagcttttcacttaagctctgtttgagtgtgtagagtatcaatgggagagtcagtcataaacatgtgcgtggaagtggcacggtgggatctgtaggttccgctcgtgaaagttggagctctcataagaagcttcccgaagaagagcccttatggctgagtcttcttagagacatggtctggtatgaaattctcccactgagtctagcttttaatatatatatctgctggaagagtctgaatgttgcattatattgaattgcatttttcttgtgagaaggagcacgagatctctcttgtctttcatggctgagcaaccaagtcagctgaaatacatagagtggccaacttttgcaagcacggtatgtcttgttgttgttgttacaacatatgagaaagaaagagatagtttgtgggtgtaactttgtttttttttgttttggtaacaaacagctaaagactgctacactgagtctgtgtctggtagctgtattcattgttgcgctatcatcggtggatgctgctctttgttacatattggcgttgatcttgaggaaagccccatgaggaaggcaactccattatcatttgtctcttgtagccttattgataggtgaatgtttttgatgtagatagaatgcaggaggatgtactcaaaatcaatgtgtttctaaaagttgaattgaaatgaaacctctctggtctagtatctctcacacattaagggaaatccaatcatatatgtcccaagcaaatcacaccataaataataaggaaggattcaacatgttgttggtttacaagtaagagaataagatgatgctaggtgctacttgagaacaacagcagcattgcgaatggagagatactggtggacttggtcggaagaaagtgatctcacagtctggaaaacatgagcattagcatagcggaggtttgttcttgggtccacataaggtgcctgcgagggattagagaagctcattgagttttgttgtttttgggtagtgaataaatttgtagaaaagaatcgatcactcaaaaacagaataaaacctcatatccagtaatatcgcaaagtctcttgcatggttgagtggaaggaggcgattcaatgttaacatctgcgaggcacaaagaagatttgatttttgattcaaacagagtcaaaaatccattcaaaatcagaaatcagagagagagaaaagagttacaagtggggaggtcgggaggaagatctgggaagttctcagcttgaagaatctgcttgaggtgtttccaccttctgctgcttgattgtgcttttgggtacttttcgtaggcttgcttcttcttaaagctcaatcgcgacgccaccactatatctgcctccatcaactctctctccatctctctctctctctctggaaaaaaaaaccttattaattccgacgaggagaacgacgacgacgaaggcttctttcttatacggtgtcctcttaaaaatcaaaccggtccggtacggtagtggaatgaacaatttagtaaaccgatagcagtgtttacattggaaaccgaattgaatgaagtgaagctgtttctttctagatcccccaaagcgagttcatcatcttcttcgcctggattcgatcaagactagcactttcatcagatttgattacaatctctcttatcttccaagttataatcataatatccgagcaatttgggatctgggtctttcctctacattcaatttcttaataaagctggcctctttcttccgagatggttcttgagcgatgatgagtgactctcagcgatcactttctgtgcgattgagccgccggggtgagagaagcaatcattactcacaatctaaaggtctcaacccaactctttttgaactaatgatcatcactttcttttaggtatagtggtttacacatgaaaatttgaagatgacccccgttatagtgttttgtttccactatagaagaatctaatgcgtaatgaatgattatgtcttcgtaatgaatccctaatggattctattactttgtctccaatgatgcagatgctgtggctggcttcttctctcccaccagattgcatgctgattacactttgaaaaaaatttggaaggcaggcttccttcgcttgcttcttgttggcggcattgtctggatgctactcattctatttgccctcttgtttcatgtttggtcctgtcaatcttccctttctttcttctcaggtttcctccaacttctttacacttgccattcttcactaaatctatcatttgtcatacactcaatagaagatgttgttattgtactagttactccaaccatcttctgcattcaccgcagattctatcacagtaacctcatgttctttgtaatttcgttgcagctatttgcaacaaagaaggcagactctatgtc

SEQ ID NO: 3520 - DNA, 3000 bp, Unknown
  misc_feature (1)..( 3000): cDNA_ID_1821038_gDNA_ID_1620649_Annot_ID_47687 3000 nt of promoter + ATG
agattgttcaatcactagactaatcagtctcactataatctcctacagattcatttctattgccactcataacaattgagttttctcacttttttgctctttagattgtctttgagttcattcaggtcttgaagaagagcactcttttaagctgtgtgaaacttgcgccgttcctgtgaagaactacttttggcattgcagatttcagagagctgtgatttgtgctatcttaaaaacggacaagttctatgttgtggcggatgagatgagggatgctatctgggttgatgaattttctgaatgcctgtctctggccacggtcagatcagcaggctcgttctgcctcagattctggtggccgccaagagggtttgctctggttcagagactccggccagcacgtctttggtgacttctccatggccgtcgttcaagccaacagcttgctagaggaccagagccagctcgagtctggctctcttagctcccacgactctggtccctttggcacctttgttggcgtctacgacggccacggtgggcctgagacatctcgcttcatcaatgatcatatgttccaccacctcaagagtgagtcgctcaacctatgcttttaactcttgtttggattagctaatctagaaaggaaatatagaagcatttctctaatagcagcactagtccagaaaatggttctagttttgatctctcatcttttatgttatgcacagggtttactgcagagcaacagtgtatgtcatcagaggtgataaaaaaagcgttccaagccactgaagaaggcttcttatccatagttacaaatcaatttcaaactagacctcagatagccacagtgggatcatgctgtcttgtaagtgtcatctgcgatgggaagctatacgtggccaacgcaggggactcacgggccgttctgggacaagtcatgagggtaacaggtgaagctcatgccactcagctctcagcagagcacaacgcatctatagagtcagtgagacgggaacttcaggccctgcatccggatcatccagatattgtggttctgaaacataacgtctggcgagtaaaaggcatcattcaggtatttaataaactagagttggactaaatctgtttttgtatgtcttacaattcctgttgtctttctgagtggctttatgactatactcaggtttcaagatccattggtgatgtgtatttgaaaaggtcagagttcaacagggaaccactgtatgcaaaattccggctgaggtcaccgttcagcaagccattactgagtgcagagccggcgatcacggtgcatacactggagccgcacgatcagttcattatatgtgcatcagatggactgtgggaacatatgagcaaccaagaagcagtagacatagtccagaatcatccgcgaaacgtgagaacacacaccccactctgtttgtactactagactatatataaagaatgcacataataataaggactctttaatggcaggggatagcaaagcggctggtgaaagtagcgctacaagaagcggcaaagaagagagagatgagatactcagacctgaaaaagatagacagaggagtgaggagacatttccacgatgacataacagtgattgttgtcttctttgatacaaacctagtgagcagaggaagtatgttgagaggaccagccgtgtcagtgagaggagcgggtgtgaatctacctcacaacaccctggcgccttgcaccacgcccactcaagctgctgctgctggcgcctcctgactattgaatttttacggtgtccttaaaattctttccaagatccttcctgtaactatatataaatatatatatttgattattattatcattgactgggaaaggatatatcatcatcaagtgggaaaggatatatcataatcaagtggttagttttgtttgttccctttgttagctgtgtactggagaaagaaaggtgacaagaattcttcttcttcttcattaattttcattgcttgctttttaaggtattactgattcagactagagaaactcagcttattctcagaccatggccttacaaaacacatggcctttggtatgcagttgtgttctgaaccaatcaataagtctcagctctcatataatctcgcctgagagttttcaacttttcttaaaatgaaatttttagattttttctctcattattaaatctctcggaaatgcaaatagcaaagagtttaacacatatatcaatcaatacttgatttattcttttcttttttgaaaaaaaataaagaaaattattaaattttgataaatactattttgtattaattactaattagtaaacttatgattttctaaaagaccataattttctgtaaaatctaaaaatagcgggacaaaataaatcttaccaaactaggttttcttataacttaggtgttttaaataaaataaaaaaatcataccaaattaagtagaacgttggatatgttttttttctcttcaaaaattttaaagtataaagatgagaaaatgattaatgtgataatatgggaaagtaaaaggctataaatgtaattagctgaaagttatgaaactgattgaattgaaatcggtggtatgtatgtatagtccaccaacatagatctctctcttgctgtggctcctttcttcctctacacagatctttggattcagaagaaagaggtacgtacactctaaacaatgtctttcccatttctctacttgtcgattattcccatccatttgttatcttcgttttgaatttgttgttaggttttatgctctgagggtaagtaatcccgttgatctgatcgagaaattcatattgatagagctctaaaattgggtaaaatggaacgaattaagtagattcacgtccatcgctttcctttgagtctctgattcttttatttgttgctgacatgttcgtttgtttgctctgatttctgaagatctaaaatg

SEQ ID NO: 3521 - DNA, 3000 bp, Unknown
  misc_feature (1)..( 3000): cDNA_ID_3071426_gDNA_ID_1620649_Annot_ID_47689 3000 nt of promoter + ATG
ttaagtaaggaaaccatcggaagaaagcaaaattagtgatgcggcaagcaagaaaaaaaaacaaaaggatttatgcggcagattccaactggttcgtattcgctaccaaaaaaaaggaaactttaccttgcaagatgttggaagcaactcaagttgagcaagaaaatgaatgaagagaaggatctcaagaggacggaggagatgtgggcgtggaatttcagagcttgtagatctactacgactacggatggatcaaccaaacacaaaatttatacttttatataaaaatgaacaccgatttttattattattaaattaaatataagcgagcggatgaggaagaagaagaccaattgacaaaaaaaaaaactttttaagaagaaaaaaaaatggttatcccctcagaaactaatgatctttctttcaatgtctggaaacagtgaacaatgaaggtaaaagagagagagagagagaggtcaagtcgccgaacgagacatcctccttcgacgtttttatgtaaaaaaaagaaagaaagttggagttgttttttttatcttctctctttatctctctctatagtcttaagactaagagtgattcttaccagacaagacccataaaagaccaacgatggcgaggtcggagccagcacatcaaaggtcccagctttcgggctccacttccctctcgtccttttttgcctcattagatggacaacaccaaacagtggcaaagaataatattacagtttttttagggaagaaaataaaatagttgatattattgatataataattcattcaagtctcctctttattttaaaaatattcaactcttttactttagacattatcataaactggggtcaaacggaagatttttcttcaacgtttaataaaatctcttaacacaaatcaaagaagagtaaaaatatacggtttcgataaaatttggttatgtggcggtgttacatgactacgactgataaaactacacgagtacttttgtttttctgtcaccaagatttatttcttttacttactccatgtgtttttttctttcttcgttaaaactactcctcgtaaattataatcaagattttaagcagtgtgcatataaaataaaatacatgtacagtctagaaataatatatgtggattcatgaatctttcatttttaatttccccacacaatttgtatcaaacgtttaatgcccataaaagtggtggtccaggaccctgagattaaaattttaaaaaaatatatagagaagaggcttgggcttgaagaatgaaaaattgaataacaaatatttaaaaaaatttgggacccgaaagtgattgggataaagtgagatatgtcactttacctaacattatttaattttatattaatgtatgtaccactaaatttggcccttttctccccatcgactctttgtagttatttatacttttgtagtaccaataatagaagaatcaactataaaaatttcagctcaataaagaaaaacagaactatgaattaagtgagaaactcaaaagcctgcttctaaaacatgaatacgtccacgataattatcactaagttctagataatctaattttgcgggaccaaattgatgtatatgcgaactttttcatacttttttcaccaacaaatgtatatacttcccatcatgcatgctcccatggtatctcgccgagtgtcaatatatgtgaacttacataaccaaaaattgatttataaagataacaataataagggagacctaaaaatagagaaaagggtggtgtggactgtggagaaggtccctacttacagaacatagcttccatcaatcacacaaaaatccaaccactctgaacctttcacttcaggaccaacttcgttatccaatcatctcccaatatgccaatactttcacttatatatgaacgtgtatatataaacccttcacatttacttcacaaaaatatcttttaaaaaaagatcataatcacaactactaagctagaattttttagtaaatttactactacggtaattataaacaaattatataggtttcttaaatagtagaacttaaaatataatgcaaagttatgtacgaatactatcttttaattaaaaataacgataagaatgttaaaaaagaaaaaaaaaaaatcatgttgatgatatatatgttgaagtaaaatttagttattaggtttaggtatacgtcaatcattcatgatacatggatcccaaacccataatatatcatgcatcgatctctgaaaatcaccaaagcaaaaaaaacccatgtaacatgatatactatattatgcatcatttcgccaatgtaacttctctgatgccctgaacctatttcacatatgactcatgggaaagaccgacaaagggatcgtattacccaaatatggttacgataacatccactgaatatcactcaaaatgaattattgtctcttactagatatattacggctagttgatgatttgtttgaaaagtttaatcttacaaaattattaatagatttgatgctgctcaaagtggtctcttttatttgcaccgcaaaaagccagtatatatccccattagaaaagacgtgacaaagtgtttaatagatcctttatgttttcctcggacccatgcatatataagtgtatttaaatcttttataaggtttttatagccataaataaacaaatttagttcaaaataagaataattaagtaattggaatagcgagacacgttccttgagatgataacacgagcatatattcttcatcacttttgtttgcttcatatcatatacgctaacttatgtgtgtgtgtaatatatgatctcagaactaacaagtaagaagaagaagaatgtcggagagtttcaaagtgtgcttctgttgcagcagaagctttaaggagaaaacgaggcagccaccagtgagcatcaagagactcttcgaagcttactcaagaaacggcaag

SEQ ID NO: 3522 - DNA, 3000 bp, Unknown
  misc_feature (1)..( 3000): cDNA_ID_1821026_gDNA_ID_1620649_Annot_ID_47690 3000 nt of promoter + ATG
tgaacctatttcacatatgactcatgggaaagaccgacaaagggatcgtattacccaaatatggttacgataacatccactgaatatcactcaaaatgaattattgtctcttactagatatattacggctagttgatgatttgtttgaaaagtttaatcttacaaaattattaatagatttgatgctgctcaaagtggtctcttttatttgcaccgcaaaaagccagtatatatccccattagaaaagacgtgacaaagtgtttaatagatcctttatgttttcctcggacccatgcatatataagtgtatttaaatcttttataaggtttttatagccataaataaacaaatttagttcaaaataagaataattaagtaattggaatagcgagacacgttccttgagatgataacacgagcatatattcttcatcacttttgtttgcttcatatcatatacgctaacttatgtgtgtgtgtaatatatgatctcagaactaacaagtaagaagaagaagaatgtcggagagtttcaaagtgtgcttctgttgcagcagaagctttaaggagaaaacgaggcagccaccagtgagcatcaagagactcttcgaagcttactcaagaaacggcaagatgtctttcgatgagcttctaagatttgtgagtgaagtccaaggagaacggcacgcagggttggactacgtgcaagatatcttccacagcgttaaacaccacaacgtttttcatcaccatggacttgttcatctcaacgccttctatcgctacctcttcagcgataccaactctcctcttcccatgtctggccaggtatctaagtttggaaactttttatggatttatttcacaaatggttttgtaattgggtatattatatgttcttggttgggttaaggtgcatcatgacatgaaggcgccgttatcgcattactttgtgtacacgggacataactcttacttgactgggaaccaagtgaacagcagaagcagcgtagaaccgatcgtgcaggctctcagaaaaggcgtaaaagtgatcgagctcgacttatggcctaatccttcagggaacgctgctgaagttcgtcatggcaggttggtcccactaacgaagtcttataatcaacaaacagactccaaaaaatgtcacacactatatgtgttttggttctctcatcaggacgcttacttcgcatgaagatttgcagaaatgtctaaccgccattaaggataacgcgtttcatgtgtctgactatccagtcatcatcactctcgaagatcatttgccacccaagcttcaagcgcaagttgctaaggtaagttggttttgcagaaacagagtatatatttcgttctctgaaaaagagtgatttacaaatttgattgattctatgtttgtagatgttaactaaaacatacagagggatgctgtttcgtcgtgtctcagagagttttaagcattttccatcaccagaagaacttaaggggaagatcctgatctctacgaagcctccaaaggagtatcttgagagcaaaactgtacacaccacaagaactccaacggttaaagagacttcgtggaacagagtagcgaacaagattcttgaagaatataaagatatggagagtgaagctgtaggatatagagacttgatagcaatccacgctgcaaactgcaaagatccttcaaaggattgcttgagtgatgatccagagaagcctatacgggtcagcatggacgagcagtggctagacactatggttaggaccagaggaacggatcttgtcaggtaaaatatagagtgagaggagtcataatgttgaacctttttcgactcaagagttataagatgaacctgagtcagagtttgaaaaaaaacaaaaacaggtttacacagaggaatctggtgaggatatatccaaagggcacaagagtggactcgtcaaactacgatcctcatgttgggtggacacacggtgctcaaatggttgcttttaacatgcaagtaagtggaactggctcatcatcgtttgacttgttaaaaaatggttgaataatatttgtgttgaaaagggacatgggaagcaactatggataatgcaaggaatgttcagggggaatggtggatgtgggtacgttaaaaagcctcgcatcttgctagacgagcacacactcttcgacccttgcaaaaggtttcccattaagaccactcttaaggttaagatttacactggcgaaggatgggatttggatttccatcatacacactttgatcaatactctcctccagatttcttcgtcaaggtaaacaacaactactactcttcttttaaactagatttcttcgtaactgtgtgtgtgttgcatttgctgcatcagattggaatagcaggagtaccgagagacacggtctcatacagaacggaaacagctgtcgatcagtggtttcctatatggggcaacgacgagttcctgtttcagctgtctgttccagaactggcgcttctgtggttcaaagtccaagactacgacaatgacacccagaatgatttcgcaggacagacatgtcttcctctgccggaactgaagtccggagttagagccgtccggcttcacgatcgaacaggcaaggcctacaagaacacgaggcttctcgtcagcttcgccttggatcctccttatacgtttcgttgaatctcgttttctttccgaaataagccacacagtgtgtatctctgtttgcacgtttataaatttataatgtacaattatttgcgccctagctagaacgggataaagtgtgacaacatataaatactattaaagattcgatatttgatgactgtagccgcctgcctagaacggggtgccttgtttgacttgccaacttcaaccacatttctttttgtttacttgaaagttaaaaataaatactagagaggaagaaaaacagagctttctttctaagatcatcaacgcacc

SEQ ID NO: 3523 - DNA, 3000 bp, Unknown
  misc_feature (1)..( 3000): cDNA_ID_1821022_gDNA_ID_1620649_Annot_ID_47691 3000 nt of promoter + ATG
tacgtttcgttgaatctcgttttctttccgaaataagccacacagtgtgtatctctgtttgcacgtttataaatttataatgtacaattatttgcgccctagctagaacgggataaagtgtgacaacatataaatactattaaagattcgatatttgatgactgtagccgcctgcctagaacggggtgccttgtttgacttgccaacttcaaccacatttctttttgtttacttgaaagttaaaaataaatactagagaggaagaaaaacagagctttctttctaagatcatcaacgcaccatggaagaagaaggcagcccagatatcatcatcgttggcgccggtatctccggcctttccaccgctgttggactacacaggtgtgtgtggcgtgccttttgagttgttattaagcagagtaagttaactaaagtggtgtgtgtcacaggcttgggatcagaagcatggtgctggaatcttcggagacactgagagcgacaggatttgcatttaccacttggttcaatgcttggaaggccatggaagctctcggcgtttctcagcatattcgcagtctccatgatcgccttgaagggtatcaaactaacactattattactattcatatataatcagctcagtaaaaaaggggactcatctttgattttgctgcagatgggtggttggaacaatttctgcaggaactcctcccacagagatgctgtttccagaatccgagtatgtttcttcttctctgcacagagcatatgaatgttaaaacaataaataagataacttcaataatattgttgaatgattttgtcagagaatatgagtctcgatgcgtacagaggaagctgttgttagaggctctagcaggtgagttgcctgaagagaccatcaggttttcgtctaaggttgttcatattgaattgtctggatgctacaagaaggttcatctctccgacgggaccattctcaaaaccaaggtaaataactacttgtcctctgtaaaccatgtgaggcctggtcttgctacggaattgtagggtttctaaacgaaatgcaggttttggtagggtgcgatggagtgtactcagtggttggtaagtggctaggcttcaaaaatcccgctacaactgcccggttagcaatccgagggctcacacattttccggaaggccatggatttgggaaaaggttcttccagttttatggagacggcgttcgttccggttttatcccatgtgaccacaacactgtctactggttcctaacccacacctccactgatataggtgaagatatgcaactttacctgatatctaatatctaactacaagcagcttcttgttcatatcatactactgtctttgactcttctccttgcgcttgttagatgaggagacaaattcggaaatcctcaaagagtttgtgctgaacaagatcaaagacttgcctgaaaacattaagaatgtggtggagaccactgatcttgatagcatggtgatgtctcaactgaagtaccgacctccatgggaactgctatggtcaaacatcacaaaagacaacgtgtgcgttgcaggagatgcacttcacccaatgactcctgatatcggacaaggaggttgctcagccatggaggatggagttatccttgctcgttgtctaggtgaagcgataaaggcaaagagtctgaaaggtgaaacagaagaaaatgaagaagagggttataagaggattgaagaaggtttgaagaagtatgcaggagaaaggaaatggagaagcattgatcttataacaacggcatatacagtaggattcatacagcagagcagagggaagtggatgaacatgttcagagacaggttcctgtcgtcttacctttctaggatgctgctgaaaaagtcccatttcgattgcggaagccttgtcccatgatgattctcaaacataagtcaaaagcttgtgattcttcttgtcatcaccaactgcagaacagttttcacctttggtttgcttcaaagactatctatctgtttagtgttatttcatataacaaactcagaattaataaagtaagtttgtgtagtgaacaagaagctcttttattttttacggcaatctaaagctctgatatcaacaagtgatgaatgagaaaagaaaatgactacttcaattgaaccatagcagaagttatgtttattacattataacgtatgcgagcctcgttcaaacaggaatggattcagaaagaaaaagaaaaggaacctgaaggctgaggagagatttgagtgttaggaaagagagaagaggcaaggtgacaaaagttcccactggatcgaatcgcatcagcggcaaccccggtggccggcgatggcgagcagcgatgaagacgcatgtgatcatctgggcggggctgggtttttaaggaatttctcctctatttgggcctttcttttttctattttaaggcccattttgtgactgcttatgggcccatttgaatacaggagaaaggtcgccactattgaccaagtcatggttgctgccacttgattgataaagaaaaacgaaaacaaacaattatgtgatttagatctgagtctgaccaatattgttatatctttaggaatttgtttgtttgtaataatttataagtcaatagtcaaatgaatggttatcgtagacttttccaattgccattttcttgtttataaaaatatccataatacacagacttaaaggggcctctgactccattatatctatcgaatcatatataccagtcgtagtatgacgcgttgaagaacagaaacgaaacgaaccaaaaagtcttctccggcaactttagatcctccagcagcaaggtactcactcttatgaattcctaacatatgtataattactatacaaccaaggtactaatttgcatgccttcttatgttccggtctaaccacagatcatttctcaatcccatcctttgcctcaacccaat

SEQ ID NO: 3524 - DNA, 3000 bp, Unknown
  misc_feature (1)..( 3000): cDNA_ID_1022149_gDNA_ID_1620649_Annot_ID_47693 3000 nt of promoter + ATG
taaacactttgatacataaatgttacaacttgtattatattgttcccttgttttaaggatgtcctaggttaaagagggaagctcggaacccttgtttcaactactctctctattttaatttaatggttttcttaactacaacttgatccgcatttgaagctttcttcacaattacaaaccataaatgaaaataatttaattttgggtagaaatatttattaacattaaaagtctttggaagaaagggaaaaacacatattgcaatcataaagtgtaaggaatacagaccaaggaactaaaaccaaaacaagaaacctaccgttatggtattaatgtacaaaacaagacattaaattaagccataacaaattgaaacagtagtagtccatatgacatcacatgaccacacaagccgccgggttctcgtcgctaaatgcagtggtgtagcggacctcggtggagctagcacgagccagctgcgacactccggggtcgtcgactcttcggacataaccggagggtgccttcttgtcgtagacaccggcagcgtaaggatgagcgaccacgtcgtagggcacatatggccagagctcgactttcttgccggtcctgtgagacattcgagccaccaccttgttgggatcgacgtagccgactacagtgactttatgggctttgggctccaacgtcacagaagacacacccttcatgccttcgacagaacgccgcactttccgctcgcaaccttcgcagtccattttcactttaatctccaccgtctatcctcatcaagcagtcgacacaaaacgacaaaattagcctactttaaaaatatctaagaagaatagtaaatgtccacaattgaaagactttaaccatatcatcatgactagtgagaaaaattaacgtggttggtttccccggaaattaatgattttatatagtattcctgacagcgagaagaatacaaatcccggtgtaaaatctaacagatggctgtatcaacttatatttcagattaaaagaatctattcggtcggcgttaggaaggaacattaactcaaaacaaaaactgcttcaaataaaatcccacttatatcatgtaacaatttggatatacttcttcagataaaaaaacacagagatattaaaaaagatctgaagtaagaaaggtaacacaaattagccagccaaaaccacaataataaacttgctaatggcagtctatttatggaactataatatacgagatctactaagtaacactcaaactttcctagtaaccatcgaagctagtttctactagactcattcatcataacttttcaacgaattattatgtttgtttttttgcaaaccaagatctaagttatcagctgaatctgctaagataagaaaaggaagagggaaagtacctgcaactgtttgcgctttttaatcttgtgaccatgagagcagtcaaacatttcagagacatgatcaagaacacccatttcttcttctttttattccagaaaaggaaaaacctgaagaacccaggagagttaagaactttctttaggaggaggaggaggagagagtagtagagcagagagtgaaatctgtaaaaaagaggggcaaaagggaaagtggaggtgtaaagaagtaaatgatgaattgggagaatatatataggcattattgtaataagtaatacagtatgtatctaattaagtgaatgatggatgggtcacctttcttttctggtcccagcagtttcctagtcgccgtctcgattcttctcttcttgctaacggtttcctaatttctagtttttttttttcggtttcttttttggattggcttaaaacatttcttcattccaattccatgaatgaaaaaaaaaagagttgtaatttgtaagaaaaaaataaaattacaatggataataaaattttctgttttgatgatgactgagactgatcttgggacaagagtcgtgcgttagattttctgctgctttacttttttttttgtttaataaataataataaaaaaaatatattcttggtgcatgggaagaaagtaaagagaggagttattgtttttggataatcgatgatgactcgcaaagtcacaccgacgtaccgaccttgatgaccagatttgtttattttatgaagcccactccaaaatttggtctaggctttctaatggatttttctgaggcccacttacttaccattttatatttttggcgattttttgacaaaaatcaaccgagttttaattccatttagatttgcaagacttgcaagtagaaccatctggatatctggacccccatgggattcaagttcatatatccgaaaatcccatcatcaattatagtcttaagcgatgaagatacaaaggtttgtggaaattagtaatgagtgagtaatgactaatgacacaatccgaattcagcagtaaataaagtgtgcgtggaagaagaagaaaattaacgatatatgcgtgtatgtattgtttgcaaataaaatatgcaaattttcagtgttgaagcggcgaaaccgagaaaagttttacaaataatttaacaaatgttagtactgtatttcacaaattgaatttgagaatattaaacgaaaaaacgtttttgcttgagagagaggcgaatctgattcttgtgagagcttccaacaaagtctgcaggctcatcctgcggatcccttcgttcccaatttctcttaggcaggtgagaaatatttaatttccccatacttactttgagatttgatatttccagttgcgtctgaaaatcgattgacctactttgtttgtgtgtgtgtgttcacgtatttaccggatttggggttcctctgtccgtacgcattttcccacaaagtttgttccttttttctttctaatctcgtgtaggtatcccttcattggcgagatccttgttttcttcgttggggaacagattgcccaaactgaagtctctctctctctgttatg

SEQ ID NO: 3525 - DNA, 3000 bp, Unknown
  misc_feature (1)..( 3000): cDNA_ID_3410055_gDNA_ID_1620649_Annot_ID_47694 3000 nt of promoter + ATG
ttgatggaccaaccaaatatgctcaaagccaagagtaaagagagcggtgaaatctgcatcaatgatttcactaccacctgaggtttgaaaacaattggaaccatgaataatgcagtaggaaaagctcaagagattaaaggggaaagagaatagaagagaagctcacgttcatcaagttttcggtttggttcgttgctatgagaagaaggattatataaagaacctgtagtcatttgactatttgagaaactctgtgtttacaatatctcccaatagaaatacattgaaaaaaagttaagtagctcagatatcaatgatccaattacctcgcaggaaacacagcaataacccatgaacatccggtttccataatagagtctaaagagccagctcgtgctatctttcacatccttatggctggtcttccctgataggaaggtactgcgaatcaagtattaaattcctggtttgctatgtacaagaacaatacatctaagaagttgaatgaagattttatgtagcaacaaagagtacctgtacatttgcagccagtgactagcgatatctaaagccagcaatgacaggaaaaccaagctaggcctgtttgtaattgtgaaagtccaagactacatgttaaacaaagattacgtagaaaaccagataagtccatgaaacggagatgtcagtgtaaagaagtagagaacactgacacctgtatatctgggagagaatcacgagaagacaggctgtgctgactctgtaaccatgcgcagaccccaaaatatatgacaaaaatgttaaatgagattaaaagaatgagcaagttgaaactcgggaatatgtagcggaagattcacctatctgtaaccatatccaaaacagctccaaatgtagagactgaaaggaaaagagttgtgtgttacgttcaatcgtttctgataatgtagaacaagaataaactgtgtatgggactaaaaatattgatcaatgagacaatgacatgaaatgtcatatttaatcaatgtcaggatcatagaggaagcataagtaatgagttagttgaagctaagaaaagagatggggagaatgaaaagagcaccttggttaaatttacgagcgcaccatccatccacagcatcacaacaaaaactggaaacaagattgggtaaagagtgactaacatatgaaagaagaagcaccaaacacacaagatcaaaaaaggagaagaacatgatgttggtaccacaaggataaagtcacctgaaaaagtacaagagggagaagagtgtcttgttggagaagcacacagagaaggcaatgcagttcaagagaactctcatgtaccctgccaattttgcatgtaacaacactaatctcatatggtttaaaaaaaatgaaatttttaaagacagaagaaaggaagtagcaaaaaaccgaccaacgatattgggaatgtagaggtagactgacaacgtcgccggtctctgtttagccataacagagagagagagacttcagtttgggcaatctgttccccaacgaagaaaacaaggatctcgccaatgaagggatacctacacgagattagaaagaaaaaaggaacaaactttgtgggaaaatgcgtacggacagaggaaccccaaatccggtaaatacgtgaacacacacacacaaacaaagtaggtcaatcgattttcagacgcaactggaaatatcaaatctcaaagtaagtatggggaaattaaatatttctcacctgcctaagagaaattgggaacgaagggatccgcaggatgagcctgcagactttgttggaagctctcacaagaatcagattcgcctctctctcaagcaaaaacgttttttcgtttaatattctcaaattcaatttgtgaaatacagtactaacatttgttaaattatttgtaaaacttttctcggtttcgccgcttcaacactgaaaatttgcatattttatttgcaaacaatacatacacgcatatatcgttaattttcttcttcttccacgcacactttatttactgctgaattcggattgtgtcattagtcattactcactcattactaatttccacaaacctttgtatcttcatcgcttaagactataattgatgatgggattttcggatatatgaacttgaatcccatgggggtccagatatccagatggttctacttgcaagtcttgcaaatctaaatggaattaaaactcggttgatttttgtcaaaaaatcgccaaaaatataaaatggtaagtaagtgggcctcagaaaaatccattagaaagcctagaccaaattttggagtgggcttcataaaataaacaaatctggtcatcaaggtcggtacgtcggtgtgactttgcgagtcatcatcgattatccaaaaacaataactcctctctttactttcttcccatgcaccaagaatatattttttttattattatttattaaacaaaaaaaaaagtaaagcagcagaaaatctaacgcacgactcttgtcccaagatcagtctcagtcatcatcaaaacagaaaattttattatccattgtaattttatttttttcttacaaattacaactcttttttttttcattcatggaattggaatgaagaaatgttttaagccaatccaaaaaagaaaccgaaaaaaaaaaactagaaattaggaaaccgttagcaagaagagaagaatcgagacggcgactaggaaactgctgggaccagaaaagaaaggtgacccatccatcattcacttaattagatacatactgtattacttattacaataatgcctatatatattctcccaattcatcatttacttctttacacctccactttcccttttgcccctcttttttacagatttcactctctgctctactactctctcctcctcctcctcctaaagaaagttcttaactctcctgggttcttcaggtttttccttttctggaataaaaagaagaagaa

SEQ ID NO: 3526 - DNA, 3000 bp, Unknown
  misc_feature (1)..( 3000): cDNA_ID_1821010_gDNA_ID_1620649_Annot_ID_47696 3000 nt of promoter + ATG
tgtgcaagaaactaccttctgatgcatctgattatgttatggaagctgtacctttgctgacaaacctacttcagtatcatgattcgaaggtaattgacctgctttctgttataatatggtactaatatctagttccgctcttaccccagtctcctccataatctgttcgtatgatggtaggttttggaatatgcttctatctgtctgactcgaattgctgaagcatttgcaccgtatcccgagaaattagatgaattatgtaaccatggcctggtgacgcaagctgcgtctcttatttccacgagcaattcaggaggtgggcaagcatctcttagtgtgtcaacatacacggtaagcgtaaaatctttattgtgttttatttatccttatacacaagatgacattttcaccatattgtgcacaggggttaatccgattactttctacctgtgcgagcgggtcacctcttggattcaggacattacttcttcttggtattagtagcattcttaaggatattctgttgggttctggggtctctgctaatgcatctgtatccccagcactgagccggcctgcagatcaggtaattaccttttctgtttaatacctgactgaaataagaatagcttaaatttagggtacattctctatttcgggcatagtttcctacttgtttttgtattaccaagttttacttaggtgtttgtatagtgtattgatcatagtctatatacaggtcttataatctgtacttatgttggagtactcttatgcctgttctgctcttatgttagatctaggttttttatctcatggtctctaattctggaatctataaattttgctttatatattagatttatgagatagtcaacctagcgaatgagctcctccctccattgccagaaggagttatctctcttcctactagcacaaacgctcttgtgaaaggttcatgccaaaagaaatctagtccaagtacttcaggaaaacaagaagatattctaaaaatttcaccaagagaaaaattacttggtgatcaacctgaacttctgcagcagtttggattggatcttcttccagttttagtgcaggtaatttttctctgcgttggctacaagataatgctcatactacctgctgttttgtctaattattcttgttttcttttgcaacagatctatggttctagtgtcaatggtacgattcgccataaatgtctctcagtcattggaaagttgatgtatttcagcagttcagaaatgattcaatctctaattggtgacacaaatatttcgaggtatgctgtttacgatataaattaagtttgacacgacagtgtgtgcaacttcttacatttttttcttcttatgtagcttcttggctggtgtcttggcatggaaagacccacaggtcttggttcctgctctacaagttgcagagattttgatggaaaagcttcctgaaacattctcgaaagtgtttgtgagggaaggggtagtccatgctgtagatcaacttgtcttggttggtaaaccatcccatgcctcacctactgataaggacaatgactgtgtacccggatctgcacgatctaggcgttatagacggcgcagtagtaatgccaattccgatggaaaccagtcggaagagcctaagaatcctgcgtcccttaccataggggcaaaccataattcccttgatactcctacagctagcttcatgctaagggaaacagttagttcctgcgccaaagcattcaaagacaagtacttcccgtctgatggtggggatgttgatgttggagttacagatgatcttttacatctgaagaatctttgcacgaagctaactgctggtatagatgatcataaagtgaaaggaaagggaaaatctaaagcctctgggccattccttggcgatttctctgctagcaaggaagagtacttgattggtgtcatttctgagatacttggcgagataagtaaaggggatggtgtctcaacttttgagtttattggcagtggtgtggttgcagcattgcttaactatttttcttgtggatacttttccaaagagaagatctccgaacttaatttgcccaaacttcgccaggagggactcagaaggtttaaagcttttctagaagtcgctcttccttttgatggtaatgagggaaaggtccctcctatgacagttttgattcagaaacttcaaaatgctttatcgtcactggagcgctttcctgttgtccttagccatccctcaaggtcactaagtggaagtgctcggctctcctcgggtttgagtgctttggcacatcctttaaagttgcgattatgccgagcatctggagagaaaacactacgtgattactcctccaatattgtacttatagatccattggcaagcttagcagcagtggaggaatttctgtggccccgagttcaacggagtgaatctgctctgaagccggcagcgcctattggcaatacagagccaggcacgttacctagcggtgctggtgtttcatcaccatcttcgtcaactccagcttcaaccactcgtcgtcattcttctagatctcgatcggcaattaacatcggtgatacttcaaagaaagatcctgtgcatgagaaaggtaccagctcatcgaaaggaaaaggtaaaggcgttatgaaaccggctcaggcggataaggggcctcaaacaaggagcaatgctcaaaagagagctgttcttgacaaagatactcaaatgaaaccagctagcggagactccagttctgaggcatgttacagtgctaagtttttgataacataaatgttttacttcgttacttcgttacttcgttacatcatgatcttgtggtgtgatttacttactcaacacaatcttacttgtatgccttgcaggatgaggaattggaaatatccccagtcgacattgatgatgccttggtgattgaagaggatgacatttctgatgatgaagatg

SEQ ID NO: 3527 - DNA, 3000 bp, Unknown
  misc_feature (1)..( 3000): cDNA_ID_1821006_gDNA_ID_1620649_Annot_ID_47697 3000 nt of promoter + ATG
tttttagaatacgatcgacaacactaatcatatacgtatgtagtaattcgtatgtcaggagaatagttgaagaatagaacacataacagtatataggagagaataattaaactatagtatctactgtgtactgtccatgtatgctaaacaaaaaaagttgaacttaattgtgaaatttggtaagttaggtggaaaatgtgagaagaaacgaaaaagaataatggtttattgaaaaagatgaaaaaaccgaaaaagagagagagagagagagagagtagttgaatttcaatttgtttaatctattggtacaaaatcactcacctcatgcatgatgatggccctcttctagaaggttaggttcttagctaaaggccaagattcttcaattcatcaacaaaagtttacgtccatttacatctgaatcaaaattaaaccccaatcagtcagtttttcacattcactatttatacccaattaacttatttactgctctttcttttttcttgcaactaaattgtaagagacaaattcgtaatattgttttatgaaaaaccaaatgcagcaacactacatgcaaaacgttttttaacatcatgggagaataatagttctccaggtgaattattctctctgttgtttttttttgtttttttgttttaggaataatatgttattacttgttagtagtactactaatgggattgtaaatgacgtggaggaaatagcgatgtgctataatataaaagcaaaacttgtgtcacaaatataatatagaagcgaaatcacaatgtactgattaatttggcattttctttaagtaaatatactgatattaaaaaagagtaggataattatattatttaggttgctgccaaaaacaaaaaaaaactatatattatttaggtccgtatgcggttgggacgtgggatttggttcaccttccactttattattattgttttaataatggattcatttgtttgatatttaatttcaactttgcgtattcagatacaagaattaagatcaccttgatctcaaggtaaagattagattttattgacgaccaaagaataagttaagttttccataatagttgagttgtgataaactgatagagtctttaatttcagaagagtaagatgctactatgatctgtttcccttacgagacgtgaaaataaggtggatggttggtgacggtggatgattaattatacacataacttgtcacaccacaccatttgtaaagagtggaatataatagggatagagaggtccatatccaccaatgtatataaatgtgaaggtatttaattgtgcgtctacatttttatttcttaagttgagattttttcatttctttgccgagccttttcttgtttgttacatttttctttcttcttgttaattggtaaatacaaaccactatcgtggaaaaagagatataacaatacgataagccaaattatcaaaagaaaacaaagataagccaaattaaccgaaccaactatgacaaagtttctaagagaatgatcttgagtttaacgaataaactagattcgaaattagattccccgcgcaatcttatactataatttgtgttggaaaatcctttttctttgatatttaatataaagacgaaacttgaggaagaagaaacaaaaatatatatggtctttcacgacatgtaacaaatttttttgaagcaaatacatatttccgctggcagatagtttcaatgacaaaaaaacagtcataaggaacgaacgcaagcttcgggtatgcagattatatgattgatattaattaaagttttttgtttgaagtggaatgaaattgtaactttttgataccaaaaaaacaaaaaaattgcaaacgagactcttacgacagtaaaatgaaaaagaacaattactcgttcatgagtgggtgtggccttggtaaatcataattcataatagtgatcactagtgtcgtccctggttttcattaagtatggaattggaatcaaattagtgtcccagactataaattccaaccaaacaaaataaagaggtaattgcattttccattattttttgtaatataaatgatctatgtaatctacttaacaaagatgtcttgttttagaaaaaaagtagtagaagaagaaaagacaaccaaatctctaccgaaccacatgaaaaaccaaatctctaccttaaattgtttatatatatattaacgtatatacatgtcattgagtagtttatatatacaacgaaagtgaagcgctctacaactaatgggctttaaaatctctatgaaagcctttgcagagtacgatctataacagatggacgggcccggcctttatacaacaatatgttttattccaattacaaagaggccctcaagttttgtgtgatatatttttccaaatgtgaaaaaacttaaaaacgcaggaaggaccgggtatgatacgaaacgacatcgtatgagatgggttcgatggagtgaaggaaacacacgtagcccgatcgccgtgtcagtcacttgttgtggtaaggaaagaacaaaacgctaccgtattcgtccccggtcgcctctctctctctctcttttctttttttatataatatttatatgtcttcttctattttattcatcagtcgacggactctctcgatttagggttttcttcttctaatctctcttttcatcgtctctgcccaaattggatcccctccttccttcttcttccatctctcttctcaatccctttgttgatttccaattcgtttgattcgcatcatgctctctcaatagctctctgggttcgatttgagaggttcttcttctctggcgttttcgactaattccggtggctaattagggtttcgtgcgagtttcaattggatccctggagtgaattgatctgagtgagatgcgagcgagtgtccgatcagaatctttctgatcgagcgaatcggaaactcggggtttcttcctttgtatg

SEQ ID NO: 3528 - DNA, 3000 bp, Unknown
  misc_feature (1)..( 3000): cDNA_ID_3074301_gDNA_ID_1620649_Annot_ID_47699 3000 nt of promoter + ATG
ctttgagaattctcttatcagactttcttcgaagcccgtctcaatgtcttcgtgaatttttcttttaatactggtaaaagaaactatactaatattttaatgcacatgaagataataatactcctttggacggtataatacctgtatacgtgactaatcaacgaattaaatttgagcattgtggtggcgagatcttggatcatcttcgcttggccgcttgggcggtggtcgtcggcatcgtcactaattaattattgtgattaagaaaaaatgctaaattgagtttcgtcgtcttctgcttctgcttaagcttcttcatcatttagctccagaggcggagctttcttctctctctgtggacgaccatggcggcggacgacggcgaccccactaaattcgctgcaatctacgactcatcctctccgtcacaccctcttctctctaaaccctccacgtccgctctcgattctccgcgtcgaagtgatcccgaatccgacccaactcagtttcttcagatctcctacaattttggcccaagaactttcaaggacatccctttcctacttctcttcgatcttctcgtactctccacctttggttttggaatcttctccatttttcatagaaataacgattacgggaactcctcttccttcacctacgatttcacctctagctcctgcgtcaaaaattctacctttacgaaaatttcggatgggtactactgggcttcttcgagtgtcatgtacggcatggtttcttcgtctgatccagtctttgagaaggatttgatctggacacttgttgtaacgcttattttaagcgtgcccttctgttttagcgtcctgcttttgctcaaacactacactaagcagattgtttatgcttgtttacctctctttgtcctttttcccatctttttcaatgtctattggtttgtcgcctgtactcttagctcttcttgtagcgatgccctccctctagcttacagaatacttgtcctagtctttgttttcttgatcatcgggatcattgtctggatcatagtagctaattggcacagaattgatcttactatccaaatcatcagtgttgcatctgatgccttgtccaaaaatttgaaactttttgttgtgctgccgctgctgactctcgggttagtggtgtactatgcgccgattgtggtgttcttggtgtttgcaaggtttaatgggaagtttgtgccgcgagagttggatggtcagtacttttgtgagtggaaagaagattcttgggttcctgcgtattacgctcttgccattttaacgatgatctggtctcttgctgtaatggtggaaatgcaagtgtatgtgataagtggagctattgctcagtggtatttctccaaggaagactcaatccctaaaaaatgcatccggagttctttgaggtgactcgctgccacatctttctctattttattcttgttatcaatgaatttgctgtgcagtttctcttacaatcaatggtgctcttagttctaatatatgttttgtgtgatcgcgggagtttttgctttgagttctcttagttttgtttcctcataaaatataatctatggtcattcgaagtatcccttgcttggcttcgttctggagtattcagtgattctaggtcatggtattcatagtcttggccttatagattggatattgtattggaatccatcatctgaacttgtttggtactttaaatgtgaaaagagacaacagacagtggtatttttgaaaggagattatagctttgaggatccaaatttgcattagtcttcaaatctgttgttggtttatgtcaaagcatgtgtgaatcttattattttttgtatctgtctcttcaggaatgcatttggtcaatcctttggtacgatatgtgtatcaggacttctcatatgcattgttcgtgtggtccgggcaattgtggacaatgcaagagaagagaacacacaaggaatagtgaacatggttctccgttgctgtgcaaacgccttacttggtgcccttgactatctcaacaagttcaccatcaactttgctgcaataacaggggaagcgtattgcacctctgcgaaaatgacttacgagctgttaagacgcaacctactgtcagctgtatttgtcgaaacggtttccaccagaatcctaaccggaatagtctttgtcctgtcagccgcatatgcagtcgcggtaagtattatcttctgcttgtctcaccaaccaagcatttaataattgccataatgactaattccggggtttgatgatgcgcaaaagcagacatgggctgttctgagaggagtgagcaacctgggtatagattcgtacgtggtggctgtactggcgtgggtgttactgattgtgatattggctttctttgtacatgttcttgacgatgtgattgacacaatctatgtctgttacgcgattgatagagacaaaggggatgtatgtaagcaggaagttcacgaggtttatgttcacttgcctatcagcagaagcacaagatcttctctcatcccaaatgctcttaatgcatagcagaagatgatccaacgtctctgcttgttgtatctttttttgtttgttagcaccgttgtaaattcctctctggtgaactgtggtttgtcttcttggggtttatattgatgttttgtagagttatggggtaacaatgttgaataaaagaaagactttagttataggaattactgtaatgtggtctgtgtttcttttattcattaataaatcaactttgttttgctttttatcaaaaacaaccattggggctaaattgaaataaacgtaaaacattagggtctaaaaggagaaagtaaaaaagtaaaggggatatttaaagaagaacaatgttattattatcggtctaaactaaaatctaaatcttgccttcctgactttctctctacgacagaatttttgaagcttctctctgcttatcgacacgatg

SEQ ID NO: 3529 - DNA, 2053 bp, Unknown
  misc_feature (1)..( 2053): cDNA_ID_1820987_gDNA_ID_1620649_Annot_ID_163413 3000 nt of promoter + ATG
ttcattttctatagacattgaaatgaatccatgttgacacattttcttaatagcagatgatccatcagcaatagatttcttatccactatgttttgtttcaccttttggttctgtgcctttctgctatcatttgtttgagaatatttgcatgtcaagaaatgggagtatgacttgcttgatgaatggtgcaggtttcggaggttatacatatttgttagagccactttggtgggtaggcttggtaacaagtgagttcaaaaaaaccatcttttattttccatatgactcttcccatcttaaaaaccatcgttctaaatgtgagattttgtaactcagtgacttttggagaaattgctaactttgtggcttacgtttatgcacctgctgtactagtcactcctcttggcgcattaagtataatcatcaggtttgtactgtattggcatctttttgagtggtatttcaccttttctctgactaaccttttcatcttttgccctgattgctccctcctagtgctgttttggcacatttcttgttagacgaaaaacttaggaaaatgggagtttggggatgtgtttgttgcattgtgggctcagttatgatcgtcatacacgcacctcaggagcagactcccaattctgtagaagaaatctggaaactagcaatgcaaccaggttttgctttttctacctctctctctctctgtgtttatgttactgatatagacaataacgtatatcccttctcttttttgtgtgagacagcttttctaatttacgtagccatatcaatgtcgatagtccttgctttgattctctactgtgaacctctctgcggccaaaccaacattcttgtgtatatcggaatttgttcattgatgggttctctcacagtaagcatctcggaatttagtgctgagctctatatcttttcccattttttgttctctaaaggttttaatttcaaataggttatgagcatcaaggctgtagggattgccataaagttaacatttgaagggataaaccagatctggtatccagagacttggttttttgccatggttgcagcaatctgtgttgttatgcaaatgatttacctcaacaaggtaagaagaacctgtgcatgtgtctgtgtgatgtagtgttgagcacactttggccaatggttaatagtagtcatatgttttgttttgtcaggcgctggacacattcaacgcagcaattgtttctccaatctattatgtgatgttcacaacactcacaattgtcgctagtgcaatcatgttcaaggtagagagatttcaacaaacattaaagagtaatgatcctcgtgtttcaagattgtcaaatgaatcacctttttcttaacaggactggaatgggcaaaacacagacagcatagcctctgagatttgtggattcatcacagtgcttacaggaacggttatactccattccacgagagaagaggaacaagcttcgccacgacgaatgagatggcaggattcagggaagagctttgacgaagaacatttgacaagtttgtacagtcctgaatattaggaaggtaacaaagatttaaaccttgtgctgaacggaaggatgttgggatccgaatcagaagatcatctaattaatctcttagtggggaaaagaatgtaaactagctttctgtatatacttgatagttttgtaacagtcttttgtatacaaatttgtccactgtttgttcatattcatttctttttgagctcttaggacagatttgttaccatatatagatcatataacattgactattattattttgatccaacaacactgtttccttctccttgtaggtgaaggaatggaaaatatactaaataataaaaccctattgatatgatgaattcataaccgtccgatcaaaacccaaaaagatctaactataaaaaggaaatcgagattcggtgagccattcattgtttttgattcacacgaagagaagagaagaagaagaagaagaagcagaagaagagaagaagagaagaagaatccaatcatg

SEQ ID NO: 3530 - DNA, 3000 bp, Unknown; identical to SEQ ID NO: 3528
  misc_feature (1)..( 3000): cDNA_ID_3074301_gDNA_ID_1620649_Annot_ID_163404 3000 nt of promoter + ATG

SEQ ID NO: 3531 - DNA, 3000 bp, Unknown; identical to SEQ ID NO: 3527
  misc_feature (1)..( 3000): cDNA_ID_3071309_gDNA_ID_1620649_Annot_ID_163402 3000 nt of promoter + ATG

SEQ ID NO: 3532 - DNA, 3000 bp, Unknown; identical to SEQ ID NO: 3525
  misc_feature (1)..( 3000): cDNA_ID_3410055_gDNA_ID_1620649_Annot_ID_163400 3000 nt of promoter + ATG

SEQ ID NO: 3533 - DNA, 3000 bp, Unknown; identical to SEQ ID NO: 3524
  misc_feature (1)..( 3000): cDNA_ID_3071317_gDNA_ID_1620649_Annot_ID_163399 3000 nt of promoter + ATG

SEQ ID NO: 3534 - DNA, 3000 bp, Unknown; identical to SEQ ID NO: 3523
  misc_feature (1)..( 3000): cDNA_ID_2156638_gDNA_ID_1620649_Annot_ID_163397 3000 nt of promoter + ATG

SEQ ID NO: 3535 - DNA, 3000 bp, Unknown; identical to SEQ ID NO: 3522
  misc_feature (1)..( 3000): cDNA_ID_1821026_gDNA_ID_1620649_Annot_ID_163395 3000 nt of promoter + ATG

SEQ ID NO: 3536 - DNA, 3000 bp, Unknown; identical to SEQ ID NO: 3521
  misc_feature (1)..( 3000): cDNA_ID_3071426_gDNA_ID_1620649_Annot_ID_163394 3000 nt of promoter + ATG

SEQ ID NO: 3537 - DNA, 3000 bp, Unknown; identical to SEQ ID NO: 3520
  misc_feature (1)..( 3000): cDNA_ID_1821038_gDNA_ID_1620649_Annot_ID_163391 3000 nt of promoter + ATG

SEQ ID NO: 3538 - DNA, 3000 bp, Unknown
  misc_feature (1)..( 3000): cDNA_ID_2158388_gDNA_ID_1620649_Annot_ID_163390 3000 nt of promoter + ATG
ctggaggaagaaagacggagagcttctccgtgccatggaagcagacagacatgttgtcaattgtatagagtctcatcctcacatgccactgatgtgtagcagtggaatagatactgatatcaaaatatggactcctggaggaaccgagaaacctctgtcgccaggaaatgcgaaacaggtaatgccacatctattgctaacctcgtttgcttcttttatttttggtgtttgaagactcggaggatatgctttagttaacaagaatgtaactttggatacaatacatgtgactggaggctgaatttggttttggaaggcaaactaaatgtttgtatgtttgcttcttggaaacaggcttcgggttttggtaacccacgatggttcgacggatattatgtggatgacgatgatgattctgacgatgaatctagtgaagagagttcagatgatgatgatagttcggaagaggaggagaatggtgaagttgatgttgagattacgaaggatgatgataatgatcatggggatgatgatgatgatgatgatgaggatgatgatggggatggggatggggatgagggatgagatttgtatagacatgtatttatctaaacacaaaataaaacagcatatggtaacagtaccaaagaaaggattagttatagtttagttagatgtcatcatcgtggatacaaaatactattcaatagacattttcattcttaaccaaatggatcacatacataatcagcttctgtaatgtcagattgtcagtttcttcaatgaactagaatttccaacaatccaaattccaaagtaatttaaaatgtaaaagatgtcattggtaaaatgggtttataatccaggaaactttgagcccaaaaaaggcccatagatcatcgaaggcctttgatatctgcgacggcgagatcagcttcgtcttcctccaacgctcgatttagggaggatggtggtttctccggggctgctctcaactgtttcaggtcactattcgctccggttgcttcttctatatactttcccactgctttttgatattgtccttagtaatcatctagcttcgattttggttcataggcgtaatccgattggctccgtcacaccggattctaagacgcgatgggttcggacccatttgcttcaagttttctggggatttggtaatttacctttctttctattgcggcttaacagcttaagaagcttttcacttaagctctgtttgagtgtgtagagtatcaatgggagagtcagtcataaacatgtgcgtggaagtggcacggtgggatctgtaggttccgctcgtgaaagttggagctctcataagaagcttcccgaagaagagcccttatggctgagtcttcttagagacatggtctggtatgaaattctcccactgagtctagcttttaatatatatatctgctggaagagtctgaatgttgcattatattgaattgcatttttcttgtgagaaggagcacgagatctctcttgtctttcatggctgagcaaccaagtcagctgaaatacatagagtggccaacttttgcaagcacggtatgtcttgttgttgttgttacaacatatgagaaagaaagagatagtttgtgggtgtaactttgtttttttttgttttggtaacaaacagctaaagactgctacactgagtctgtgtctggtagctgtattcattgttgcgctatcatcggtggatgctgctctttgttacatattggcgttgatcttgaggaaagccccatgaggaaggcaactccattatcatttgtctcttgtagccttattgataggtgaatgtttttgatgtagatagaatgcaggaggatgtactcaaaatcaatgtgtttctaaaagttgaattgaaatgaaacctctctggtctagtatctctcacacattaagggaaatccaatcatatatgtcccaagcaaatcacaccataaataataaggaaggattcaacatgttgttggtttacaagtaagagaataagatgatgctaggtgctacttgagaacaacagcagcattgcgaatggagagatactggtggacttggtcggaagaaagtgatctcacagtctggaaaacatgagcattagcatagcggaggtttgttcttgggtccacataaggtgcctgcgagggattagagaagctcattgagttttgttgtttttgggtagtgaataaatttgtagaaaagaatcgatcactcaaaaacagaataaaacctcatatccagtaatatcgcaaagtctcttgcatggttgagtggaaggaggcgattcaatgttaacatctgcgaggcacaaagaagatttgatttttgattcaaacagagtcaaaaatccattcaaaatcagaaatcagagagagagaaaagagttacaagtggggaggtcgggaggaagatctgggaagttctcagcttgaagaatctgcttgaggtgtttccaccttctgctgcttgattgtgcttttgggtacttttcgtaggcttgcttcttcttaaagctcaatcgcgacgccaccactatatctgcctccatcaactctctctccatctctctctctctctctggaaaaaaaaaccttattaattccgacgaggagaacgacgacgacgaaggcttctttcttatacggtgtcctcttaaaaatcaaaccggtccggtacggtagtggaatgaacaatttagtaaaccgatagcagtgtttacattggaaaccgaattgaatgaagtgaagctgtttctttctagatcccccaaagcgagttcatcatcttcttcgcctggattcgatcaagactagcactttcatcagatttgattacaatctctcttatcttccaagttataatcataatatccgagcaatttgggatctgggtctttcctctacattcaatttcttaataaagctggcctctttcttccgagatggttcttgagcg

SEQ ID NO: 3539 - DNA, 3000 bp, Unknown; identical to SEQ ID NO: 3517
  misc_feature (1)..( 3000): cDNA_ID_3439905_gDNA_ID_1620649_Annot_ID_163386 3000 nt of promoter + ATG

SEQ ID NO: 3540 - DNA, 3000 bp, Unknown
  misc_feature (1)..( 3000): cDNA_ID_1820996_gDNA_ID_1620649_Annot_ID_47701 3000 nt of promoter + ATG
actccggatgcattttttagggattgagtcttccttggagaaataccactgagcaatagctccacttatcacatacacttgcatttccaccattacagcaagagaccagatcatcgttaaaatggcaagagcgtaatacgcaggaacccaagaatcttctttccactcacaaaagtactgaccatccaactctcgcggcacaaacttcccattaaaccttgcaaacaccaagaacaccacaatcggcgcatagtacaccactaacccgagagtcagcagcggcagcacaacaaaaagtttcaaatttttggacaaggcatcagatgcaacactgatgatttggatagtaagatcaattctgtgccaattagctactatgatccagacaatgatcccgatgatcaagaaaacaaagactaggacaagtattctgtaagctagagggagggcatcgctacaagaagagctaagagtacaggcgacaaaccaatagacattgaaaaagatgggaaaaaggacaaagagaggtaaacaagcataaacaatctgcttagtgtagtgtttgagcaaaagcaggacgctaaaacagaagggcacgcttaaaataagcgttacaacaagtgtccagatcaaatccttctcaaagactggatcagacgaagaaaccatgccgtacatgacactcgaagaagcccagtagtacccatccgaaattttcgtaaaggtagaatttttgacgcaggagctagaggtgaaatcgtaggtgaaggaagaggagttcccgtaatcgttatttctatgaaaaatggagaagattccaaaaccaaaggtggagagtacgagaagatcgaagagaagtaggaaagggatgtccttgaaagttcttgggccaaaattgtaggagatctgaagaaactgagttgggtcggattcgggatcacttcgacgcggagaatcgagagcggacgtggagggtttagagagaagagggtgtgacggagaggatgagtcgtagattgcagcgaatttagtggggtcgccgtcgtccgccgccatggtcgtccacagagagagaagaaagctccgcctctggagctaaatgatgaagaagcttaagcagaagcagaagacgacgaaactcaatttagcattttttcttaatcacaataattaattagtgacgatgccgacgaccaccgcccaagcggccaagcgaagatgatccaagatctcgccaccacaatgctcaaatttaattcgttgattagtcacgtatacaggtattataccgtccaaaggagtattattatcttcatgtgcattaaaatattagtatagtttcttttaccagtattaaaagaaaaattcacgaagacattgagacgggcttcgaagaaagtctgataagagaattctcaaagcccaactagccgtattaaagcccaaatcatcgcatgcaagagtaatagtcctaactcctaaggagcgtgtgactgcatcacaagggcagatacgtttgttaacttgggcccaattgtcacttgtaaagctaaatctttgaaatcttttgagagtttaaactttaaagatatgaaatttagctaaattcgtacaaatttatatccaaatgttgacaacaacgtaatctaaaaatgcatagacgacaatattggtttccctttgtatcaactaacaaaattaatttttaaaattttggtggttctttagttatggtaattggttccttttgtattgttttccaaatatttgagttctataaaataagaaattaaaaacattagtacaaaatcttgtaaatttaaatttcgaatcaaactaaatatgttaattcaaaatctctaacttttaattatatattttataataaagtaaaaaactatattcaatatttttattatcagatatatccatctcctatagaaaacaaatctggatcgtagcgtgagtttgcattttgcaggcgtgagagttttttgcacgcacacacacacaaacacaaaacaagcaaatggtaagatttaggtaagaaacttgtaaccaaagcatgcatcaacccgtggtactctaataggctagtatctatataaaagcacaacttcacatgacaaaaaaaaccacttcgcatataacaacatcatcacgtgaactcactcaataggttcagtgtttctgacatattgttccctctctgaatgaaactctcccaaatagagaatggcctaaccacctatccaaccgcatcaaggcacttggtttcatccccttgatttctctctttttttcttttcctatcgcaggattttgtgttcttgttttgaatatgaaatgttcgtcgatgtgttgtttgatcctcttggccctttctctcctcaccgccttcactcttgcttcttcgtcaaatggtacacacaagtatattatagcataccatagtatataacatacatgtatacagaattttagcttgatatatgatgtttttactcttcaggtatagatggacctttctacgactctactgcctacacagaggtttttaaagctttgagctattaattcaatttcacaagatatgtaattgcgcatagatagaaagtatatatacattatgtggtatgtgaaatgcaacagtgtagagccgaagcagagaagccactatacaatggaggaatgctgaaggaccaaaagccttccgtcccaggcaaagactctctcacaggcattggtgctcattacacaccaacttacatattgcacaatctcacacagaacaccatctattgcttctccagttaagcatttcatgctttcatctctagaatgttatatattcgttaacagatgaaatgaatgtgatgatctgactgatggacacagtatgggtgaagatagaggctggtgctgcatcagctcatgtaagagcaaggctgagagcagacaacgccacattaaactgcgtcggttctgtaactgccaaac

SEQ ID NO: 3541 - DNA, 3000 bp, Unknown
  misc_feature (1)..( 3000): cDNA_ID_3410059_gDNA_ID_1620649_Annot_ID_47702 3000 nt of promoter + ATG
cgagtttactctcaacggcacaggaggactagatttttacgacgttagcctcgtcgacggttacaatctcccgatgctaatcttgcccaagaaaatcgtcattggaggatgcggagccaccgggtgtctcgtggacttgaacggcgcgtgtcccagagacctaaagctggtgacgcgtgggaatgggaacggtgttgcttgccgtagcgcgtgcgaggcattcggagacccaaggtattgctgcagcgatgcgtacgccacgccggacacgtgtcagccttcggtttactcgctcttctttaagcatgcgtgcccacgagcatacagctacgcctatgacgataagacgagcacttacacttgcgccaccggagccgattacttcatcatcttctgtccgccaccgtatacaaggtgagatattgaccgttttgcccctctgttcgctttggaatatgctagggatgtttcttgttatttagtatatgagcaggaatctaatctgagccacactgttgattattatggactttagctaacgtagttactcgttatgatttgtagtcttttagatcatatgatcatcttctataagcatttgattaagattgtagtgtctactagaagcatttggtatgattataaatgattgtaaaggtctactataagcatttggtatgagaaagtagtgttgattaaaagggttttgttttaatggttggaaaagcgggtagcaacagttggattgagttcgacaaatatagattgaagtgctccattgttataaatgtacttaggtgtaatgagcttagtaagttgttgactatgagttttgttttgcagcgagaagcttttaggatcgaggaaagatggtgcaacactgccactagtaaacaagagcatgattcatttgccgcatccgcacagcagctgagccatcttcttattatatgtcttaagtccttcttacatcaggtccgtcttacatgggtactcgcattgtctgttgaggttactatactgttttcatttcctctttcttgttgcaggcagatagaaaattcatgtgtagaaaaatgtcattacggttaataccaaggtagaattacttctttacttgatagaaaaattcatgtgtaaatctttacttgttttacacttgttacttctttcgaaattgttccaagaattgttgtttctgtcctctgctctttctttgtcaaacataaggaagaaagaaatctattttgtctagtaatttaaaatagcaataattggccagaaacggataaaggggtcgataaaattagtcccacaagcccatttgcacagcacgctcgtctgcaaaaccaaggcttactactacctttatcgttcaatttcttaagttttacacttatactcctttgggctagcttattattctgtaccaaaatttagttactccaatgtgaatttgcctttttgagcattgttaatttgcaaagtaacagaaaaaataaagaaaattgtaatttgctttttgggaatatatatacatcaggcttttgtagacttacaaaagttcttgggaaaaaaatcgacatttaaataaaatgtagtttgtcagttacctgggcgaagttaaaaatattgaaaagatttaggagtcaaagactcggtcagggcccagctctcaatggtagtagtggcatgggtgagataagactctctctctcgctttctcttgttcctcaaaagacgaaagacagaagagagttatatcctctgtatttcgccactaattcttccagctgtgttcttccatgtgtcacgatctaacatcgtcacattttcatacattgatcatcaacggttagtggctcaaaccatactagtagtctcagtaaatccacagtctccacccttaaaataatccttctaataacaaaaacaaagaaagggaatgtcaaaaatatggcagtaattggtttactttttattttacttgtaagttggtagttggtacataatcttgtttgtttggctctgtgccaaaagttatgtttctcgttattatttttggggatagttagttttcagggattgtgaaaaataagcaattatcacgattcaaaactcgaatttcaaagaaatttgggtttaaagttatgtggactgtggacaatcacagaaatgaatatgctttaacatagtttcggtaggtcccccttttagccccaaagcttctcatctttctttgtctttttcttgttgtgttttgaacgcgggtccactttccaccttcacatgggccgactttcaagcccaattagtgtgggctaataacatagtttttttttacacagacaaagctcctcaaccaattgatacgaataaatacggcgttgtcatcataattttacacaaaatgaaaatgaattttaattaatttagacatagtagtactagtatacacagaaaatcataacaatacaattatatttttttacaagtgaaataataatgaataatgatattgaaaaccatttggtcctatctcttcctacccataaatcttttttgtagttattttaacccaattaaaaagattcaataataagtgcacaagagaaattttgtcaggtttcaggcatagagcccagtaacactcaataacaaattcaaggaaaaaaataacaaaaccccatttcaactcaaatagcttcacagttttactaatctctctcatcttcttcccaacatcaaagaagacctttacttctggttagaatagaccaagaacactgagtacgacaaagaaccatgatgaatctttcttctcgtcgcgcctcttccactctcacattgagcttcactgttctccttttagcttccacaggtataaccagaagaagaagaagagtctctcactcacttacttcaaagtctatcacatctacttacactcgtttcaaagtttcattttttttagtgatttgtttctttatcttttggatg

SEQ ID NO: 3542 - DNA, 2053 bp, Unknown; identical to SEQ ID NO: 3529
  misc_feature (1)..( 2053): cDNA_ID_1820987_gDNA_ID_1620649_Annot_ID_47707 3000 nt of promoter + ATG

SEQ ID NO: 3543 - DNA, 170 bp, Unknown
  misc_feature (1)..( 170): cDNA_ID_1820983_gDNA_ID_1620649_Annot_ID_47708 3000 nt of promoter + ATG
ttcattttctatagacattgaaatgaatccatgttgacacattttcttaatagcagatgatccatcagcaatagatttcttatccactatgttttgtttcaccttttggttctgtgcctttctgctatcatttgtttgagaatatttgcatgtcaagaaatgggagtatg

SEQ ID NO: 3544 - DNA, 3000 bp, Unknown
  misc_feature (1)..( 3000): cDNA_ID_1821117_gDNA_ID_1620650_Annot_ID_47711 3000 nt of promoter + ATG
gaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaatttttttataaaaaagatgaacttcactttagagcaatagcaatccctcgagtctcccctatataaagattccaactccttaacgattcatctaatgaaaaaacacacacaccaaaaatatcagatatctcaaacaatgtcttcagtttttggatctgtccatatcttggccatgatagccatacaactcctccttacacacagtgtttcatctctgaaccttaccaatgcgtatctgcaccacaaatgcagcaacactcaaggaaaatataagcaggggagcgcgttcgagaaaaatctcaacttagtcctcagtaccatcacctcgattggaaattttcgtgacggtttccgctacaccgaagaaggtgaggatcccaataacgtctttgtcatgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttttgtcaaatcttaaatatgtgggcaatgatcctgatactttatataaatgattgaattgagacaaaactgatagacattaaaggctagttaaaaactactgattaaacaatgcaatattgttcttgatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactacagcaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtggcatcatgtcttgtgccggagtcgatgtatgtagaagtcggaagaaatagtaaattcacatttatcagcttcatgataacttcatttgccaacaatttttagtatatgctaacattaatacgcttggatgtatatattcatcatttgtttacaaaaaaataaaaatccacaagacataaattagtgtttgatagaaaccaaatagtaaataattacaatattcttagtcacttagaaatctatgtaatatgcctaaattaatcttttactctcttctcgtagcattatactttttattttattttagactctgagatgaaagacaatgctattacagtgtcgaaatcacattatcttgaatagtctaattcttttgaatgcaaccatgctctacgtgaagtagagttacaatatctttggattaaaaaatatgagctaattgcaatggaaatgagataactacaattgaaaattaaccttctttcacagggacactacgcatgaaagttaaaacatcttagcccaaaatccccagagccaaaattctattgctcctgtacaaaaccagcggtgcactacaagtttggtatgattctattttctcagagttttaacttagtaaagtatttgaactttgactttttcatatgctctccacatccctcgccgaaaataccaaactcctctctcttggttgttacagacgaaaaacaaaatcttctccaaactaaaatgatcaaatccagttttgtataaggtaaccaaaaaggaattgaataccgtcttgaaaaactagtgaccaaaatattgaagccaatcagctaaaattcttcctagtctcctgtatatataaacatcacaccttaacgcttcatttatactaaaaaacaaaaaacacccgactcttgaaaaaaataagcaaaacaaaatacaat

SEQ ID NO: 3545 - DNA, 3000 bp, Unknown; identical to SEQ ID NO: 3544
  misc_feature (1)..( 3000): cDNA_ID_1821117_gDNA_ID_1620650_Annot_ID_163428 3000 nt of promoter + ATG

SEQ ID NO: 3546 - DNA, 3000 bp, Unknown
  misc_feature (1)..( 3000): cDNA_ID_2173238_gDNA_ID_1620650_Annot_ID_163437 3000 nt of promoter + ATG
ttcgggcgggctggttttcacctaacgtcacagccgattttttctgtctaagttcgggttagatgttaagtgcgagactgagctcggctttataataaaagtattcggcgtgtactgggcgcgagacgtctctcggcttatgcccagtaggcctatgtataatttaaagagggagttctgggctctgtataaaaaataagtgaggcggactcagcatattagttggggagcgagatgctgggctcggcttactccccgtagagcatctgttcggcagatcgcgaaattcagggttcggcttatatttctgtccgaaccagagcttaagtgcgagaaaactggtctcggctatccctattagaaaaattaagtgtctaatagggcgtggattatttcaccactgcatccatgtgagacgcgcatcgaacacctggccagggtgccgagagttgatttattacagatcttaaagcgaattccgtattgagaatgcaaactttaattttattaagtggtatagctgcatccttacgaaggattgcctagttagggatcaagccattcgtagttcgagttctaacggagaggtcggattaccgagctcgtgtttttttttttttttttttttttttttttttgcatagacgagtgtttcgaaaatctatgcaaaaaaatataacagataatgcatgtatatgattgattgatgtttgttagattataatcgataatacttatctcagcggtttggagatggagatgatgacatcaacgatatggacgatctgaatatccgaaattgtaaacgtcgatggatgaaaatctacatttgagatgttcgttagagaagatctcatctttacgtagaaagagaaaagcaatgatgaaagctagtgatataagcgaaaatgtcaatcaagcttaactaatatgtaagaaagtaattgaacttatcttttatgtgggaggtcgtggagacggagacagaattggagatcgcatcattgatgaatgagtggaagccttgagcgattgctagtgatgatccattgtatgtacttccttttgctgatttatagaagaactgataacttccgtttgaaccgttaaattattgatcccaccgttgaatctttagctgatagtcccacgaagattttgtccgaattttagtcagatcggatattgcctgaggcttctaccgtcttatgaagttgctgtgacagagtttatttttcttcctttggctgattcggagatgcattaataactttattctgaaccgttgatttctagatcccaccgttgaatcattatctagtagcgtcaagaatcactctgtaaatttatagctagatcggacgtcgtatgtatcttccatgatcctctgaagtcgctacgacaaagtcgttttttcttgatttctgcagtttggatgattctgggccaactttgaaggtgatttgcagatggagattaacaccaattggtaatccgcttacgggaaatgattccttgtagtgagatcttcgctaagagtacttagttagaccttaggtctttctgatgcgtcgggaaaatgtctcgcaaaagctctagttgcacatcaaattttgtttcagactaggcacattgaggactattccaattgtttcttgtacaggaagcaagatgaataacttcttgatcttgagtccgtttgacgaacagtcaggtgtggtggactatcggattgatagtggtcacgttggagcctttgtatcgggttttcgaccttatctccggcgccggagagtttctcaacctaccatctccactctgcttttaaattccttcctttgctatatttgtttttggtttcggttgctccggtagcaacatacgatcctcagtgaatataggaggcagtatccagtgatgcttactctttggctgacttctggtgatctttcttctttacttctctttcctttgaattttcattacacgacatgattttgtgagatctgaacaacgtcttgtgattaaggaagataaagcagaagctctccaaggcgaggaagggacgatttttcttagatatatgttgcgttctatgcctctgacacatggtccgtggtgatgaggcgtggcgatgacgtgaagctttttaaattgaagaccatcggtgacgaggtgaagacgtgaagcctaagatgggaatgttggtggaatcgtcctggaaacgacgatggacgtaaaatcggtcacaaaggtggctgatctgatagccgcagacatgcatctttgggctacagccaggacgtgcttgtcgcagaaaaacagtaataactcttgttaaacgtaatcaattgaggcaaggatgaatccgttagaaagataagccttgtagcttcaaaatgatgtgcagatcggctcctggttccttttagatcgccgggaaatcgatctgaaagcagacagatcgggtgtagacggatctgtgtctcgataaacaacgcatgcttgagagaaaagcctataactctcggaagacagcaccaaatggagcaaaatcgatcttgttggaaagataagcctcagagcttcatgatgatattaagatgggctcttgatgttttctgaatcgttgggagtttgctttctaatccagttgctcccacagttcgaatctgcgatttgacaggtgtcatatgtttcattgaaacagtgataacgcttagtaaacagctcggaattggatgaggtcggtctctattgaaagataagcctcggggctcagttgatacttagatcgcctcgtgatgccttttagatcgccgggaatttgattccgaggtcaacagatcggatatagatcgatctgtattttgtcagtcttctgcagataaacggcagtatctccgagaaaacagaccctaacgaagtgagctggggcttgttaaaaagaggagcctcagcctatgcaatgtgcttttcaagatcatcactaagacgatg

SEQ ID NO: 3547 - DNA, 3000 bp, Unknown
  misc_feature (1)..( 3000): cDNA_ID_2173249_gDNA_ID_1620650_Annot_ID_163440 3000 nt of promoter + ATG
tcaatattgataaatgtgactacaatctaagtcaaaagattaggaattatgatgatgtttatattaatgaatatgaccttcttgaatagtttatccgttttcatctcccaataaacagatggaataaccaaacatctacacgaacttcattagttttatcatgagaatgtcattcaaaaccaaccttgtttctaaattgttaagggcggctataatcaaagtcaaacaaaaacaaagtcgttattccaatgcatgtcgacactaatgagtttcttccttatatggatattaatttcaattagttttttaggatgtgcgattgcaatgattgtattgtaatttcaactaaaaatgcaatcatttgttgctatattctcatttctttaatcaaattatggacaaaaaaaaacaatagatggtgatcaaagcagtttcgctgcctagttgtagcgactgccttataaccatctaacgtgataagccaacgaatggatagcaaacaaataattatccagagacatgtcatatataaaagactttgtataactacgtaataatttctctatatgcatacattctttctacgtgagtaataattgagagtttaaacaaatgcaactttgttttctttctctcatatacaaagaaaaaatagtcagagcaactttgttttctttgcttttcctttattttttcaaacgaaaggagacgaaaataaagacgtcagtatccttcttgtagcgtaattataatagagacccacctaagacctaaccaccttagactgctgaattctttgtgcacaaaaagaaaaaaaaaacaaaaaaagactgctgaattcttttagtcattaggtttaccagcaaaaaaaaaaattttttagatatattgttggcttgtagtctcaaaaacacttgcttttcagttttgaacttaagtttaaatattaaattcgacgtaagaatgtaattttagagacgggctctataagcatgtgagatgtgctaatgagtaagcttctaggtttggggtttggttaaccaaaccggaactacataagtgcatttgtgtagagactatgtgacagaatttccaaattctttattttgttactctagggagtagggtccaaatatgaaatatactgtatattgttttaaatatttttagcctataactactgttagacaatagacggtcttaaaactttttttttttctttatatacttaattagaaattaatgcagccaaatccaactacatttaacctattttgtaccttaaactgtacctaatcgagatcaaacccgaaaaatatttactgtagttctagtcaagttcaagttcaaacttgtacattaattcaaaaataaaataaaatcgatttgaatcaaagcaaactaataaaccgggtttccaccaatagtccaatactccaaccgaaatctgaccgaattgaacttaatcgtagtattatacatttaagattagtatatagtaatacacaagagcgagaagaaacaagaaaagaagtatagaaaccctagaaaagaaaagaaaaaaaataaccacaccgcagaaaccgcccgccgcatattattcatcttctttctttatttccagattacttatccgtacacgtgtatcgcaatgaagagaggaagaagagttaaaaaggtaacttttataattcgaattttgggattttctaatcgggaaaaatgtcaaaaaaatcatcactttgccaaaagtggtgaaacaaagcaccaattgggtctggtgaaattctcaattttggttgaattttcttttaaattattaactttcgttgactttgccaaataagacatatcgttaagtcaactaacggactaatttaacggagttagagtcaacgttaacttttttcgttaagttctgaaacgacgtcgttttgagtatttttctaaaaaattaaaatcattacaaatcaagctcactggtaagattcgaacaagggaactgacaacgtatagcgtagtagtcaaccatcaagctaaagtatttattagctaattgacacacaaatatacatatattaatcatatacaagtatttattcacttaaaggtataatgattgatgttttttgtgataacatgttcctctagtccactatattaatccattacggagagaactatctaaaaattgtataatcgcaattgtaaattgcaaatctattaacaaaactaagatgtgttcacatgcacacttcgataaacattcttccatatatcttttgtgttaaggcatgttttaaatgatcaaatcacatattgattttatttgaaagtatatcaatataataaactgtttagaagatgttttgccaaaaaagaaaaagatgttttgttcttcttggaagtgtttgttaaagcccaagagagacttcaagctcacaatttctcaaagatccattaatactgggccttagttagatatccatattacatgttaaggcttcacgggttcgaatccagttggtgttcttttttgaacagatttttgtttttttttgtttttaaacataaaacgacgtcgtttctaaaaattaataaaaaaatagaaacgttgactctaactctgttaaattggtctgttagttgacttaacgacatgtcttatttggcaaagttaacgaaagttaatgatttaaaagaaaattcaactaaagttgagaatttaattcaccagacccaaagttggtgttttatttcaccacttttggcaaactgatgatttttatgacatttttcccttttctaatccgagttttcgagtttgattttgaatttgcatacaattttttttaggtcgtcagagattatagaagaatctgggttttctggaattatgagaatgctcagctacctaggggattcaatcgaacgtatgttgttcggatgttccgtaattttatgaggagtagaggttattttggacaaataagcatacta

SEQ ID NO: 3548 - DNA, 3000 bp, Unknown
  misc_feature (1)..( 3000): cDNA_ID_1821103_gDNA_ID_1620650_Annot_ID_47716 3000 nt of promoter + ATG
cccagtattaatggatctttgagaaattgtgagcttgaagtctctcttgggctttaacaaacacttccaagaagaacaaaacatctttttcttttttggcaaaacatcttctaaacagtttattatattgatatactttcaaataaaatcaatatgtgatttgatcatttaaaacatgccttaacacaaaagatatatggaagaatgtttatcgaagtgtgcatgtgaacacatcttagttttgttaatagatttgcaatttacaattgcgattatacaatttttagatagttctctccgtaatggattaatatagtggactagaggaacatgttatcacaaaaaacatcaatcattatacctttaagtgaataaatacttgtatatgattaatatatgtatatttgtgtgtcaattagctaataaatactttagcttgatggttgactactacgctatacgttgtcagttcccttgttcgaatcttaccagtgagcttgatttgtaatgattttaattttttagaaaaatactcaaaacgacgtcgtttcagaacttaacgaaaaaagttaacgttgactctaactccgttaaattagtccgttagttgacttaacgatatgtcttatttggcaaagtcaacgaaagttaataatttaaaagaaaattcaaccaaaattgagaatttcaccagacccaattggtgctttgtttcaccacttttggcaaagtgatgatttttttgacatttttcccgattagaaaatcccaaaattcgaattataaaagttacctttttaactcttcttcctctcttcattgcgatacacgtgtacggataagtaatctggaaataaagaaagaagatgaataatatgcggcgggcggtttctgcggtgtggttattttttttcttttcttttctagggtttctatacttcttttcttgtttcttctcgctcttgtgtattactatatactaatcttaaatgtataatactacgattaagttcaattcggtcagatttcggttggagtattggactattggtggaaacccggtttattagtttgctttgattcaaatcgattttattttatttttgaattaatgtacaagtttgaacttgaacttgactagaactacagtaaatatttttcgggtttgatctcgattaggtacagtttaaggtacaaaataggttaaatgtagttggatttggctgcattaatttctaattaagtatataaagaaaaaaaaaaagttttaagaccgtctattgtctaacagtagttataggctaaaaatatttaaaacaatatacagtatatttcatatttggaccctactccctagagtaacaaaataaagaatttggaaattctgtcacatagtctctacacaaatgcacttatgtagttccggtttggttaaccaaaccccaaacctagaagcttactcattagcacatctcacatgcttatagagcccgtctctaaaattacattcttacgtcgaatttaatatttaaacttaagttcaaaactgaaaagcaagtgtttttgagactacaagccaacaatatatctaaaaaatttttttttttgctggtaaacctaatgactaaaagaattcagcagtctttttttgttttttttttctttttgtgcacaaagaattcagcagtctaaggtggttaggtcttaggtgggtctctattataattacgctacaagaaggatactgacgtctttattttcgtctcctttcgtttgaaaaaataaaggaaaagcaaagaaaacaaagttgctctgactattttttctttgtatatgagagaaagaaaacaaagttgcatttgtttaaactctcaattattactcacgtagaaagaatgtatgcatatagagaaattattacgtagttatacaaagtcttttatatatgacatgtctctggataattatttgtttgctatccattcgttggcttatcacgttagatggttataaggcagtcgctacaactaggcagcgaaactgctttgatcaccatctattgtttttttttgtccataatttgattaaagaaatgagaatatagcaacaaatgattgcatttttagttgaaattacaatacaatcattgcaatcgcacatcctaaaaaactaattgaaattaatatccatataaggaagaaactcattagtgtcgacatgcattggaataacgactttgtttttgtttgactttgattatagccgcccttaacaatttagaaacaaggttggttttgaatgacattctcatgataaaactaatgaagttcgtgtagatgtttggttattccatctgtttattgggagatgaaaacggataaactattcaagaaggtcatattcattaatataaacatcatcataattcctaatcttttgacttagattgtagtcacatttatcaatattgagtcatttcattatcaaaaccttctttatctagtctagtcaaacgtcatttagtctagtcaaacgtcattatcaaaacctttttttttttttgacatcatgtaaaagatttgaatcgagatttacacgattatgaaactacaaccactattttgcacccaaaaaaagagaaaaaaaaaaaaaatacaaccactatatctacaaactaaggtttaaacatgtacaaaaatacttgagggtttaaaaataaaatttgactaaatttatttttaaaccctcaagtatttcgaacgtatctgacacgtgtcaaatcgccgcgtctgtacgcgcgcgtgaagctcaggaaccgaagcgtctcgtaggtttaatgatgacctcgtaggtttgccgcccattcgcctctatttatattagattaaaccctcgggaaatcattttccgccgcttgcaagaagaatctaaggtagctctcgctctctcctctgcgaattattttgtactctcgattctttatcgatttttccggcaatg

SEQ ID NO: 3549 - DNA, 3000 bp, Unknown
  misc_feature (1)..( 3000): cDNA_ID_1822833_gDNA_ID_1620651_Annot_ID_47729 3000 nt of promoter + ATG
attacagttaaatcttgagattagcaaccccaagtttcaagattaatggtcaaagaatcattgaaatgcaacagaccaaatagtaagcaatcaaggcttttgttaggcatatactcgtagaccaaaattctttcctctccttgtaatgaaaatccaagaagcctaaccaaatttctgtgttgaagcttggcaactacaacaacctcggtcttgaactccgcttcgccttgtcttgaatttttcgacaatctcttcaccgcaacttctttcccatttgaaaatgtaccctatccgtttaactttttaatcagcatcatctcgttatccaatcaaagaatcaatacgaagtacttaacctagggtgtacttgaagatattatagtataccttgtaaacctcaccaaaaccacctcgaccaatcttattactctctgcaaaatcatttgttgcagtttggattgttctatagtcgagctgtagtgagtctgcggttgccatatcatctcctactgcacaataaacagaacaaatgtcttagtaatcagctaaagaggctgatgaatgacgaccactaatatatcaaacctaattaagattgttagtaatctttaccctccgatgcagatgctgtgtcaaaagtcttctttttcttttttgcaaggaaacaataaccaactaaagctatgaaaagcagaacagccagcacaacaacggctaccactaacactgttgagttcccacttttccctgctttttaaagatcattggcttaagatcagataatgccacagagtataaaaatacaaaaattaatcaaaacaacaaaactttccctactagtatttcaagaaagcaggggaaataaaaagagaggacggagaatgagttcaccaggtaatgaagaagatgatatcggaggagtagacaccaacgactccctcggtggtggtggtggtggtggtggtggtagtggtggtgtttcaatggcgctttcattgtagaacgggtaaagctcgtaccttgcagtacaactcggccagtaaagtcttgctcctattctggaaagagccattccattgatggaactttgcaaacaactcaagcagtctgctcttgtaagatcaggagtgcactgaagcagcccgtacaaattctggtatgcggtcaattcggtattcaccgtatataattttctagaactgttggctgctttaccggcagcttcactcatcgtggaggaaacaaaacttgtgaacccgtctatttgtttttgattaggagaaatagtgttggtgttactcaagataaattctccttcgtttgtaatggccgtcgatagaatattcttgtgagaatatctgagtatacattgctcgtagtaaaacacggcttctcttaccttgggacaaagatttaaggtttgattgacagaaaaggctacgcagttacggcaaacttccggtgagacgtctccgcggcaaaggaaaagtccggtgactctgtcgggggcttttcctgcagtggcgttttggaatccggtggagtaagaggcgttacgtgaagatagagaggacaaaagggttctgagattggtggagtaagtgctgttacttgagtaagttgtcgtatttggacaataatgatttaagtaaaaaggatcttgagcagaagctgtgaaggagctagtgaggaatgagaaaaggaaaaggaagttgaaagatataagagaagacattgtttgagtaccttgatttgagtttcacatcatagagctcccatttataagctgatcactagcgtgtagtataagatgggttgtggtgactataagagtcaacaagtcaaagtaaatgattctttttcttattattgtcatttctcttaaacaacatatatttttatttgggaaaagcccacgttaaaattaacttgaatttgaatcaaaatttagttatttgatcagtgatccacatatcaccagttgagcccaataatgagtgtataaacgggagctccttaaaagttgggaaccactagcctactacaacttggtattagaaacaaaaggaattcaagaatgagattcttgttgtagcaaagcttaacgcagaatttcggtcaagcttcgatttttcttagttaaattacttccatttttgtttcataatattttagtgcctgacaagtaagtgtaagatactcttgtctagaattttatttactagagagtgaaaacaaaagggtgcagagaattaatggcttatctgctgattcttacacaatcagtttgttttgttggaacagagatgtgataagtaagtacggttttctgcagaagcaagagagtttgtgaggaacagagagatgaaatgatgtaagtaggcaagtttcagttctttgtttcccaaaatgactctaaaattcttatacacagttgtaaagttcagaaggaaaagtactaaaatatgaagtcaacgacaatctttagagtcaaccttccactaagagtgttgattggtttgatgaagcagtgaaggctagaaactgaagcaactagggtttgggaagttactgttttaacttgtaactgttcgtttgttacttctttggtaaggaagtaaaacggtgttgtcttattgacccaaagtctccgcggcttgctgaataatcacaaacctattaaatatccaactccaataggttcatctttttccggaaacagattcatgaaaacttaaaaatttataattgtattttctctggttttcgctttcacatgtttattctaacatttttatagttgattcattttagttaacatcaatacaagttgatgttactcgtctagttgaccttgacttgcaagatattgtattattttacaaaaaccaaaatttgactggcttggctggtttcacattcattcattagtactcataaaccaatcattaaaagtaagaaaaaaaaaacagagaagaaaggtgaagaaattggataatg

SEQ ID NO: 3550 - DNA, 3000 bp, Unknown
  misc_feature (1)..( 3000): cDNA_ID_1822829_gDNA_ID_1620651_Annot_ID_47730 3000 nt of promoter + ATG
aaaaggatgttacccgcttttaggtctcgatgtatgattgtgagtcgtgaatcttgatggagatacagaattcctctagcaattcctcctatgatcttgtaccgtgtagtccaatccagctggctctgcattctagaatctgcacatccatatagttagaatacctaaaacatgagttccaaaaggaaatatctttcctaagctaaatcttaccaaacaagaagtaatcaaggcttttattagacacaaactcgtagacaagtattttctcttctctctccaaacaaaatccaagaagcttgaccagatttctgtgctgaagctttgccacaacaacaacttcgttcttgaactctttctcaccttgtcctgatgttttcgatagtctcttcacggcaacttgtactccattaggaagtgtgccctaaaaagattgtgaattaaacagagccatccccttatttgatcctcttatgcaagtaacaaggaaactcaatgaaccggtagtagtaccttgtaaacttgtccaaatccaccttgaccgagtttgttacacatcgaaaacttatctgttgcagcttcaataaccttgaaatcaaactgcagtgaccctgcagttgtgatgtcatcctcttctgcaaaatatttaagaattcaaatccataaaagtttaagcaacggacacatagattttggaatctttaccatcatttgcacctggtgtatcataagtcttctttgctctctttgatgcatggaagctaaaaacagctacacaaataagaactgagatagcgactggcacaacaattgctatgattatcactgtagaatttttgccttttcctgcataagtcttagattagacatgaactaaaaccaaactaactattaggtaaataaataaaacagagctctaaccaggcggaaaggaaggagttgaaaccagtggcagtggaggagccgaaaccggcggaggaagaacagttccctctatagtttccttgtaaaaggggtaaacctcgtaccttgagttacaacttgggacaagaaatcttcctccaactttgttgaaatataattctttgatggattgttgaagacacattacacaatcttcactagtcagatcaggaatgcactgaaccgatgcataaagcgactgagacgaactgaaatccgacttcttaaccgcgaatttcttgcttgtactattagccgcttcctctgcagactttttcatcagagaaagcactgcatcattaaaccggtcagattggtccgccgtaactttctgagtgttccaagtgattattgtagttgtggttacagtatccatgaatatattcctgtctgagtatccaagcatgcactcatcatactgaatcaagaactctttcccacctggacatcgactccgagtgtctttagcagcaaagatgacgcactcacggcaagattctggcgagagatctcctttgcagagataaagtccgaacaccatgtcggagttttgaccctttgtgagactatgagatcccaaagagaagtaagcattgttagaagaaagagaggtcaaaagtgtttggagatttgagaagtaaatggagtttcttgatatcctgttagtacaaacatggccaacgtaagtagggtcttgtaattgtgcagaaactctcaagcttccaatgaagaaggttagaaggaagagaaagtttaatgaggtataagcagacattatccaatttcttcacctttcttctctgttttttttttcttacttttaatgattggtttatgagtactaatgaatgaatgtgaaaccagccaagccagtcaaattttggtttttgtaaaataatacaatatcttgcaagtcaaggtcaactagacgagtaacatcaacttgtattgatgttaactaaaatgaatcaactataaaaatgttagaataaacatgtgaaagcgaaaaccagagaaaatacaattataaatttttaagttttcatgaatctgtttccggaaaaagatgaacctattggagttggatatttaataggtttgtgattattcagcaagccgcggagactttgggtcaataagacaacaccgttttacttccttaccaaagaagtaacaaacgaacagttacaagttaaaacagtaacttcccaaaccctagttgcttcagtttctagccttcactgcttcatcaaaccaatcaacactcttagtggaaggttgactctaaagattgtcgttgacttcatattttagtacttttccttctgaactttacaactgtgtataagaattttagagtcattttgggaaacaaagaactgaaacttgcctacttacatcatttcatctctctgttcctcacaaactctcttgcttctgcagaaaaccgtacttacttatcacatctctgttccaacaaaacaaactgattgtgtaagaatcagcagataagccattaattctctgcacccttttgttttcactctctagtaaataaaattctagacaagagtatcttacacttacttgtcaggcactaaaatattatgaaacaaaaatggaagtaatttaactaagaaaaatcgaagcttgaccgaaattctgcgttaagctttgctacaacaagaatctcattcttgaattccttttgtttctaataccaagttgtagtaggctagtggttcccaacttttaaggagctcccgtttatacactcattattgggctcaactggtgatatgtggatcactgatcaaataactaaattttgattcaaattcaagttaattttaacgtgggcttttcccaaataaaaatatatgttgtttaagagaaatgacaataataagaaaaagaatcatttactttgacttgttgactcttatagtcaccacaacccatcttatactacacgctagtgatcagcttataaatgggagctctatgatgtgaaactcaaatcaaggtactcaaaca

SEQ ID NO: 3551 - DNA, 3000 bp, Unknown
  misc_feature (1)..( 3000): cDNA_ID_1821185_gDNA_ID_1620651_Annot_ID_47732 3000 nt of promoter + ATG
caccaccaccgccgctgcctccgttggcatctccttcactatctggtgaacagtttcttctacctttgccctgtttacttgatctttgcagtattaccaatatggaacgcagagttttcaatttttgttttgttataagtctactattttcttactaaagcagatgatctgtttaaacgcagataaaagtgggaattcaaatgtggtcgtggtagccgttgttgtgcctatcatagtcgctgttctgattttcatagctggttattgtttctttgcaaagagggcaaagaagacttatggcacaacacctgctttagatggtaaagattcaagtccttaattggtttgattaatgtttttgactaatatattttgtctttctttttctgattactaagacatttattttgcaacagaagatgataaaacaaccatagagtcgctgcaacttgattatagagcaattcaagctgcaacaaatgatttttcagagaataataaaattggtcgaggaggttttggtgacgtttacaaggtataatattatatacttctacataatttatcgattgttttgttttctttttgctacaacacatttggataatgagattgataaaaatggatagggtacattttcaaatggaaccgaagttgcagtgaagagactgtcgaaaacatcagaacaaggtgacacagaattcaagaacgaggttgtagttgttgcaaatcttcggcacaaaaatcttgttaggattctcggattttctatagaacgagaagaaaggatattggtctacgagtatgtagaaaataaaagccttgataacttcctatttggttagttgcatttgatgatttgtttcattgattcgttaaccagtcctgaaacatggttagagctaactactattcatggatgttcacagatcctgcaaagaaaggtcagttgtactggacacagcgataccatatcattggtgggattgctagagggatcctatatcttcatcaagattcacgactcacaatcatacaccgtgaccttaaagcgagtaacattctcctggatgctgatatgaatcctaaaattgctgattttggaatggcaaggatctttggaatggatcaaacccagcagaacacaagcagaatagttggtacctagtaagtcttccacttgactactctctcacatgttgaacattttattttgataacatattaaagtttttgatgtggatatccagcggttacatgtctcctgaatatgcgatgcgtggccagttctcaatgaaatctgatgtctatagtttcggagtgttagttcttgagattataagcggtaggaagaacaacagctttatcgagacagatgacgcacaggacttggtgacacatgtaagtttaaaggaaaggagttatatatatgtacctctcctcatcctacaataagcaatagttgcaataactgtttgactgattgattctaggcttggaggctttggagaaacggaacagcgttagacctcgtggatccattcattgcagatagttgccggaagagtgaagtggttcgatgcacccatatcggtcttttatgtgttcaagaagatcctgtaaaacgtccagccatgtcaaccatttccgtgatgctcactagtaatacaatggctttaccagcgcctcagcaaccagggttttttgttaggagtagacctggaacaaaccggcttgattcagatcaatcaacgaccaacaagtctgttacagtatctattgacgataagtcaatgtctgatttagatcctcgttgaatatggtgttattaaaccttacgattgaaatcaagtttaattaagcctatatttacatatttctaaacttgatgaaccatgttgatcctttagttttgatttggtttgatatttgttttcaagaataatcaatttagtctcagctatcagcatcaccaccgattgaaaaattcattacctaaatgagagggagagaacacttaatgttggcattagagttttgtccattctaaaaatttgtgcattattttggagttcatttcaacaaaagaatcgctttagcaatacctctaatgattttgtgccatttgattttgaaaacagagggaaaacagagtacagtgggatggtgatttgcatgatttgtaaagtggtgaaataaatgaaatgtgaaccatctaacacgtcaaagtttttttctttctttcgttgtaaagtaaactagttgaatttctaagttttgacgcctatcaatctatttccgagaaagatataaaataaaaatattggagttgaatattatttaataggttgatgattattctgcttggcgccgagactttgggttaataagacagcacagttaaacttccttgacagacaagtaacaaacgaacagttattaagtaaaaacagtaattacacaaccctagtttgattcagaatcagaaccaatcaacacgctcagtggcaggttaacttgtaaagattatctttgaatttttcttttagggctcttccttgtttaactttacaactgtgtattagatttttaaagtcattttttgaaacaaggaactttacttagatcagtcccaatctctcttttcctcacaatttacgacatttaaaagaaaaaaaatcgcttacattgactactgacttagtcgtaacaaaccgtcgtatacttcacgttactcagtactagtcagagagagtatcatggaagctccacgatgagaaactcaaatcaaggaactcgaaaaaaacaaaaccatgtcttctctgatcttattatgtatatagtttcaatgtaaatattatggttttgtataggtttaattggagtctgtataggtttggtttagctggtttagaggctttggtttaggcctggtcaaatgtatataaacccacaattgtatcttttaccagattaatgagaatgagattgtttactaat

SEQ ID NO: 3552 - DNA, 3000 bp, Unknown
  misc_feature (1)..( 3000): cDNA_ID_1821177_gDNA_ID_1620651_Annot_ID_47735 3000 nt of promoter + ATG
ttttgcaaagactaacaagctaggtcaaggtggatttggagaagtttacaaggtatagatatagtctttagttctctagctacctggttcattacagagttagggtaaattgatcatatcatcatccgtttttagggcacgttagttaatggaacagaagttgcagtgaagaggctatcgaaaacatccgaacaaggtgcacaagagttcaagaacgaggttgttcttgtcgccaaacttcagcataggaatcttgttaagcttcttgggtactgtctggaaccagaggagaaaatacttgtttacgagtttgtccccaacaagagcctagactacttcctttttggtatgtggcattaccatatacatattaacctgagattctgagtagacatatatgattgtaatctctaagtggctcatgactacttgtgtacgtgcagatcctacaaagcaagggcagttagactggacaaaacgatacaacattatcggaggaatcactcgaggaattctatatcttcatcaagattcacgactaacaatcatacaccgtgatctcaaagccagcaacattcttctagatgccgatatgatcccgaaaatcgctgattttggaatggcgaggatatctggaatagaccaaagtgtagctaacacaaaaaggatagctggaactttgtaaaatactaaccttatgaacagaagttttcaagaatattttcttggacattctaatttaatctttcttgtgtgttttatcttgtagcggttacatgcctccagaatacgtgatccatggccagttctcgatgaaatctgatgtctatagcttcggtgttttgattcttgagattatatgtggcaagaagaatagaagcttttaccaagcagatactaaagctgaaaatttggtcacctatgtgagtaccaaagaagaaacttagtgcatgatccaatctaactttgtttgttagttattgattaatgattacattgttgtacaggtttggaggttgtggacaaacggatcaccattagagctcgtggatctaaccatatcagagaattgtcaaacagaagaagttataagatgcatccacatcgcactcctatgtgttcaagaagatcctaaagatcgtcccaacttgtcaacaatcatgatgatgctcactaacagttccctcattttatctgttcctcaaccacctggattctttgttccgcaaaacaaagaacgtgatagctttttgtcgagccaatttacaatgggatgtacttctcagactaaaaatgatgtaaccattacaaatctagatcctcgttgaagttgctgttccaattgacaaattggaattgttactgaaaacaacgcagattccacatgtgaggtattatttcacttgaaaatgaaatgtgatgatccatagttatgtaagatttgtgagtcactcaaagttatttttcatacaaactctttatcatttctacattgtaacattggtttgttgtattgaagatttctgatacgaatggcttcaaaattttataaacataccaattcatgtatagtagtaacgcaaatgttgttatgcatgtaaaaaagctctgtaaattagacggattcggtttggctttaccggtagacgaatttctacgaatatttacccaaaccggtttatttactaaacctataccatatgaaccggaaaccaaacgctattaccgacttttcttcttcactctcttcgtcggaatcagcctttgcgcattcttctgagctcggatttagggtttagcattctggttctaatggcgtttaatgatattgattatcggatttgtttgtgctcttttgttagattttgatgtgtttaatggcataatcacgatttagctaagggctccgggccaactgcgttttccggtgggaaatgtaatccgtctccgatgcttatttggggtaagagagcaaacatgggataatactgcatcaatttgatagacctctatcactaatctgttgtgtccttatttataagctttggtaaatatgtgtgttcatgatttgatgattaaattatgtacagccagctttggaggtcgagccagtctgcaaacaggcccacttcccaaactatcaatgatgtaaccattacagatctggaacctcgttgaagataattgaaacagtcagaagccatgtttaggtgttttatctgtttgtagactggctcgaagttataaacaaactctatcaatgtctacactgtaatatcagccctttgttatgaaatattttgcattctatttggactcaattgttgctgttgttactcacactagtggttcgttgctactctgtttcagccaattacgacatgttcttctggtttcggcgtgattcatatgtacgcattcttacatgactcaacccaagagacactgattaggctataaattgagacgaacagaacacaacgaaaaaaggtatgctaatcttctgtttttttcttttaggcttttacaatgctttgattgccaaatgtatatgtatagtctgggaatgtgctgagcagcctatgacaaaagccggtttatttgtgaaattaatgacactgacactttagcccaatacttttcttgttcctctccatctgcctctgcgtcactgggtttgattctatgaatactttatcctttatgtcattatctgagtcaacattccaatcaatattcaacaacccccttattatataatgtgaacaaagaaaatattattgacttttagcttttgacattgactttgacttttgacactcgttttcgtgaccatatttgtaggtttcaggaccactgtcatcaatttgacgaattcaatatttgaaaattttggagagaagcttcgattttgcttgtttaaactggtaagaaacgtacagatgcgtcaaacactaaacacaaagatctagcttttgctttaatcttcaagaaacaatg

SEQ ID NO: 3553 - DNA, 3000 bp, Unknown
  misc_feature (1)..( 3000): cDNA_ID_1821165_gDNA_ID_1620651_Annot_ID_47738 3000 nt of promoter + ATG
tacgttggatgtgcagaccatagaaggaggggtcagctggattggagaacacgatacaacataatcaggggagtgactcgagggattttatatctccatcaagattcacggcttacaatcatacaccgtgacctcaaagcgggtaacattctcttagatgtcgatatgaacccgaaaatcgcggattttggtgtggctaggaattttagagtggaccaaactgaagctaccacaggaagagtagttggaacattgtaagtaattgttaacttcaattacactctgtctattcccttttctttccctaataaaacttaaagtgatatgtgctgtgttttgcagcggttacatgcctcccgaatatgtggcgaacgggcagttctcgatgaaatctgatgtttatagttttggagtattgattctggagattattgttggcaaaaagagtagtagcttccatgagattgatggttcagtaggaaacttggtcacatatgttagtcctacaaagccaatgcaatcttgaacttatttttgacctctttaaactttgatacaagaatgaacattggtttattgtgacttaacaggtttggaggctttggaacaacgaatcattcttggaacttgtagacccggccatgggggagagttatgataaagatgaagtcatcagatgcatccatataagcttattgtgcgttcaagaaaatcctgcagatcgtccaacaatgtccacagtgtttcagatgctcactaatacttttcttactctgcccgtgcctcaattacctggatttgttttcagggtcagatccgagccaaacccattagccgagagacttgagcctggtccgtctactaccatgtcgtttgcttgttccattgatgatgcatcgatcacgagtgttgatcttcgttgagattagaggttaatgataatatgcatagcttttcataagccaaaaatctaatggtcactttcattataaactcttcctgtcttgttttcccacttaaaaagacaaaagcagttgacttatagtagtagtcaatcctctgtttcacgtaacagagagaagaagaaaatattcataataattaggagattcatgatctgaaacaaaagctgaggaaatcgaacaatgtcttctggtgcctctttcatcttccttttcttcttcctcactagcttcacagcttctgttgaaaatgttttctatataaagcatatttgcccaaatacgacaacttattcaagaaacagcccttacttgactaatctcagaacccttttgtcttctctttctgcccccaacgcctcttactctactggattccaaagcgccagggcgggacaagcccctgatagagtcaccggacttttcctttgccgcggagacgtctcaccggcagtttgtcgtaactgcgtcgccttctccatcaacgacacactcgttcagtgtccgagtgagagaaaatccgtgttttattatgatgagtgtatgctcagatactctgaccagaatattctctcgacccttgcatacgatggagcatggatcaggatgaacggaaatatttcaattgatcaaaatcaaatgaaccggttcaaagattttgtgtcgtctacgatgaatcaagctgccgtcaaagcggcgagcagtcctagaaagttctatacggtaaaggccacttggacagcactccagacgttgtacggcctggttcagtgcactcctgatcttacaagacaagactgcttcagctgtctggaaagttccatcaaattaatgcctctttacaaaactggaggaagaactctttactctagttgtaattcaaggtacgagcttttcgcgttctacaacgaaactactgttagaacacaacaagcaccaccaccgctacctccttcgtctactcctctggtgacatctccttcactaccaggttaatttctccttcctctgtttcttaccctgatttcttgaaattagtcctttcaatttattttaggtttgttctgccactatcaaatcttaagccaatgatctttgaaatgcagggaaaagttggaattcaaatgtgttagtggttgcaattgttctgaccatccttgtggctgctctacttttgatagctggttattgttttgcaaaaagggttaagaattcttctgataatgcaccagcctttgatggtaacattcaaatgattaacaatctcaattgggtttgactataatcttgtttgctatttttctgatcacagagacttttattgtgcaacaggagatgatataacaaccgagtcgctgcaacttgattatagaatgattcgagctgcaacaaataagttttcagaaaataataagataggtcaaggtggatttggtgaggtttacaaggtactattactacgaaattctcttaactttgtacgtttaattgaaatgttgtgtcaactcaacacatttggataacgagatgatgttgatgaaaacgaatagggtacattttcgaatggaactgaagtagcggttaagagactgtcaaaatcttcaggacaaggtgacacagagttcaagaacgaggttgttgttgttgcaaagcttcagcatagaaatctggttaggcttctaggattttctataggaggaggagaaaggatattggtctacgagtatatgcccaacaaaagccttgattactttctctttggtcagttgcattttttgctttatttcaatgattctgtagctattcgtgaaacttgggggactaagcaatatctcacacagatcctgcgaagcaaaatcagctggactggactcgacgatacaaggtcattggagggattgctcgaggaattttatatcttcatcaagattcaaggctcacaatcatacaccgtgacctcaaagcaagtaacattctcctggatgcggatatgaatcccaaacttgctgattttggactggcaaggatctttggaatg

SEQ ID NO: 3554 - DNA, 3000 bp, Unknown
  misc_feature (1)..( 3000): cDNA_ID_1821149_gDNA_ID_1620651_Annot_ID_47742 3000 nt of promoter + ATG
ccctgctttgaggtctcgatgtataattgtgagtcgtgaatcttgatgaagataaagaattcctctagcaattcctcctatgatcttgtaccttcttgtccagtctagcttcattttcatcgtagagtctgtacagcgtatttcaaatgttaagaacaaagaatggcatacaatttgaagatatcttggctacgtactaaatttaactgaccaaagaggaagtgatcaaggctcttgttgggcacaaactcgtagacaagtattttttcttctccttccaaacaataaccaagcagctttaccaaatttctatgttggagctttgcaacaacaacaacttcgttttcaaactctttttcaccttgtcctgatgtcttcgatagtctcttcaccgcaacttgtagtccactactcaatgtaccctacacgagtaatttattttaagataaccataagtatataggaattgtcggtaagattaatcatgaaaatgaagtactcaaaatgcaagtatacaagtagaagttagtatttgttacaaatataggatgataattaacgactagagtttctttgttccgcaacaacctttgcaagtacaaggttgctgcactcatcccatacatctcaactttcgaagtaatgtgtgtgagatttgatttggaaacaggggaaaaacagagtacattgctctgttcaatggtaataataccttgtaaacttcgccgaaaccaccttgacctagcttgttaattggcaaaaagcaattcgttgctgcctcaattgccttaaaatcaaactgaagtgatcctgcagtcgtaatatcattcccatctggaaaagaaaacttcaacagctgaattaagtaagagcacaacagactattcattctatgaggagatatgtttatcactggtgtgcttaccttcagctactggttccttctcattaagcgtcctcttatttttagccctgacactaaaaacagctactaatagaagaaaaagtacagtgattggaacaacaactgcaataattatgacagaggagtttccaccttttcctgtatcaacaacagcaagaattttttaagcaaaattcttgtatgaaacttgtgttgaaatatgtagtcaaaggaaagggactgttcataccaggacgtggtgatgaatcttgaggtgttccaacattagattcgttgtaaaacgcgtaattatcgtatcttgaagcacagctcggcagaagaatccttcccccaattttgtcataggttacttgattgatgcctattttcagacagtctaagcagtcttgttccctaagatcaggagtgcaccgaaccattccgtacaaactctgggatgcatttaaatcaatttttctcacagcccattttttgaaactcctggcggcttcaacggcggctaagttcatgggggtcaagaccaaatctctgaactgatcttgtttgactgatagaggattcctagcgctctgcatgaacattcctccatcggtgtttagagtggctactatattcctgttagagtatctgagcagacactgctcgtaatagaacacgccttctttatcttttggacaccgagtcaacgtttcgtttacggcaaaggtgacgcagctacggcaaacttccgacgagacgtcgacgcggcagaggaaaagtccggtgaccctgtcgggggcctgtcccgccgtggcggtttggaatccggtggagtaagaagaagcgttaagggaagagagagaggacaaaagggttttgagattggtggagtaagtgctgttacttgagaaagtcgtcgtgactgaacaattatgatataggtagaaagtattttgagcagaagctgtgatggatgagaaaaggaaaaggaagatgaaagagatcagagaagacatggttccttttcctcgatctgggtttcagatcatgtagctctcaatttttgaaactagaactatatttttcccttttttctatgagaccaacaagtcttagtaaacgccggttttattttattttattttgtaatgtcaaacttgtatcgcgcaaaataataactattattaaaaaaagacaaagagagagtagttacgatttctaaattacaataaactatttgtcaggaattaaaggaaaaaaaacagcctaacttagttggatatgataagatattatttgtcagaaaagaatcttttctctctctctctcaattttctaatacaagatattatttttatatttttattttttcgtggacatcagaaattcagaattatgatagcatgaaaaatcagcgtgaggagagtaccgcaaatattgtcttaaattgtatttacgctgtaatttaagcttcttaaaaaaaaaaaagttttaaaccattttcaactctattttaaaagaattgtattctaatgatcatctccaaaataaagttttttcaaaaataaaggaaaatatagaagtaaccatcgaagatgtctttacgtaaccgaaaaatagcattttacactttacatcacaaaattaaagtcactatgcttcttatttgtggagaaaacaaatcgaatctagcttgatcatttttgcgtgttttgagatgacaattttttctttctgcgtgttttgactttttagatatgagtcattaaatgcattcacatcctccaagcatgtctactagcaggtcttttccttgttctgtacgtagatgatgcatcgatcacggtttttagctctcgttgaaattgaggctaatgattaacatgtatattctttcataagccccaaaacctaatatcaaagattgactcacatagtccaagtctagcacaaaaatttcaaagttgtcaatttcttattaatgtgcatggttattcaaatggaaattttaaactgatgattaaatttctaagaaccacaaatagtcaaatactaactacaccacccacacattatctcaagaaaaaagaaaaatg

SEQ ID NO: 3555 - DNA, 3000 bp, Unknown
  misc_feature (1)..( 3000): cDNA_ID_1821137_gDNA_ID_1620651_Annot_ID_47745 3000 nt of promoter + ATG
tatatgattgtgagctgtggatcttgatgaagatgtagtatcccttgagcaatccctccaatgatcttgtatcgccgagtccagtctagctcaccttgcttttcaggatctgcacatctccatgtacaatcatttactttaaagctgtagaagaatcctttgagtaatcattctgttaaagggaactataccgaatagaaaatagtcaaggcttttgttgagaacaaactcatagatcaaaaactttccatctccttgcaaacagaacccaagaagcctagccagattcctatgctgaatttttgatacaagaacagcctcgttcctgaacttttttgtgtcttgtcctgatactttcgagagcctcttcacggcaacttcagttccatttgaaaacttaccctacagagcattgaatgaaacaacaatcgccatttattaccagtaacttagcctatgtgtttgacttggcaaatttggcaaaccgatagcttaataccttgtaaacttccccaaatcgaccttcgccgagcttattgctcttcgaaaacttattcgttgcagcttcaattgtcttaaactcgtattgcaatgaatttgtagtagaaacatcactatcagctgaaaagaaagcgtgtattagttatgcttcgtctcttggctaaggagacaatataggcttataatgaaaaaaaaataccgataaaaagcataaatcacaagacactaacattcaaattcagttctttgcaaagactttctcctccagcaaataaaaaatcctagaacaactagtatcaagacgatgacaactgctggaacggtaatcaccactacaattccagctgagactcccctgctatctgttcatgacatagataattgagtttatttcagttttttcttacaggcatagtttaatcggtttgaatacttaccattatctgtagtgttcgccccgtgacctacagaaggtggtcgcggtacattcattggaggtttcggaggagtagccaaggtaatgttatgaaaagccttagagaatgtaaaaagctgccaccggaaaaagcagattggccgcataacatagcctccagtattatttccacagcatgactggtactcaagtacgcctcgttggagacagttgttacattcgtcagaagaaatatctggcgtgcattgcatcaatgcgtagatattctggaattttgtcaagttcgcaaaatcaactctgtaatggttatcactggacgatggtgtgcttcttgctgcggaggctgcagtaatcgtacgagatgttaagtcttcccatatgttcttgaaatccgttagatctgaggcgatagttgcagtgttcaagaccaaatactgaggctcaatctcccaaaaagctgcagatcctgagaaagaaatgttggagtagcggacaaggcacagcgttggatcaagtgcccaataatacgcgtctgtctggttaacacagtcctgtatcaaccagcctgccgcaccctttatacaattaaaacagtcacttggagttgatcttgggatgcacatccctaatgcgtagactcgatcttgctcttctccaatcgaaccgtagtagaaaccatcttgagaggcggtattgttaggaagagaagagaggataagacgacgatttgaatcgtatgtaccgttgggtgtgaaatatttacggttctctatgcatgtttgtgctgaaacagaagcaacaccaaaggctagaagaataaaacagaggattgataagaaactcctctgcttcattttgccttacgagattatagctgtgatctttgtgttagtaattacgcatgtatctgtttctaacccgttcgaacagataagtgaagtttctctgcgatttttctaatgttgaatccatcaaactaataagtggtccctaaacctacatagtcgatggtaaaatgtcaataatgtttgaaagtttagataataccctgaaaatgacgagtcccttcgtttacttgtaataatgggtgagaactacgacacagttccatagcaactttcatatttcgagaattaaattatattccgcagcaaatgctatgtccttgtaaagctctgtttttagtctatgaccatacttgtaaaacatgttgtttttttttgtgtgaattaacagttcattcaaaataaaaataaataaataaataatcgaaaatgtaactctgtggttattgtagcttgaaaaaacgaataatcaagtgtgttgttcattctcttcgttcgttgcacactggtatagcttgttgctgtcatctactgctgactccagcgataatgaaacgatcagaaccacgaaatttactagaactcagcttatcggaacttggaaggggaccagatgagtattaggctaattcgtcgtgttgtatttttcaactaatgcgtcagtgtcgtttttattttcaactaatgcgtcagtgtcattagtttcggaaataaacgatatttgttttgtttttgtattgggtcctatatcgagcgagattggcatgtgagttgggttggctagggaaaatggtaaaatctccacattttgttttgaaaatgtgaaaaatacatttttccctacagcggggatatgaatcagtactatttataatgcaagatatgtaaatttaaaagacatcataagaaaaacaaaactacagaatttcgcttaagctttcaaagatatcgatttgaatataatggtgcatttgcggggttcagtttccacggaaccggtaaatttaaaagccaaataccttaaaagagttgtgaaacagggttacaaatatacatagtggattcgtatgaaaaagaagggaggaatgagtcctacacgtagtcacatcacatatgaaagagattgcttttgaaaatcgaatcctcttctaatattaaatctttcaagactggaggttttaaacaagaaaatcaaactcgatgcaaaagaacaaaatg

SEQ ID NO: 3556 - DNA, 3000 bp, Unknown
  misc_feature (1)..( 3000): cDNA_ID_1821133_gDNA_ID_1620651_Annot_ID_47746 3000 nt of promoter + ATG
aagatttttatgctgaagtcttgctacaagaagcacctcgttcttgaactctggctcaccttgatctgatggtttagatagtctcttggcagcaacttctgttccattcggaaacataccctgctcattcgcatgacctttactatcagaattagcatctgagtttataatacaatcaagtagttgagaaaatttaagaacatcatgccttgtaaactgcaccaaatccaccatgaccaagcttgttactcttatgaaaattacttgttgcagcttttattgctctaaaatcgaatcgaagcgaacctgaggacgctgtaagatcatccgtagctgcacaaatatactgttatgctgtagagtttccaagggacattaacatctctgaaccgtagacaagtatttttaccatcatctggtgatgcagtaccataaggcctcctaggtcttcttgaaacagagaaatacccatctgagaagaaacagagacataacaaaagtgttggaaataattttaccctaaaatgttgttctgagataatgtcgttctagcaaaccattgaaaactcactttcacttgcaaatgattggtaagcttttctcctcctagaaacagcgtatccaagagcaagcagtacagtgctcacgacgacggaaacaaccgcaattgccacaatagatcctgtagatatatttttgccatctgcgcgaaagctgtcactcagaatacaatccaaattggtttaagggcataaagtattttaaatgcgaatttttttagaaacttcttttaaattttttgaatatgaaacaatttttttttgtgaaacgaatatgaaacattattacacaaaaataacaggaggttgtgttttctttttgagtttgtattttcaagtaaacaaaaataaatgcaaacacatcagcaaaaatcgagatccaacacagcagaaaaagttcaaatgaagagttcatatctttatattatatacctttcttggttgtgttagagtgaccattatctaattcagaagggggagttggtaacatcccatttatgaatagtcccaagaatggctgtagatcccatcgcatgaaacagctggtccttgcaatatagcctacttgtatcccccggcagcatgacctattatctatcctaagatgttgtaaacatttctcgcagttcaacttggttaggtctttattgcattgcgcgatggcataaatgctcctgaacgggaacgacccgagctcttgtatgctgttggcgtacaatgaaccatcaactttgtttatcacacgatccatcaaagcctgccatgtagatttaaactccgtcaagttggtttggccgaacgatgtgttatatttgtactcaatatactctgcccatattatgtcttcgtcgagcgatccattaatcaagtggtttgagtagcgtaccaaacaaagcgagtctccagaactccagtctatagcttctgcctgattaggacatgtgtgtagcaaggtatgagatacactcgtgatacaatccgaacaatcctgtgttgtagtacctcggctacacatccccagaccatgtgctatgtttggaccgggcttgaacggagtcttgtagaagccttcattatccttgacacgagaaggaagagacgagagcatggctcggaggtttatgtcgtaaggaccattggctttgaaaaaatcagatctctgaatgcaggttggtgcagcgacagcacaagagcttatgaccacaaaccagaagattgctcgcaagtcgaccattttgttcttttgcatcgagtttgattttcttgtttaaaacctccagtcttgaaagatttaatattagaagaggattcgattttcaaaagcaatctctttcatatgtgatgtgactacgtgtaggactcattcctcccttctttttcatacgaatccactatgtatatttgtaaccctgtttcacaactcttttaaggtatttggcttttaaatttaccggttccgtggaaactgaaccccgcaaatgcaccattatattcaaatcgatatctttgaaagcttaagcgaaattctgtagttttgtttttcttatgatgtcttttaaatttacatatcttgcattataaatagtactgattcatatccccgctgtagggaaaaatgtatttttcacattttcaaaacaaaatgtggagattttaccattttccctagccaacccaactcacatgccaatctcgctcgatataggacccaatacaaaaacaaaacaaatatcgtttatttccgaaactaatgacactgacgcattagttgaaaataaaaacgacactgacgcattagttgaaaaatacaacacgacgaattagcctaatactcatctggtccccttccaagttccgataagctgagttctagtaaatttcgtggttctgatcgtttcattatcgctggagtcagcagtagatgacagcaacaagctataccagtgtgcaacgaacgaagagaatgaacaacacacttgattattcgttttttcaagctacaataaccacagagttacattttcgattatttatttatttatttttattttgaatgaactgttaattcacacaaaaaaaaacaacatgttttacaagtatggtcatagactaaaaacagagctttacaaggacatagcatttgctgcggaatataatttaattctcgaaatatgaaagttgctatggaactgtgtcgtagttctcacccattattacaagtaaacgaagggactcgtcattttcagggtattatctaaactttcaaacattattgacattttaccatcgactatgtaggtttagggaccacttattagtttgatggattcaacattagaaaaatcgcagagaaacttcacttatctgttcgaacgggttagaaacagatacatgcgtaattactaacacaaagatcacagctataatctcgtaaggcaaa

SEQ ID NO: 3557 - DNA, 3000 bp, Unknown; identical to SEQ ID NO: 3194
  misc_feature (1)..( 3000): cDNA_ID_1807311_gDNA_ID_1620651_Annot_ID_47749 3000 nt of promoter + ATG

SEQ ID NO: 3558 - DNA, 3000 bp, Unknown; identical to SEQ ID NO: 3215
  misc_feature (1)..( 3000): cDNA_ID_2134228_gDNA_ID_1620651_Annot_ID_163476 3000 nt of promoter + ATG

SEQ ID NO: 3559 - DNA, 3000 bp, Unknown; identical to SEQ ID NO: 3556
  misc_feature (1)..( 3000): cDNA_ID_1821133_gDNA_ID_1620651_Annot_ID_163472 3000 nt of promoter + ATG

SEQ ID NO: 3560 - DNA, 3000 bp, Unknown; identical to SEQ ID NO: 3555
  misc_feature (1)..( 3000): cDNA_ID_3071384_gDNA_ID_1620651_Annot_ID_163471 3000 nt of promoter + ATG

SEQ ID NO: 3561 - DNA, 3000 bp, Unknown
  misc_feature (1)..( 3000): cDNA_ID_3071396_gDNA_ID_1620651_Annot_ID_163468 3000 nt of promoter + ATG
tttcttcgtctttttcgtcataagcttcagtgcaatttctgtttctgcacaaacttgtgacaatactactgggactttcatacccaatagtccttatgataagaaccgccgactcatcctctctactctagcttctaacgtcacggctcaggagggctacttcatcggttcgattgggattgctcctgaccaagtctttgccaccgggatgtgcgctccaggttctgagcgtgatgtttgctctctctgtatcaggtccacatcagagagtttactacaaagctgtctggaccaggcagatgctttcttctggtcaggtgaagaaaccctttgccttgttcgctacgctaaccgccccttctctggattgctcgtcatggatccactaggagcgatattcaacacaggagaactcaatacgaatcagactgtgtttgatatcgagtggaataatttaacttctagtatgatcgccggaataacttcttcttcatcaggggggaacaattcgtctaagtactactcagacgatatagctcttgtgccggattttaagaacatatcagcgttgatgcaatgcacaccagacgtttcgtcagaggattgtaacacttgcttacggcaaaacgttgtcgactatgataattgttgccgtgggcaccaaggcggcgttatgtcaaggccaaactgctttttccgatgggaagtgtatcccttctctggtgctattgatcagattaatttaccaaagtcaccgccgccttcagttacatccccgtctcctatagccaacataaccaagaatggaaagtccttgttggaacattttcagaaaattgtcttgttttgtttctgtttgtttttttttctttttttggtttttgtgtatttatgcttttgatgagttgtgttttgtgcagatagtagaatatcaggaggaaaaatcgcagcaatagttgttgttactgttgttacaataatattggttgttttaggctttgttatttccaatagaagaaagcaaaagcaagaaatggatcttccaagtgagttttctttgtttgtttgttaaaaccttgattgttttcggtcatgagaccttatactttgaagtggtactttttcacgagcttatttatggtttcaaatgaagcggaatctgttcaatttgatttaaagacaattgaatcggcgacaagcaacttttccgaacgtaacaagcttggtaaaggtggattcggtgaagtttacaaggtaatatataggatctttgttgtccatctagtttgcttcttttgtggagaataggctatgtgcttaatttgttagtattttcaagggtatgctcatgaatggcactgaaattgcggtgaagagattgtcgaaaacatcaggacaaggtgaagtagagttcaagaacgaggttgttgttgttgcaaagcttcaacacataaatcttgttagacttctcgggttttcgctacaaggagaagagaagttactcgtctatgagtttgtttcaaacaaaagcctcgattatttcctctttggtatgtaatatttaactaaaaacagtttcctctttggtatgtacgttttaactcatacatgtataagtatgcagatcctacgaagagaaatcagttggactggacaatgcgacgcaatatcatcggtggcattactcgagggattttatatcttcatcaagattcgcggctgaagatcatacatcgtgacctcaaagcgagtaacattctcttagatgcggatatgaatccaaaaatcgctgatttcggaatggcaaggatctttggagtggaccaaactgttgccaatacaggaagagtggttggaaccttgtaagtatcatcttaaaatggactttgagatttttgatcattagtttaagagaccttttttgacttccagtttataacctctatttttcagtggttacatgtctcctgagtatgtgacacatggccaattctcaatgaaatcagacgtctatagttttggagtattgattcttgagatcattagtggcaaaaagaatagcagcttctaccaaatggatggcttagttaacaatttagtcacatatgtgagtcccaaactttatttgactctcttaaaagttaaaacactgatcatagttctgaatgtgtatatattctacaggtctggaaactttgggagaacaaatcattgcatgagctcttagatccctttatcaaccaagatttcacaagcgaggaagtcattagatacattcatattggactgttatgtgttcaagaaaatcctgcagatcgaccaacaatgtctacgattcaccaaatgctcacaaacagctcaatcactctgcctgtgcctctgcctcctggatttttctttaggaacggaccaggatcgaacccgggtcagtcgaacagcaagtcttttgcttgttctgtagatgaagcaacaatcacggacgttaatcctcgttgaaaattcagcatttggttttttcttgtttccacaaacgtctatcatttatttattgtccgtttatgaaaaagtttacaaagggtcattttttcaggttgaagattcaaatttgaagtttctatattagtcaagcatgtctacaatagctcgagtgctgactattataatttatagtaattgtaggaccgatcattagtgttagtcctcgttgaaagttaggccaatctaaaccctttatcaaaaaagaaaaataagctttggccaatgttgactttatattcttttataagggtaaaaccgtaataataaatattgacttagagaatccaactacgtcttccccttaaaatccaaagtagtcaatgtctggttaatgaggatgggtcattccgtcgttcgagtagaaaattcagaagttatgggccatattaatgataagaaccactagtagtaaccaacaacaacaccagtcacacatttttctaaagaaacaaaaagaaaatg

SEQ ID NO: 3562 - DNA, 3000 bp, Unknown
  misc_feature (1)..( 3000): cDNA_ID_3071400_gDNA_ID_1620651_Annot_ID_163467 3000 nt of promoter + ATG
caaacgtgtttaatggacaaaaacatatgcatatattcatacatgcttacttacttgctctcctaaacccaaacaaaatctctatgatattcataatgaaactgaagaatctcttgccaatcttctgttttttccttgtaagcttctctatttcatctgcacaaaaatgcggaaaaactggtttatttaaacccaacgataagtatgatataaaccgtcacctcctcctttcttctctagcttctaatgtctcagctcgaggcggcttctacaatgcttcgattggacaaggacctgatcggttgtatgcttctgggacgtgtatccaaggttctgaaccagagctttgctcagcttgtatcgactctgcttttattagggtgataaagaaatgtcacaaccaaacagaagccctcgactggtcctcctttaacgaggagtatccttgtatgatacgttactccaaccgttctttttttggattacttgagatgacaccatttttcaagaattacaatgctacagatttccaagtcaacttgacagagttttatcaaaaatgggaggctttgatgcttggtgtgatagctgatgctatctcgtcgccaaacccaaaattctatggtgccggcactggaaaaattgggattcaaaccgtttacgctttcgtgctatgcagtaaggatatatctccatggaactgttccagatgtttaagagggaatgtggataactataagttgtcctgcagtgggaaacctcgtggccatagtttcagcccgagctgttatatgcgatgggatctctatcaattctatggatttattgagtatagggcttctcccacgcttcctcgtgaaaaaggtagaatctcagaactatctgacggtactagctttttagtctcatattttcccttaagcgcaataatcgtaggtgatttggccttgttcagatggcggaaagatttctacaagaaatatcctcggaatcactgttgctcttgccttttttatcacggtactgcttgttctagggtatgctctttctaggaggagaaaagcctaccaagagtttgcaactgaaagtgagtttttttttttgttttaacaattatgagttcagggcataaacgtttttaaatatgtcaattcagttgtctctttctctgttcttcaacgatggttatatttctcttgcagggaggtcaatgaccacttatggtactgcaccgccagatgatggtaagagactatacagctatttgcattaaaactgttaatgtccctttggatacgtttccaccataacactatgtatatatgctttctgctgcagatgatattacaacttcaggttcacttcaattcgattttaaagcaattgaagctgcaacaaataattttcagaagagtaacaagcttggtcatggtggatttggtgaagtttttaaggcaaaatgttcttaaactttctcaactactagtttgtgttataaacttagttgccaaaaaaaaagataagaaattctgatagtgagtgaagatcatatgaattgacagggaacttttccgaatggaacagaagttgctgtgaagaggctgtctaaaatttcaggtcaaggtgaagaagagtttaagaacgaggtgcttcttgtagcaaagctccaacatagaaatctcgttagacttctggggttctctgttgaaggagaagaaaagatacttgtctacgagtatatgccaaataaaagtcttgactattttctctttggtaagaaacatatgatatataggattagattctctgaaacatttgtttttgatctcttacccatagtctaatggctctatacgttggatgtgcagaccatagaaggaggggtcagctggattggagaacacgatacaacataatcaggggagtgactcgagggattttatatctccatcaagattcacggcttacaatcatacaccgtgacctcaaagcgggtaacattctcttagatgtcgatatgaacccgaaaatcgcggattttggtgtggctaggaattttagagtggaccaaactgaagctaccacaggaagagtagttggaacattgtaagtaattgttaacttcaattacactctgtctattcccttttctttccctaataaaacttaaagtgatatgtgctgtgttttgcagcggttacatgcctcccgaatatgtggcgaacgggcagttctcgatgaaatctgatgtttatagttttggagtattgattctggagattattgttggcaaaaagagtagtagcttccatgagattgatggttcagtaggaaacttggtcacatatgttagtcctacaaagccaatgcaatcttgaacttatttttgacctctttaaactttgatacaagaatgaacattggtttattgtgacttaacaggtttggaggctttggaacaacgaatcattcttggaacttgtagacccggccatgggggagagttatgataaagatgaagtcatcagatgcatccatataagcttattgtgcgttcaagaaaatcctgcagatcgtccaacaatgtccacagtgtttcagatgctcactaatacttttcttactctgcccgtgcctcaattacctggatttgttttcagggtcagatccgagccaaacccattagccgagagacttgagcctggtccgtctactaccatgtcgtttgcttgttccattgatgatgcatcgatcacgagtgttgatcttcgttgagattagaggttaatgataatatgcatagcttttcataagccaaaaatctaatggtcactttcattataaactcttcctgtcttgttttcccacttaaaaagacaaaagcagttgacttatagtagtagtcaatcctctgtttcacgtaacagagagaagaagaaaatattcataataattaggagattcatgatctgaaacaaaagctgaggaaatcgaacaatg

SEQ ID NO: 3563 - DNA, 3000 bp, Unknown
  misc_feature (1)..( 3000): cDNA_ID_3071404_gDNA_ID_1620651_Annot_ID_163466 3000 nt of promoter + ATG
tttacaggcttggaggttgtggagaaacgattcaccattagaactcgtggatccaaccatttcggagaattgtgaaaccgaagaagtgacaagatgcatccacattgcgttgctgtgtgttcaacacaatcccacagatcgccccagcttgtcgacaatcaacatgatgctcataaacaattcgtatgttttacctgatcctcaacaacctggattcttctttccaataataagcaaccaagaacgagatggcctcgactctatgaacaggtccaatccacaaactatcaatgatgtaaccattacagattttgaacctcgttgaagttgctattccagtgagacattgttccatttgaatgattatgtatctaagtatctttatcattcctacgttgtaatatcagctctctgttttatgggagtcttgacgtataatatccaaaccggtcttatatttgatatgaatgttacttaactcggtttattttctaaaaacgatattatgtaaaccggaaactgatactctgtttttgctcaacactcagatttaggaattagggattatcattttgcttatctttagaaactgatgtctcggtcagctttgatcactgaaatttggttttaatttgtgtgtagacaccattgtttgctgcgttgaaaactggtttcgtcgaattgtgaagcagcttatgagtcttcgtttttttttgtctttaattcttcgtattctcatctctgatagcgttgctctgatttttccaatcaatggttgaattttccactttgttaaagtttttgtatttgtgttgaattatctctgcgttgaaaattctacgacgtgttcttttaagtgccacatgattcaggaattgcacgagtcaaacgaatagaaacatttgactgagaaacatgcgaccaacggttcaatgaaaacttgcgatcgaaatttaatggacgtgaatatatgcatgtacaatgcaaacacaattgcttgctgtcctaaaccaaaacaatatatgatcttgaaaatatatttaaaatcttttgttttctccttgtaggctttcctgttgtgtttgtaccaagcgggaaaactggcgtttttacacccaatgataagtatgatacaaaccgtcgccttctcctctcttctctagcttctcatgttgtagctcgaggtgacttctacagtaattcacttggccaagtctatgatcgggtgtatgctttggggatgttcatctcagttgttgaaccaaaggtttgctcaaactgtatcgaccttgcttctaaagaggtgttagaggaatgtaccaaccagacagaaggcattgcctggcccgaaaatgggattctttgtatggtacgttactccaaccgttcgttttctggatcacttgagatggaaccaaagtatatatgcatgtacaatactggagatatcggatccgaaaactttgataacctgtgggacgacttgacaagtcgtatgatagctggagttatatgatcgttttgtgcgtgtttgtaacatatttatactatctataaaaaggttttcttaaaaatggggatggtttgatgatataaggttttgtccgaaccgcataacttccttttccggtaaaaggttggcaagccggatatcgagattggaagggacagtgctgagcatggacaggtaaggggggtgagttttgtgctttaacctcaatccgcttgtgcgaagtactcgtcacatgtacgattctagccgggctatttctagcacggttcatgatcgctacatacaaagcctttttattttattttaattatgtaatctcaagagccgtttatgtttctgtacaatattgtgtgatcactaccaaatgatctgagtgtatgccatggtgatgcttctataaaccctataatctcttcaatcttgtgtgactaggatatgcttggtagttctataaaatggtgtacaattcaatttttttttgggtttggtttgacatgggagtatgtgataggttcatcactctggtaacgtgctacacaagtaactgaatcttttttgcaaaaccaatgaaagaaggatatactacaaaaccggttaatttgcaaaaccaatgacacaatacatagccctctgcaacgatcatctgatcttctgcatctgcctttgcttcgtcaggtttggtgataggagacttagaagtttttgggttcaacggttaacacatatggttaggaatgatgatgaaattcaacgttttccactagcccaaaaccattgacttttgtcgcgggtccgtttcacgccgtatatgtcgaacatggagggttgaaggaccactgttatcagtttgacgaattcagtatttagatattttcagagaaactcgatttcttttttagtaagctataaaaaacgcgtaaacaaaagacaaagaattagcgattaaaaaaaaactagggataatcttttaaagaattaacgcttaattatatctaaatcattaactgaatagttcattattcacgtcttattagcgaatggagatagtgcgctaggttataataggagctaaggtaacttagagctcacgaaagagtaaggactcatcaggaactggtggctgactggtgctttttaaggggtttgttacgtggcaattgcgacgtcttttgaatgcgttttggttttaaaggtaagaaattggttaggaaaaagctacgtaatttggccgtggatgagtgttaaatgttaatggtacctcgaccccagcctcctgacctagtacatatctacattattatttgaaaggatttaaacataataatactgtatgaacagaaaaaaatgaaataagacttttgattttcatcttttgttttgtgacatttagaaagtttctgagaaacaacaattgctgtttaaattgctaaggaacgaacagatgtttaaacactaaaacaaagctataatctctaaggcaaaaaatg

SEQ ID NO: 3564 - DNA, 3000 bp, Unknown; identical to SEQ ID NO: 3551
  misc_feature (1)..( 3000): cDNA_ID_3071414_gDNA_ID_1620651_Annot_ID_163461 3000 nt of

SEQ ID NO: 3565 - DNA, 3000 bp, Unknown; identical to SEQ ID NO: 3550
  misc_feature (1)..( 3000): cDNA_ID_1822829_gDNA_ID_1620651_Annot_ID_163459 3000 nt of promoter + ATG

SEQ ID NO: 3566 - DNA, 3000 bp, Unknown; identical to SEQ ID NO: 3549
  misc_feature (1)..( 3000): cDNA_ID_1822833_gDNA_ID_1620651_Annot_ID_163458 3000 nt of promoter + ATG

SEQ ID NO: 3567 - DNA, 1057 bp, Unknown
  misc_feature (1)..( 1057): cDNA_ID_1821121_gDNA_ID_1620651_Annot_ID_47750 3000 nt of promoter + ATG
ttcatatttcaaaattgggaacaggatagtggcacgggaaattggtggtttgtatttaaagaggagattattggatactggccagcatcattgttcaagtcctggatggaatctaacagcgcaaattatgcatcttggggagggcaagtgtatagccctatcagagagaagagtccacctatgggaagtggtcattggcctagtgagggctttcataaagctgcttttattagtggcctcaaactcttcgatggtcacgggaaagtttataatccaggacgcgggacagtgaaggtacatgagagcagaccaatctgttacaaagccagatatgttcatgatgttgataaaccttggttaaaatctgtttactttggaggtcctggagggtgcatagggtaattgatctacgagataaagagtaacaatatcataagattttaattttacacaggctataggaaaaatcaacagatttgaaatatatctaagcattacttgcgctctaataaataataataaagtattagaaattcacaactttcagcacaaatttctatagtttattgagcatagattgatagctaactcaccttaaagtacattaaaaataaaaatctcattctcaactgcaaaaaaatgttacaaagtcacatatgttcatgatgataaggatccttggttaagagctatttactgtggaggtcctgcaggatgcatttggacataatatatgatatgcagagttacaagataaatcttatatatgtttgtatgaataataaagtttccatgaatcctcccaacttttttgcaataagtttgatgtttatgcctaattgtaaaaatgtcacaatctaatcatcaatttacaatcctttctaatacagacataatgataaccaaaaatgtgggttctactgttactgcatttgtctgaaacatttctaaagcctcttttaatcatgtcttaaatatatatacccctatccatagcatagcttgcccctactcataacctctaaactctttagacaactaaatatataatataatg

SEQ ID NO: 3568 - DNA, 3000 bp, Unknown; identical to SEQ ID NO: 3486
  misc_feature (1)..( 3000): cDNA_ID_1820873_gDNA_ID_1620652_Annot_ID_47751 3000 nt of promoter + ATG

SEQ ID NO: 3569 - DNA, 3000 bp, Unknown
  misc_feature (1)..( 3000): cDNA_ID_1821247_gDNA_ID_1620652_Annot_ID_47753 3000 nt of promoter + ATG
ttcattctgcatcaatcatatattaattgacacatccattcatcatccaaaaatatttatatgtatttcttttgagaaatttccaatgccttaccaagtcttgccaatagtgatatatccctgtaatgttccgtttcctccactctttcaggtcaaacatattcatcccaaatgcccacccacaagcaccagcgtcaaaattctctgaaatctttggatttgagaagttgaggtacttgtcaaatctgtggaagctctccttgcacgtctccaccgcaccattcacttttccttgcatgtctatttcccatagtggtgccaggtccttctgcaccacaatgtcatcgtctagaaacagaatcttctccagcttcggataaacctcaggaaggtagaatctgagatgattcagcatcgatagatactttgggttgcggtactttagattatctgcgccagctgagattgatgaaggatgatttgctttgaaatagtattctttcagccttgcagattcaagctgccgtagaacagagcagtaagaggagttcagccacttgaaatcatttatgttttcaacttgaatcgtcgcatcagcaggagcattgatgcgaaaccacatcttcattgcaccaaaattcagtttgtcagttactatatggaacacatgcctctgcggttcctttgcattcaagacagtggagttcaccaccactgatgtagccagaacgttatccgaaaagatcgcatagtgatagagcgaaggatcttcaagcttcttttgactgacatcctctttcactgcatcctcttcattgaaacctagaataaaatagtctgccgctagctgcagactcaggcaatgcaatggcttgggaaatgttttggcagctagctgaattaagaaggttccctttttcttcagtccatctactttgcgttcagtggactgaaggatggcccggaacttttttgcaagttcatggcagtcatataactcgtcttttgcaagagagagtgcatggcccatggcttttgcttgatcaagagcgctagcaaagaaaatgggatggaaaaagtttcaacaaagattgttgtcccacaaagattgctgacaagaggaatgtaaaaaagtaccttgaaggaaggtcagcatcagaggttgctttacctataacacgtttattttctccacactgctgcatcaagaaaacgtacagattggttacattttttgatttggcaatatttgcatatgcttttgccattatgatctggtctctcataagcttcaagatagcatcagcatttgggctctcatagtctctcctccatatactgtatttccctatgactgagttttcaaagctcattgacttctgaatggctgcttcttgcatctgctcatcagtttccttttcttgtcggatcagctctaaagttcgttgacctctcctttcctgacgtaaaatctgaaagggtctacagttgttacaatctcagtcatatagtgttaaggcatccagagattagaaaagaaggctatttgacagatcacctgccgcttcagttttgctgggcttgcaaaatccacgtttggaaactgattttcgctttcatcagtctgattagttgtagaatggcttgcattatcttccattccagtatcattttgaaatgaatcccgtggtataactagctaattccatacaaaaaaatgtcagcaactagagaacaaagaatatgagcaagcttaaggataaattcaagaaacacaaggttagaacaaatgaagttcatgagaggtattttttgctcggtgagaagagtggtaagtaatcacttcacacactttaagttttctactatagaactccatatgcccataggatatacagttctattcttaaactgatgatcaaatctcattaaaactaaaaaccagaacatgaaatgtttggtacctgcgaaccttttgttttgcggctaacttgataggcaggattctccaaaacccaagaaggtgaaagatcccccattttcaccctaccaaggcgtatattgccgtaatggtcactgtatgtcgcaactatgttcacatcctgagataacagctttattagaagtaggaagcatacaaattgtattcactactcagagaaagaggactgcagccttactttcagatctggatcgtagtgcactgcagcagctgaggaagcatacacctcctaaaggcaaaagtggataacaaaaacttaatcacagcaaagtctgatatttgaaccaaataagttatctggagaacaagaggagaatgggacctgtagattattatcttgcagcggacgataagctttaagttctctgtggctgcataaggaaacatcatggcaaaaagaagaaaagagtataaaaataaaatagaaacagtgtagccaaaagacaagcttcaaggagatgtatcattacggtgcttgtgactctaaaatggctccaccgacatgaacagcatgtagcactactacctgcaaatcgtcgacatgtcaaaaaattaaggcacaatttgatcagatgatccattttaagagagtagtgcgaattccaggacgagctaagtaaatatagataatcatatcgaacggagagagaacaatcaagctaggtaccagcgataaaaaggcggcgcatgtagagaacgtcgtcatctggatctgactgatattaccacatcgccggcgagctttctttaaagcaaatcaatcaatcgagaggtttgttaaaacctgcacgtgctgccgtttcgtggtaagaaaaactacacgcagtttctttaagtagaagacggagaaaaaaaaaaaaaaaagagacgacgactttgattagagcagagagatggttggttcgttggttcgtcggaggagaagagaatgtgcatagcagtatttctgtggcaatcgcatccgctgtacccttttcttctatttctcaacagagatg

SEQ ID NO: 3570 - DNA, 3000 bp, Unknown
  misc_feature (1)..( 3000): cDNA_ID_1821243_gDNA_ID_1620652_Annot_ID_47754 3000 nt of promoter + ATG
gaggactcgcctcttctcggcaagggacctcccctctccagccagtttaagaccttcgccaacgtcttcatcgctgtcgtcggcgctggtgttcttggtcttccttacgccttcaagcgaaccggatggctcatgggtgtcctcctcctcgtctccgtctctgttttgacccatcactgtatgatgcttcttgtctatacccgccgcaagctcgactctttcaatgctggcatctccaagatcggctcttttggtgaccttggattcgccgtctgcggctccttggggaggatcgtcgttgacttatttatcattctgtctcaagctggtttttgtgtcggatatcttatcttcatcggcactactttagctaatctatccgatcctgaatcgcccaccagtctgaggcatcagtttacaaggctgggttctgaattcctgggcgtgtcttctaagagtctctacatatggggatgctttccctttcagctcggtttgaattcgatcaagacgctcactcacttggctcctctcagcatcttcgccgatattgttgatcttggcgctatggctgtggtcattgttgaggattccatgattatactcaagcaaaggcctgacgtggttgcctttggtggtatgtccctcttcttgtatggtatgggcgtcgctgtctattccttcgaaggcgttggaatggtcttgcctcttgaatcggagatgaaggacaaggacaagtttggcaaagtcttggctctcggcatgggattcatctctctcatatacatcgcatttggtatcttaggttacttggcttttggtgaggacaccatggacattatcactgctaacttgggggcaggacttgtcagcactgttgtccagcttggactgtgcatcaacctcttcttcaccttccccttgatgatgaatccagtgtttgagatagtggagaggcgtttctcacgcgggatgtactctgcgtggctcagatgggtactcgtcttagcagtgactctggtggctctttttgtgccaaactttgcagattttttgtcattggttggcagcagcacttgctgtgtgttaggctttgtgttacctgcattgtttcatttattggtgttcaaggaagagatggggtggctgcaatggagttcagacacagcgattgtggtactaggtgtggttcttgctgtgtcgggaacttggagttccctgagtgagatcttctctgtcaaagtgtgagcgtccgtgaagtcagagattggagaggtttttctctccttgtgtgcaattatgtatatggaattggttgtggttttaagagtaactgtgattgtatttgtattttgatggtttggaataaaagagatcagctctgtcttctgttttgtgtttacatgtacaacatatgtgagagttttgatttctcaatgttacaagcaagggaagctcgcgaaataagcctggctagctaatcaaatgctttggttttgtattattacaaactgttgagtgtgttccttccatgaatcgccttcttcaagatgcctctcgtagaagcaaatctcaccatcaccaccaccatctccatgggacttgacgatgatcgcagagatgcttctggtcccataacgcccctgtatctccatgagtgagactgaatatttatggaaagtgttaaacaaacaatcaatgtactctaaaaaaggaaggttacagttggtctctgcatgtcgacgaagatggagctgagatggtattccgtctctggtgtgaaaacgtgaggtagctcggtttcttcgtccttgacagtattggtcatcacctcctccaccatggtcttcaccgggaattcaccgctcccgttctcagccagaagctgttggaaaccctccctcagcctcagacactgcagagacaaaaacacgcaattgggggagtctgcaaaaggtaaataaagggagaaatggcccacatttacttaccttgggccaaggggagtcgaggttggcgttggaaaggacatggatcccgggagagacttgcgtcacgagcttgtcaccgtggggtggtcggttggtaatgtaaatcatggatttggacaagacatgagcgacaaccaggttaaagccattgtagagtgaaatttcgtcttggatctcctcggcaaactcggccggactcttttcgctctgttctcaccaaaacgttaaaagtactctcagtctctaacatgagagacaatctaaagcatattaggtggtggtgtagacctgcaagtaacgaagaggcagatctccacgggatttagcagcagggaaggaggaggcttccttgaaattggtgaggaaagccagacggccatgcctcgtgcagcccagccacgtcccgccgccaacaaggtctcttcctcccaccgtctctccgtcttcccaccaacgcagcgcctctgtcgcccttgacaatttacacaaaagattagtacaatctcatcaaaggaaacgattacagaggggattgaatcacctgttgtgatcttcatctctgttgagaaatagaagaaaagggtacagcggatgcgattgccacagaaatactgctatgcacattctcttctcctccgacgaaccaacgaaccaaccatctctctgctctaatcaaagtcgtcgtctcttttttttttttttttctccgtcttctacttaaagaaactgcgtgtagtttttcttaccacgaaacggcagcacgtgcaggttttaacaaacctctcgattgattgatttgctttaaagaaagctcgccggcgatgtggtaatatcagtcagatccagatgacgacgttctctacatgcgccgcctttttatcgctggtacctagcttgattgttctctctccgttcgatatgattatctatatttacttagctcgtcctggaattcgcactactctcttaaaatggatcatctgatcaaattgtgccttaattttttgac

SEQ ID NO: 3571 - DNA, 3000 bp, Unknown; identical to SEQ ID NO: 3485
  misc_feature (1)..( 3000): cDNA_ID_1821240_gDNA_ID_1620652_Annot_ID_47755 3000 nt of promoter + ATG

SEQ ID NO: 3572 - DNA, 3000 bp, Unknown
  misc_feature (1)..( 3000): cDNA_ID_1821237_gDNA_ID_1620652_Annot_ID_47756 3000 nt of promoter + ATG
taatggcaaaagcatatgcaaatattgccaaatcaaaaaatgtaaccaatctgtacgttttcttgatgcagcagtgtggagaaaataaacgtgttataggtaaagcaacctctgatgctgaccttccttcaaggtacttttttacattcctcttgtcagcaatctttgtgggacaacaatctttgttgaaactttttccatcccattttctttgctagcgctcttgatcaagcaaaagccatgggccatgcactctctcttgcaaaagacgagttatatgactgccatgaacttgcaaaaaagttccgggccatccttcagtccactgaacgcaaagtagatggactgaagaaaaagggaaccttcttaattcagctagctgccaaaacatttcccaagccattgcattgcctgagtctgcagctagcggcagactattttattctaggtttcaatgaagaggatgcagtgaaagaggatgtcagtcaaaagaagcttgaagatccttcgctctatcactatgcgatcttttcggataacgttctggctacatcagtggtggtgaactccactgtcttgaatgcaaaggaaccgcagaggcatgtgttccatatagtaactgacaaactgaattttggtgcaatgaagatgtggtttcgcatcaatgctcctgctgatgcgacgattcaagttgaaaacataaatgatttcaagtggctgaactcctcttactgctctgttctacggcagcttgaatctgcaaggctgaaagaatactatttcaaagcaaatcatccttcatcaatctcagctggcgcagataatctaaagtaccgcaacccaaagtatctatcgatgctgaatcatctcagattctaccttcctgaggtttatccgaagctggagaagattctgtttctagacgatgacattgtggtgcagaaggacctggcaccactatgggaaatagacatgcaaggaaaagtgaatggtgcggtggagacgtgcaaggagagcttccacagatttgacaagtacctcaacttctcaaatccaaagatttcagagaattttgacgctggtgcttgtgggtgggcatttgggatgaatatgtttgacctgaaagagtggaggaaacggaacattacagggatatatcactattggcaagacttggtaaggcattggaaatttctcaaaagaaatacatataaatatttttggatgatgaatggatgtgtcaattaatatatgattgatgcagaatgaagacagaacactgtggaagctgggatcgttgccaccggggctgataacattttacaacctgacgtatgcaatggataggagctggcacgtactagggctgggatatgacccagcgctaaaccaaacagcaatagagaatgcagcggtagtgcattacaatgggaactacaagccatggctgggtttagcattcgccaagtacaaaccgtactggtccaagtacgttgagtacgacaacccttatctccgacggtgcgacatcaatgaatgaatgaagagatggtggaggtagtatacatgatgaagcactcaaaggaaactaaataagtaaaaattgttttcagtttaccataatactaggaatcagcagacaatcacacatgacgattaattaaatagaatctcttgtttttctcaaactcagaaaaactcaccaaaggaaactgaacaatcttttcactcggagtgttgttcttcacttgtttttttggtatcaacgtgactgaaaagcatatgggccttagaatgcgatgctttgtctatatacagtgtgtacagtgagtaaaactgccccgtgaatgcacataatgggccttacactggcccatcattgctttactctcctctctagctagcgacgagatgagtaaaacgccatctctcggagcggaacggctctgctctgctcttatcctctgtctgatccgtctccatcaccatctccgttctacaggtaaattgttttgcttcgcgctcctccgattgattattcactgatcagattctaataattataatcctgagtcctcgtttggttgatgttgaagcaccgcagatcctctttgaacttgttatttgtaagcttcttcttagtttctccttaatcgcagtgaaatggagattccggaggggacatcaaaagattcagaaaaggccaacgaacaagattcagtgtcatcaattggggcaaagaaacctccactggaatctccagccactactaatgctgcaagcggtcgacttgtttatgtccggagaagagtggaggttgacacatccaaagcagctgctagcactactaatccgaacccgcctcctactaaggcaccacttcaaataccttcatcacccgcacaggaaccaacccctaccagccataagttagactgggaagagcgttaccttcatcttcaaatgcttcttaacaagcttaatcaatctgatcggaccgatcatgttcagagtaagctcctcccagtatcactctaattcctaaccttgatgcttctgtttttttatatatatatatgtttccactgttattagtgctttggtcactttcctccgccgagcttagcaagcatgctgttgacttggaaaagaggtctattcagttctctctcgaggaaggtactctactcctttacttacactctctcacttcctaccattgctgaatcatatctgtttggcacagttctagttgaccatccataagtggattattcatgctgctgcttaagccattttttccatatctgctgacaactatagaggttttagtcacatgcttttaggtttgtagctaggaaccatctggaatcaagttcatgctagaaataatgttgttgatcctctgttgcagcgagagagatgcagcgcgtagcagctttaaacatgttaggaaggtctgtgaatagtctaaaatctacatcaaatgagtgaagggaa

SEQ ID NO: 3573 - DNA, 3000 bp, Unknown
  misc_feature (1)..( 3000): cDNA_ID_1821233_gDNA_ID_1620652_Annot_ID_47757 3000 nt of promoter + ATG
attgcatgtttaaaccggaacattgaaccgattcgcagccgtgacgtaaaccggtgaaggtgaaagtgaaagaaggtgaaaagatagagaagtaagaccagacgagggtaagagacatgaaagctccggcgagaaagataacaccatctgataaacaaacggtggttctagtctttgacccgccgtgttttcccatcggagatgatgtcatgtgactgagaatctacaatgcagtgattagagatgatgagaaatttcagtaaaactctgagaacagttgggtgatgaagtaaaaatgtgagtcaactaaatgtatggtaagataaagggattattataattctgacacagatttaacatagtttttagtttttctcctaatataaaattgatattactatcgaaacatttatggcaagtgttaagactttgaactttgaagtcaggttattaatgcacacgatttatgtatagaatataatcgtttgagaatttccactaattaaagttctctctaactaattatttccatataaatctgagccataatgctcaaaaatattaaaaggataaatatcatttacatatattttttttacaatttatttgaattttttttccttctaaaagctttataagtatccagaaaccagaatcacaatcgttgtttacagcaaatatatatattttacagaaacaaatgaatttctaaattaattacttgaatgctaaatatacttttaatataatttgagttccgtcaaagcccatttatggcccacgtataaacgtcgccgtttcactccgactcttcacctccgaccaggaagtaatcccggaatttgtcactccggtgaaaatggaggcctctggcctctgctgtttatgcattctggcaatttttttttcttctcttttcgcctagaatctcgtgtttttgggatttagctaagattttaagctatactgtaagatttggctctcttattaatcgcattggtttagattatgatctctgtgtggaatcgaatcaaaattatcaatctggttcgttggaattggatagtgaaagtgaaacagcgatgggttttatgggtttacattggttttgaaattcaaattgatcttggttcggtttactttggtttagagaagaaaacaaaaaaaaataagacacgcgacgggtttttgagaatgaggtgcgtggatcgaaaaatgaatgatttttgtggattaaccccctttagaaatcgtagacacgcgctcaacgcgacatgggtgagagtgactgtgaaatggcacgatcggtaaaagtggggtatgaagtggagctctctcattggctaaaaaactaaaaatagtagacatatagctcctatcctcctcctctccttttgtcatttttatattagcccctgctgagaatgaaattcagattttattcaatctgaaagttgtgtgtgttttagatacaattgaaaaaaaacttgaatctggactttgtgatactaaaaaatttcctcatcattttgttctgcagccatttttacaggttgaagcttataactgaaaacttgattcaaagaatcgcagctgaagaaatcaaactaagtgagttgaatattttctaaacatgttaaatatattggtacaagtttgtccaatcattttgctgaaattggtacaagcttgtgaaattgtagactctctcttttgtagcaatttaaaaatctcatctcttcaaatctatatataaaacaggtggataacagaaaaattggtactagagcctttgtcttctttatgattctctgatactttgaaaaaccgttcacttgactaacctgcgagtgaatttcccttgagtagttacttatgtaatcttctcatgatgcagacagctaactcaaactccttagttactgtcttctaaatgcagtttaaatttcttgcatttgcttccttctagagcttcttttcagccactgccaccagcattgagatgtgtcgtttatcaaactagatacatgacactttcacattattgaagtgagtagccttgagacagttcatgcagcacttgcacttgtctcttccattttcttcttctaagaatcccactgaatcactccaataacctcttcttagcttactcagccctaaaaaacataataattcagaatcctgcaacttattctaggatctgcaacttagtttcgaaaacctgcaattctctagagatctgcaattcgtttctgaatatcttaaccaatcaacgaccttcaaacaaatccgtaagagtccttttacccacagatttataacctttgaacttgttcataaccagttattcttggctttcctttcttttggtaaactgaacttccatgaatctttatcaaacattttctgcagccttttgactcatccattgagctacatacctaagacaacctccatgaacatagcttcaccagaaactaaaaaaaaggatgtcactttgtctttgtaagctcagcttctcttctatgagttatgctgcatgctcttcactgtttctttgattcactcacacgttctaatgtatccgaatgagtttctgtgacataactcttaagaaagtgtgccaaaacgtgtgacacatctcctttcttcatgtagccactcaatctaattcttttattcccaaaagaaccaccaagaacttttctttaataactgcaaccttgtcctctctttacatggagcattcttcatgttttgatgatgatatagcttaagctgatgtatcacaaaacaatgccttaatctcagacaatctcttgtactctcttgtagctgaaatgcaactcatacttgtcttgtaccgctgttaagataaacaggacacgctgcctaactcttctagctaggaagactatcgacacaataatagtttaccatgttgcataatacacacactcatttctaacatcaaaatcgcaaactgtattctttatg

SEQ ID NO: 3574 - DNA, 3000 bp, Unknown
  misc_feature (1)..( 3000): cDNA_ID_1821205_gDNA_ID_1620652_Annot_ID_163497 3000 nt of promoter + ATG
ggtcacgagcacagaaagagtccttcccagaacaaatccccctataattcaagtcaagtttaaaacctagaaatatcaatacagtgcttacatccataagtcccataagggagaaaccagtgtctacatacctgattttaggtaatcgccgaactttagtgacccaatctttggaggaagcagtataactcttttgttcaagagtataagcatcaaaatggcaacagtgtacctatgaatcagaggaaaggggtttagcaccatcctacaaggttgaccaaaggaggaaaacaggaaaagaaaaaagatctatggatacatactgggagatgacactagagattgctgccccggctacacccatcctgaatttgtatataaacagagggaatagaaatacagccagaaaattaccaatacctgaattatggaaattagggaacgaaagaactgatgtaaaccgagaacaataaagataatctaatgttcttggatatgtaacaagatctcaaagaatgctaacctaaacagtagactggagtttttgtatccttgaatccacgaaaaatgccttgaagtgctaaggaaaccacataagcaggagcaccaagcgccctaaggacaagaaactgccgcgcagggatgaacatttctgacatctgggtttcaggtaaaaaaaaagacagaaaacatgcattcctcagcatagatttctcacgaaatttcgtaagacatagaagacaataagcactctctggaccgaacttacagattgtatacccattaaccttagaaagggtccagatgccaaagacaatgccagtgcctcgaagatgccaattccaatggctaacactagcgctgttgacactgaagataactgtttcctttctggtaaaccttgagaaggtatgtcactctgactatcttctgtaaatccattcaaagagatataaggctgggaaaaattgggaagagaaaaaagctattatcaacgtatacctgaggctaaatcttgagcggcaatctttgcaatatcttcagcgacgaaagaagtggcaacgctgaggagcggaatgttgaagagctttgatatggtattgaaaatggccatggaaacgccagctgaacccaactctacagatcctgcatattggaaagaaggggagtccttagaactctcaaaacaacatcttccatggtgaaataactctagagaagcaaaggaaaaataccgagccttccgatgtatgcagtctccattagcagcgtcaaaggatcaatagcttggccagcaatggctggaagagagagcatcacgagttctcgtttgatatcgacaggacgtgctacaccagtgtgaaccccattaacctccctagcaagaacggagaccaaagcattacataggcaagaaacgcaaagcaacatggccaaagagtaacaaagggataacgcaacacctcaatagccttacgggagtttgtccagtgaagagcaagagtcatcttcttcccccaacttgacgacaccgcaatcagggttagtctggctcttgcggcgagtaacaaaagggaacatggggtttggattggtgtgaagggagcatttttggggggcagagacattattgatccgagatagaggtagaaaagtcccttgttggattttgggtttggcaaagctagagttcctcctattcgccaagggcagcccaccacccactactactctactggactccatcacacacagacactgcaaaaacgaaactttactagttcgtctatatataattagaaccaaaagaaagaaagaaagcttcgaggatgataactgacctaaattccggttctttaggggaagaaaattggatgagcgtgggagagaaaagaaacgacggtgaaagaaactaaaacgatatagaaaaccgagaagaagacgatagtggcagaggagaagaaacgattcaaaaccgaaacttacggaatcgggaggatgattgagcggtgcgaaagagatcgtcgaagaaacagacagagagagagagggttcaatcaggggttaaccgttgcagggaggcggtttttgtttggggaagacgatggtaaatgggccttttgcttctctttagttaagcccattaaagcccactgacatcggcaccttattagaaacaagaaaaatatcttcttttctttttgtttctgcgtcccgttcggtcgtgtccaaaccgctctaagcatatctttttatttttgctgcgaaagtgcgagtgagtccctctcatgattataacaaacgatttttaataataaaagatttaatattgtaatgcatcatttttattcaaaaccaaattaaaaaaaaaaaaaaatgacttgttcttctctacgcttttatccttcttacatgtcatcacgtatgagatatgttctgctattgactcgaaacacatctttctaatattagctttttttgtttgacttcatttttttcaaaaagaaaaacctttttaaaactcattcaatgcttgacgttttaaatcccaatctttaataggataagtttgttttcagaattcaaaaaaacaaaattaagtcgatttcaattcatgataataatctaaacagctaattaacatttggcaaagtaacaataatataactacatttgaaagagagagcaagagattcgctgtggtttgcttatgcataagaataaagggaattaaaaaaaaccaaactcagtttttttcttcttttttaaaaaatttgtgtgtgtgtttgtttgtttgagattagtttggactttggagttttgttcatagtttctcggcaaccaacttctcctctgccttaacgtcatcgagaaatggcgtcttcttcctcttcctcctcctccttttgcactctctccttcccatttctcttgttttcttcctattctttgtagcctatcctccttgctttttttgtgtctgcgttatacaactcatta

SEQ ID NO: 3575 - DNA, 3000 bp, Unknown
  misc_feature (1)..( 3000): cDNA_ID_1821217_gDNA_ID_1620652_Annot_ID_163494 3000 nt of promoter + ATG
acgaagcaaaacatagaaactacctgctcgattctgtagaatggcgaaaggtgggtatcaaagaactttttctcttctgctgctttgctttcaggaccaacccacaactacaacatgtagaaattcacatgaacaatcataccagtatttgcagttgcttttctgctgaatgatttgtacaattatggtcctggcaaagttaatacataccttttctggtcgtgtttccaccttgaaattatagagacctgaacagagtgcaagaacaatagctactgacatgaagagaacaagagatggatttctagcaatccatgacccatatgatctgaggcaaacaattggaaacaattacgaatttcatctcatctaattgtagagataacttgcgagtaagatacagacaacgaaacaaaatcctggagattcacctgtaaaattttgccatatatctctgaacaggagagagttgagcatgtctttgcacctaagaattagaagtcaattgatcaattagttctttcctccaaacagattaaatcttcaaggatagtccagcatttatgtgggtatataaatgtattttatgttatatatacatacacataagaactacaatttctagccaatacattgatataccttgacaccaagtatgttttccttcatttcactattaattccatcttcttccacaggatgcaatagtggctttgagctatcaagaggctgtgtcgtatttcttcttcgatttaaaccagcccatccgaagaagcaagacaccagcaagacgtatacaagtgccattgataactcaatgcatctaacctgaaaatacaaatcaatataatcaaatccaagatcataccaactcaataatgttttcaagcaacaatgggataattcataactcacaccttaagaggaccgattctaattgagcaagaatcttcatcatggggcggcaggggttcgggacttgagcaagctggtgaggaagggcaatcaccacaagagcatccaagggatgtgtcaccacatgaataaacagatacattcattggtaccatcgcagatgactcagggatgcttgatttgaagttgatcgcatatggtgaaccaggaaagccagatggtgctttctgaccaataaacgtaaaccattctggaaaagcagaagtaaagatgaaacatggaacttttgaaacaagataaagcgtgtatggaacgccttagaacaaaactgcagagcacctctgaagtttttagcaccaccgccaacaaagttaattgcacgtgtgttcattgttccaaatttcacctctttacaggactcgtaaaggccttctccaaacgtatcagttatgtgatagtctataccatccactgtcaaatttccactcacctagaataaatcccaactagctagtgttgttaaccatataaatgggtgtcaagtaaccaacaaaagctgaaaaaaatggaagctaacctcagcaacagaagtgacgttgatgaaaagagactgatttggagaacaggagagctcgcagaacaaatttaagaagttccgtaagcatgcaggacaacccacaagaaaagggacagcctaaaagagattgcattgacaacgaattagtaaaaatggcctgctctgataatagcaaaaacaagagaataagaaaaaggtcatacctgttgaacttgagacctcaaagtgtcaaactgagtctctgtacaacagacattgccacttatggttgggcaaaggctttggattttggcagaaaacagttcatcaggctgcagaaaggaatgtcagattgactcagacatgcagaagtaattggaaaagtaatggtcttactccatgatctgaaaagttgtctacctgaatggaaggggaggcataaggacagttaaggacttttccatcgctgcggtgtccgcaaatgtcatacatagcgcaatactcttttgaatgtctattattactgagcagcagtacagattaccgaaagagagatgaataagagattgagaaaaaaggaaggccatatgtctcggtcactaaaatgcaaattaccttggttctgagtgggtcaggtttgcggtgagtaaaagtgagaaagtaaagagctgcaacatgacaatcattcccaattatacgataatagcatcgatagaagtcagaggcggaaatcgttcaataaaagcaaaggcctaataagaagaagcacacaaagtatatgcaatttgcataacgaaaaaacccagaaagaaaacataacaagtttttttttaaaaaggaaaatttggcaagaaacgctaggacaagacagaaaatgaagaggattgcctgtaagaggagaagcttggtaggaatcgccatgttttgtctgaagagcaattaagcaagcagttggggtttatttaatcttggcgtagtagttagttgcagagagattggattgttgactaaaattgaattggagagtaaagtaaggagagtcgggagacacgaggcaagaggaggacggtgatgatgagtcagtaccagtaacatctgcttgccgttttaaatgctaacaattgcaatgcatgccgtttttacgttttcttttaccatcaaagttagatgaaaaaaaaggcatctcttttgtcttgtttgttttttctcatcatcctctcatgggtcgtccattgcagacgtgagctcgtctgatcaaatcctccttggcttctcttcgttttctccaatccatttctttgtttataccaaacttcatgtcattaggtcctccgatcattcttcgaatcggtttttgtgtggcggatccagtttaatcatcatcaattcatcatcatcatcatcactggtcgcagctgaattcgattctttgattgggcttgtgggatgggaacttgttcctgatggatatattaaagtcttaccatctcctagctgctgcttactcggctcctgcgtgggcaagcttt

SEQ ID NO: 3576 - DNA, 3000 bp, Unknown
  misc_feature (1)..( 3000): cDNA_ID_3071442_gDNA_ID_1620652_Annot_ID_163493 3000 nt of promoter + ATG
ctttgaggagaaaaatgtggaacaaacttgtagatcaatattttgttaatctttggtgatccatctgcggcccctgacttcaaatccaccataagcttgatcactactgctctctcccccgctctctgcgctagtgtatcccgatttacgcctgtgctttttggttcttgtaactccactatcgctaaaactcccatttagaagcggatcatcaatccctcgaatcactctccgactgggtgatgatgacatgcaactatcgtccttcactcttctcttttccttgtcgtgtttcttaatgttctgggagatcttgtgcagtttctcattgaactttgtgatgctcttctccataggctccaccgcttgagtcactgtgaatctcacgtctttaacaatctacaacatttagcctctttgtgatcagaagctcttaatccaatgatcatttatttgtatgaaagaattagaagactcacgtattcaccaccaccaacgaaaacatctcgcatactttctttgatggtcataccacttctgatatcaacgtcaggatgtggtagacggacttttgttggtctctcactgtccctaatctcatctggatcaataggacagtcaacagatgcatagtcaccaagaactgaaacggatccagtaaagcggtctcccattagaccataaggctttgctgggaatacatacaggtgaacaacggaagcaatacccatctgcactggaccagcacaagtgttaagagctttaatttatttaaagaaaggaaaacagacgactccatagactgcttgttaataggaagcaatgaagaaaaagttttgcactcgtaaacaaagatcacacataatgtttaaccttttgcaggaattggtaacaacagaagacatttacctctatgcaaatgatgaaatcttgcacgctagtcttcaactgcaagctttgtgcaattgaacttttgaacaagccgagggaagagaggagagcaatggcaacaccttgccaccaagtgagaaacacaatcgacttaaatgttagaaatttagccagtggttggatgtgtgcaagctcatctttcgttgcaccatagaactgaaccagacagtataatgcccatgactgactaaaatttagaacaactgccaaataagggtacctacaaaaaagaaaacaatggtaagatgctgctatcttgatcacagtccatcatagatgaaactgattttcgtttcttaaggtcaatctgtatgttagcactgttcttgtcaaaattgtctcaacgtacccacatccccatttaaactctccttcacagtacacaccgaaggcttcaagaatcagagctgtgagggcagttaaagactttattatcatctgcaaaaggagagaaatagttaacttccacttcaaagaaaagagttttggagcaagagaaacaggaggcatttgtgagaaacatacatattgaacaataccaaacttaacaacttgataaaaccagggactgagcctccacggttttaagaataaattcataggaaaaggatgtttgatgattcccttttcatccttgtgatctaagagtggcgtcttaaagctcttacgcccttgtctttccataaactcgatagtcctttcttccccacctggtaaacaagtcaatttagaacaaagagcaagggaaagagaaagtaagtttgtgcgattatccttgtttcacaggtagaactacaagatgcggaacctaatcaatattagacataaaaaagagtgaaaatggtcataccaatgcaggcaacaaggtatctaccaaaacagtacatggcaaaggattcatagcagtctcgaagaatcccacagtcaacactgatggatggtttaacaagtgatgcaaactgttacaaacaaacacaattaggaacagatatcttagggaaacacattcagttgacgatccgttgacgagcacaatacaagtaaatattcgatgagattatcaacgctgaacatgactgtattattatgagtatgatacaggcttcttctacactttggcgataaaaaagtcaatttttttaggttcctaaaatcttcaacccaaaatacgtatcatcaaaacctcctgatttgcttaagaaaaaagtaactgaccgattcaatagaatagcaagggaccatgaggatgactccaatcaaaaacttttgctcctgagagagaagatagtagttaaggtaagcaaggatataaaagccaaagtagagggaatagaaagagagagagagagaaaacctcagggttcttgtaagtagaaaggtgatcgaagacaagaaacaaggaaagggagagggtgagaaccaaaaaagcaccggccataaagcttgcccacgcaggagccgagtaagcagcagctaggagatggtaagactttaatatatccatcaggaacaagttcccatcccacaagcccaatcaaagaatcgaattcagctgcgaccagtgatgatgatgatgatgaattgatgatgattaaactggatccgccacacaaaaaccgattcgaagaatgatcggaggacctaatgacatgaagtttggtataaacaaagaaatggattggagaaaacgaagagaagccaaggaggatttgatcagacgagctcacgtctgcaatggacgacccatgagaggatgatgagaaaaaacaaacaagacaaaagagatgccttttttttcatctaactttgatggtaaaagaaaacgtaaaaacggcatgcattgcaattgttagcatttaaaacggcaagcagatgttactggtactgactcatcatcaccgtcctcctcttgcctcgtgtctcccgactctccttactttactctccaattcaattttagtcaacaatccaatctctctgcaactaactactacgccaagattaaataaaccccaactgcttgcttaattgctcttcagacaaaacatg

SEQ ID NO: 3577 - DNA, 3000 bp, Unknown
  misc_feature (1)..( 3000): cDNA_ID_3071446_gDNA_ID_1620652_Annot_ID_163490 3000 nt of promoter + ATG
tttaccattcataatgagactttgaatgtttggacgtaagtgttgaatcatgtttcttgatgtatccttgtttaaagttcaagaaaccttgagtgtgtttgtgtgtgtgtgttctttgggatttgcaggcatttgattgggtttttcctgtttttggcactcactatatacactgcaacgaaagtaccgagtgtcgtggatcttcattcgcttcaacaccgtttacccgatttgttgaggaaaacagatctccacaaacttcattctgagctcatgtctcgccttccttctagtccatctagttggcatgtgatggaccttctttataactgtttgcctgaaagattttctcatggcaactacactgacatgtgtgttctggtaagaaaagactcaatctttctctctattcctgcagattactgtttcaaaatgtggccaagttcatgtctttgtaattgcattgcagcattctgtgagggaagatcttgcaaacttgatagctcctttgatcttcaggccaattactcgatggccgttttatgcatttctaggtggtgctatattctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcctggagtttcgggtggtgagggcgtctctgttctttggaatgggattctctggcttagctccgattcttcacaagctgatcatcttttgggaccaacctgaagcccttcacatgacaggttatgagattttgatgggtttgctttatgggttaggagctgtggtttatgcaactaggatcccagagagatggatgccgggtaaattcgatatagcaggacatagccatcagttgtttcatgttctggttgttgctggtgcgttaacgcactatagagctgggctatgagagatattgaaggatgttgaagatgaagattgaagattagatggaatctttgatgttttaaatcttgtttgtagtagcttcatataaaagttggattatgtaaagtcttatctgtaatcaaacgtttaattgtttcttttattcaacaaaggattcatattgttaatctgcatattactggttaaagaagctgaaggattcatatttttagatgattccagtcttgattgcagcattcaaagtatcataatctagtgtcaacctcatataagcctccttgtgaacctgacacaagcctaactggttccatcgcagaggatactttggttctgatcttcttcttgaagatttcccctgactagttggtatacatttcgaatgatccataagtgttgataaactacaagtacacaagtaactactcaagggaaattcacttgcaggttagtcaagtgaacgttttttcaaagtatcagagaatcataaagaagacaaaggctctagtttgagtctggaaattgttaatgatgatggtactaagttctggtggagtttgcatgtaagacaaagcattgcagactgaggttacagcaggaagtgcatctgggttcaatggttgatgtgtaagttgctgtaaggacgtgtctcaaggatatcacaacggtttgttgagatgagacagagttaaagataactagtagtggttaagaatacagtgttaattattgttttcaatatatgagaggaggagcttccctactatttttatttttttagccaatgagagagctccacttcataccccacttttaccaatcgctagatttcacagccactctcacccatgtcgcgttgagcgcgtgtccacaaaaatcattctttttttgatccacgcacctcattctcaaaaacccaccgcgtgtcttatttttttttgttttcttctctaaaccaaagtaaaccgaaccgagatcaatttgaatttcaaaaccaatgtaaacccatcgctgtgaaaacaaaaagctcggccactgtaacaacaaaaatggagacgacacaacttggaaaagaaatcaactcgaaatagccaagagaatgttcgaaaaccctctcaaatccgatgcttcctttgattccaacctccaaaagcccatctgctcaaatcttcatttcgaggacgaggactcgaggagtattacaaggtacctctatagaatcaatggcttccatggtttttgaaactttacttctaataaacaccattgtaatgtcttgttgtgaaattgtgtaaggaacaaaggatagtgaaagctgaagagtgggcagagtttttttttgactaagtggcctctgtttttgattcttcagtggtcaattttgtgatgggatttgattgaaattggagaatgatttcatgaaatctcttcgggctgaggttgattcatgactctttcatttttctagtgtctcattgatgatagacataagaagcactcagatgttggtttttgttttccatacttaaggccatagagagtggtgaattggaggcaatcaagcctttgccttggtaccctaagaatcttcacttttctagtgtctcattgatgatagacataagaagcaccattgctgaatcatatctgtttggcacagttctagttgaccatccataagtggattattcatgctgctgcttaagccattttttccatatctgctgacaactatagaggctttagtcacatgcttttaggtttgtagctaggaaccatctggaatcaagtacttgctagaaataatgttgttgatcctctgctgcagcgagagagatgcagcgcgtagcagctttaaacgtgttaggaaggtctgtgaatagtctaaaatctacatcaaatgagtgaagggaa

SEQ ID NO: 3578 - DNA, 3000 bp, Unknown; identical to SEQ ID NO: 3483
  misc_feature (1)..( 3000): cDNA_ID_2999395_gDNA_ID_1620652_Annot_ID_163488 3000 nt of promoter + ATG

SEQ ID NO: 3579 - DNA, 3000 bp, Unknown; identical to SEQ ID NO: 3573
  misc_feature (1)..( 3000): cDNA_ID_1821233_gDNA_ID_1620652_Annot_ID_163485 3000 nt of promoter + ATG

SEQ ID NO: 3580 - DNA, 3000 bp, Unknown; identical to SEQ ID NO: 3485
  misc_feature (1)..( 3000): cDNA_ID_3093739_gDNA_ID_1620652_Annot_ID_163483 3000 nt of promoter + ATG

SEQ ID NO: 3581 - DNA, 3000 bp, Unknown; identical to SEQ ID NO: 3486
  misc_feature (1)..( 3000): cDNA_ID_3071457_gDNA_ID_1620652_Annot_ID_163479 3000 nt of promoter + ATG

SEQ ID NO: 3582 - DNA, 3000 bp, Unknown; identical to SEQ ID NO: 3522
  misc_feature (1)..( 3000): cDNA_ID_1821026_gDNA_ID_1620652_Annot_ID_163513 3000 nt of promoter + ATG

SEQ ID NO: 3583 - DNA, 3000 bp, Unknown
  misc_feature (1)..( 3000): cDNA_ID_3071426_gDNA_ID_1620652_Annot_ID_163512 3000 nt of promoter + ATG
tcaattgttatgagtggcaatagaaatgaatctgtaggagattatagtgagactgattagtctagtgattgaacaatctaagaaacttgatgcaacattgaaaagttaacatctttaagtaaggaaaccatcggaagaaagcaaaattagtgatgcggcaagcaagaaaaaaaaacaaaaggatttatgcggcagattccaactggttcgtattcgctaccaaaaaaaaggaaactttaccttgcaagatgttggaagcaactcaagttgagcaagaaaatgaatgaagagaaggatctcaagaggacggaggagatgtgggcgtggaatttcagagcttgtagatctactacgactacggatggatcaaccaaacacaaaatttatacttttatataaaaatgaacaccgatttttattattattaaattaaatataagcgagcggatgaggaagaagaagaccaattgacaaaaaaaaaaactttttaagaagaaaaaaaaatggttatcccctcagaaactaatgatctttctttcaatgtctggaaacagtgaacaatgaaggtaaaagagagagagagagagaggtcaagtcgccgaacgagacatcctccttcgacgtttttatgtaaaaaaaagaaagaaagttggagttgttttttttatcttctctctttatctctctctatagtcttaagactaagagtgattcttaccagacaagacccataaaagaccaacgatggcgaggtcggagccagcacatcaaaggtcccagctttcgggctccacttccctctcgtccttttttgcctcattagatggacaacaccaaacagtggcaaagaataatattacagtttttttagggaagaaaataaaatagttgatattattgatataataattcattcaagtctcctctttattttaaaaatattcaactcttttactttagacattatcataaactggggtcaaacggaagatttttcttcaacgtttaataaaatctcttaacacaaatcaaagaagagtaaaaatatacggtttcgataaaatttggttatgtggcggtgttacatgactacgactgataaaactacacgagtacttttgtttttctgtcaccaagatttatttcttttacttactccatgtgtttttttctttcttcgttaaaactactcctcgtaaattataatcaagattttaagcagtgtgcatataaaataaaatacatgtacagtctagaaataatatatgtggattcatgaatctttcatttttaatttccccacacaatttgtatcaaacgtttaatgcccataaaagtggtggtccaggaccctgagattaaaattttaaaaaaatatatagagaagaggcttgggcttgaagaatgaaaaattgaataacaaatatttaaaaaaatttgggacccgaaagtgattgggataaagtgagatatgtcactttacctaacattatttaattttatattaatgtatgtaccactaaatttggcccttttctccccatcgactctttgtagttatttatacttttgtagtaccaataatagaagaatcaactataaaaatttcagctcaataaagaaaaacagaactatgaattaagtgagaaactcaaaagcctgcttctaaaacatgaatacgtccacgataattatcactaagttctagataatctaattttgcgggaccaaattgatgtatatgcgaactttttcatacttttttcaccaacaaatgtatatacttcccatcatgcatgctcccatggtatctcgccgagtgtcaatatatgtgaacttacataaccaaaaattgatttataaagataacaataataagggagacctaaaaatagagaaaagggtggtgtggactgtggagaaggtccctacttacagaacatagcttccatcaatcacacaaaaatccaaccactctgaacctttcacttcaggaccaacttcgttatccaatcatctcccaatatgccaatactttcacttatatatgaacgtgtatatataaacccttcacatttacttcacaaaaatatcttttaaaaaaagatcataatcacaactactaagctagaattttttagtaaatttactactacggtaattataaacaaattatataggtttcttaaatagtagaacttaaaatataatgcaaagttatgtacgaatactatcttttaattaaaaataacgataagaatgttaaaaaagaaaaaaaaaaaatcatgttgatgatatatatgttgaagtaaaatttagttattaggtttaggtatacgtcaatcattcatgatacatggatcccaaacccataatatatcatgcatcgatctctgaaaatcaccaaagcaaaaaaaacccatgtaacatgatatactatattatgcatcatttcgccaatgtaacttctctgatgccctgaacctatttcacatatgactcatgggaaagaccgacaaagggatcgtattacccaaatatggttacgataacatccactgaatatcactcaaaatgaattattgtctcttactagatatattacggctagttgatgatttgtttgaaaagtttaatcttacaaaattattaatagatttgatgctgctcaaagtggtctcttttatttgcaccgcaaaaagccagtatatatccccattagaaaagacgtgacaaagtgtttaatagatcctttatgttttcctcggacccatgcatatataagtgtatttaaatcttttataaggtttttatagccataaataaacaaatttagttcaaaataagaataattaagtaattggaatagcgagacacgttccttgagatgataacacgagcatatattcttcatcacttttgtttgcttcatatcatatacgctaacttatgtgtgtgtgtaatatatgatctcagaactaacaagtaagaagaagaaga

SEQ ID NO: 3584 - DNA, 3000 bp, Unknown; identical to SEQ ID NO: 3520
  misc_feature (1)..( 3000): cDNA_ID_2158392_gDNA_ID_1620652_Annot_ID_163509 3000 nt of promoter + ATG

SEQ ID NO: 3585 - DNA, 3000 bp, Unknown; identical to SEQ ID NO: 3538
  misc_feature (1)..( 3000): cDNA_ID_2158388_gDNA_ID_1620652_Annot_ID_163508 3000 nt of promoter + ATG

SEQ ID NO: 3586 - DNA, 3000 bp, Unknown
  misc_feature (1)..( 3000): cDNA_ID_2158384_gDNA_ID_1620652_Annot_ID_163505 3000 nt of promoter + ATG
ttatccaatatatctacatcatttgctatactatatacatatatccacgtttaatattttctttcaaacaagaaataaatatcttcagtctctttcattcggatttcggattataatcacacttaatttggctatcatacgaggattgaataatccgagtttgcgtacacaacatgtttattggactaaatgaattatatttgtgccaatccatatttgggttgcttactttttcatcatgatattatttctgaacttatctacctaatgtttgtataaactagctaatcccatattcccattctttatatcaacatgctgaataagtgaattatatcattgttttaagtgggactaatatatgcattatgcagagcacatctttgttactcttttgaacgaataagttgtttcaagtattttctgtacgtgttcaatcggatattttcgacaactaacatgttattttcgttcaccgcttcattaaatctaaagctttagttgaataagcagttgctagctgaattacatcaagtgatacctttatatgttttagaaattcaattaatgcagttgaaaatgtgtaggcttattacaactatattatcgggacaatatggacaccatcagaaattgatgtcccgattcaatgaattaacgtgtagacttacaactatatatcgggacaatggacaccatcgggaattgatgtcccgattcaatgaatctgttaaactcttttacacatttgtttaaattttcataatcaatcaatggatcgtgtaatcatactaattagtaaactacatatataattaagtctggctcatgcaagataatttataacaaacaaaaaacttatttaagtgtttctctaacattggccgtatccgttagcatgatccttgaccgacggtgtgtgtgtcattgggtcattagggtttatcatgtcaataataaaaccttgttaaaatatgggtattatttggtgataatattatcaaagtgatcatctgacattgcgtttagtggttgaatctttaatatatcttggtacttggaacggggaataaataaattaataaacacatgtaataacatagtatattgcttcatgatatgaatatgatacatataaataaacatggcacgcaaccatactatagaccagtacttgttaattgttgatgtaaataaactaggatgtattgaaatactgatttacgaaattagtgttttgtttttacgtggcattagtgatgtgaagaaatgaccgatgtgagaaagaagggagaaataaatataatgggagtgtcgatggatggattgcagcaaactttaacggcgacaactcgccgcttacctggccgtcccagtttgtgacctttggtgagagtaaaagggcaaaaatccacgtgggctaaaaaatggagccatgtgccgccacatcatcggtcaattgggaccaaatacctctctatactacttattagtaacttgactatatatcttatgtttttttttataatactaataaaattatgggcgaccgaatcaaagtggtttattcctttttctggctgccgcatctttactctccctctctggtcaactcctacccgagatctatatggagtaccattttattaaagaaagaaaaacaaaaacgaaagtcagttaatttatctctccaaaatatatatatatgaccaaattaaatcgcattgcattaggaatgactgcatgcttaacatatatcgtgatatgcatggggtgtgttaatcataaaaaaatgccatataatttacaatgtacgtgtatattgtgagattaatttacaatttgcgtgtatatctctagtttaagagtatgttacttggaatgattttaaatactaaggaatagagattgcgttagaacgcgcataagacatgtttattaataatatacacgagcagccatacctgcaccacgtgttaccccattatatatgttttaggtttatgataatctcttttctataattttggttgactagcgtgctataagtttagttaattatggtaatgtagtatacaaagttttgatatatatcacacacaacataagagtaaagaatcgtgaatcctccagagatgaggggagtgagatgcgagagagagagagagagacgtttctatagttgggccctaagtttgtttttccaatctttaatgtgtggggatactagtttttactaggtgccaagcaaagcagaacaaaattgaacaaaagggatagattagagggaaagtaagtagggggttggaaaaaggataagtaagaaaacaaagggaccagaatagtaaaacatacaggtggaacctgatccggataagtgagtggggtctttatgaaagggggccacttgtaagaaaacgttttaattttgatcaaaaagggcgtatctgttggagggacaaatggagaatgtgttggattttcttggggatttgatctctcttcattattactacggtttaatatttgattatagtaataataatcacgatttttaaagtggcattaattaaggattaatccagagaagcttcttttgtccacctgcaatgactttaatacccattttagacgttaaaggatcagtatcgccacggcggcatgactcatccgctccttccaatacgccgtcgttttatacccccacctcgaattgaaaaaaaaaaaaccccaacaacaaagataaaaacgtaaaacgaaaaaagcatatcaatctctgtgcctctctcaattctcaaattctgaattctgatcgtatcttcttctctttaagattatcatttgaatatcttcttcatcttcttctccaagcccctctctctctgtatcgatcaatcatcaataggaggagctagcgaggggattcaataaagagatcttcttcttcttcttcgattcactttcctttcttttccattttccctttcgtcgtcgtcgtca

SEQ ID NO: 3587 - DNA, 3000 bp, Unknown; identical to SEQ ID NO: 3517
  misc_feature (1)..( 3000): cDNA_ID_3439905_gDNA_ID_1620652_Annot_ID_163504 3000 nt of promoter + ATG

SEQ ID NO: 3588 - DNA, 3000 bp, Unknown
  misc_feature (1)..( 3000): cDNA_ID_1821197_gDNA_ID_1620652_Annot_ID_163500 3000 nt of promoter + ATG
tcacgtcatatatagaagcagctggcacaagggtaggcgtgttcattatttattgagttgagagttttgagtagtaggaatgtgtagtgtgtgtctagcctataaatcatcattccaagtaaaaaggaaaaaaggtagtgtgaaagctagagctaccaccacattacccaatagtctagggtgaatgacgtggcattgcaccgactctctgctctgcctcacagctgggcctggtactacatgttgatgtcggtcggtctcttgttttctcaagtgatttattaccacacactctatctagctaattgtgttcctattaatcattcatcggacatgttaaactgttgatttcagtcaatgatgagatcttcaatattcagcagattggtagctaagaaacatccatgtgagaacgactctgtcacatctacggcattcattactacatgtgatgatatcttcatacttctccctctcttgtttaagaccctatatcaactgctgatttctttcaagttctaatgatggataacagatttagagaaacacccatgtcttgttgggtttaggctcatgactagaacaggaagagtaaacctttggttcctcttctttttttagtggtggggctgtaaagaagtccaatgacgtgagcagcattaaccaaaaccatcaagtttaacccaatactggcccttttatgtttatgtaagcccatcttctgattcggcccaatcaagacacttcagttagcagtaagattttcaaacttatttttctaataatgtctaaacaatttaaacagtgcttttgctctctttattggataacgtggaccgtccacaccgacaatccattggtcgacgaaacgcagagtattcggacatgtactatgttttttattacactttccgaaaaaaacaaaccttgttccgatcaaagtcggtccttaaaatattgacttgttagtacaatttgccggcaacaccttggctaaacgcgaaccgagtgttaattactataaattaactgtaactaaaataaacaaactaaaagctagagctactataaatacagtgtcgcaggggtttgtgtaactcatcagtcctcacagctagcaaaggaaagtctcgttggtaaattaaaagtgagtcttgaataccttgtttgcgtttttcctaaaagatggcggatcatcctcgttctactgagcagcaagaagctgatgctgcagcttccaaaggctgtgggatgtttgactttctcaagaagaaacccgaagatgtacattcttccgagaatgcccgtgtaaccaaggagcccaaggaagaggagaagccttctctcgctgaaagattccacctttctgacagctctgtaagcttaattgtatactcttgttcttatgcatgagaaatgttaataacacttgttgatggaggatgtgatatatatgtatatgcagtcaagtgatgaggaagcgggtgaaaatggggaaaagaaggagaagaagaagaagaagaagaagaatgaagttgctgaagatcaatgtgaaacagaggagaagattcctgcgggtataggccatgaggatgggaaggagaaagggtttatggagaagataaaggataagcttcccggaggtcacaatggaaagcctgaagctgaacctcataatgacaaggccaaggagaaagggtttatggaaaagatcaaagagaagcttcctggtcataccaatgatgagaagaagaaggaaacctagttataagaagaccctttttttttttactttcgcttttaccacttgcgttttcatcttcttgtattgttgtccacctcgttatgtgtcagtgaaatgccaacttttcgaattgaacaactcttgaatcttaaataactcatactattataacattgaaatcctcaagtatttaaaacctgttgttttcatctgttagtgaaaaaaacctatgtatgtatgaaacgttaaaaccctaaattttaccacaaaaaaaaaacgttaaaaccctaaaaccggcatccaataacccattaaacatataagaagaaacccatgctttctgagcaagaaacggttctgcttagttaggtttgggctgactaaaaagggcccaaaaggcccatttgaaatcacggaaaataggaaaaagttcaaggggaaggagcagccagagacacggagagtctgtgtatgaaagtgaagggaaaaggagatcgacgtctcctctcagactctcacgggaagaagacagtctgtgactttttgtgtttccagctgttttcatatcatttctcaattctcactcgtatacctgacaatttgggttaccaagttgaccgttgaaatttgtgtttatataataagaattttgtggactattactaatttactagtattattttatacttccagcatatatacatacatacattgcttcttcatattctctacgcgttcaatcaatatttctcgtgtaggctggctatttgtgccaaaatacaactcaaattgtttcaccccaaaaaaaaaaaagcagatacaataaaataaaatttatataattatatgttaattctcatttgtgtaaaatattgaagcagcttaaaataaaataaacctcacagtaaaaatgaaataaaataccttgcaattaaatgagaatgcttatttttaacaaaataaaaaataaataaaaatcaatgcatcaccggattgggattttattttctttcaaaaaaataaaataacaatccccaacccaaaggacaaaataatgggtatttaattagtaggtggggtggccttataatatattacaggttgaaataaaaacacggaattagctgattggaaaagcttccccctccccattggactttaaatacgacaccagagtcatttgttccgttactacaaaacagagttgaagctttctcttccaactttatcttcttcttcttcttgtcaaagcgagt

SEQ ID NO: 3589 - DNA, 3000 bp, Unknown; identical to SEQ ID NO: 3483
  misc_feature (1)..( 3000): cDNA_ID_2999395_gDNA_ID_1620652_Annot_ID_47759 3000 nt of promoter + ATG

SEQ ID NO: 3590 - DNA, 3000 bp, Unknown; identical to SEQ ID NO: 3577
  misc_feature (1)..( 3000): cDNA_ID_1839226_gDNA_ID_1620652_Annot_ID_47760 3000 nt of promoter + ATG

SEQ ID NO: 3591 - DNA, 3000 bp, Unknown
  misc_feature (1)..( 3000): cDNA_ID_1821221_gDNA_ID_1620652_Annot_ID_47762 3000 nt of promoter + ATG
gctcttaatccaatgatcatttatttgtatgaaagaattagaagactcacgtattcaccaccaccaacgaaaacatctcgcatactttctttgatggtcataccacttctgatatcaacgtcaggatgtggtagacggacttttgttggtctctcactgtccctaatctcatctggatcaataggacagtcaacagatgcatagtcaccaagaactgaaacggatccagtaaagcggtctcccattagaccataaggctttgctgggaatacatacaggtgaacaacggaagcaatacccatctgcactggaccagcacaagtgttaagagctttaatttatttaaagaaaggaaaacagacgactccatagactgcttgttaataggaagcaatgaagaaaaagttttgcactcgtaaacaaagatcacacataatgtttaaccttttgcaggaattggtaacaacagaagacatttacctctatgcaaatgatgaaatcttgcacgctagtcttcaactgcaagctttgtgcaattgaacttttgaacaagccgagggaagagaggagagcaatggcaacaccttgccaccaagtgagaaacacaatcgacttaaatgttagaaatttagccagtggttggatgtgtgcaagctcatctttcgttgcaccatagaactgaaccagacagtataatgcccatgactgactaaaatttagaacaactgccaaataagggtacctacaaaaaagaaaacaatggtaagatgctgctatcttgatcacagtccatcatagatgaaactgattttcgtttcttaaggtcaatctgtatgttagcactgttcttgtcaaaattgtctcaacgtacccacatccccatttaaactctccttcacagtacacaccgaaggcttcaagaatcagagctgtgagggcagttaaagactttattatcatctgcaaaaggagagaaatagttaacttccacttcaaagaaaagagttttggagcaagagaaacaggaggcatttgtgagaaacatacatattgaacaataccaaacttaacaacttgataaaaccagggactgagcctccacggttttaagaataaattcataggaaaaggatgtttgatgattcccttttcatccttgtgatctaagagtggcgtcttaaagctcttacgcccttgtctttccataaactcgatagtcctttcttccccacctggtaaacaagtcaatttagaacaaagagcaagggaaagagaaagtaagtttgtgcgattatccttgtttcacaggtagaactacaagatgcggaacctaatcaatattagacataaaaaagagtgaaaatggtcataccaatgcaggcaacaaggtatctaccaaaacagtacatggcaaaggattcatagcagtctcgaagaatcccacagtcaacactgatggatggtttaacaagtgatgcaaactgttacaaacaaacacaattaggaacagatatcttagggaaacacattcagttgacgatccgttgacgagcacaatacaagtaaatattcgatgagattatcaacgctgaacatgactgtattattatgagtatgatacaggcttcttctacactttggcgataaaaaagtcaatttttttaggttcctaaaatcttcaacccaaaatacgtatcatcaaaacctcctgatttgcttaagaaaaaagtaactgaccgattcaatagaatagcaagggaccatgaggatgactccaatcaaaaacttttgctcctgagagagaagatagtagttaaggtaagcaaggatataaaagccaaagtagagggaatagaaagagagagagagagaaaacctcagggttcttgtaagtagaaaggtgatcgaagacaagaaacaaggaaagggagagggtgagaaccaaaaaagcaccggccataaagcttgcccacgcaggagccgagtaagcagcagctaggagatggtaagactttaatatatccatcaggaacaagttcccatcccacaagcccaatcaaagaatcgaattcagctgcgaccagtgatgatgatgatgatgaattgatgatgattaaactggatccgccacacaaaaaccgattcgaagaatgatcggaggacctaatgacatgaagtttggtataaacaaagaaatggattggagaaaacgaagagaagccaaggaggatttgatcagacgagctcacgtctgcaatggacgacccatgagaggatgatgagaaaaaacaaacaagacaaaagagatgccttttttttcatctaactttgatggtaaaagaaaacgtaaaaacggcatgcattgcaattgttagcatttaaaacggcaagcagatgttactggtactgactcatcatcaccgtcctcctcttgcctcgtgtctcccgactctccttactttactctccaattcaattttagtcaacaatccaatctctctgcaactaactactacgccaagattaaataaaccccaactgcttgcttaattgctcttcagacaaaacatggcgattcctaccaagcttctcctcttacaggcaatcctcttcattttctgtcttgtcctagcgtttcttgccaaattttcctttttaaaaaaaaacttgttatgttttctttctgggttttttcgttatgcaaattgcatatactttgtgtgcttcttcttattaggcctttgcttttattgaacgatttccgcctctgacttctatcgatgctattatcgtataattgggaatgattgtcatgttgcagctctttactttctcacttttactcaccgcaaacctgacccactcagaaccaaggtaatttgcattttagtgaccgagacatatggccttccttttttctcaatctcttattcatctctctttcggtaatctgtactgctgctcagtaataatagacattcaaaagagtattgcgctatg

SEQ ID NO: 3592 - DNA, 3000 bp, Unknown
  misc_feature (1)..( 3000): cDNA_ID_1821217_gDNA_ID_1620652_Annot_ID_47763 3000 nt of promoter + ATG
tgccacagaaggaaatcgtgaacaaagattatatatacggttaataataaactggaatatagacagacgaagcaaaacatagaaactacctgctcgattctgtagaatggcgaaaggtgggtatcaaagaactttttctcttctgctgctttgctttcaggaccaacccacaactacaacatgtagaaattcacatgaacaatcataccagtatttgcagttgcttttctgctgaatgatttgtacaattatggtcctggcaaagttaatacataccttttctggtcgtgtttccaccttgaaattatagagacctgaacagagtgcaagaacaatagctactgacatgaagagaacaagagatggatttctagcaatccatgacccatatgatctgaggcaaacaattggaaacaattacgaatttcatctcatctaattgtagagataacttgcgagtaagatacagacaacgaaacaaaatcctggagattcacctgtaaaattttgccatatatctctgaacaggagagagttgagcatgtctttgcacctaagaattagaagtcaattgatcaattagttctttcctccaaacagattaaatcttcaaggatagtccagcatttatgtgggtatataaatgtattttatgttatatatacatacacataagaactacaatttctagccaatacattgatataccttgacaccaagtatgttttccttcatttcactattaattccatcttcttccacaggatgcaatagtggctttgagctatcaagaggctgtgtcgtatttcttcttcgatttaaaccagcccatccgaagaagcaagacaccagcaagacgtatacaagtgccattgataactcaatgcatctaacctgaaaatacaaatcaatataatcaaatccaagatcataccaactcaataatgttttcaagcaacaatgggataattcataactcacaccttaagaggaccgattctaattgagcaagaatcttcatcatggggcggcaggggttcgggacttgagcaagctggtgaggaagggcaatcaccacaagagcatccaagggatgtgtcaccacatgaataaacagatacattcattggtaccatcgcagatgactcagggatgcttgatttgaagttgatcgcatatggtgaaccaggaaagccagatggtgctttctgaccaataaacgtaaaccattctggaaaagcagaagtaaagatgaaacatggaacttttgaaacaagataaagcgtgtatggaacgccttagaacaaaactgcagagcacctctgaagtttttagcaccaccgccaacaaagttaattgcacgtgtgttcattgttccaaatttcacctctttacaggactcgtaaaggccttctccaaacgtatcagttatgtgatagtctataccatccactgtcaaatttccactcacctagaataaatcccaactagctagtgttgttaaccatataaatgggtgtcaagtaaccaacaaaagctgaaaaaaatggaagctaacctcagcaacagaagtgacgttgatgaaaagagactgatttggagaacaggagagctcgcagaacaaatttaagaagttccgtaagcatgcaggacaacccacaagaaaagggacagcctaaaagagattgcattgacaacgaattagtaaaaatggcctgctctgataatagcaaaaacaagagaataagaaaaaggtcatacctgttgaacttgagacctcaaagtgtcaaactgagtctctgtacaacagacattgccacttatggttgggcaaaggctttggattttggcagaaaacagttcatcaggctgcagaaaggaatgtcagattgactcagacatgcagaagtaattggaaaagtaatggtcttactccatgatctgaaaagttgtctacctgaatggaaggggaggcataaggacagttaaggacttttccatcgctgcggtgtccgcaaatgtcatacatagcgcaatactcttttgaatgtctattattactgagcagcagtacagattaccgaaagagagatgaataagagattgagaaaaaaggaaggccatatgtctcggtcactaaaatgcaaattaccttggttctgagtgggtcaggtttgcggtgagtaaaagtgagaaagtaaagagctgcaacatgacaatcattcccaattatacgataatagcatcgatagaagtcagaggcggaaatcgttcaataaaagcaaaggcctaataagaagaagcacacaaagtatatgcaatttgcataacgaaaaaacccagaaagaaaacataacaagtttttttttaaaaaggaaaatttggcaagaaacgctaggacaagacagaaaatgaagaggattgcctgtaagaggagaagcttggtaggaatcgccatgttttgtctgaagagcaattaagcaagcagttggggtttatttaatcttggcgtagtagttagttgcagagagattggattgttgactaaaattgaattggagagtaaagtaaggagagtcgggagacacgaggcaagaggaggacggtgatgatgagtcagtaccagtaacatctgcttgccgttttaaatgctaacaattgcaatgcatgccgtttttacgttttcttttaccatcaaagttagatgaaaaaaaaggcatctcttttgtcttgtttgttttttctcatcatcctctcatgggtcgtccattgcagacgtgagctcgtctgatcaaatcctccttggcttctcttcgttttctccaatccatttctttgtttataccaaacttcatgtcattaggtcctccgatcattcttcgaatcggtttttgtgtggcggatccagtttaatcatcatcaattcatcatcatcatcatcactggtcgcagctgaattcgattctttgattgggcttgtgggatgggaacttgttcctg

SEQ ID NO: 3593 - DNA, 3000 bp, Unknown; identical to SEQ ID NO: 3574
  misc_feature (1)..( 3000): cDNA_ID_1821205_gDNA_ID_1620652_Annot_ID_47766 3000 nt of promoter + ATG

SEQ ID NO: 3594 - DNA, 3000 bp, Unknown
  misc_feature (1)..( 3000): cDNA_ID_1808704_gDNA_ID_1620652_Annot_ID_47767 3000 nt of promoter + ATG
ccccacctactaattaaatacccattattttgtcctttgggttggggattgttattttatttttttgaaagaaaataaaatcccaatccggtgatgcattgatttttatttattttttattttgttaaaaataagcattctcatttaattgcaaggtattttatttcatttttactgtgaggtttattttattttaagctgcttcaatattttacacaaatgagaattaacatataattatataaattttattttattgtatctgcttttttttttttggggtgaaacaatttgagttgtattttggcacaaatagccagcctacacgagaaatattgattgaacgcgtagagaatatgaagaagcaatgtatgtatgtatatatgctggaagtataaaataatactagtaaattagtaatagtccacaaaattcttattatataaacacaaatttcaacggtcaacttggtaacccaaattgtcaggtatacgagtgagaattgagaaatgatatgaaaacagctggaaacacaaaaagtcacagactgtcttcttcccgtgagagtctgagaggagacgtcgatctccttttcccttcactttcatacacagactctccgtgtctctggctgctccttccccttgaactttttcctattttccgtgatttcaaatgggccttttgggccctttttagtcagcccaaacctaactaagcagaaccgtttcttgctcagaaagcatgggtttcttcttatatgtttaatgggttattggatgccggttttagggttttaacgttttttttttgtggtaaaatttagggttttaacgtttcatacatacataggtttttttcactaacagatgaaaacaacaggttttaaatacttgaggatttcaatgttataatagtatgagttatttaagattcaagagttgttcaattcgaaaagttggcatttcactgacacataacgaggtggacaacaatacaagaagatgaaaacgcaagtggtaaaagcgaaagtaaaaaaaaaaagggtcttcttataactaggtttccttcttcttctcatcattggtatgaccaggaagcttctctttgatcttttccataaaccctttctccttggccttgtcattatgaggttcagcttcaggctttccattgtgacctccgggaagcttatcctttatcttctccataaaccctttctccttcccatcctcatggcctatacccgcaggaatcttctcctctgtttcacattgatcttcagcaacttcattcttcttcttcttcttcttcttctccttcttttccccattttcacccgcttcctcatcacttgactgcatatacatatatatcacatcctccatcaacaagtgttattaacatttctcatgcataagaacaagagtatacaattaagcttacagagctgtcagaaaggtggaatctttcagcgagagaaggcttctcctcttccttgggctccttggttacacgggcattctcggaagaatgtacatcttcgggtttcttcttgagaaagtcaaacatcccacagcctttggaagctgcagcatcagcttcttgctgctcagtagaacgaggatgatccgccatcttttaggaaaaacgcaaacaaggtattcaagactcacttttaatttaccaacgagactttcctttgctagctgtgaggactgatgagttacacaaacccctgcgacactgtatttatagtagctctagcttttagtttgtttattttagttacagttaatttatagtaattaacactcggttcgcgtttagccaaggtgttgccggcaaattgtactaacaagtcaatattttaaggaccgactttgatcggaacaaggtttgtttttttcggaaagtgtaataaaaaacatagtacatgtccgaatactctgcgtttcgtcgaccaatggattgtcggtgtggacggtccacgttatccaataaagagagcaaaagcactgtttaaattgtttagacattattagaaaaataagtttgaaaatcttactgctaactgaagtgtcttgattgggccgaatcagaagatgggcttacataaacataaaagggccagtattgggttaaacttgatggttttggttaatgctgctcacgtcattggacttctttacagccccaccactaaaaaaagaagaggaaccaaaggtttactcttcctgttctagtcatgagcctaaacccaacaagacatgggtgtttctctaaatctgttatccatcattagaacttgaaagaaatcagcagttgatatagggtcttaaacaagagagggagaagtatgaagatatcatcacatgtagtaatgaatgccgtagatgtgacagagtcgttctcacatggatgtttcttagctaccaatctgctgaatattgaagatctcatcattgactgaaatcaacagtttaacatgtccgatgaatgattaataggaacacaattagctagatagagtgtgtggtaataaatcacttgagaaaacaagagaccgaccgacatcaacatgtagtaccaggcccagctgtgaggcagagcagagagtcggtgcaatgccacgtcattcaccctagactattgggtaatgtggtggtagctctagctttcacactaccttttttcctttttacttggaatgatgatttataggctagacacacactacacattcctactactcaaaactctcaactcaataaataatgaacacgcctacccttgtgccagctgcttctatatatgacgtgacgtgtgctgtgatgctgagctggaacccattcccttcttcttcttcattcttttctgttcactatttatatatttgattcactctctccttcctctcctctctattcatcgcatcccccacacacctcattaacattataattgtttttttagttattcttcaatttcaagaaaatg

SEQ ID NO: 3595 - DNA, 3000 bp, Unknown; identical to SEQ ID NO: 3588
  misc_feature (1)..( 3000): cDNA_ID_1821197_gDNA_ID_1620652_Annot_ID_47769 3000 nt of promoter + ATG

SEQ ID NO: 3596 - DNA, 3000 bp, Unknown
  misc_feature (1)..( 3000): cDNA_ID_1821326_gDNA_ID_1620653_Annot_ID_47772 3000 nt of promoter + ATG
gtcaatatcttttgctttatcgataagaaacttcaaagcaaacaatcaagttcgacatagaactctgttcaaggaagataattactttactttgatctcggcggtcatatagtgtgttccatgaacggacaaattcttcctcttccccaaaattttccaaaggttatttttggctatttacgggttgtcacaaattaaaaaggaaatgtgcaaatatttattattattctttgacttgagggttaggatactcaatatttacaacaacccctattcaaaacacagataaataaatatgaaagtgaataacatttaattgatggagtagtaggaatcaatcaaggagagagctagggccgctcatatcaacaagtcttcaccttcactccactccaccaacaagatttgatctataagataaatgtgataacgacaacgaagatttgagtaattgtagcacatgcatcccaaaactgattattgttgatgatgaagggtaaagtaggcaactctatcatgcgacgtatcctttttcttttgtttattctttttcctgtccgtaaagttcgccgagaattcgaaaaataagtaatcttatgctatccaaccatatatcatacgtggcacatttcatgctatcctctctactcattgattgaatgaacgtaattttggtgacatggaacttagaaggattccaatgtcaataaaccctatatactctgaagcaaaacataaaaactttgtttacatctccttttgaaaggtgtttaaagatttcttgatgtcatttgaaatagaactttagttccaacagtttcgaaacggtgagaaaggggatgaattattagttctaatccgcgaaagaactttctaactagagaggaatcatccctaggcatccaataaacgtaactagtaattaacggggttgaatcttcttctcatgagtccaacacttttctgccatcttgatttatatacaagaatattgttttcatttaaggtattttgggtttaccagtgcgctttcgggttacattcaaatctttgtcaccacacggacacttctctctctaatagaagaataacctacacatggccgcatattatggtttagttaatagactcgaaaacgggtcagtaggttcagctcattataacacttggccctggtgctataaaagttctatttggacctaaaattagattattatttttttgtttgcgcaaaaatattactatagattttgttcatttgcaccttggacacttgtcaagaacaggatatgctagtaacaacctaaaactaaaacctactaatagttgataaattggacaaaacaattcatcaaaaaatttccttactccacccataaagtttgatttaagaattcttcagtgcaccagcccttaattggtgtagttggaatttatcaaaagcatccttaaaatcgtactccaactacaccaagcatccttaatattgacaaaggatcttcttccatgaatgaaaaccagccctttactatctctaaccacccaagccgcaccagctagattgtttctctttgaccacgaaaaccccacattacacttaagccactgataattggtgtagttggagtacgattttccataaatattatcgtaagactctttgaataggagttcaatttgcgttgcatactaatgtgattaaatgatcaaattggtattattgtcggttgtatactctcgtaagatttgatgcatgtagagccctggtttttgggtcgaaaataaattggctcacactctatcatgctttagttttattacttttttcttatgatttcctcatttctcttctcgtctcgatttgtatagtttcttaacaataaaaatgtatatttcaacaataaaataaaattagttttccttccaaaccaaaaccattagcgattcacacttctctaaatactttttgatgcttttgtaacgtccataccaatataacatggaaaaactaaaatttgactcgaaaaactaacatggttcaatagacacactagtctaatcacaatttgaaagaggatatcagacatgcaaattgaaggatttttttttgtgggggtctggtcaaggagatgagactcaataactcatgttgaattccaaacaacaaataattgttgcatctagaattccaaataagaaataattgagatagttgaatcagaatatgttggtagaatgaacgaacacgtgagtagagtccccaaacgtggcagagaagcggaccacacgaagtcctgtttttattatttgttgccataaagaaatccaaacttgaaactgaaaccgtcgaacgaatcttaaatgaagcgaagaaggaacaccaaatagtagtcttaactctttctctctctctctctctcttactggttgggctctctgtccaaagactccacctttctctgcaaaaatctctgccctcctactctaacatgtctccccttctcctctgtcccttatctctctctattcactcaaacaacaacgaccctttttctatttttacctctcaccataataacttcccttatttaccactttaccaactacttcttcttcttcttcttcttcttctttcgacaagggattttagggtttaggattctccgcattgtacgccactctgttcaatacaccttggtattccccaatctttgacgttttgtattttcagtttgtcgtttccttatcttaaaccttatttaaatcgttcccaagttttttttgttttgtccatagcttatctgggtctctgttttttgagctctgtgattgttaaatttaataacttttctctcatatgtctctgtgttaccacattttcattgtttatcactaattgcttacattcattattaggtaagtgatgatgagtgttgaatcttgaagttttaggagatagagagaaaggtttaggattgttttgatctgttttggaaaatg

SEQ ID NO: 3597 - DNA, 3000 bp, Unknown
  misc_feature (1)..( 3000): cDNA_ID_2999594_gDNA_ID_1620653_Annot_ID_163546 3000 nt of promoter + ATG
cttcgaattccgtcgctggttagcttaggactttctgattctgtcgctttaatcttcttctctccatgacacaacgggtattccaagtctggaaaggaagcaatgtaagtccttttttcatcgaatgattgagcctggaattttattggttttttgtgtgttttctctttgttgggagatgaatattctctgaattctgttctctggtatgaatatgatttggaattcgttttttctcgagtttcacctgtgtagcataatcttagttacgcaattggtttactttggtacgtgtaaactaatgttgttgagctgaatcgttgaagtatctcttgattcactctcaaagcatgaccatgcatttttgcataaccttgtatcaagttgaatgttccttgtaatttattaacaattggaagtatcttcaatgcttgactcttcacatgttttaaattcagtatggtgataccaataaatggtccctctctcttttgcagaaattcatcctgggtgggagattgatatttggaccagatgctaggtcactgcctcttaccttgctattgatcatagttccggttgttttgttctgtgtatttgtagcaaggcaccttcgccatgagttctctccctacaatgcgggatatgctatcatggtggtagcaattcttttcactatttatgtaagtcttctccgatacccaatctgatagtcctatatatctcattgttgtaaatatttgatttctgattttatgtttgtttcctgtttgcttactgcctaatcgggtaatcaacaacatttatcagctatttcattgtttgtttcttacccggcttagaagcttaaaccctgtcctcctgttctgtcacttgttgtgtggcattcaggcgttgttattttttgcttttctgaatcacgaatttgggtttgataggtattgatcctcctcttcttcacatctgcacgagatcctggtattgttcctcgaaattcgcatccaccagaggaagacctacgttatgagacaactgtatcagctgatggaagacaaacaccgagtgttcaaattcccaggacgaaagaagtcattgttaatggcgtttctgttagagtgaaatactgtgatacatgcatgctttacaggcctcctcgctgctctcattgctccatatgcaacaactgtgttgagcgctttgatcatcattgcccatgggtgggacaatgcattggactggtaagctcaatcaaaagcatattgactttgaaaaatataaagttcgtaaatttttatctcccaaaaaagtgtgaggtttctgtttctgttatctgaaaggccaagatctgttttatctgccgattggccaatctgttgtctgccattttgtcctgtgattctgactgggaaagttctgtccattggcagagaaactataggtatttctttatgtttgtttcttcgtcaacacttctctgcatctatattttctcgatgtcggcggtatacatcaagattctgatggatcatcaacaagcaactgtgtggagggcaatgaaagaatcaccttgggctgttgtgttgatgatatattgctttattgccctgtggtttgttggagggctcacagcgtttcacttgtacctcataagtacaaaccaggtcagttggtctctattgttttaaaattctgttttctacttgttatccctgttattaccttcccgtatatacatattaatattgtatgcaaattgtaagtcaactgatagcaacaccgtgcaagtttttcagacaacctatgagaaactccggtacaggtcatcacacagcaggagcattgtctataaccgtggctgtccaaacaatttcctggaagttttttgctcaaaggtgaagccctcgaggaacaactttagagccttcatcgaagaagaacccccaagagttattactctgcctagcaccaccagggaatcaggggaagcagaagacgaaaatgtgacccggcgacagaaagtggaagacgatctagacattggagacgatctaatgaatctctcacggcgttgtaatgcagaagatgccaacaacaatcagcctcatcacacattggacatagaccatgagagagcaggctcgataaggacagaagcaagacatgaaagctggggaagaagaagtgggagctgggatgtagcagcaacagatgtgagggaaagtcgaagctacgcaacagcaaaggatggaaggggataagggtttgtggggtttctcttttaggacagaagtcggtagatgtgaattggtttcagggatttggggatcagttaatgtaatcttgagtgtactataccaagagtagtagttcttctatcttcttttcgttttctacaatgtgtattgtgctattttattaatattatgtggatattccattctgtatttgcgtccatgacatctaccttaaacattgtcatgctgtcttttagctcggccaaaatccaatttataatcttctcttacatgcaattagcagcactgcgattaaaggaaatatcaaatctaacaaaatttgtattttatgactaaaataagtttttcgtactatttaaatctaaaaactaataaatagttattttttaaagtaatccctagggcatttacttgtctaattttgctcaacacttatgagttatgatcacgagtcacgacatccattttctaaacaaagtaagacgatactggacgttgtctttgactaaatttgtacaaaccacgaattatttacattggccaaatttagaaaacataagaaaaaagttactaaagtttaacgttatttgataccagttataatatagcacattctaaagttatccagccctagatgaaaccctaagcatacatatatatccgccttgaaccaaaagccaaacaacacaaaactgaataacaaccggaaacttgagcaacaaaacttccgacgctaagagaaatg

SEQ ID NO: 3598 - DNA, 3000 bp, Unknown
  misc_feature (1)..( 3000): cDNA_ID_2999597_gDNA_ID_1620653_Annot_ID_47773 3000 nt of promoter + ATG
acacatatgttggtttagaaaaacttcaagttgcatttcttcttttagccaatcgcactatcttccgtgaaaaggtaaataatatatagctttatgacaatttcacaaaaatggttcgttagttttgacttagcattaagatttttttccagaaatctaagtattggtaaaataattctatatctactactaggtcaaaatacaattctatattatttaaaaaattgtaactgaggtaattgatcaaattaccaaaatgatgaaagagctagttaagaatttaacaatgtacaagttttagtgaaatggtcaaaactaaatatccattcttttggcccgttagcatcattaaaccaaccactcaatggagacatggaagatcaaaattcgtcaaccctagcgctttgtttctctacaaggatcaagtatggaacaacaacaaccacaagaaatcgaaatgtgctaaggtcgcatgagttcgctaggaataagtctataacatttcgttttgtcaacaaaataagattttagtatatatattatttacaattttaccagacttccattgtcaacaaatgacattattgttgttgtcgaagaaaaaacaaaggtgacactatttgctgttttactttttatttcatgaggacggaggacccatttttttaatttagtttaaaagagcaaccgtatcagttgattacggagtccagcagagaaaagcatgctcaactgtcaaaaacaacctaacaattagggaatcccgtaaaaccggcaaatcacgagggcagcattacattacattacattacatgtcccacaaatcactttccctcccatgcttttccacttccacctatcattaccaacacctattacctaaaggactttaagccagagagttttcaaatcccgtaccgtgattggtgcactatgaagtggaaaggaatacgatgaaaaacaaactgttttctcaatacattttcaccgacaccaatcatgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaaatgaaa

SEQ ID NO: 3599 - DNA, 3000 bp, Unknown
  misc_feature (1)..( 3000): cDNA_ID_1808608_gDNA_ID_1620653_Annot_ID_47774 3000 nt of promoter + ATG
cacacattgggagatgtatgcgattggtggaagtgctaatcctacaatcaatagtcaagggaacagatttttggcacccaatatcagatttagcaaagaagtgactaagcatgaggacgcgcctgagagcgagtggaagagatggaattggagatcttccggagatttgttgctaaacggtgcgttttttactccgtctggtggtgcagcctcgtctagctatgcaaaggcttcgagccttggggctaaaccgtcttctctagttggaccattgacgtctacttctggtgcactgaattgccgtaaaggttcccgttgctgattgtggcttagtggtcacacttaagtttttaccccattattatataggaaaaggcaattaaagccaccaattaagggggattaagtagtgtagtaagactttcttaatcccttgatttactcttttttttgtttgtttattcgggtaaaattgaaggagaatacaacctctggctagctgctctctaggacccttcttaaggattctctgttttaaggaatctttaaattaggttaaagtgtgggaacaagtgcagatgtgttgatcttgatattaatataaatatgattttgtgtctttatcttttactagtattattttcttatgagcattgcaatgcaaagacatagattagtcacaaaaattagtttgaagtataaatttgcgtacacacatgatggagaggttagttaaaagtgtgcccatttggcaagtcaataatggctctttgattttccaaataaaatgactttttattcggaagtttgtaatgttatgtaaaatggtaacttttgggtcaaagatgttggagccagtcaatgtttgaccaactgccgcgacttttttttcctctggccaatgcatcgattccggtaaattaaaagaaaaattacccttaaaaataggaaaagaaaatcctaggcatgacaatgagagaagagaaaagtgaagttgatagattttgaatagaaaaaagaaatactaaaattttcaaaagaaagataattggagcagtcaataccacagtagctctacttttgatgggtttgtctcatattcgtgttttgactactgtccactgattatgggatttatttaaaatttgaaagtaactaattaaacaactaaccaactttctttgtggccatgtgcacattttcttttgttaaagatggccatgtgcaacatgataatacatctaggaacgaaaggaagaagaaaactttgaaagtaacaagtggtcgcaactaatgatgtgatgtagttggtgtgattagtatgtggctggtttgatttggtcagtcagtgagtattaaatgttagtttgccaagaaagattttttttttttttggtcatactgtatatagcataaaactaggtagagaatttccttgttatgaaaaaaaaaatctttacatttgagttattggggaacgaaagaaattcctatggagcaagaaggtttaagtggccatgttatgagttgtgtgcggtcacgtgtactggtcagttaatttagttgtaacaatcgattatatttgttctattattctttatatttcagtgatgccgtaacagtaagaaattatagttaactgaaaccaacaaaaagattcagaattactggtgttattcaattatggagttaaagttaattctttaaactttagatttgttttctgatattgcttttaagaatatgtttgtatgaatttcaaaatctctgcaatatatcttggattttgattctaatgatttactcatgaaactccaaagaggtttcatttcaaatcaattaatatacaaagattttacaagacttttagttttgaacaacattggattttaatgaaatatttaaaatcttaattgaataacaccaaactttaaaatctattaagcatgatttacaaatatgagttccaataacactagattttaaagctggatttagaatcattagttgaataacattggattagtgttggatttcaattctattaaaattcattaacgaataacacccccttaaagttaactctttcaaaaccgatcataacgcacacaagcctccaccgaaatgtttgacaccataatattttactaccgagttcgcaaggctaatatgtatttccttttgtaatttttctctttattcgtattcgagaataagtggattgttcttccgaaagttagatagatcattatgaggttgttcttagagagctagaaaactcaaaacaagtttatcaagtcgatcaactctttgataaactcaacaaatagttatcattgctcattataagattgaaaatgagactttgtattgtggaaaataaaatgcttacctcaagtgaaattttaaagtttatgctatgatgtttgtgatttcgcaattatatgatttaatgatattaaataatcaaataaataataattcattaaaattcacatatggtttaaataggtctaaatgagtttatatgggtcaaaataattttgatggttctaaatgggcttcaaatttaagtgggtttatatttacatgagtgtgtgtgtttacatgtagaggggcttacccaaattaacatccaaattaacatagagtaatttccaaaatgaagtaagattaacattcaaattgtgactagaactttgatttgagttatatagactttgtgtattatttttttataatataaacttcgttttgataagtttatataaaccttgttttcgtaagagattgtgaaattttctttgcagagggacatggttattttttgtctttggttcttgtaatgagattttaactatggtaaatctaagagcccatttgaagatgatgtctcggccctccttatccttatctcgcccaccgttctaaaacccttcccttcctcttcttttctcttctccttccacttccacttcttctatctctcacaattcagca

SEQ ID NO: 3600 - DNA, 3000 bp, Unknown
  misc_feature (1)..( 3000): cDNA_ID_1450335_gDNA_ID_1620653_Annot_ID_47775 3000 nt of promoter + ATG
ggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacaggtaccctactcttcctcatatatggttatgctaatgcagtcaacatgattttgtgatgtatctcttaatcgacctttcattgtctcttgatttacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatgatctcttattcatagtttaattcctaattgttggagtttcattccctcaatcgcatcgggggatacgacacatttctgggacatgccttgtcggtgacctttagatattagcaactacgaggtttaccccaaaatcggctgagaatgaaaggcttctatagcaaagcacaagttggtcgaggcctaagggaagaagactagaaaggtggtgtcatatggtgagttagtctctgccagtctagaggttcctaaagaagaggattgggatcttcattgtgttcgtaaagggatccactattttaatctcttgattggccactctctaatccaacacttaaacaaaccacacatgaaaaataagtctaaatttaaagcttattaatatggcttacttatttggcttaagaggcctaaactcatgtgatgtatcctagaaaaattatagatatacaaaattatgtatatcacctacgtctagctgaaatcttacccaccaatgccaataaaaagtttgccggagagaatacaagaaattcgtgtacaaatatacacgctccctctttatctttctttcccttgttagctaagaacaaatgataaaaagcttacaccttttatgaaatgctctctcactctcttaccctttcacccatgcccggttcttagtactgggagtgctatggcacatgacccactatgtttttttgtaaagaaaaaatcatttatattctagctccagcttacagtcctgaacttaattgatatgactcgttgaattcactaatctgaatgaaagactcttcttcgagttctgtttgtagcaagtatgtataactccaagccaaatatgaaatcatggtttcacattattagagggtacgtaatacaaactgagacaagcaaaacatgtaatgtaacaatcaaattctaaaacatatagaattagattcaactgatgatggcagagtgaaatatgcatttaaaagacaaaacaataagcaaaaagtctcgatcgtgctcgttgagtcgctttatcaaaatatggaaatgcaacatttgttgggatacacgagattaaatggtccatatattcatgcatgtgtagcaaacagcgtaagaaataatagacgcaatatataaaaccaattaaaaagagaggaaacaaagtgtatgagaatagagcgacactgatgattcattttctaggccagatcttgtcttggaactctcttatcgcccaaccttagccttagcttctcgaccagtcattccaataatttccacacttgtctctttgcttacctctattaattatttttggatccatcgttcaacgttttataaataaaataacattatttaattttcattattgtcactatcattctgcaaaaaagtgtaaaaatgtactaatatttttcttaaacaaaatgataagaatgaagtcgtccaaaatgtgttttaacctattttagtaaacctggacaaaactgacgaaaaaaaaaaaaagtaattggacaaaacaaaaatagtcatttaaaaaaattatatatcatgatatagagctacctaatgcagatacttagaaaactaagattcattattctctgataaagaaaataatcacccacgaaactactcaattataaaaaaactagtccattattaattggaatatacttaagtgtagtttttgttaacataaatggaggtgtatatatagttggtgccggcaagaaaagatggaggaaggattgtatcggtcccctaccccatgatcccgccagtaaattctttctagggcacccaaccatccacgtgtatccctcaaaccctacaacctgtaaatgtaaatccattacattacattgtatcttatttaatactgtacttacccaaaaagtttcttttaaattcaatcttaaatcatgttatagcaaacaaatctagctacacaccaacttgtggtttttagaatcttttaacttgtaatggacttttatgatgatatccatgtgaatcacacatgcatgctatgatttatcatgtgtagtaatatagtatgagaggccaatcacataaactcttaaatacaatgatattggacatgttatgttttgcatttcaaacaaaacaaagaaagaagaaatgtcgttttttgtttgtataaatccaggaataatggttttggtttttagacgcaatagagacagtatcaccattttcgttctggacaaacaaataaaattaaaattttgatacattaaaatatggttagaacttagaaaacaaatttatttaggttcataggccagtgagtctctctctctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaag

SEQ ID NO: 3601 - DNA, 3000 bp, Unknown
  misc_feature (1)..( 3000): cDNA_ID_1808145_gDNA_ID_1620653_Annot_ID_47776 3000 nt of promoter + ATG
ctctctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaagatgggaggtgtgacttcttcaatggcggcgaagttggcgttttttcctccgaatccgccgtcgtacaagctggtcagagatgaaacaacggagctttttctaatgagcccttttccccatcgagaaaatgtcgacattttgcggctgcccacgcgccgaggcaccgaaatcgtggccatgtacatcagatacccaatggccgtcaccacccttctctactctcatggaaatgctgccgacatcggtcagatgtatgagctcttcatcgagctcagtattcacctccgcgtcaatttgatggggttagtaaatctcccagatcagatttttctttctatatttagctcaggatcttgctcagaaagtcctcgccttttttggttttgctctgttttctggatttgtgcaagtagatttgaagcttctagatgcagaattttggtcttagtgttagagagaagtggactttattaagctgtggatttgtgattcacaaagcttttgaaagtttaagttgcagactcataaaatcttggatttttgctggaagagtttgtctttagggtttgtctgaatcaggatctctactgatcctttatcaaagagacaaaaagtagttttgaggttgagatgtttgagtttgattgttgacacttgacaacaagtggtcttgggcaaacattaccatttctagaaattcaagatctgttattgtttctgtttctaaaggcaagtactgaatacccaaaatgtagttctttgatgtaacaactttttggctcattcaggtataacttgggattctgggatagattggtttctcaaattagtacgctatttttttctgtcgtatcttcaagtgaacctgaaattagtagaatttacttctgtaaggttatgatttccatcttatgacattggaaaatcctctaaatatgttgtggtgtttataggtatgactattcagggtatggccaatcatcagggaaggtgagtaaccacagatcctaaagctctcttagttctgagattcaaatgttggtccatttacactgtgaacaactgaacataaatctccattttgttgcagcccacagaacaaaacacttatgctgatatcgaggctgcttacaaatgtctggaagagaattatggggctaagcaggagaacattattctctatggtcaatctgttggtagtggtccaaccgtggacctagctgctcgtttgcctcgactaagagcttccattcttcatagtccaattctttctgggcttagagttatgtatcccgttaagcgaacttattggtttgacatatacaaggtgaacataatacccttttgatttctctacatgatgttgctgataaacattcctccttcttgacaccgttttgtttgatcttcttcagaacattgacaaaattacgctggtgaggtgtcctgtcctcgtgattcatgtaagtttccgtgatcaaagattattgattggaagaattgaagttaataaagttgaacagatttgcaagatccgttcattcttgtatgaatccttgtctaataatcctcagtgttagcttaaaggtgaaagcttttcgatttgcagggaacagcggatgatgtggttgacttctctcatgggaagcagctttgggaactctgccaagagaaatatgaaccgctatggctcaaaggtggaaaccattgtgatcttgaactctttcccgaatacataggccatctcaagaagtttgtgagcgctgtggagaaatctgcatcgaaaagaaacagttctttctcaagaagaagcatggaagggtgtgaacaacctcctcgtcatagtgtagatgctccaaggaagagtaaggacggacgagaaaaaccgaggaaaagcatagacagactaaggttccagggatacaagttgagccacatagagaaaccggagaagctgaaggttccatttgaagaaatggagaggtcaaggagaagcgtggacatatacagagataagtctcagccgatggagagagcacgtaagagtgtggattggttggacagaagtcgagctaccgaatgaaaatggagggtttgatgtcaaaagattgtatttgagtgtcgttcaatttattggggtatgtgtttgtattgtagtttgtatgccaagttaaaatacaacaggaagatagatttaaacaaagtatgataacttgtctgactgtttcccacacgacacttttgactggtttttagtttatttgacaagattcgtgtgctgtcgtcttgctgttgttgttgttcatgtgcaaacttgaagtgtaatagcctgcaaacagaatctccgatctaggaaccaactaacaataatcaacaaaaactctcgatccaacctagcacagaagcttgcactcgatttgctatagtgggtggaagttgtattgtacttgtatttgtaagaactaagaaggatccatagttttttgatcaaaaagaaaaaggaaaaagaaggatcaataggcttgatgattactgattatgtagatgggtatttttattggctttcttaggcccaaacaagggatctttatgggcttttattacattggtactgtcagagtcggataagactccgaccgaattttctaaccaaagtgagtctggttcgaaaagactgcttcaatgaagccaaaactatccaataactcgaaattgactactcttttcttttgtctctgttgttgattcgcaaaggcgaagattatccatcttctcagttactcctactggaaccaaaagctcagaaccttaaaac

SEQ ID NO: 3602 - DNA, 3000 bp, Unknown
  misc_feature (1)..( 3000): cDNA_ID_1807910_gDNA_ID_1620653_Annot_ID_47777 3000 nt of promoter + ATG
tcttcacttaaatcccccattggaggcacatcgctctccactgttcgtcgctttgtaagttgattctctattttggttttatggccttatctcgttttctccattcgatttttttgattggaagcgaaagtaaaattttgacactctttgttgttgaatagggagtaggtgttgttaggatgcaagctgttgatgaagatattgatttgaagcaaatgagagacatagctgctgctaaaaagcgttgggatggtttggtaaccatcacttacatcttaaaattggaacattggagtgattatggttcatgtttttattttcattgttattcaactgttctcactattaacaaatttattgtttgcatagttaagggaaggaaaagtgaagcttcttacaccaagagaagcaggctatgctatttctctttcaaacaaacctctccttgatgttcgtccctctagcgagcgcaacaaggtacattcttgttttttaagttattaggctgcttgtttacttatccatagatgatgattgtcttgtctaaattcacccttgaacgttattgcatagaatttggttcatgtatctcacctttgcatgacatgttagtaagttagttcaaactcttggcgactgtaatgttattatgaaatcaaaactatagtgtgttactgatgtagtcttctccttcgatttttttcttttcttttctataaaggcatggattaaaggctccacttgggttcctatcttcgacaatgatgacaaccttgacgctggaactctttccaaaaaagtcactagttttgctatgggtacttctccaccattataagttataacctgttgactatagtgacattggatcaattcattattattccctactattatctatatttctattgtatatcattgactaatcccatctaggatagagactagaacacttgaatacacgcatttattaaattctttttggttcttgtaaaaaattttggttttgatttcaccatgtttccacttgtacagggggatggtggagtggagcacctacactatcttttaataggtatgtctgcgagagtaagctgaccttcttctttgccttttggcatacttacttgcttcttggttttctacttcgtttgcaggctcttcttgtcaaaggttgaggagaaattcccaaaagactcagagctgattgttgcttgccaaaaaggattgaggtacttgaaatatagatagataatgagtgactaaccatgcttgaaatatgtggttactttatattataatgagtaagtggctggttaggttctctgcctatatattatatattcatagaattgcatggtgatttatccaggttttgggttgaagaagtatcattatcaaatggtctcggttcttgtggaatgaaaattagtcttatattgaaagttagtatgttgatagtataactgtgaatcacagggttcatattgttggatgatcctcaaatttatgcttgactcgtaaatattgtcagatccttagctgcttgcgagctactatataatgcagggtatgagaatctgttctgggtacaaggtggtttagaatctgctcaagacgaggttatacgattgttttaaactttcggttttgtgctttatactttttcagtttcgtttctgaattgcaagattctacaacatcgataactaattcattcattatgtgatagcaggatctagtgacagaaggtgtccaacccttgaagcttgctggtattggaggtttttcagagttcctcgggtaattctctcttttgctactcagactttctcatagcttgaaaagtaaaagtctcaaaagacaatgaggagaataatggataggcctgtatttatttataatgactgtaagtcaatagcctagctctatcttgtacatcattagcagcatttggtattatgctcatacatctttttacttgcagttggacagaccagcaaagagctcaagctgcgaaagaaggttgggggtaccgtttggtatatactgctcgtctggtgagtttttttaatcaaaatctcttgtagcttctttcttttgtgaatcatgttcctcatgactgcttctctcatgtcatgtttgtagtttggagttgttctggctgctgatgctttgttcgttggggctcagcaactaggccattatattcaggagttaagaggccattaggatctctctttaaccacgctccaagtggctatatttctcttcaacaaaaaaaaattgaaaagttttggaaggtagagtagttgaaatagatcaaaaatacatctttgaatcctgaaattccaatggcaaacttaccctttgctttataccaagatccgtattatccaaagaataatttgcttatataaaaaagaaaattcgttgacgaaaaaaaaaagaaaaaaaaaagaaaaaaagaaaagaaaattcggcttaaacttctagtagacaaagttaaataatctaggacaaaaattgcgactattcgagtttggtccgaaatcgtaagtaagagagtttggtcgggacgaaaaaaagaagaagagagtttggtccgaaaaaaaagttaattagagagtggaatattcgacccgcggaaaaaaaaatctttatccaatttaaatgcgtgtcgttttactagaaatatgaagcacttcttgttgtttcatcgtctggaaagtggaagcatattctctctcccatcaattattgagccaacccaactatggttaaatccagcacagttccaactaacccaggttataccggttgattacacgtggacggtggagatttttctgactgcttctctatcgcaatttgctattcctctgcttaaaaactagggttaggctacgattctgtttacaccaaaaaagcttttcgtcatcgccgtttggctttctgaaacaaatcacaccgtttaagattttctctgattctgagatt

SEQ ID NO: 3603 - DNA, 3000 bp, Unknown
  misc_feature (1)..( 3000): cDNA_ID_1821310_gDNA_ID_1620653_Annot_ID_47782 3000 nt of promoter + ATG
agttggggtctgtttcagttccaagcctggatatcaaagtgtctggtgattcgtctgaacaaatcagttccttcactaatgaagagtctcaaaacagagctaaaaacaactggaaatctcaacatgtgcgtaggactcaaagaaactcactggtaaataagcctgcagagaaattttctggcaacaatgctgttatttgggctccagtacatccacagcaaaaagctgatgtttccactggtggagggagtcagactactgtccctgagtttggcacctcttcaaaaagtcagcatcaaggacagactagttctaaaagcaaaagagtggaaattgaaagatatgtaccgaagcctatagtaaaggaaatggctgagcaaatcgtcagtaaaaatctagtaacctctgctccagatatgtcggagaatgtaaaccagaaagaaaatcgtggaggtgagggtacaggaattctccaaccttctggttcaactgcagggaaatctgggtctccttcaaagtcaagacatgggaatggtaggcagggaaagcatggtagagaacatgcatcatggcaccagagaggttctggagcacctactaaagctttggaggatggacaatttgtaacctcaaatcagcccatccgaggaacagtgaactatcactctagtaagcaaaccgaacaaattgctgccaaggatcaaaccacatgtaataaggatggatggaacgatggctggtatatgactcctgaaacgcattactctgctgccgaagaaatggaatccagtgctgttggaaaagatcaaggaatgagcatgcacggcaggcagcatgcttcaagaagcaacaaggatggaggaagcaactatggtgaccctaaaaaaggcaataagagggatttcaataaagctcatacgcagcactctggccatgggtttagccaaccagatttgcctgctgcttcaaaagaaggtcgtgtccctggagatcatgtgtggcatacagctaataggacaggtaagtatggtggtcgtgaaagtacaagggacaaaccttatggatctcaggaaaaaaatgttgttggatacgagcatcaagggtttactacagaacaaaaaacgacatcagctgatacacaagcccagttgcaaaaccgatctaccaataaggaggtccaggttgagcaaaatccgaatagtatgttccaaaagaacacagggcagggtcgacggtttggaagagggcaggagtcacaaggaggttggggtttaccggcgcaagagaatatgcaccatcaccatcagaggccaccttcaaacagagatagacagaagcaaaatctgcattatgaatacaaacctgttgggtctcatacttatgatggagaacgtagtcgagaacaatcgaaagagagttctcagacagaaggtccaagatacagagagaagggacaggggcagcaaaggcagggtggataccaacagcaaaggggtactagtgggagaaacggtggtcatggattcactggtgatagaaactaagattggcctcttattgttatttaggtagtaagagctgccatgctgaggatacttgcattttgagatatggcgattgaggaagctaattcgtaggcacatagcttgggagattgctgagaggagacctatccgaggaggtattggcagattaaaaaaaaaaagtctttgtcttgagagtttattattatatgtttcagtcacttgtttgaatatgattataactactgtagtagccttttgtatacactagatgaatactcatgagtatttttgtttttaaagttgcttaaaaaaatatgattatgttttttggttgattttgatgttcattttgataaattcctatctatttaatataatttttttattttatgattagatttatctataactcgaaatatcaattctagtataatatatatatttatatctattattctaatattttattgtcatgatcacatataaaaacaatatatgatatattgatacaatgtatgcgttttgaaacttgtctaaattaattgtacaaacaattatttattccatatattctcttgtcatcaactacacaatcacatcatgatatgctagtaattcaagtcacactttaattcttttcacttgcatatagccatatagaatctcatatttttttttttgtatgtcgaatgtcgaatgtctcaaatgactattatattataaaattgtatatcaatgttactaagttattagaacgcaccaaaatgtacagaaaaagttcatatgataaattatattcacaaaacgtaataataagaaaatatctaattaaatttactaaatttatatgaggttaggtagcaaacataagagttttaagagtttggattttggaattggtggtgtttgtttctcaaacttcataaattagagtttaaaatgtttttttattttttgtggtcggcataagagttgaagttttaataaaataaaatagtatctgatcattttattggagaaaacataaaagatgtagtattttataagaactcgaattggtcaattttcaaaatgttagtatgaaaaataaaatatctagttatatgtactcgtatctcttgatatttttggctttaacttagggatgttagtttgatttgtctttctggataagccagtagtaaccaaaaaagtcaaaatcttgttggctaagtcagaaattaattaaataaacaaaagggcccattaaattaattattttaataaatattctgtgtaatgatatatagtataaaacgcgaccgtctaaattcttggttgtttacgagaaaagcggattacgggtacgcttcttctaagataaatctctccccgattctctctttttctcgctagatactctttttcttcaattagggtttcttctcgcttgccttttaattctctccagctgatctgatctccgttaccgatg

SEQ ID NO: 3604 - DNA, 3000 bp, Unknown
  misc_feature (1)..( 3000): cDNA_ID_1821306_gDNA_ID_1620653_Annot_ID_47783 3000 nt of promoter + ATG
agagtaagtagaaacttacaatttgagattgataattctatcatcgtcttcttcaatcttgctatagttgcaagatgctgaagacaacgaagaagattctgaagccgtggtggataccacgggccatatgctaacatacgctgttctgtcccatgaatctcctcgttctctatcacccttcaaaatctttagaatcaagctgaagttgatggccaacgagaggaccaacatattcctccaagaaagaaacctcggaatctgtcccattttctctcaaaactaaaacacaaaaccaagaaacaagaatgcaaaatgcttaaagaagaagagcagagtgggatagctggataaagacctcttttaaaaaaaacaaaggaaacaaacaagtggtgtccaacgagactgatcctttttttggctgatattcgaagttatgatttttgtaagagattaaaataacccttgaagaatctcaagagataaaggtatgtataacaatgtgtttatattggattacgaacctaactcatgtacttaactcataaatattaccaatcacgattttaagaaattgaatttttaatcctagtagacaaattctaaactgagactacctatcaaaatacctgtagaattgcaggcagaggatcaaaaggtcacagaacaaattggccacagtgaaaggatcgctagaaggctttttatatgtaaactgaaaaagaagaatgtgtaattaggtcgaagctctttgtttgtttctctccacgataaaagatatttcccattgggaaaaagttattgtattttggctttggcgtgaagagtttcagcttttcggtttgtcaatggcagaccttggaaacgacagtacatgaaccgagtgagacactgaatttattcaggatctctgtttactagtacaagactggtgaatgctttatgtgtaacaatattttctagatttacgtcacttctctgttttcacatctaattagattagcttaaggctcattatattgactatgtaatattttgccctatatatgtttagtgtaatttacacatttggacaaaacgatttagggtgaaattgttgtaataacatattttggggtgttgattgtgaaagtaacaaagagaagaaaataatctctgcaagggtaacattaaaatagataaatgatccatggaccaaaatctacatattgccacggcccaaattgttcaagagtttagcaaagatcatatgggctggatccaagaggtttattatatttggtcattgttcaagtatatttgtttttttgttttcttttcatacattactgtttattgaatatgattctatcaaaggtgaagttgtataaaatggggtgggatcatcatttgtaagcattcaagtgtctcgttctctaactttcttaagtttgttggctttctctctaactcttaagtatcaatttggagaaaagcacgaaaatttaaaatatgctaagactactcgtaataaattaataaaaatcaaactatgcattatctaaaatcttctgtatataaaatttacacaaaattttaaaatttgaaaaaaaataagctagcgttgagctcaaatccgctcaagatcatcctctagcaccatgtacacagtgcatgtacgaacacttccaaccctcgattacaaaacaccggattaatatatgatctttccttagaatgagtgtactccacaaagaaacatgagaggtttggaagataaacataagcattacccaaaaaaccttattcatttgatcatgcctgccatcgtcttacttccctaaacatgtccttaaaatgaagaagtgaacctaccacataattcaatttctcccccatttttaacattcgtaaaatgtaaaagaaaggaaactattttgttaagtattgtttttatggctatcctttttttttttttttttgtcaaactatggctatcttttaaaatgggtaggtaaatatataaatgatgttaatgaataatactactcttttaatttatatatatatttttgttttttggagataggtgatcctttattcgctctattttattttaatcggcattcattttacaattcacaggaaaaaaaaaaagagagagaggaaaagctgagtaaaaccgtgcagccctgaacttcgacgctttctcctctttcaaccaatccgttgaacgtcgtcgtaataagcttcatcttcatcaatcatcatcactttcttctttctcccacagatccttccttttctccttcatcttccccttcttccttttccctcatcgcccaggaacacatccgatctgcaccctcttcgttcgattctcacaattaatatctagggtttgcgaggaccccccctctctattcaaaaaaagagagcagattttctctataatcccctttggtcagtttcttctctacctttttttcccctttgtattccagaggaatcgagtgatgagtttatagaattatcgcattttgaagtaatttgggtccttttgtagagcttgattgacatttctggagacatttgtatgtttcagagctctttttttgttgctgttgttgttctagcaagttgattgcgaaattgtcaacattctgggaatacgtcaattgtttttttagtattgcggtcatttagtctggaacctcttttgattccgcagtttgacgatctttcatacttttaggtttctgtaccaatttgattgtcgaacattgtctttctgttatgatggtgaattttagaaagtatttcaattcatgttggagaatttgtataggcagtctgattctgcaacacatttcacggtagcagtgttatagcaatagttcttcagtgtcggtcttgtttgattctttgggatttgagcttcaaatttcatttgtgaatctgattctgtatgtgacttacaggtttcaagtggtgtaattggatcgtgtagctgcttttataatg

SEQ ID NO: 3605 - DNA, 3000 bp, Unknown; identical to SEQ ID NO: 3597
  misc_feature (1)..( 3000): cDNA_ID_2999594_gDNA_ID_1620653_Annot_ID_47787 3000 nt of promoter + ATG

SEQ ID NO: 3606 - DNA, 3000 bp, Unknown
  misc_feature (1)..( 3000): cDNA_ID_1821290_gDNA_ID_1620653_Annot_ID_47788 3000 nt of promoter + ATG
acaagattcaaaaaggtgagctaagtaagactctgcatacaactatctttccagcatcagaaatttccaaacaacactcaaaaggtgatctaagtaagacactctgcataaaactatcttttccattacgatcataatgccaaacaaggccggtgggatcaaaaactgacctttccagagattatgtcgtcggagaaagcgcaaatagaatcaagtgtgttctcgatcaaggtctttaaagtaggcttaggtgcgagcttagagttcctaagccagtaatgtccaaccattcttccttcatcaggattcgctatagaccctttttcaagatcctccatagccttaaacgcagcttgaaaccttggctccatttcagccacaaactcatcggtaaatccgacccgactaatatccagatacaacccaagctctttctgctgataaaaccaatcgaggtatcgcttccacaacgcatccggatccttaagaagctctttcttcgaatccgcatgagaaatgtcgcgtgccacagaacgagccgaggagagagtcaacggtagattggtgggtttggaggtatgtgggaaagagaaggaatctcgagattgcgccggcaatgctttaaaggaatggtttttggcaggtttgagagatggagaagaagagtataggcctgagagagaggccatctttagagacagcgatgtttacgagggaagagagacagtcaacaatggagagagagagatagaaagagaaagggtggagctttatattggaggattcgtatagtttattccgatttgattgatattttttgggaggaaccaatgaacagagatgagtgcgggagagagatttgtcctttggtgggagcgagcggccctgcttagattaggtaggcttcacaaagcttttatcactcttattacgactatgtatatatattattgtctcaattggcatcatattctattttatttcacgtggcccgccattttcagatgttttgttttctattcagaataactaccactcttttgagctgaagaacataaactagcacttccaaccgtatatgctataaaatgaatggtaatgtggttttaaacaatttgtatgtgttttggatgaaattatgcgtatgttaaaatgttgattgggagtagggttgttcttcaaagaacttcgagtttacaagctttcgaaaaaaagattcgacatctaaaggacaaacgagactaccattcttggtgatctaaagagtaatatccatggagtatgctgatttagtcgggttgctttatgtgttcaacatatgctagatgcgtggatgtcgattgttgagcgttgtcgcatagcttttgatgataaagataacttttgtgcttattgacatttctatagttctccctaatctacatgatagatctcaataaattgttaaaaaaaaaaaaaaaaagaattttgaaagaaatgtgatatatcatatagattagggagatctatagaaatgatacgatggtagcttttcgaatatttttatgtcgccgagacattttaagggtttgactggataacttagttaacgcaaacaaaaagataaaaatgtaattacgtcggatcctgttaaagtttctactaatcatgatgaaaaatagagattatattcctttcattttacgtgcaaaacctagaaaaataagtaaataattacgctaaaattaaaaacaattcagctgctttttgtttattgtttccacccatttacatataaactaggttttaactcgcggtttaccgcgggcaatcaatttatttggttcttatactaaatatttgaataaatttgatatcttaaacttataaatataaatttctagtgattagtgaagaatcgtaataaatggtttggatattattgattattgatttcgtgattgaatatactgtttttagagatgaaatgtgattatattttgatttcaaaaacgacatagattccttatttttgttgaacggtttagattgaaagaaattaattttattaaacggtttagattgaatcggatcatataaagtttaggagattgttaagaccaaattagccttaataattttgaatagcaaagaataaaatccaaaattgaaatcaaaattgaggccaaattagaaaaaaattcaatttgtacttcccttttaataataaagggatttatgtttgcaaggtatacatgtcatcatctttaaataatcgagaattcgtttgtaaaattttaacattaaatggaattttcctcatctctacaatttatttttaaattacaaactttcaaagttttattaagtgtctattcaaacatgtcaaattcttggctcattgagaaggaacaggttcaaacaattcaatagaattagtcaaaaccagttgatttgcgatcataatcaattgtaattgatagtcaattgaaagacaaaatggacaatgactcaaataaatggtatttggttgttttcctacaaaaaaataatgtatcccaaaaacaaaaaaatcaccaactgaaattgtatagtttgcacgaggaatgaaatctgacacaaaatgcgcagaaaaattgaggacactaattgtaatttgtggtttaggagataaacatgattacgtcataatttaaaacaagagaaaggcagacaaaaacgtttaaacataaaaaaataaaaataaaaaaaaaactcaggttattcgctcgttcgtcttcgtcgcccattgaaggaggtcagaccagaagtcgcacgcgagccttataattgtgtaatccttagggttttgctcgcgatttctggtactattaggtttccgtcgatttcttcgtcgggataaaaaccctcttcttcgccggagggagaacacggcgagaattacacagctatccttcgaattccgtcgctggttagcttaggactttctgattctgtcgctttaatcttcttctctccatg

SEQ ID NO: 3607 - DNA, 3000 bp, Unknown
  misc_feature (1)..( 3000): cDNA_ID_1821286_gDNA_ID_1620653_Annot_ID_47789 3000 nt of promoter + ATG
ataaaatcagaaatcaaatatttacaacaatgagatatataggactatcagattgggtatcggagaagacttacataaatagtgaaaagaattgctaccaccatgatagcatatcccgcattgtagggagagaactcatggcgaaggtgccttgctacaaatacacagaacaaaacaaccggaactatgatcaatagcaaggtaagaggcagtgacctagcatctggtccaaatatcaatctcccacccaggatgaatttctgcaaaagagagagggaccatttattggtatcaccatactgaatttaaaacatgtgaagagtcaagcattgaagatacttccaattgttaataaattacaaggaacattcaacttgatacaaggttatgcaaaaatgcatggtcatgctttgagagtgaatcaagagatacttcaacgattcagctcaacaacattagtttacacgtaccaaagtaaaccaattgcgtaactaagattatgctacacaggtgaaactcgagaaaaaacgaattccaaatcatattcataccagagaacagaattcagagaatattcatctcccaacaaagagaaaacacacaaaaaaccaataaaattccaggctcaatcattcgatgaaaaaaggacttacattgcttcctttccagacttggaatacccgttgtgtcatggagagaagaagattaaagcgacagaatcagaaagtcctaagctaaccagcgacggaattcgaaggatagctgtgtaattctcgccgtgttctccctccggcgaagaagagggtttttatcccgacgaagaaatcgacggaaacctaatagtaccagaaatcgcgagcaaaaccctaaggattacacaattataaggctcgcgtgcgacttctggtctgacctccttcaatgggcgacgaagacgaacgagcgaataacctgagttttttttttatttttatttttttatgtttaaacgtttttgtctgcctttctcttgttttaaattatgacgtaatcatgtttatctcctaaaccacaaattacaattagtgtcctcaatttttctgcgcattttgtgtcagatttcattcctcgtgcaaactatacaatttcagttggtgatttttttgtttttgggatacattatttttttgtaggaaaacaaccaaataccatttatttgagtcattgtccattttgtctttcaattgactatcaattacaattgattatgatcgcaaatcaactggttttgactaattctattgaattgtttgaacctgttccttctcaatgagccaagaatttgacatgtttgaatagacacttaataaaactttgaaagtttgtaatttaaaaataaattgtagagatgaggaaaattccatttaatgttaaaattttacaaacgaattctcgattatttaaagatgatgacatgtataccttgcaaacataaatccctttattattaaaagggaagtacaaattgaatttttttctaatttggcctcaattttgatttcaattttggattttattctttgctattcaaaattattaaggctaatttggtcttaacaatctcctaaactttatatgatccgattcaatctaaaccgtttaataaaattaatttctttcaatctaaaccgttcaacaaaaataaggaatctatgtcgtttttgaaatcaaaatataatcacatttcatctctaaaaacagtatattcaatcacgaaatcaataatcaataatatccaaaccatttattacgattcttcactaatcactagaaatttatatttataagtttaagatatcaaatttattcaaatatttagtataagaaccaaataaattgattgcccgcggtaaaccgcgagttaaaacctagtttatatgtaaatgggtggaaacaataaacaaaaagcagctgaattgtttttaattttagcgtaattatttacttatttttctaggttttgcacgtaaaatgaaaggaatataatctctatttttcatcatgattagtagaaactttaacaggatccgacgtaattacatttttatctttttgtttgcgttaactaagttatccagtcaaacccttaaaatgtctcggcgacataaaaatattcgaaaagctaccatcgtatcatttctatagatctccctaatctatatgatatatcacatttctttcaaaattctttttttttttttttttaacaatttattgagatctatcatgtagattagggagaactatagaaatgtcaataagcacaaaagttatctttatcatcaaaagctatgcgacaacgctcaacaatcgacatccacgcatctagcatatgttgaacacataaagcaacccgactaaatcagcatactccatggatattactctttagatcaccaagaatggtagtctcgtttgtcctttagatgtcgaatctttttttcgaaagcttgtaaactcgaagttctttgaagaacaaccctactcccaatcaacattttaacatacgcataatttcatccaaaacacatacaaattgtttaaaaccacattaccattcattttatagcatatacggttggaagtgctagtttatgttcttcagctcaaaagagtggtagttattctgaatagaaaacaaaacatctgaaaatggcgggccacgtgaaataaaatagaatatgatgccaattgagacaataatatatatacatagtcgtaataagagtgataaaagctttgtgaagcctacctaatctaagcagggccgctcgctcccaccaaaggacaaatctctctcccgcactcatctctgttcattggttcctcccaaaaaatatcaatcaaatcggaataaactatacgaatcctccaatataaagctccaccctttctctttctatctctctctctccattgttgactgtctctcttccctcgtaaacatcgctgtctctaaag

SEQ ID NO: 3608 - DNA, 3000 bp, Unknown
  misc_feature (1)..( 3000): cDNA_ID_1821282_gDNA_ID_1620653_Annot_ID_47790 3000 nt of promoter + ATG
tgcagttggtctgcttccagcagcactacaggtaatttgtacataagcgtaaactttctatgaccattctttgttatttacacgaaagcattgtcatcatataggggattaatgttagggagatgcttactggtgctgctttaatggatgaggctactaggacaacttcggtaagtagtacttattgcagcttgtgttgaagatgagtttacttaccaggttttagtagaatgtcatatcatacggttgggtttcctgactcatacactttagatagtctctaccatgactcactctagcctgtaaatttctttcttctttcagatcaagaataaccctgcagcgctcttagctatgtgttggtactgggcttccaatggcgttggttccaaggtgtttttcctcaacttttttgagagttctaaggctatcaaggagattgagttcttattgaccttattactctattcttgctttcttttacaggatatggttgtccttccttacaaggatagcttattgctatttagtcggtatctgcagcagctggtcatggaatcactaggaaaggagtttgatcttgacggtaacactgtaagcatactcttcaattttctctgcagtaccccaaatcaaagttcatgagcatttactgagaactgagaaggtgtaaattggtcttgcaattaatgcccactcttataaatcagaagaccttggttacttaattacttgtgcacatgattgagttcagtttgttaccactccttcatggaagaattgaaacttgtgtactgtttcctcgaccctgttattacgagtgtgatcccaaggaccggttctttgaatttgcaggttaatcaagggttaactgtgtatggaaataagggaagcacagatcagcacgcgtgagtttcatttattcatatagttttactattgagagagcatagcaaataaggagctttttaacagtatttaatttgtttatttcattagctacattcaacagctgagagatggtgtgcacaatttctttgcaaccttcatagaagtgttacgggacagaccccctggtcacgattgggagcttgagccaggtgtcacttgtggagactatctctttgggatgctacaggtctgatttatgaatctcgtttcgcacaaattagtcagagataatatacactctttagtaacactatatatggtgaatttgtccagggaactagatctgctttatatgcaaacggtagagaatccatcagtgttacaatccaggaagtgacaccaacatctgttggggctattatagctctttatgaaagagctgttggtttatatgcctcaattgtgaacataaatgcttaccaccaacccggtagagatattcctcccatatctagaaaccgatgttctgtaattgcctaattgatatttgtttactgaatctgaataaaaaacgatttcaggtgtggaagctgggaaaaaggcagcagcagaagttctcgccctgcaaaagcgggtattgtcagttcttaatgaagccacgtaagaatcagaccgagtccgcttctttgtcaaaaaatcttgtctcgactcatgagagaccacttatatacttctttctgtggctgcagttgtaaagatccggtagagccattgacactggaagagatagctgatcgttgtcatgctcctgaggaagtaacgtccaaatccttgaaacttgttttttcattggtaacttttcgaacgcacgtatcaagaagtttttatctttgaatatgcagatagaaatgatatacaagatcatagcgcacatgtctgcaaacgacagagttctgatagcagaaggaaactgtggatcgccacgaagtatcaaagtgtatttgggcgagtgcaatgtggatgacctgtacgcataacaaaacccaacactttctcaaactccaaactctcattctctccattccttatttctttctgccatgtctatgattttgaaaaagaaaaagattgcaataagagccaggaaacacttgtgtacttgttttgaaataaagataatttcagaatgttacaaatgttgattgtaatgataacattggagatagattcatcaatcaagcaggctcatgtgaaacaatgatctcaacactcttctgcttgttttttggttaggtgttcttttgttgcataaacaaacaaaagcttaagctaatcagcaggttagagatgctcaacaacttcctcccatgtggttagattgtatcaactatagtttcttcaattaaattcacttctgaattttcttagaaaaccccattcagatctaaccaagataactctaaatatttaattttccataataacttttcacttgccacttttgaaattcgaatggaatatgttgacaaaagaaaatggtagatccaccgtaagaaaacaagacataagtcgagtcgattgtccccaccaccacctatttagtagcctaccataacaacaaaaaaattataacgttacaatcccttttatcaattttcaaaaccaagatgttgaatcgctttcccatgtcatcactacccgttatgccatagctcctatcaagctggtgagcgtactaaacgacaccgctttggggaggtcttaccaactcgattgcttttcctctctaccctttcccaaatttgaattcccaattttttcaaaatcaaaagtaaatactaacaaaaagcaaaaatatcaaaaaaaacaaagaaaaatcattttgaagtgcacagatatcaatcgtctctctccctctctctctgtgagaaagctttctgattaagctttcgtcgtctcctccattgcaaaatctagctcgatctgtgaaggtttctctgagttcttcaaaaatctcttctagagaaagacttcattagctcaattttagcaacttcctccacctccttttactcacactgtgcttcgatttcaacttcgcatttcaca

SEQ ID NO: 3609 - DNA, 3000 bp, Unknown
  misc_feature (1)..( 3000): cDNA_ID_1821278_gDNA_ID_1620653_Annot_ID_47792 3000 nt of promoter + ATG
agcaagcataatggtttaacctgaaaaggtaaaactctcaagtcttaagtcaatgatgcaataattcaattccatatttccattaatcgatcggaatgagatttgctcgaaagaaaaccaggacatgcctaatgattacatgaatgctcatcatcgcgcaacaatgaccaatggagaagacagaaaatgcaggtaattgtagccaaaaacgagatcagaagtgggattgtgaacaagtaatttctcctgcttcgcgttccattacagaggcaattcgatcaaaaagcaaataaatatctcattaagaaattaccgtgttgccaccacgggaacgcgagtctgtgtttccagactgcgcaggaggaatactgcaggtgtcaccctgagatcagaacaaaaacaaacattgagcaacattggaagaagaagaagaacaacaatcgggtctggagcgagatgaatttccaaaaatagagagacgcacatgaggctcctgctcttgttcattggcaatcggtggctgctgctgctgttgttggtttggctgcacatgaggaggaggctgtgaagatgattctgcgtttttgttagccatgaccgcggttcacgccattgacgtgcggcactataaacccaggaaacaaaaagagaatgtccgatgatcaaattcgaggaggaaaacgcagtcgtatctaactgatctcagatcagagaagcatgaattcgatcgagaaacaaaccttgatctgggaatgatagtaaaaaaaaagtatcaattaaaaataaaaatagcgaaaatggtgttttagggagagaaatggtgagagagattttggttgtgaatggattgattgatgagttcaacggcgttagaggagaagaggtgaagcgaaaaaaatggccgaaaaaagaggaacctttgcttttattttggcagttgtacacgtcatcatcttccccccttccttggagggaaattttccctctttctccccctttgacctcttccctcttctctcaaccattatttctcttataccgaatttatattaacactcttataattactctctactctatagttttatggattatatgctacttaatatgtcttagagtcttggcaaaataaagtttaagacattaatttagagtaaataagaatctctctttctctttgtaataaaaaatggtaatggagatgacaaccttattacaccttgcattgatttgaccctctgacctcagtaatatactgaatcgtgctaagcacgaccatccaccactctctctgtttttgtttgtctgatttgttttgcttatgatatgttattggtttgaatagtttaataaatctacgtgatccatttgtttatctttgtttggataatgctgctgcgtgcatggggattcgttcattcgtctgcttttcgattaattttaatttttttttgtttgatggttgtttcaatattaattgactattcatccaacaatcttcttcttcgtttcaattactatgcaattcatataacttatgcaatctagatttggatatagcatcgatcttgtttgttggatgtccaagcgcaacactaatgcctcaaatggcaatgcgttttaggtgtacaagcgagcgacctaagtgtatataggactgtcatatcatgaaattactagtgttaagttaaattagtatagtcaccgctttccaacatatccaccaccccctactcgtgttcccttgcaagtaattaacaagtgtgatttgcgtagacgcaccaaaaccgaatcacattaatgtaatctgtagtgatcaaaaaacagattgggtgacacttacagtatgaattcacctgattccactaaaacttgagcatttatatggcacaaagtgttttgataagtctctttacttgttcttattggaaacacttaacaacgacattgagttcaaacatttttttttttgctaagagttcaaacattggtttctatgacatatctctaaaatggtcaaagactacgatgataaacataagtacataacataaccatctcgatacatgggaattaatgatagaatgtgaaaacaaaatccaatttgtaaggaaaaatggcgaagtagtaagaaagcttaaaataaggaatttcacataagagatgagttaatgcacatgtacaagacatgtttatgctaattagccgaagaagtacaacgatggtgagaataaatcttattatttaagtataattaattttcctcagagatcgtcttcaacaagttttaaaggactttatcaactgctactgatcaatcatctactcaaggagaaatggagaatagtacacactacacaaactattgtctatgactctatggtgtatagttcacatcagagacaaaaaaaaaaaaggaaaaaaaaaaaaagaaggtgaaaacaacaagagatcgttgtcataaaaaatagtaacaagttgttacttcttgcataaagttgtgatgtatgtaaaaaatttgacgtcttcgttgtgtttgtcaccgtcactgttacagctcccgtcaccgtgggaatattttatgtatgccaaatatgccatctgtattccataacacttatcgagattttaataagtactcaattgctttctgattaagtgttgatgattatggtttttattgtggttaagtatgctgatttcaaaattttaaaaatcaagaatacatttctaaaaattatatacaaaataataaaaatatttaaaatcaattaaaattctttaagatatatataaagcaatatttgtcccaaagattgaatagaatctaatttcagcaaatttagttgcttgttgtcttacgagtcacgactctccttttcccctttttccggtggaaataaaacaaacaaatattgtaggtcgcaattgtggaggagaaccatcaaattcatcttcttctctttcacaaatttcagcctaaaactttccgattccatg

SEQ ID NO: 3610 - DNA, 3000 bp, Unknown
  misc_feature (1)..( 3000): cDNA_ID_1821274_gDNA_ID_1620653_Annot_ID_47793 3000 nt of promoter + ATG
ttcactaactacatcccaagagctactatcttctgcaaattcaacagctagcttatatagttagttatctctacaaccaaattacacacacattggcaatcttattgagtagataaacaaagctgaaacatcttaccagcaagaacttggggaactgaaacttgagctaattctatcttttcacgaaagtcattacattcaactctagatttgatgagatcataaaactgcacataagaaaacagatcacagaatcatgaaattgagcttctatattctaagttgagctaacatcgatcaaaatcctacgaaacagagagattaaagtaataaaaaagcatactttatcagcttcaggatctcctggatcggaagcagacggttcttccctgtccgattcttcctcctcctcctcctccggtgattcactctgttcgccaccgttttcatcgccgggaagttctagaagctcaagagctctctggcaatccgcgagcagattctgtaacgtctttcgctttacacgaatactatccaaatcgatgcggtttcctttggtttcggcatcatgagtcgagcaagagacttcgatttccatggaatcggaaagttttaggctgaaatttgtgaaagagaagaagatgaatttgatggttctcctccacaattgcgacctacaatatttgtttgttttatttccaccggaaaaaggggaaaaggagagtcgtgactcgtaagacaacaagcaactaaatttgctgaaattagattctattcaatctttgggacaaatattgctttatatatatcttaaagaattttaattgattttaaatatttttattattttgtatataatttttagaaatgtattcttgatttttaaaattttgaaatcagcatacttaaccacaataaaaaccataatcatcaacacttaatcagaaagcaattgagtacttattaaaatctcgataagtgttatggaatacagatggcatatttggcatacataaaatattcccacggtgacgggagctgtaacagtgacggtgacaaacacaacgaagacgtcaaattttttacatacatcacaactttatgcaagaagtaacaacttgttactattttttatgacaacgatctcttgttgttttcaccttctttttttttttttccttttttttttttgtctctgatgtgaactatacaccatagagtcatagacaatagtttgtgtagtgtgtactattctccatttctccttgagtagatgattgatcagtagcagttgataaagtcctttaaaacttgttgaagacgatctctgaggaaaattaattatacttaaataataagatttattctcaccatcgttgtacttcttcggctaattagcataaacatgtcttgtacatgtgcattaactcatctcttatgtgaaattccttattttaagctttcttactacttcgccatttttccttacaaattggattttgttttcacattctatcattaattcccatgtatcgagatggttatgttatgtacttatgtttatcatcgtagtctttgaccattttagagatatgtcatagaaaccaatgtttgaactcttagcaaaaaaaaaaatgtttgaactcaatgtcgttgttaagtgtttccaataagaacaagtaaagagacttatcaaaacactttgtgccatataaatgctcaagttttagtggaatcaggtgaattcatactgtaagtgtcacccaatctgttttttgatcactacagattacattaatgtgattcggttttggtgcgtctacgcaaatcacacttgttaattacttgcaagggaacacgagtagggggtggtggatatgttggaaagcggtgactatactaatttaacttaacactagtaatttcatgatatgacagtcctatatacacttaggtcgctcgcttgtacacctaaaacgcattgccatttgaggcattagtgttgcgcttggacatccaacaaacaagatcgatgctatatccaaatctagattgcataagttatatgaattgcatagtaattgaaacgaagaagaagattgttggatgaatagtcaattaatattgaaacaaccatcaaacaaaaaaaaattaaaattaatcgaaaagcagacgaatgaacgaatccccatgcacgcagcagcattatccaaacaaagataaacaaatggatcacgtagatttattaaactattcaaaccaataacatatcataagcaaaacaaatcagacaaacaaaaacagagagagtggtggatggtcgtgcttagcacgattcagtatattactgaggtcagagggtcaaatcaatgcaaggtgtaataaggttgtcatctccattaccattttttattacaaagagaaagagagattcttatttactctaaattaatgtcttaaactttattttgccaagactctaagacatattaagtagcatataatccataaaactatagagtagagagtaattataagagtgttaatataaattcggtataagagaaataatggttgagagaagagggaagaggtcaaagggggagaaagagggaaaatttccctccaaggaaggggggaagatgatgacgtgtacaactgccaaaataaaagcaaaggttcctcttttttcggccatttttttcgcttcacctcttctcctctaacgccgttgaactcatcaatcaatccattcacaaccaaaatctctctcaccatttctctccctaaaacaccattttcgctatttttatttttaattgatactttttttttactatcattcccagatcaaggtttgtttctcgatcgaattcatgcttctctgatctgagatcagttagatacgactgcgttttcctcctcgaatttgatcatcggacattctctttttgtttcctgggtttatagtgccgcacgtcaatggcgtgaaccgcggtc

SEQ ID NO: 3611 - DNA, 3000 bp, Unknown
  misc_feature (1)..( 3000): cDNA_ID_1821270_gDNA_ID_1620653_Annot_ID_47795 3000 nt of promoter + ATG
tataaatagtcgccatcatcatcatcaataaaagaatggtatcaaaaatctcgaagcagcttcctaacttgctccaacgtaacgaagagaacaacagtgaaaggaccttgcctacaaactgtaggaacaaagcctttataaagagccatggctccttccgctttaaccgtcttcaccgcacaatcccacgcgccgtcgtacgctcccaccttcatattcatcactctcgtctttatcacatccaccggattagacgcaaccgaagcaacaaaccccgccgcaaaactcgctaccacgtgagtccctagcccatcattcatcacaccattctccaatatcccttccttgaactgatcgtaagacgctagctgagccgccgtcacaatcatcgctcggttaatcgtcaacgccgagcctcgccacaagctcgttacgccttctcccttaaccatgctcctgattgcgtctcctactccggcgtagttacgacgttgcgctaaaggtaacctcccgtcagcttgcatcctaaccatcgccacgtcagctggatttccaacggcggctccgattccaccagcgactagccctgcaccgatcttcctactcagattcaacttccctgactcaggatcagtccatttgttcttaagcacttcgtatagacccatcctggtggtggaatataacgtctgacggagaagtgtagcggagactcctgagaataacgcggcggcgccttccgatttgactatgttgattccgagtgagatcggtcctactttggggactgaagaagtcgtttccaggaaagctgcaggagaagaattggggaaagcgagagctggacggaggagagtgacggtggtggtggaaggtgcttcaccgtgaagctgaagacgaaccttgattagatcgagagggtgagtagagcaaccggcgattacagaggcaatcccaccttcaacgaaacttttgactcccattgttgtgaaattggagagagaagagagaatgaaattgagatgttgtgagtgaaggagaagaagagggaaacaaaggtatttatttgtagcgagttttgttttgtgacgcggttttgtctgtgttcaatgttgacgaaacgagtgagagagtgtctgattattaaagaaaaccctaattaagtcagacccgccggttataaaaatagtcaaaaagtaggaaaacgcgtgtgtgagtgagacagagacagcccattgtttgctttatgggcttataagcgagacgtgttaattgggctttttcctttatggccgaaaacaaaagaaacgtcgcctgagagattcgaactctcgcgggcagagcccatgtacttagcaggcacacgccttaaccactcggccaaagcgacttgttgctatgagttagacaaaatcattaaaattctctattatgatttctcatagtgtgtgtgtatattgtggatctactaaaaattctttgttattattactttattttgtgaattagtttgatataggtaagtacaaagttaactttattatttactcaaaatttatcagattaactgattttatattgtttcctttggtatatagacgtactatagtttttagaaaaaccataagattcctttatatttcatagagtgaagagatgagatgagatcttggctggagaagaaataagtttccacgaggaggactctttttttttggtgaagacgaggaggaggactcttggttgatccagtctttacgttagacatcgacccctacatttatttgcctttctctatcaacatggcaggtaaaaatcttcattcaaccgaaccaaccaaagtctcttcccaataatattcaagcaccatcctttgggaaactcatacatactacagtctacactctttcattttctttcaacgctcaacttaacaaatgatatagtctagttgtcaattatatgttttaattagtgttttcacatcaaattctggtttgatatttgatgactattttcggaaacatctcaatgtcccgcaaatacaatcgtctatcatatataatcccgtacgttgtattcttatagatagaataatatggcgtgatctttataatataacatatagaatcgtgtagatttattttattttatttttatatatcgcataaattgcaaaatacttatatatgtttgttatatatgatacccattttatagttacttaaaaaaagttaagcgataatatatatatatcaactttttataacaaaaaagtataacacatggtaaagaaaaataaaaatgaagacatggtgtgacacgaaaatggcactaaatatacatatataatagatagctacaatatcccatcatacacacttttttaattgactaatacataacttacacacttttttaattgactaattcataactttttatcattgtcaacatgcaaattcatatttccgttgaactattattcttattttgtttttaaaagaagggcttcctggtaataaaaatatgatttccaaatgacgttagagcaaaaaaaaaaaaaggttgtctggtctggtaaaatgaaaaagcaaagcgtcttggtatagaaaagtaatatactgcctcctaatttcttcgtccttctaccgaagaatctctccactcttgccctctttcgaaaccctaaaccagaagcaccagattttttcaactttttcccagagaacaatagaaaacccaacttgtgctctctagggttttctttattccttctcatctttggattttcttgggtcatcattttggaagcttacccaccagcgaaaaaattataacttccatcgattcctggcttctctctctcgctctctctgcatgtgctaaatcgccggactgatcctcactgtcacctctgttcccggcttattcgccggtgaaatctatggttggtgctcagatttatttccaattgtttgtgcatctggtggaggataa

SEQ ID NO: 3612 - DNA, 3000 bp, Unknown
  misc_feature (1)..( 3000): cDNA_ID_1807115_gDNA_ID_1620653_Annot_ID_47796 3000 nt of promoter + ATG
gccatcacgatacagacagatgactcgtttcccaattatggtaatgcttcccaagataaactaaacgagtggttaagaattaatccccaatcataccaagtgacagtgtcaaagacttttgtaatacacaaagtcaaatgaaaaaagggaaaagaaattcattctaattgtggtaagtactatgtatccatatatacatatgctttcctaattaacaaaaatcacactataatattctgctctcttatttcccagtacagaaatcttaaccatgagtctaaatgaaaatgattgaaaaattacacgttaaaaacccatattatgttaaacggaattaaatacatgatgtgttatacataaaagtaataaaacatcaatcctatactttaaagtataataatttaggtcatcaaattatgccgtacatgagatctccgagcctactgataattaactttagagagtaaacgagaaaataaaaatctcatttaaatacatatcttaatatatttatccaaccatattctcaaaaacacaaacatggattgaaaaaaataagacaactactaacaaaaagatagaatataccttgagctggagaactcgaagagctttccggtggcagagaagatgatgagagcaacatcagcatcgcaaagaactgaaagttcatcggctttcttgaagattcctcttcttctctttgagaaagtaacttgtctcgctgttatgttatcaatcttctttatccttatcttctctctcgccattttaccagatctctccttcactactgttcttgaatctgcctatacccataacaccatttagattttagaccaagaacaaagaaagaaaccaattggaacggtgttagctaaagagagtttatataatattcttaggaaaccctaatggctagagagagagagaaagagagatcagatccataaaccatgagaagcaaaagaatggacaggactagatgaattcatcaaacactttgcttaagaagaaagaacacagattcacagcttttacctttctgtgagttggaggatcttggattacgttattcaatctcagcacccactttattaaatttgtgagaagataaaaaaggtttttctggtagctgtttactccctaatgtgtgagtgagagagaaagagagagagagatggtgactgtgtttgtgttcaagattggaaaaaagagtctgctttttttagctaaacagtgatctatacttatcaatgggccatatgttttgtatcccttttgattatgtctttttcccaaactataatcattaaaaataacacataaacacactttgtgttttgtctgactgagctgccagacgaagagactgctacagttatgatttaataatttacctaaccttctaattcaattagtctgtcatggaataatgtggaattgtaactttattcagtagcgggtttcctagttttactgttttagtctagttttgaataacttcccatctaaaaacaaaataaaaataaatgacgtgaaatactactccgtataagttaatagatttatatatggctaggtcaaataaaatgatacaaaagttacccactatcaaaaatgtaacatgataaaataaaaaaacataattggaaaatgaaagaaatcacaatacacaaggaactacgtaccaattctaatggaaagaaagtttggttactttttttattcgtaattagaagatgctgttcatcagttcatctacctttttggttttggtttattacaaaagttgtgtctattaaatatttcatgtcttttttatagtctttcacctatatatgctagatgcgacacctgataagatcactcgtctcccaccgtcatcattatcttttatttttgggtttgatcagccatttatacccttttaagttttaaccctaattagaaatgatatatcaccggactccggtaactctagggtgatatcatggccgacaagtatcttgtaaattttttctcccaaagtacaactgaaaattaaactaaactgataaaattcgtgggaaacgtaccatctcataatgatacatgtgaaaagtaatatagatgactttaagacttcaatctgtataagattaagttctttatgactaaaacaaataagcactaagaatgtgagacagatttagtattgtaagcctttggttttgtttatgggaggaaaaaaagcgagtgcaaaatcagaaagtgagagtttttggtgtagatcaatgttattggtctttaggatcttatagtaatatgttgaaaatatatttgggacgagctagaagactcccaaggtcatataaatgtgaaactaaacagtaattgtaatagtgttcaagaagaatcatctaacacgtttaaaaagcttagacttgttgttgacccttgttaccctttcatatatcttgtgtttcttacttgagtttagaaaaagaaaaatcttaagcctttcatttggaatgcttggtcatcttgtcagccctctaggctcatgtatatctcccgattgctcgatcccgaaagtcttcactaaccttcgttgtcagcttaatcctcaaagttttgacttccaaaaataaattatgtgttgtaccctttatatcaactcacattttgcttcctcgtaaacaatgtttttttttttctcctccgagatcgaaccatcatttatagtacttactacttatttccttaaactcataacaagttcgaaatttgggccatattgatgtcttaaaaataggcccatataagaacaagaaatcataattcacaaaaacacagaaccctccgtctcatgaagaagcttcacgataacgacggcaaatggtaaaacgtgaaccacctcaccaccagacacacaaaaagacgagaccgatcggcgatcagtagacttaaccaaactcgcggtgaaacagtcggaatccaccgctataaggaacgatg

SEQ ID NO: 3613 - DNA, 3000 bp, Unknown; identical to SEQ ID NO: 3604
  misc_feature (1)..( 3000): cDNA_ID_2152761_gDNA_ID_1620653_Annot_ID_163540 3000 nt of promoter + ATG

SEQ ID NO: 3614 - DNA, 3000 bp, Unknown; identical to SEQ ID NO: 3603
  misc_feature (1)..( 3000): cDNA_ID_3071501_gDNA_ID_1620653_Annot_ID_163539 3000 nt of promoter + ATG

SEQ ID NO: 3615 - DNA, 3000 bp, Unknown
  misc_feature (1)..( 3000): cDNA_ID_1821310_gDNA_ID_1620653_Annot_ID_163538 3000 nt of promoter + ATG
gtagtaaccaaaaaagtcaaaatcttgttggctaagtcagaaattaattaaataaacaaaagggcccattaaattaattattttaataaatattctgtgtaatgatatatagtataaaacgcgaccgtctaaattcttggttgtttacgagaaaagcggattacgggtacgcttcttctaagataaatctctccccgattctctctttttctcgctagatactctttttcttcaattagggtttcttctcgcttgccttttaattctctccagctgatctgatctccgttaccgatggagtctactgctaacgcactcgtcgtcaaggttagagatacaaccttcctttctttatttgcgaatcgtcagttttctcacagtaattgtcggtgattctgggttttcgtggcgatcgtctcgtttctgttgattttgttgcttgtaatcggtcctttccttttgaatttcgctatggatcgactctctctctctctgtctctgtattataatcttaagtgtaattcgaaaattttccagacatacttagcagtatctgcttgaatcttatacccgaacaatgattaaaactataagttatcgtaattagaatcgtaatctatttcttcgacaattttttttcatttttttcattgaagtgatactaattttgtttgtgattatgtaggtgagctatggaggtgtgcttaggcgtttcagggtgcctgttaaagctaatggacagcttgatcttgaaatggctggtcttaaggaaaagatcgctgctctctttaacctctctgcggatgctgaattgagtctgacttactctgatgaggatggggatgtggttgcccttgttgatgacaacgatctctttgatgttactaatcagcgtcttaagttcttaaagatcaatgtgaacgctggcgtgtccactaactctgctgctccagagagtagtgggagttccacacctgcgggtatgcctaacccggtttccaaaatccagaagggtataaatgatgttctgatggctgtacctaacccgatgcgtgataccatatcaaaggtgtacatggaccttgcatccaaggcctcaacttctagtcctgtagttggtgagatgcttgattgcatttccaagctagggcagctctcaattcctcaggaaagtagtccttgctcacctgttaccaagcctggttcttcaggtgcttccctgagcagggatgttccttccgctggtggaaagaaggatatctctgagaggacccagaccggaaggaaacctgttaatctgaatgaacccactggcgctcattcaaagacttctggtcatgtaccaaactcgtctggactgggtgctaatttcaacgagtgtccctttagtggcagtaccatgaattactcctgtccaaatccagttaacctcaacaagcatcctcgtcgtgtttgtcattccaaaaagagcaccaatggtgattactggacttcattgggtgtattccataagggcatccgttgtgacggatgtggagttcttccaattactgggcctagatttaagtcgaaagtgtaaggatgccttctacttactactttagaaactataaacatgctagaacttattgtgcttatatgtttcgcttgtgaatattgtgcagtaaagaagactatgatctgtgcaccatctgctattcggtgatgggtaacgagggggattacacaagaatggataagcctgtatccgttcaacatctgcatccttttagaggaccgtttacccaagtattgctcttcttctaagtttataattacttttcttcttgtttattctatgtgtcttctctgatagctatgaggaattcttacccttttttttttggtatagtttcctaatccttggttgagccaccctgtgccacgagcaaccaatggaggtgcacctctcaggtgtactcgccctaaactagacagtcggtttgtccttgatgtgaatgtaattgatggaaccgttgttgctccatccgccccatttactaagatttggaaaatgaggaacagtggttcgctggtgtggccacagggcacacagattgtctggatcggtggggacaggttctgcaactccttgtcagttgatttacaggttagaaacaatttccttagttttcactcttttagctcgattcttaccactaacagagcaattatgttgtttgaatttacactcgatggcttgagttaggttgttttcttcacgaagtgactatagctgcttgattatataatactaactgtttttttctctctttacacatggcagattccaaaggagggtgtgcctatctatagtgaacttgacgtcaaagttgattttgttgcaccagagttacctggtcgatacatttcttattggaggatggctacctctgacggtgctaagtttgggcaacgtgtttgggtgttgatacatgtacttactagatttgtgcagcttctgtcctttaattctttgtctctttctatcatatgtgtttgatacattttttctttttgcatggttaggttgatgcatctctgaagaattctgttgtgaatgagtttcatggactgaaccttaatgcctccccctcccttgatgagaattttccaagcgaatttctagggattatgaattatgagtcagctcaacctggcagctccagtgtcaatcctgggaccgtgaaaggtactgatctagagggcgaagttggtgaaacacaggccgtggaaaaagaaaaccttttggttggtgaagctcatcctgctatccctcacggtcattctccttcatcttcatcttcttcatttaacatggtcgacttcccaagcatgcctgctgttgaggtcttgtctggtggttcttcatctactacaaaagacgtgccagttcctcttcaggaggatatagaaaagaatgacgtggagataaccatgctcaaggagctcgaggaaatg

SEQ ID NO: 3616 - DNA, 3000 bp, Unknown; identical to SEQ ID NO: 3602
  misc_feature (1)..( 3000): cDNA_ID_1807910_gDNA_ID_1620653_Annot_ID_163532 3000 nt of promoter + ATG

SEQ ID NO: 3617 - DNA, 3000 bp, Unknown; identical to SEQ ID NO: 3601
  misc_feature (1)..( 3000): cDNA_ID_2995209_gDNA_ID_1620653_Annot_ID_163531 3000 nt of promoter + ATG

SEQ ID NO: 3618 - DNA, 3000 bp, Unknown; identical to SEQ ID NO: 3600
  misc_feature (1)..( 3000): cDNA_ID_1450335_gDNA_ID_1620653_Annot_ID_163530 3000 nt of promoter + ATG

SEQ ID NO: 3619 - DNA, 3000 bp, Unknown; identical to SEQ ID NO: 3599
  misc_feature (1)..( 3000): cDNA_ID_1808608_gDNA_ID_1620653_Annot_ID_163528 3000 nt of promoter + ATG

SEQ ID NO: 3620 - DNA, 3000 bp, Unknown
  misc_feature (1)..( 3000): cDNA_ID_3071510_gDNA_ID_1620653_Annot_ID_163526 3000 nt of promoter + ATG
gacaaaacacatatgttggtttagaaaaacttcaagttgcatttcttcttttagccaatcgcactatcttccgtgaaaaggtaaataatatatagctttatgacaatttcacaaaaatggttcgttagttttgacttagcattaagatttttttccagaaatctaagtattggtaaaataattctatatctactactaggtcaaaatacaattctatattatttaaaaaattgtaactgaggtaattgatcaaattaccaaaatgatgaaagagctagttaagaatttaacaatgtacaagttttagtgaaatggtcaaaactaaatatccattcttttggcccgttagcatcattaaaccaaccactcaatggagacatggaagatcaaaattcgtcaaccctagcgctttgtttctctacaaggatcaagtatggaacaacaacaaccacaagaaatcgaaatgtgctaaggtcgcatgagttcgctaggaataagtctataacatttcgttttgtcaacaaaataagattttagtatatatattatttacaattttaccagacttccattgtcaacaaatgacattattgttgttgtcgaagaaaaaacaaaggtgacactatttgctgttttactttttatttcatgaggacggaggacccatttttttaatttagtttaaaagagcaaccgtatcagttgattacggagtccagcagagaaaagcatgctcaactgtcaaaaacaacctaacaattagggaatcccgtaaaaccggcaaatcacgagggcagcattacattacattacattacatgtcccacaaatcactttccctcccatgcttttccacttccacctatcattaccaacacctattacctaaaggactttaagccagagagttttcaaatcccgtaccgtgattggtgcactatgaagtggaaaggaatacgatgaaaaacaaactgttttctcaatacattttcaccgacaccaatcatgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaa

SEQ ID NO: 3621 - DNA, 3000 bp, Unknown
  misc_feature (1)..( 3000): cDNA_ID_1821254_gDNA_ID_1620653_Annot_ID_163561 3000 nt of promoter + ATG
caccatttagtcacatttaccacacagatgcaacatctgaaatcgagaaacttaccttcagtggaatgaagctcattgtgactaaggtctaacatttggacaaacagcaacttctcaacagaggctatccgagatagtgataagttatttagccgtagacatacaagattgttcatatccctatatcgcaaaaggtgtcttgacaaagattcactgcttgaagtcacctgcatgaacattctctttatgagtagtaggcatgatgaaacagaattaaggaaaaaatctagaatcgaacaatcaactttatactgtagacgagaatcggggaaaatcataactccgatgaaaattttaatagcaaaagtttaacataagattcacagcaacaaggaagactaagtaccttgtggagaaaagctttgctgtgctcatccttgtagtactggtagtgtgaagaatccagcgccatcaaatcgttatacagctgaaggatttcttcatagtgaacacccttgacagcatcatccgataccatagcttcacgagccatcaaaagccttgcaagagtgagctttccaattttgctataaaggaaaaaataacacaacgtttaagactacaatttctctttccaatcaaagagagaaagtatataggatatatacctgtcaggcagtataccgaaacattcaacctcagaatctatagcttcctgacgccatttaaaatccatctcagcatttaaccgatccaaggtgacaagagaattcaaatcctttgacttcgcatcccaaatatcaaatccatccgtccatgaaacaatgccttcttgagaatcttcgacggtatcatgaacatgggctgtaaagacaaactcataaggtgcgttgaagttatatcctctggaagaaacgattcctggagagttcccaactctgatcttcactttgtattcgcaaggatctgaactgacatatttcagacgagcaacccatacacaggacacctgagaatttttgttcggaattggttcccaaacaaggccctcgtttccttttagttcagaatcaattgtaacagtagatgagcttactccaccaacagcttggtcaaagtagagaatcagtggaaaagaacccgactcagaacaaaaagtagtgaacatagatgaagagccactcaagcacccagctccagacagaatgatacttgaaccatgtgaaggccatgaggaagtgagaagaggagtctccacattaagagtttggtcaagaagccaaagatgataaaaccagccactttggtcatctggttccgtaaaaatagccgaatgtacaaagtcatattcctcaggaatctttatatttggcataaacccatcagcattttgtgccaacaaacttgatagaagtacactgcagaatgtgaacaaaaatatatagtaaagaatatgcatacctacgattatgctaaaaaactatttctgaacatgtaaatcagtaaagtataatatatactaaagaatatgcatacctacgattatgccatgcagaatagttgctgaaattgttattgatcatatcatctgtatactgcaactcatcctgttctgatctgttggttagctctacaacaaacctggaaaggaacaacacattaatatgcaagcttgattaacatacacaatgctcctttcaaaaagtgttgacattccctaattttcacctgcgatagttccaagcatgaaaatttctggaatccagcttctggaatttttccaaaagtctcaattcattccctacggatgaatgccctttactcaaaacccactttcgatgatgccaagcaccataggacttgaaattctgcctcaaagcactttctacctgaatttagaaccgacttcacagtaactaataagcaactactttcataaagagcaaattcgtttcttttaattgacaggataactcaccactctgagttcttcatcaagaattgcgctgaccaagtttggatcaggctcaattctggcaaggcgatcctccacagcaagcttccggtagttccatgcggtgtacgcctccggattgatttctagaagcttcgtgcttaactcaatagcttcattggtataactagaaaccaaaaaagcaacaaatgattagtaaataaacaaaggatccttcaaatcgtactaaaaatctgggaagtacactgatccgatggaaatgaaggagaagattgtacattttatcgtgatgattcgtcataaactgagactggagagagcgaagctgaacagctttagcagctgaagctgcttcctcttctggcttagaagcattccttggacgaccgtgcattcttctccgacgactgtgagagatgcgacagtgtgattcaacttttccggttaaatctgatcagaaattacgaaaacagttaaaacaaacactagatcgaggaaagaaaaaacgtgatccaaatctagaaacaacagagatgacgaaatggagaataagaagcagatcacctgaaaggagcacgttgcggcgtcgatcgagagagagagacttttgttttcgggcaattgagcgactgagagaaggttctatcggaaaatttaatgggccggtttaatgatttcaatcgcttaaaccagtaaaccgggtttaattgaaaaatacggtcgaacactaacccggttttggaagtcttcgtttatgtagtgaaaggcttcgtcatcatcgttgtttcacagttgaaggttttcacgagaaagtgaagatttttggagaaaccatacttttgtgaaggttcgtttcaccttcaatttcgtttttccaatttgggtatccgataattgtaagaatttggggttttaaggtcagattgattatgtatctaatgcttttacattgtagtagctcgtgttttggattttgaaggattgatttctaaatttccttttgatcttgtagttgaatcacaatg

SEQ ID NO: 3622 - DNA, 3000 bp, Unknown
  misc_feature (1)..( 3000): cDNA_ID_1821258_gDNA_ID_1620653_Annot_ID_163559 3000 nt of promoter + ATG
agaacctatgatctgtgaccatattacaagatttgaatctgaaaataaattttattcttcccaatatttgtttttgcgaaaaaaagagattatttggaattgctgacgtcacatctctctcaggagattcccacccggaagtatcaactgtcgtcgtgtatcggttgtttccgtagatctctgttaccactttccatccaatttcaacaaattggatttggcaaactttcggatcagaaacgtgctcgggatgaggaggtacaccgagaaagtttggtcttttattcgttcgtcgctgagtttagaataagggattgtcttcatcgtacgactctgtttttgttgaaaatcgaatgctccaaatgaagcagccattacagaaccttaatcagtcgcagaagacagctttagctggtgttttcgtgctccttttcccgattctctatccgaatctcttcagccctcttggtcgcgcctctccttctctcttctccgtcagtctctctctctctatctccgatgatttatttggaatttcacattttgggattgtgaagctgaagaattaagtttggcatttgcaggaatggaatgctccaaggcctagacatttgagcctactccaaggcgctcttgatcgacaaattgtaagtgggtttagctcagtttcttggatgtatctactacgttcctctaaatctttttcttcttcctcgaaccaatgtgtagtcgatcagacaacaagttgagttatggtctcccttggcagatcaaggttggaagccttgcactgaatcttatagaggcgcttgtaagtttccaaatataaagctttcttccttctttcatcgtttacattcatgtgccctgaaaagtttgtattttgattgatgggtttgtcactctttgcagccttgccagagaagtctgaagggtttcttcaggttttccttgacggcggactaaatcaacaaagaatgggagtgagtataagaatttcagtcaatttttatggtggtttcccttctgactcttcttgttccttttgcagatatgtgatgctgttgctgttgccaagataatgaacgttacactcgtgattccacgccttgaagtaaatactgtttggcaagattcaaggtaatctactttgaaacttgtaagttgtctggtgcctgatgaatttggtgatttatgatttggcatttctttacagttctttcacagatatatttgatttggatcactttataagtgtccttaaagacgaggtgcggattgttagggagcttccaatacagtatgcctggagcactcgtgattattacgctacaggtattcgagctactaggattaagactgcgcctgttcacgcttcagcagagtggtatttggaaaatgtcttacctattatccagaggtttgtgctttctaaacctggtgatctatcagatgaataactgcattttaaagtcctggaaaatacgatactacatatgatctggaatgctttatagacaatactaagggagtgttcaatgtagatgtttttctgtcaagtcacgttttttttttgtgtctatctgaggaactatatatgtctgtagttcaatgcattgttactcatatgaattatccacttcgttatgcagttatggcattgctgctgttgctccattctctcaccgtttggcatttgacaatttgcctgaaagtatacagcggttacgctgtaaagtaaattttgaagcattaaactttgttcctcatattcgtgagctaggggacgctcttgtgcatcgactcagaaatcctccttccagctctcaaacatcaggaactatggatccgacagacagaataaacaccattgtaaaagctggtgctggaaagtttgcagtgcttcatcttcgtttcgataaagtgtggtcttaattctcaacaaatgtgcccatttcctggcagtaacatctagttctgacattgcttcatctttttttttaggacatggctgctcattcaggctgtgactttgaaggtggcaaagcagaaaaactggcgctggcaaaatatcgccaggtgatctggcaaggaagggtcttaaattcacagttcacagatgaggagctaagaaacaaaggtcgctgcccgttgacaccagaagagattggtttactgctgtcagctttgggtttcagtaacaatacccgtctctatctagcgtcacaccaggtttacggaggagaagcaagaatctcaacgctgcgtaaactgttccccgggattgaaaacaagaaaagcctagcctctgctgaggaactagctgatgtacaagggaaagcttctctgatggctgcagtcgattactacgtgagtatgaagagcgacatcttcatctctgcatctcccgggaacatgcacaacgcattacaggcgcatagagcctacttgaatctcaaaaccataagacccaacatgatactgttaggacaagtctttgtgaacaagagcttagattggtcagagtttgaaggagcagtaatgaatgggcacaaaaacaggcaaggccagcttcgtctacgcaaacagaaacagtctatttacacttatccagctcctgattgcatgtgtaaagtagcttagcattccccttttactgtcccaatcttttgttgatttttttaaaattttaatatatggtttttatgtactcgatgattagtaaattaattgaggaactcatattatgtacactaaattcaagtttagtaaaaaattggattaatgtgatttacttattgacaaaggtaaaataaaagtcaaataagaaaaggagagaaggacccactcagattcaacgccccaccaccgataactcaattaactctcttctcttggcttctgcaacgctgagccaccatcgtcctcttctcttcctcttcgatctctcctgaatcctcaaaccctggagagagagagagagagtgacgggggaagaag

SEQ ID NO: 3623 - DNA, 3000 bp, Unknown
  misc_feature (1)..( 3000): cDNA_ID_2152804_gDNA_ID_1620653_Annot_ID_163558 3000 nt of promoter + ATG
agccgatgaactttcagttctttgcgatgctgatgttgctctcatcatcttctctgccaccggaaagctcttcgagttctccagctcaaggtatattctatctttttgttagtagttgtcttatttttttcaatccatgtttgtgtttttgagaatatggttggataaatatattaagatatgtatttaaatgagatttttattttctcgtttactctctaaagttaattatcagtaggctcggagatctcatgtacggcataatttgatgacctaaattattatactttaaagtataggattgatgttttattacttttatgtataacacatcatgtatttaattccgtttaacataatatgggtttttaacgtgtaatttttcaatcattttcatttagactcatggttaagatttctgtactgggaaataagagagcagaatattatagtgtgatttttgttaattaggaaagcatatgtatatatggatacatagtacttaccacaattagaatgaatttcttttcccttttttcatttgactttgtgtattacaaaagtctttgacactgtcacttggtatgattggggattaattcttaaccactcgtttagtttatcttgggaagcattaccataattgggaaacgagtcatctgtctgtatcgtgatggctacttctgattacttttcttttattataaccaaaaaggcttctaatgtacttaattaattttacaaatgtaatatggacgaaggaaatgtttataagaaagatggattgtttgttgaaacgtgtagaatgagagacatattgggaaggtatagtcttcatgcaagtaacatcaacaaattgatggatccaccttctactcatctccgggtattttcgatatcacttactcttttttttttttgtggattttaaactctctgctctttttaccaaacccttctctttttatcaaacccttctctctataatattatccgatgttcactttgttacacgtgtttgttataatttttagctgtaagtctaaatatagaaacattgagtggcatataatcattaatcttgaagcatctaattaattggttttacatattaatagcagaatcctgaaactgttgactttgcatctagcagcttgagaattgtaacctctccagactaagtaaggaagtcgaagacaaaaccaagcagctacggtatggctccattgatatgttatgcagataaacctattttcatataggctatagctgtaagagatcatctatttcatgtgtgtggtttttttttttatgttttttcaatgatgtgtgcatgctatttttaggttttagaatctatttcatggaaattgaagatatttcatttcacgtgtaagttcgtcaagttgtggcgtgtgtcttggaaattgatgttttgtttgtagattttaagagctacttctaaaatttacaagagttttgtaattttcaattatggcccattattctcattaattcattaaaaaaattatatacattactatctatatctagcataggtagttttttttttctttttctttggtagacctactgaacaaatatctgatatatcactgactggataaatatctatagagatatttttgatagaaatgagtgttaatttaacgtaaaacaggaaactgagaggagaggatcttgatggattgaacttagaagagttgcagcggctggagaaactacttgaatccggacttagccgtgtgtctgaaaagaaggtttactactatacataaactaatagcatgcatattttccttaacgtggcatataaataataagctgtacatatataaaagtttgactttgttgttgttattggtaaatagggcgagtgtgtgatgagccaaattttctcacttgagaaacgggttagtagttagtacatacaattcgtataactaatggatcataagcctatctatagctagtgactttcttaataagtgaaacagggatcggaattggtggatgagaataagagactgagggataaagtacggctctaaacccttatagatatcatggaataaccttaatctatttttttatgtataagaaaatatgatgagggaacgtatattatatatcggcagctagagacgttggaaagggcaaaactgacgacgcttaaagaggctttggagacagagtcggtgaccacaaatgtgtcaagctacgacagtggaactccccttgaggatgactccgacacttccctgaagcttgggtataatttgtttaactgaacatatttcaaactttttgttgacattttgtatgtggatgtttactaactgtttgttggttaggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattggtctttataactattttgcaccaaagggattcttcacatcacggacaaataataattttaacactaatgaaacaagtaaatatagtgaaacgataggttttctatagtgattctttacattaacaacaatgaaacaataaatataatattggagaggggtgtgaaagaacaaatatgttaattaatttctacaaatgttttcacctcctttctcgattcatataaaacaaaggtaagtctttgttccttaccttcactctctagaaaagatttttttggccaaaaatatgtattcacgcaatcagcagaacaaaaacctcggaagatcacgtccaacgaaggacctttaggcttaggggtaacgtcatgtcttccacttttgagcaaccttgcaaaccatcaacgaagtctttcatgtgcattttattcaaca

SEQ ID NO: 3624 - DNA, 3000 bp, Unknown
  misc_feature (1)..( 3000): cDNA_ID_2152800_gDNA_ID_1620653_Annot_ID_163557 3000 nt of promoter + ATG
agacttacaataacttcatcaagcaactcatacacgagcacaaagtttttcctgaatgaatcttcattcagaacaccaagataatccttaataacacgagcaatcctttgtagaagctccaaaacaagagagggtgacacgttaactctcgttgtcgcaacaaaatatagaccaacaaccttgacatggaagtagttcacgccatcgacattctataagcacaaaaaataagttagatgaaatcattacagctcacaaccaaacagaaagtataatacctacaaagataggtggcgcctctgcattgccatcctccttccagaacttgactttacggaagaatgtctctgtacttcctttgggtacctcagcccggtctgtagcaataaaacgttacacatcttgaaacttgtattggatccaaccaaatcgtataatctcaaaacaaatagctttcttctactacattacatacagatactctgcccaaactaattgaatagttttgctatatttgtacaatctgatttggaaattcagctcaacataatttgtcatcggataagaaatgttggtagatcaaacagatcaatgagcttagagaagatttcaatggaaaattctcatgaaacagtgacataagactcgactctgaagagaaaaagcaaaacaggaagaagcagagaggatcagatcgagaaagagagcttacagtcacggaagacgatgttatctcctcgctgagataagacgaagaattgggagatcatcatcgttccttatagcggtggattccgactgtttcaccgcgagtttggttaagtctactgatcgccgatcggtctcgtctttttgtgtgtctggtggtgaggtggttcacgttttaccatttgccgtcgttatcgtgaagcttcttcatgagacggagggttctgtgtttttgtgaattatgatttcttgttcttatatgggcctatttttaagacatcaatatggcccaaatttcgaacttgttatgagtttaaggaaataagtagtaagtactataaatgatggttcgatctcggaggagaaaaaaaaaaacattgtttacgaggaagcaaaatgtgagttgatataaagggtacaacacataatttatttttggaagtcaaaactttgaggattaagctgacaacgaaggttagtgaagactttcgggatcgagcaatcgggagatatacatgagcctagagggctgacaagatgaccaagcattccaaatgaaaggcttaagatttttctttttctaaactcaagtaagaaacacaagatatatgaaagggtaacaagggtcaacaacaagtctaagctttttaaacgtgttagatgattcttcttgaacactattacaattactgtttagtttcacatttatatgaccttgggagtcttctagctcgtcccaaatatattttcaacatattactataagatcctaaagaccaataacattgatctacaccaaaaactctcactttctgattttgcactcgctttttttcctcccataaacaaaaccaaaggcttacaatactaaatctgtctcacattcttagtgcttatttgttttagtcataaagaacttaatcttatacagattgaagtcttaaagtcatctatattacttttcacatgtatcattatgagatggtacgtttcccacgaattttatcagtttagtttaattttcagttgtactttgggagaaaaaatttacaagatacttgtcggccatgatatcaccctagagttaccggagtccggtgatatatcatttctaattagggttaaaacttaaaagggtataaatggctgatcaaacccaaaaataaaagataatgatgacggtgggagacgagtgatcttatcaggtgtcgcatctagcatatataggtgaaagactataaaaaagacatgaaatatttaatagacacaacttttgtaataaaccaaaaccaaaaaggtagatgaactgatgaacagcatcttctaattacgaataaaaaaagtaaccaaactttctttccattagaattggtacgtagttccttgtgtattgtgatttctttcattttccaattatgtttttttattttatcatgttacatttttgatagtgggtaacttttgtatcattttatttgacctagccatatataaatctattaacttatacggagtagtatttcacgtcatttatttttattttgtttttagatgggaagttattcaaaactagactaaaacagtaaaactaggaaacccgctactgaataaagttacaattccacattattccatgacagactaattgaattagaaggttaggtaaattattaaatcataactgtagcagtctcttcgtctggcagctcagtcagacaaaacacaaagtgtgtttatgtgttatttttaatgattatagtttgggaaaaagacataatcaaaagggatacaaaacatatggcccattgataagtatagatcactgtttagctaaaaaaagcagactcttttttccaatcttgaacacaaacacagtcaccatctctctctctctttctctctcactcacacattagggagtaaacagctaccagaaaaaccttttttatcttctcacaaatttaataaagtgggtgctgagattgaataacgtaatccaagatcctccaactcacagaaaggtaaaagctgtgaatctgtgttctttcttcttaagcaaagtgtttgatgaattcatctagtcctgtccattcttttgcttctcatggtttatggatctgatctctctttctctctctctctagccattagggtttcctaagaatattatataaactctctttagctaacaccgttccaattggtttctttctttgttcttggtctaaaatctaaatggtgttatgggtataggcagattcaagaacagtagtgaaggagagatctggtaaa

SEQ ID NO: 3625 - DNA, 3000 bp, Unknown
  misc_feature (1)..( 3000): cDNA_ID_1807115_gDNA_ID_1620653_Annot_ID_163556 3000 nt of promoter + ATG
atcacgatacagacagatgactcgtttcccaattatggtaatgcttcccaagataaactaaacgagtggttaagaattaatccccaatcataccaagtgacagtgtcaaagacttttgtaatacacaaagtcaaatgaaaaaagggaaaagaaattcattctaattgtggtaagtactatgtatccatatatacatatgctttcctaattaacaaaaatcacactataatattctgctctcttatttcccagtacagaaatcttaaccatgagtctaaatgaaaatgattgaaaaattacacgttaaaaacccatattatgttaaacggaattaaatacatgatgtgttatacataaaagtaataaaacatcaatcctatactttaaagtataataatttaggtcatcaaattatgccgtacatgagatctccgagcctactgataattaactttagagagtaaacgagaaaataaaaatctcatttaaatacatatcttaatatatttatccaaccatattctcaaaaacacaaacatggattgaaaaaaataagacaactactaacaaaaagatagaatataccttgagctggagaactcgaagagctttccggtggcagagaagatgatgagagcaacatcagcatcgcaaagaactgaaagttcatcggctttcttgaagattcctcttcttctctttgagaaagtaacttgtctcgctgttatgttatcaatcttctttatccttatcttctctctcgccattttaccagatctctccttcactactgttcttgaatctgcctatacccataacaccatttagattttagaccaagaacaaagaaagaaaccaattggaacggtgttagctaaagagagtttatataatattcttaggaaaccctaatggctagagagagagagaaagagagatcagatccataaaccatgagaagcaaaagaatggacaggactagatgaattcatcaaacactttgcttaagaagaaagaacacagattcacagcttttacctttctgtgagttggaggatcttggattacgttattcaatctcagcacccactttattaaatttgtgagaagataaaaaaggtttttctggtagctgtttactccctaatgtgtgagtgagagagaaagagagagagagatggtgactgtgtttgtgttcaagattggaaaaaagagtctgctttttttagctaaacagtgatctatacttatcaatgggccatatgttttgtatcccttttgattatgtctttttcccaaactataatcattaaaaataacacataaacacactttgtgttttgtctgactgagctgccagacgaagagactgctacagttatgatttaataatttacctaaccttctaattcaattagtctgtcatggaataatgtggaattgtaactttattcagtagcgggtttcctagttttactgttttagtctagttttgaataacttcccatctaaaaacaaaataaaaataaatgacgtgaaatactactccgtataagttaatagatttatatatggctaggtcaaataaaatgatacaaaagttacccactatcaaaaatgtaacatgataaaataaaaaaacataattggaaaatgaaagaaatcacaatacacaaggaactacgtaccaattctaatggaaagaaagtttggttactttttttattcgtaattagaagatgctgttcatcagttcatctacctttttggttttggtttattacaaaagttgtgtctattaaatatttcatgtcttttttatagtctttcacctatatatgctagatgcgacacctgataagatcactcgtctcccaccgtcatcattatcttttatttttgggtttgatcagccatttatacccttttaagttttaaccctaattagaaatgatatatcaccggactccggtaactctagggtgatatcatggccgacaagtatcttgtaaattttttctcccaaagtacaactgaaaattaaactaaactgataaaattcgtgggaaacgtaccatctcataatgatacatgtgaaaagtaatatagatgactttaagacttcaatctgtataagattaagttctttatgactaaaacaaataagcactaagaatgtgagacagatttagtattgtaagcctttggttttgtttatgggaggaaaaaaagcgagtgcaaaatcagaaagtgagagtttttggtgtagatcaatgttattggtctttaggatcttatagtaatatgttgaaaatatatttgggacgagctagaagactcccaaggtcatataaatgtgaaactaaacagtaattgtaatagtgttcaagaagaatcatctaacacgtttaaaaagcttagacttgttgttgacccttgttaccctttcatatatcttgtgtttcttacttgagtttagaaaaagaaaaatcttaagcctttcatttggaatgcttggtcatcttgtcagccctctaggctcatgtatatctcccgattgctcgatcccgaaagtcttcactaaccttcgttgtcagcttaatcctcaaagttttgacttccaaaaataaattatgtgttgtaccctttatatcaactcacattttgcttcctcgtaaacaatgtttttttttttctcctccgagatcgaaccatcatttatagtacttactacttatttccttaaactcataacaagttcgaaatttgggccatattgatgtcttaaaaataggcccatataagaacaagaaatcataattcacaaaaacacagaaccctccgtctcatgaagaagcttcacgataacgacggcaaatggtaaaacgtgaaccacctcaccaccagacacacaaaaagacgagaccgatcggcgatcagtagacttaaccaaactcgcggtgaaacagtcggaatccaccgctataaggaacgatgatg

SEQ ID NO: 3626 - DNA, 3000 bp, Unknown; identical to SEQ ID NO: 3611
  misc_feature (1)..( 3000): cDNA_ID_1821270_gDNA_ID_1620653_Annot_ID_163555 3000 nt of promoter + ATG

SEQ ID NO: 3627 - DNA, 3000 bp, Unknown; identical to SEQ ID NO: 3610
  misc_feature (1)..( 3000): cDNA_ID_2152794_gDNA_ID_1620653_Annot_ID_163553 3000 nt of promoter + ATG

SEQ ID NO: 3628 - DNA, 3000 bp, Unknown; identical to SEQ ID NO: 3609
  misc_feature (1)..( 3000): cDNA_ID_2152792_gDNA_ID_1620653_Annot_ID_163552 3000 nt of promoter + ATG

SEQ ID NO: 3629 - DNA, 3000 bp, Unknown; identical to SEQ ID NO: 3596
  misc_feature (1)..( 3000): cDNA_ID_2164556_gDNA_ID_1620653_Annot_ID_163525 3000 nt of promoter + ATG

SEQ ID NO: 3630 - DNA, 3000 bp, Unknown; identical to SEQ ID NO: 3624
  misc_feature (1)..( 3000): cDNA_ID_2152800_gDNA_ID_1620653_Annot_ID_47797 3000 nt of promoter + ATG

SEQ ID NO: 3631 - DNA, 3000 bp, Unknown
  misc_feature (1)..( 3000): cDNA_ID_1821262_gDNA_ID_1620653_Annot_ID_47798 3000 nt of promoter + ATG
tatttcatttcacgtgtaagttcgtcaagttgtggcgtgtgtcttggaaattgatgttttgtttgtagattttaagagctacttctaaaatttacaagagttttgtaattttcaattatggcccattattctcattaattcattaaaaaaattatatacattactatctatatctagcataggtagttttttttttctttttctttggtagacctactgaacaaatatctgatatatcactgactggataaatatctatagagatatttttgatagaaatgagtgttaatttaacgtaaaacaggaaactgagaggagaggatcttgatggattgaacttagaagagttgcagcggctggagaaactacttgaatccggacttagccgtgtgtctgaaaagaaggtttactactatacataaactaatagcatgcatattttccttaacgtggcatataaataataagctgtacatatataaaagtttgactttgttgttgttattggtaaatagggcgagtgtgtgatgagccaaattttctcacttgagaaacgggttagtagttagtacatacaattcgtataactaatggatcataagcctatctatagctagtgactttcttaataagtgaaacagggatcggaattggtggatgagaataagagactgagggataaagtacggctctaaacccttatagatatcatggaataaccttaatctatttttttatgtataagaaaatatgatgagggaacgtatattatatatcggcagctagagacgttggaaagggcaaaactgacgacgcttaaagaggctttggagacagagtcggtgaccacaaatgtgtcaagctacgacagtggaactccccttgaggatgactccgacacttccctgaagcttgggtataatttgtttaactgaacatatttcaaactttttgttgacattttgtatgtggatgtttactaactgtttgttggttaggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattggtctttataactattttgcaccaaagggattcttcacatcacggacaaataataattttaacactaatgaaacaagtaaatatagtgaaacgataggttttctatagtgattctttacattaacaacaatgaaacaataaatataatattggagaggggtgtgaaagaacaaatatgttaattaatttctacaaatgttttcacctcctttctcgattcatataaaacaaaggtaagtctttgttccttaccttcactctctagaaaagatttttttggccaaaaatatgtattcacgcaatcagcagaacaaaaacctcggaagatcacgtccaacgaaggacctttaggcttaggggtaacgtcatgtcttccacttttgagcaaccttgcaaaccatcaacgaagtctttcatgtgcattttattcaacaatggagttttgtaagaaggaactattgaaaaaactaatggaactaaggtgatctagatagtgaacttagcttttcccaaacttttctttatgcactacaaaatttcaataaattaagtttttagaaaaggttctcaagtgaagttagaattttataactcaaacaatattcatgtacgtgtccaccggttttcatggttagattttgagaaagagtgagtccaaactttttaataacgtttttgattccgtgtaagaatgtgtgattctccctcctcctgaaaccctaacccaagacaggagatctttctaacacattctatactaattcacaaaaatcttccaagttccgtccgatgtgggacaaacaattctaatatcccctctctagttaccgctacgagcctacgaccatcattctttgagtcgaagttatacatatgaaatgggaggcgtgattcacgggtgaatcctacatttgagaaattagaacctatgatctgtgaccatattacaagatttgaatctgaaaataaattttattcttcccaatatttgtttttgcgaaaaaaagagattatttggaattgctgacgtcacatctctctcaggagattcccacccggaagtatcaactgtcgtcgtgtatcggttgtttccgtagatctctgttaccactttccatccaatttcaacaaattggatttggcaaactttcggatcagaaacgtgctcgggatgaggaggtacaccgagaaagtttggtcttttattcgttcgtcgctgagtttagaataagggattgtcttcatcgtacgactctgtttttgttgaaaatcgaatgctccaaatgaagcagccattacagaaccttaatcagtcgcagaagacagctttagctggtgttttcgtgctccttttcccgattctctatccgaatctcttcagccctcttggtcgcgcctctccttctctcttctccgtcagtctctctctctctatctccgatgatttatttggaatttcacattttgggattgtgaagctgaagaattaagtttggcatttgcaggaatggaatgctccaaggcctagacatttgagcctactccaaggcgctcttgatcgacaaattgtaagtgggtttagctcagtttcttggatgtatctactacgttcctctaaatctttttcttcttcctcgaaccaatgtgtagtcgatcagacaacaagttgagttatggtctcccttggcagatcaaggttggaagccttgcactgaatcttatagaggcgcttgtaagtttccaaatataaagctttcttccttctttcatcgtttacattcatgtgccctgaaaagtttgtattttgattg

SEQ ID NO: 3632 - DNA, 3000 bp, Unknown; identical to SEQ ID NO: 3622
  misc_feature (1)..( 3000): cDNA_ID_1821258_gDNA_ID_1620653_Annot_ID_47799 3000 nt of promoter + ATG

SEQ ID NO: 3633 - DNA, 3000 bp, Unknown; identical to SEQ ID NO: 3621
  misc_feature (1)..( 3000): cDNA_ID_1821254_gDNA_ID_1620653_Annot_ID_47801 3000 nt of promoter + ATG

SEQ ID NO: 3634 - DNA, 3000 bp, Unknown
  misc_feature (1)..( 3000): cDNA_ID_1821250_gDNA_ID_1620653_Annot_ID_47802 3000 nt of promoter + ATG
tcttcacgtcggcgacagtgaagtcacgtgcacccttgaagaagtagacggctcggacgtagtggagcttcatggctaagtccatgggtgtgagctgtcgtggcttgttctcacctaccacagaagcaggcaccaccgaagagagcctgacactggtcactgggcttccctccattttatttttgtgagagagctgatatgtgtagcttataggcttaaatgggatgtgttatataaggattgagtttcgaaagagagttgagttcagaataggcatgggtatcactgatttaggacagttgggaaaactgtttccgtgacggcaacattaaatgtgggtgggatttgggtctttagcaacaacattagagttggacagttgagtcatcatattcagatccatccaacaacaagcacactttattacgtccaccttgtccttattggcttcaagcaataaacgcacatgtacgtgtcgtagccaactagtattatattacggtacctaacaagtcacattaatctataaaaaaccaagttcagtttcctggtaacattgtttccaccagcaaaaatgatcttaatacggatgcggttcatttccacctcaaacacaatcatgcaacaaatttcctgataatgattttacataattgtacgataactaaatcttgcgaaaaaacagtaaaatttttggtagagaacatccctattgccaaccaatctactcctaattgcgccctcagagatgttcatcattcgctgttgtgtcttgttaagaaaataaacacaagtcactgaacaatacctagttcgaaagagtcaacggtgatctttccaggtacctcagatgcttggacttggtgtattttcactaggccagttgtcctgattaattgcttgactcatcgcatgtagcaccatctagagaagcagcaaggtactcagcaaggctctgctgattactgctagttttgtgggtagcttctgaggtcacagatttttttggtgctatagacttgggaagccaggcttgacctgttgagctgctgctcgaagcatctgagcaattcttccataagactggcttaagatgcttccatggatcttcagccatagagttggagtaaaatcgttctgcccctggttccatgggtcttcttcctccatctctcccaaagcttgtgttcataccgcgtcctcgacttctgcctcttcctgagttaggatacgtgtttccaccccagtttgcattttgtcgtccataattggaaaactgtggaggagtattgttgtagctgcctcgaccaccaaatctattattccccatgttcggcatttcttgagagaatggaaaagggcgaggtacccattgaggtggacctgaatggttaactggtggaggcctaaagttgttattccaaccggcgggtggacctctgtgtgagggtgaaagatgtgccatccctcttggttcataatgagctgcatgaaagccaccatgattggtctgtgcctgatactcactacataatgatcctgttcaaagttataatgcaaggatcagaactggattactgttcattgcaaggcacaggacacaaacctaactgaattccataattgatgtgattttcatactgtcaattcctagaaagtgaaacttaaagagatatatcaaattaaagtagctaaagctaataagtttgaagcctgagactgagagacaaatttcttcctccattgatcttgatttgtagattataatcaagaacacatgactaaacccaaacaaagaacaaaaatttcatatagatttgtagaagagaatcatcacctaactctacgaaagcccaacaaccaaataccaaagtgaattcctgattctgttcaatcctatacctatactcaccaaggaccaactaacatactgtaagttaaactctcatgatattaggcaatcttctttatcagtggactactttctttggcctcacaagaatatagacaaaacaaaaattaagacagagtcattgactatcaaggcagaaacaagcacctggaggaactgatggtggaaactgaggtggtacaggagagcttccttgatgactaggagatgagatgtattgttgcttaggggtcttgtttttcttgaaactagaataagcagccatgggatcggtataataatcaaacctttgcgtttcaaatgaatcctgctggtgattggatgtctctgccaatggattggagaggtgacctgtgctcatagatgtttcagtacctgtagtagcatcatcatcattctgcgctgcagcttccattcgcattgcttttaacatctgttttcttttctctgaatcttccattgtgattcaactacaagatcaaaaggaaatttagaaatcaatccttcaaaatccaaaacacgagctactacaatgtaaaagcattagatacataatcaatctgaccttaaaaccccaaattcttacaattatcggatacccaaattggaaaaacgaaattgaaggtgaaacgaaccttcacaaaagtatggtttctccaaaaatcttcactttctcgtgaaaaccttcaactgtgaaacaacgatgatgacgaagcctttcactacataaacgaagacttccaaaaccgggttagtgttcgaccgtatttttcaattaaacccggtttactggtttaagcgattgaaatcattaaaccggcccattaaattttccgatagaaccttctctcagtcgctcaattgcccgaaaacaaaagtctctctctctcgatcgacgccgcaacgtgctcctttcaggtgatctgcttcttattctccatttcgtcatctctgttgtttctagatttggatcacgttttttctttcctcgatctagtgtttgttttaactgttttcgtaatttctgatcagatttaaccggaaaagttgaatcacactgtcgcatctctcacagtcgtcggagaaga

SEQ ID NO: 3635 - DNA, 3000 bp, Unknown
  misc_feature (1)..( 3000): cDNA_ID_1843191_gDNA_ID_1620654_Annot_ID_47803 3000 nt of promoter + ATG
aattaacaaaaatcatatataaataattgaattagtgagttaggaaaacatacggcttggcgtcagagcacatgagaaccttaggcttgttggatgcggcatctttgaagactctaaagaaaacaggagtgtattcttctaagtcagatgtagccaacgtgatcaaaccaaaaggaccaactccaccattcacattcgaacctttcaagttacataactctagtggtttagttgcgaagctttcgtcaaacttttcggccttctctagatttccaacgttgaatgtcacatccacatccacctgagcaggagtgattccttggacctcaaagcgttggcccatctccattttctggttggtcatttggacattctttcctctcaatgactcaatctcttcaataggccaaaacacgagttgcttaccgctagagtcaagcaagattgttcttgggataagctgaattccggcccaacccttcacggtatcatcttgaacggtgtcggattcattggcccacccccaaagaattcttctgttcgtcttgtcatcaaagaatgtctttgacgcatagtagttaccataatcaaatctcaaaccatcccaaccgtcaggagtgtaaccgtctggcctgtaacgatccttcttggtgtcatacgttccaagagtgtagtactcgtatctggtcaagtccaaactaaccttcaacacatgcttggcgtttggaccgtcgtagctgaagtccaaaccgtttttcttgtcggttacggataccgggaagaaatcgggacattcccacataccggttttctttcttgagtggataggacgtttgcttttgacccattttttgaagtcacggctcttgtacatataagcaattcctctgttctttctctttgagccaacaagcattctccaatacccatcttttttgttgaaccaagccgtggtcgggtcacggaaagcggatccgttctcgccattatcgggttttacgatggggttatcgtctggctttatccatgtcttgaggtatgggtcggaaagatcttgtggaatggcgtagttttgaatctgagtctggttctcggtgataccggtgtagaggataaccggtccttttcccggtacgtgggtagctgaaccggaccatgtaccgttgatgtcgaaccatttggatgggtaaatggctggttcaagggcttcccaattgatcaagtccttagaaaccgagtgagcccacacaatgttaccccaaaccgcacctttgggattgtattggtagaagagatggtaaactcccttgtagagcattggagctgttgcaatttttgaatattgttacatgcaatcatatatataatgtttttgtcattaacttataaaaagggaaaaatatttgtaatggacttaccattcggatctgttggagtcaagaatgccataacgaaggcaaaacaacaaacccaaggaatttatgttagaacaatgtattttggttgatataaacaaccctagtaatagaagttgaataaatatgaacttgaataagatgtcacatatgttgtaccgttgatccaatggcggggaggttgaaagtgataagcggttctgtgaagaggacttactgactccaatgatgtcgattttgattgcaatttcttgaaaactttgtgaaatgcatcgacgccattattgctaatattgattaatacaatcaatagtaatacataaccaaactttggagcactcattggtgcaagagaactctatgatcacaacaatttattttgattttatttttgatgtgtaaatagtttttgagaaagaactctctgatgaaaaagatatagttttcgtaaaagatatagaagaaaagaggagggaaaagtagagtactttgaagataatatggatccgtaaaataatcctaatctcacgctaaaataagaagtacacaatgtggtttgcaatcaatttacttttgttgtctttttaatccatttttaacaattcttttattggttttgtcgaagaaaagaaaaggtgtaaagtcaaatagtttggtcaattgttttaaggtaagtaatagtaatatcgaggaaaatagtagataaaactaattttggttttagatcagagttttgttttgtctattttttttccttcgtttgttgtttcacatttgtctggacttaggggtacgtcaattggagagcaggagaagagagttagtattacactaaactaattaagtccacccatgatctatctatcaaaacactaagcagaaccaatcgaaatacataacagcacaagaaaggtcgtacgtccttaattatatattgtagttttccattaggtactctacatactatataacccacgtcgccaggatggtgatggattcttctaaggaagattgactgatgctaatctatctcttgtcaaccaaaattctgccgcctgaatccgattctttgacaatagagtcgctgctaaagagctatctatagtgtaaaatccaaaccatctatatgaataagagatattacttgacagtactcttcaaggctatctatagaatcatatcgttcaaactgttgtttcttaaagagcatctcgtgtgttttatctttattaatctacattccatatatgttgcaagctgagtgagtatgcatgagtaaaacaaatagttccacttaaaccttttccaaaaaaccaaaaaaaaatccaattatttgaccttaaaatatagggagaggtttatatagtattgcctaaacgtgagcaacgtaaaattaaagacgctaaattcgtaaatgcaaaatcatttctatttggttgataaaccggaaaaattacacttaaccgagtaaaaggtacgtcactgtatcttccccatatttacccacctgacaatatatgatacaagtaaaatcttaaaatcccaaaaaagtgaaaacaatctctcttctttctcaaggataatg

SEQ ID NO: 3636 - DNA, 1976 bp, Unknown
  misc_feature (1)..( 1976): cDNA_ID_1821379_gDNA_ID_1620654_Annot_ID_47804 3000 nt of promoter + ATG
gaattctctgcgtccacgaaattcaaattcgaaaaccgaaacgcgtttaacgagtaaccaagcacgtcgatgccacgcgcccagaacggtttatcccctttcccactcggaatcagctcctctatcgccttacctaatcccaccgccgtctccgtcgccgccaccacgggaccgtttccgaaaccatcagccgccgtctctttcataaactctctcagaagcgtaaccgccgcagtacgatcgaccgccgccgtgttcagccgaaatgtgagtatccgttgctctccgtcgtcggttagatcgtagagactgacgataaacacgcgtgactcggatttgatccaacggtgtggattgatccacgtgtttttgttcatctcgtgttctaggatgattctgtgtggatcagcgcatggatcgtcgctgtctcggatgatctgagccgtagatacggaatcgaagggatggatttcgacgtgagaatcggcggcggacgtaacgacgaaggagaaggagttagcggatgcgtcgaaacggatgttggaacggagagtggggtggtaaatctggagtttgtcgagggtattttggagattttggagttttggtgttcgggaaagtaagagagctatgacggcgatacctgtgccgccgtcaatcgctctgcaccagctgtactcggttcctccgacgggtcgggtcatggatttgggtacccgatttggctcactcattatccttgagaaagaagagagattgttttcacttttttgggattttaagattttacttgtatcatatattgtcaggtgggtaaatatggggaagatacagtgacgtaccttttactcggttaagtgtaatttttccggtttatcaaccaaatagaaatgattttgcatttacgaatttagcgtctttaattttacgttgctcacgtttaggcaatactatataaacctctccctatattttaaggtcaaataattggatttttttttggttttttggaaaaggtttaagtggaactatttgttttactcatgcatactcactcagcttgcaacatatatggaatgtagattaataaagataaaacacacgagatgctctttaagaaacaacagtttgaacgatatgattctatagatagccttgaagagtactgtcaagtaatatctcttattcatatagatggtttggattttacactatagatagctctttagcagcgactctattgtcaaagaatcggattcaggcggcagaattttggttgacaagagatagattagcatcagtcaatcttccttagaagaatccatcaccatcctggcgacgtgggttatatagtatgtagagtacctaatggaaaactacaatatataattaaggacgtacgacctttcttgtgctgttatgtatttcgattggttctgcttagtgttttgatagatagatcatgggtggacttaattagtttagtgtaatactaactctcttctcctgctctccaattgacgtacccctaagtccagacaaatgtgaaacaacaaacgaaggaaaaaaaatagacaaaacaaaactctgatctaaaaccaaaattagttttatctactattttcctcgatattactattacttaccttaaaacaattgaccaaactatttgactttacaccttttcttttcttcgacaaaaccaataaaagaattgttaaaaatggattaaaaagacaacaaaagtaaattgattgcaaaccacattgtgtacttcttattttagcgtgagattaggattattttacggatccatattatcttcaaagtactctacttttccctcctcttttcttctatatcttttacgaaaactatatctttttcatcagagagttctttctcaaaaactatttacacatcaaaaataaaatcaaaataaattgttgtgatcatagagttctcttgcaccaatg

SEQ ID NO: 3637 - DNA, 3000 bp, Unknown
  misc_feature (1)..( 3000): cDNA_ID_2992655_gDNA_ID_1620654_Annot_ID_163598 3000 nt of promoter + ATG
ttcatcagttacatgaaatggattgaaatcagtaaatctctttaatctgataaaaccctaattttacaaaccctctttggatgtggttgcagtagcggcggtgtcgaagtcatcggggtctttggttgggtcagatttgtcgattgaggagcggaatttatcgaggaaaggcttgaaagcgatctctatggctaaccatcctaacgccatcgctgcgaccaccacagtcgcctgtttcgctcccgaagtttttcccatcgctgcgtcgtcgtcttgttcgcgtgtcggtggtatcaaccgatggtttaagatcgggagatgggttttactaggatgtttaaaatgggccggtttgggcttctcattggataaagatagtttgtttgttaaactatggcccaactttttatccgtctattggttaattaatacaaactttttatataattgtaaatataattgaaaggatccctattttattttcttgggaatatatatatggaaaaaaacaatcaatagaattagataaatagttcaatatatcaacaatttcttttttgttaggataaggaacttttaccttttttctaatatagttacaaattgtgtttttttttttcttaatttattatcaaatttcttttttacttatatataacctcctttttcatatagagttattaactttttcattttctcagtaaatgtattaacaaatttagacttaatacatgaagacatctaatatttttattgatatgtgtcgtgaactcgtgacatgttagttagtaatttttataaaaaaaatttagataggttaaaattatttgatatgtgtaggggtgtcaatgggtcaaaatttattggtcaactcaactcaacccataaaccctaatgagttgaaaattttgactcaaatgagttgatgggtcaaatgagttgatgagtcaattggtttgatgagtaaaatgagttgggttgtaatgattaatggtttcaatggtttacccaattaacccatcaagttttgtaaaattgaattaaaccaactaaaatttctaaatcaatgtcaatttaagtctaaccaacacatctaaaccaatttaataaaattaatatttttccaaatttcttaaatatacatgcgatgaaattgagaaaaagtaaactcgtaaattttccaccaaaaaacataaacccgtgattttcccgccaaaaacgtaaatccgtgattttctcgccaaaaacgtaaacccgtgatttttccgccaaaaacgtaaacccctgatttttccgccaaaaacgtaaaccagagattttcccgccaaaaacgtaaatccataatttcccgccaaaaacggaaacccgtaatttttccgccaaaaacgtaaacccataatttttttccaaaaacgtaaacccgtgattttcccaccaaaaacgtaaacccgtgattttcccgccaaaaacgtaaacccgagatttttccgccaaaaacataaacccgtggttttcccgccaaaaacgtaaactcgtaattttgacgctaaaaacgtaaactcgtaattttctcgccaaaaaacgtaaactcgtaatttttccaccaaaaacgtaaacccgtgattttcccaccaaaaacgtaaacccgtgattttcccaccaaaaacgtaaacccgtgattttcccaccaaaaacgtaaacccaagattttcccataaaaaacgtaaacccataaaaagtagaatccgtaaatatcctaagtttgatgataatgaattaataatgataattatttattattattttataatagtaattaagtaaattattaattaaatgggttaacccatttaacaactcaacccatcaaattaaatgagttatgagttgacccaacccatttaacaaaatgagttgagttaacacataactcatttaactctaaactcatttgattatgagttgggttgagttgggttacccattttgacacctctaaatatgtgtctctagcctctactatttttaaaaactaaattttatataataaatttttttatcttaataataaccaagttgaacatattttagttctaaaattaactactcggtttaatattaaactttagaccaggacatgccggataacatggtcttagtgttgtcgtacgtcaccattagagtttcaatttgcataatacaaggtggttgacccaataaaagaaatttgattcaatttcgatataaacaggtttgttttggttcagttttacctattactttttattttgtccaatcccaaaactattatttcaaagacaaattggagaagaaacaaaaaaaaactaatggttggacaaaagattattatatatcaatttcaccacaaaaaacttagcattaaaatattcgaaatggacagcgacgaattcaaaccttcgtgttaattgtctccggcgactatgaattctaaaatcttccactttgcctaaaatatcaatacatcacattcatcctagccttatccactctttcttggaaattctggtctggtttcccttcagcaattcaattaacttcatcaaaccgaccggttcaaacaatcatctagaaattctattttattgttagactagatcatgaaattttgaccgagtcagcacacataaaatctggtacttgacgtggtttagttaacccaacaaagttgttttggttaaacggatttattgacaaacgtgtttcggttcactcactaaaaaacccggttaggtagatactacttcattgacaacaaacgaagcatcctttaatttcaaaaccgcgttttaatcagacttttccttttttattttcagttctaatgtttaaaactttccttttctttttctccatatttgactcgtcaatataaatacaattgtaacaaacagattttgatcaaaagattttacttttctcaattcctttcaactttcaaaatcgaagatctcttaagcc

SEQ ID NO: 3638 - DNA, 3000 bp, Unknown
  misc_feature (1)..( 3000): cDNA_ID_1821346_gDNA_ID_1620654_Annot_ID_163595 3000 nt of promoter + ATG
ggcgggaaaatcacgggtttacgtttttggtgggaaaatcacgggtttacgtttttggaaaaaaattatgggtttacgtttttggcggaaaaattacgggtttccgtttttggcgggaaattatggatttacgtttttggcgggaaaatctctggtttacgtttttggcggaaaaatcaggggtttacgtttttggcggaaaaatcacgggtttacgtttttggcgagaaaatcacggatttacgtttttggcgggaaaatcacgggtttatgttttttggtggaaaatttacgagtttactttttctcaatttcatcgcatgtatatttaagaaatttggaaaaatattaattttattaaattggtttagatgtgttggttagacttaaattgacattgatttagaaattttagttggtttaattcaattttacaaaacttgatgggttaattgggtaaaccattgaaaccattaatcattacaacccaactcattttactcatcaaaccaattgactcatcaactcatttgacccatcaactcatttgagtcaaaattttcaactcattagggtttatgggttgagttgagttgaccaataaattttgacccattgacacccctacacatatcaaataattttaacctatctaaattttttttataaaaattactaactaacatgtcacgagttcacgacacatatcaataaaaatattagatgtcttcatgtattaagtctaaatttgttaatacatttactgagaaaatgaaaaagttaataactctatatgaaaaaggaggttatatataagtaaaaaagaaatttgataataaattaagaaaaaaaaaaacacaatttgtaactatattagaaaaaaggtaaaagttccttatcctaacaaaaaagaaattgttgatatattgaactatttatctaattctattgattgtttttttccatatatatattcccaagaaaataaaatagggatcctttcaattatatttacaattatataaaaagtttgtattaattaaccaatagacggataaaaagttgggccatagtttaacaaacaaactatctttatccaatgagaagcccaaaccggcccattttaaacatcctagtaaaacccatctcccgatcttaaaccatcggttgataccaccgacacgcgaacaagacgacgacgcagcgatgggaaaaacttcgggagcgaaacaggcgactgtggtggtcgcagcgatggcgttaggatggttagccatagagatcgctttcaagcctttcctcgataaattccgctcctcaatcgacaaatctgacccaaccaaagaccccgatgacttcgacaccgccgctactgcaaccacatccaaagagggtttgtaaaattagggttttatcagattaaagagatttactgatttcaatccatttcatgtaactgatgaatccatgtgttcttaatcataacagtttgagcaatttcttttgagtcatgatcgtttatttgtcatcaatttttggaaaagtctgctatattgaatctgttattgtagttcaatcgcataacagaatcattaatctaatcaatattcatacatgatttgttacaccgtttttcgtattttgtataaagtttcgagctgtattattaaggtggaagaagagattaggaatccgataagtacttaaattgttttaagttatgattcgattatacgtatctcttgaaaagaagcatgttagagcaaaatatcaaacttgacaattacaagattgctttatagataaagcagattagctaaataagtatagggagacgataacatgtggtgatacaaagatgtgtcagattgattgtttaacatcatttagttgagaaaactttggacgacgactgacttcatcatatgagaaaacaccaagaaaatgtactactagtctctaatggagagacttggttatagaagttcattgtttaatttgaatatttactccaattcaggaaaatatcaaaaccagaaaattacatgaaaattactatagatggtagctttgcaatgattattgtccggttggatagtttcattgacatttaggattcagattatctcttttatcattatcagtttgttaaggcaagagttttctaatacatgcttaagtcctaatcatcagatatttcttcttcaaaccttttttgttttgttttgataatttgccccattttgtactctaggtttttccacaaagatcccaaacagagattaaaagatgacaatggcatggacctttcaatgctttgtttttttgttaaattagatataaacctttccaaacagtaaattatcaaattcattaacaagtatctatatctctctagtagaggtagaccacaacttaaaaatctcctcaagtcatggtgggtctaacttgtaggacttatatgggccaaattgtataactatatcatgttaagctgaaactgaaagtaattggttccttttaaaagcttagccaaaaaaacttcaaaatgtctgagtcaaatgtaggttgatttctctgcaatttccatgaaagatagatagataaactcttaccaaagtttctgcatatcaaaagttgtcaatttatgctcaagtctaaaccattccgattacataggatcacatgctttgattcgcattttcttctactatatatttacatatttttttgtcctctacacacaatgattaaaaaatgagaatggacctacctttcacagcatttctttattattattttataaaaccagtacaattttactaaattatgatgttaaagtaagagactttgaagaagacgacttagcaaagaccaaaaccaagaaattacataggaacaagccaagaagatacatagataatttctttttgcttgtaatatatttacaacttcataaacatcatcgttctgcaactctctactcgatatccaatcatg

SEQ ID NO: 3639 - DNA, 3000 bp, Unknown
  misc_feature (1)..( 3000): cDNA_ID_3071530_gDNA_ID_1620654_Annot_ID_163588 3000 nt of promoter + ATG
gtaacaaggcaataacttatgacatccattccctattgttttacttttgtattaaatatgtaagggaaaaatgtcctaccttcaatttctataagttgtgaaaagcaatgttatgaggaatatattttgctggtagagagatataattcgattcttatgatataattatgaattaatataaattatatggccctgatatatgctcataaattcataatacctttttaataaagtagttcatttgtttaatgagaacatggtaggtaaaaactaatagtaaagaaaaaaaaaaatcgactactcaacgaatgtcatgaccgtaaaatagttaaaacagttgggccttagaagttcattttgggccgttaagttgaaatggtacaataaacctcacgaggcttttcaaacgcacaaaatggacacaagacattacggcagcgattagattagttctctccctttttgttgtctatagaacatacatctgagtctcttctgttggtttcaaattcaaactaaaaccgaacagagaaaaaaaaaatgaaagaacaaatcatgaaatcaacagaacctaatcccatatacaagttacaaatttacaacaaggtttccgtttgatttataatttggttagatcacggttaaataagaaaccaaacttgatagaaaataagaaaccaaacttgatagaaaattagaaactaatatataataacccattcctttgacaccgtatctttgaccgggtcaatatccccggctaatcggagaactaaacctatctcagccgtacacactctcctcacgtaccgtcttagagagatcatcacgaatcggagaaggagacggcgtgtaaaacggtggggaagcacatggagtagaaaacggcgtagtttgattatagtggctaaagtcaacctcgtcgtcgcttatatccgtcgcgactacctcctcttccacttcatcatcctttacatgatcctctgtaaagatgcttccacgtggatcaatctcacccgtccgatgatcggactcgctagtatagtcttcagcgatggtaaacaaagtctccgaaggtccgcaaagtaaattttctccgtttattgaccactttgatgccacgtcattaaccggcggtgcggctgcagggagcggcggagcggtggcagatcctattctgaactgtttgttttcgagacagaacaagaagaagtaaagaagctctttcgatggcggtggtgtagccgttaggtcaccaccgcgagaggaaaaagcgtcgcgttctgatccggcgatactccgacgacggaaccgacgtttccaccacaaaacgtaggcgaactgcgccgttacagcgacgaggcaaaacgcgaaaacagcgacgagtagggttgcagttggggtaagacccatttaggagacgagagtttgagagagagtaaccttaatactgcgtcgtttcgtttgtcgtaattatggatatgatgttttaagataagaacagaaactgaagtggggtagtctcgtaaattattactaattattgggtagttgaagtgtcataatcggaaaagagttgctgagtaggttccggttagaaagatcattaatagtcaaatcgggattgaaagcgaaggtacacgacacgacttactatttggagtcatggagtgtctaaaatttctttagttttagctgaccaaaaaaaacgagcatctacgttgaatgtgctatatgcgaatgcgaaattggtgacttttataacaatcagagatttgagtttatcgattatcaaaaaagcccaaataattattaacattttaacggcccattttagtctaacacgccactgttcagggtttatgattaggattctagtttttttgcctgatgcatctccatcatctagattttaatcatatatgaggtactaattacaaactgtttttgaaataaatttctaggaattgtaaaatagacatgcatatatatactcgtcagtcataacacgcctttgaagtatactaattcatcttgaagattcttgaaagtgagctcatagaagaaataagatatttaagcccttgaaatgaccccttcttgagatatagatttgggccagtaagctctcagtatatttaaatttgaacctatagtggattcatgtgttgcttacattagtttctaataaataactagtactatcttgttttaaaaaaaaaaattaataacctaaaaagtttacaagaggagaaaaagttagtgtgtttttatcgcttttttaaagataaaaagtgcattatgttgagatcaaagtttaggtctataatgactaaatgcccatcacaagactcttaaaagcttaaaacccccccaaaagcagagagatagaatttagcttttttaccctctctttttctcttctgctttaaaagggtcacccactttctgcaattcttgtaaataaattaattatttacttttctaaaatcatgcttaactttatcttccttcctgcttttgaggataaactttagattccatgcatgaattgatggacatctatacgcattcatattatatgcattcatcttattttgcaaatatattaatgtggatatcgttgtgtttacacatgggtgttttctttcaagtggtatgattcatataatcataaattgttgtcatttagaaattgaccaacaaatatttgttcttaagaatcgattatagatgtagtgagctaagtatatagaaaaactttgctgcatgcatatacatatatatagaaaagcttttttaagatcaactacatgtattaatattatcataaacaactcgttttggtacaagtcatatatgaatatttttcaaagtaaccgctctttttccatacgagaaaaagatatccaagcggaaaaagcttcatcttatttgaaaccaaagcaaagcatcacattgtgaaaggagaatcattcacaaaagtgatccatacatatg

SEQ ID NO: 3640 - DNA, 3000 bp, Unknown
  misc_feature (1)..( 3000): cDNA_ID_2169424_gDNA_ID_1620654_Annot_ID_163584 3000 nt of promoter + ATG
aagtcaaataaggactatattgtaaagcgtgttaatacaatattaatattgggaccttatttttcgcttttttagaatttaattatgttaaagaaacaaatttcttgaatgaaatgaatagagatgtagtagcaaatgctggatggttggcagctgacgctccaatctcgactactttatatttttcaaagcaaaacaacgaccatattttatttttacttttaaaaataagtgtgtctgcctttaagtataaattgaattattgtagtgaacttttttttgttttttgtttccactgtttattatgatatgtttaaaaatacatatataaccaccagcaaaggagtgtaaagtaactcattcactacaagaattatgtaaaaacattttcctaaaaataggttccattttgatttagtcttccttaacgacgacgattttgatgatacatattacatgtatcacggaaagggttgaataaagtcaaagcaaacatcacaagaaaagggtcaaatgaagcagctttggcccatttcacatgaataatgtttcattggtcactttttcctttcgttaccactttgtcaattgagtcaccctccgatttaaaggtctgtacgttcgttacaagttacatcaactcgagtatccctaacgagcactcgtacattttgccctacaatcaagaatcaataatatccaaacaacacttttatttcgtgactgagccaaaacaaacgagaacccggtcctatcaaatttatatgaccaggacatttcaagagagcatcactatatataacccatcgcaataaataagaaataaagtttcattaatccgagatatttagtgtcttcggttttctaaaacactcatttagagacaacggaatatgattctcacaaaaaaaaagaatatgattcttacaatacatcacaatcaaatgcatatgaatgtcaatgagaggagtgtttaagttaattgtgttaaaaatctcacatcgaaagtacaaaccttatcacaataggagaataagctataaaaaacctacgacaatagatatgttattatctcaaatacccgtaaattgaaactcaatgaattattaaatacatggaatcaaatttcagtataaattttgttaattaaatatagataatatacatttacattttttggtataaattataccgaatattacaaaaccaaactaaaacgtagattcaaattgaactgagtcgaaccgaccgactcaagatccccaaaaccaaaaaacttttgttgttgacaaagaaatcaaaaagggctaaaaaagaagatcgagaggttcgggaacaaatctctctatctaaaagaaatcataagtgaccataatttgtacaatgttcgattgttagagttgacgttaattttattgtcaattgcatatatgtaaaatatgtcttaatttaaaaactaatttgttcgaatatagtgaaaatcatgttttagtgatataaaaacaatttgattaaaataataacctacgcctgaacctcatcaactataaaggcaagttaatttttttcaataaaccaagtttgcttctaatgcgaatctaaattgttgtgttatggacaatgccgagaaggtgttctaagtggaacaaattattagacaataagatttttctccaagctagttgtagagattgttttacaataacaacattaaaattttaaaaaaatctagataatctatgattctaactcttcttaccacggacagacgatcgcggatccatagaaacttgttcatcgtaccagttgaagaaaccctctgtaaacaacgaaatcgaagtgagaaaaaatacctccacatcaaacccaaatcatcagcgttcattcgcgtggacctaaagtaatgtgggaataagaaaatttaaggcggttgtcaaaattataaaaaattaaattgaaaataggagaaattttttagttcgacacatcgttttttatttatttattatacttttatttatatttaaattctgagtcttccgaaagagttgatatatttgtgctggctacataatttttcattggttatttttgtgctatcttagtataatgataacatcttctcaatgcaaaaacttataaaggtttacttatatttttcctctcgcgagtactatttatttatctagacttacaaactgattttaatgtgtgtggatagagtctagtatcactattatatcagcaaagataacataaaatccgtagcaaatttcacagaggtcatgcgttttatagattaagagtagaattaagcttttgaacctccgtaaaatgtatcttgttttagctcacaaaagctttattataaatcaaccataggtctataatagagtaaagtccatcaagtctgaaatgaacatttttcatccctaataaagtttcaacctttttttttttttttttttttttttaagtttcaactttgttcttgctaaaaataaagaagcaactctgttcttattgactatatcaaatcatccctaaactctagggatttacttcaacgacaaagtaagagttgcagtcctccattttgaacctttctagaatctcacaagcatactccaagaaataactcatttctccagagtcggacttatcgaattctatcctcatggaagccttaaactcttcaaccatgcttgctttagtccttgtcaggaccaaatcatcaacctatgatacatgagcagtttacttctatgtcagtcttgacaaatagtgttacttttgttatgatttagtgatgatgattcttgatgctatttacaatgttagagcttgagcaattgagataggtgaataagaatttgtatctaggtgatgaaatagttgtttttgtcttgttagtagagttttcttgtaatctccatgcccttttggtgatgatcgtttatgtttagttacaatgttaagataggtgatgaaaagtgaaca

SEQ ID NO: 3641 - DNA, 3000 bp, Unknown
  misc_feature (1)..( 3000): cDNA_ID_3071544_gDNA_ID_1620654_Annot_ID_163575 3000 nt of promoter + ATG
tcaatttcaagaaatatggtatcttttgacttgtttaaatcttttcgctttgctactattgacataagtttttcttgagtatctcttgtgcacttaacagaaaaaatcattagaaatatcaacaatttattcactgttttcaataaatagactcattctcacatacgtttgattattatgagtttaaaacattcaattttgtttgttcatgaaaaatcacatactcttaacaaaaaaaataattagaatcaaacatttaccatcattgtgtcttaattattgttagtatatgttattgtattaaaatcatattcttagaagaccaaattctccattaccaattagtctacttagcattttttttctaagttgaaaaatataatgtgaatgtttaactaaaattaatatttacttatattaataacactcaattttaatatttacactcaattaatatatatgcataaaatctgtaactgaagtatgaaataaatactaataaaaataattaaatattgactataaattcaataatgtataataaaaaattagaggtaaatctataaaaaaaaaagtgaggtgaaagtaaatatctatttgaaattttgtgagaagtatagagctctctactcaaaagagttactttcttaaaattaaatcacttgatattactagagcagttaaacccataaattaaattaaatctgtgacacaaacatatttatgtaattatatctatgatttgattagataaatttttaatatttatttttgaatttaaaaaacaaaaaaaataatcaaaaattcaaaatgaaacaatagtaaattgagatgccaagtggaccaataggaaggtagtgaaactttacttttatatatacatgattttttcattttttctctctgtttattattcatttaacataaaaagacaatattaccctccatataactcacaatatttccacagtttttcacattatatttttctctacaatgtttatcctcgaattaggaaaactgaagaagagcagcttcgttttcagaaccttcccaggtatgttgttgcttttcagaaattatctagatatgggttcttctttcgattcttttttaatcatgagataatttttgatatatggtagttgttgaatcataagagaacttttgactagattcgtttttttcttcaaaatttgagtgttgttgattgcttttgtatgaaacttgtcaaaaaaaaaaacttgtcaaaaagattttgagtataggcagtaaaagattttagattcaaggttttcaactttgagatgattagttttcgacggatagaagagaaatccgatgaatgaatgaatctgcctttaggtaacatatgattcaacctattcataaattacttattcaaagcaagagatatctgaaaacagagaaagattcattacaaggaaagagtttcaaactttacacagagtagttgacttgatcaatttgttctttgtcctgttcggatgaagacgctttgaaaagttcttctatccccttaagctctttggcgacatcgatcattgtaagcacgtcttgtcctggccagaatctgatacatctcaaagcaagcccaaaaaacgtttccacttgcacagcagatgcttcactctcaccgttccatatgtttgaatctatgacatacatgaactgatccgctaattcttcaccacaaccaggaaatgggaatccaaactccccaatgatagcagataaccaggttaggccaagctctccgcctagaagaaacagcattgtaactccaaagctatagacatcaaacttttcggaaactaaacctgttccattatactccggatcaacggataccccataaactactttatcatcatacacagatgattctccctcagggatcgatattctcaaacagaaagaagagagcttcgcagtcccatcttcgtccaagaatatgttttgaggtcttacatccctgttgattatgactcgaggaaaagctgtgtgaagataagctaccgcatttgcaatatccttcccgatctttaaccttgcactccaaggtaacggagtaccgtccatgtcctcgagttttagaggtcctttctctgctaactcacaaaccagaaccggtttataaaactccacacagcaacccaacagcttcaaaacgttcttgtgactgctcatcatcgacaaaaccgctatatcgcggtaaacattttcaggagaagaaaaaaggacataatctccttcccatttcttgatgagtactctccgttcttctatagtacccttgtaccatataaatctatcttttgctatgatatgatctgcgtcgaagttgtttgttgctttaagaatttgatcagacgaaaacattcggattggattgtatttaccatctgaacacgcgattagctcctcgtgcaacaagctcccgttcttgtctgaatgtttccttgtctcactctccgttttgaaaaaacccttcatatctttaatcaggaaaactaataggagattttctaacttcttggtgctaatagaatcagggacgctataaagctgtatatctcaacgtgacaacaacctctgttttgctaaagaagaagcagcctgcaacttgcaacaaatggttaattattgggcttaaggaaaaaataattattgaaactatactttagagtataggcaatatatgattcaacctatgggtttacttactctatcggtacctgtttttgtctaccgttggtagaatgatattgcaaaattgatttggttcattagattgtattctacttttattttcctctttcatctatagtaattttgtcaatctgccttaacttttttgcttattcattggcttactcaactttcttcttctccttttaactatgcacttcggtcactgattgattcttgtgtgtatttttcatttcagttttaacttactggcacaagttaggaatg

SEQ ID NO: 3642 - DNA, 3000 bp, Unknown
  misc_feature (1)..( 3000): cDNA_ID_3071547_gDNA_ID_1620654_Annot_ID_163572 3000 nt of promoter + ATG
gctttaattgaaaaacggataatgcggtatgtcacttatcgttatgtaatttatttagatttaattttccgtataatgaggaataaaaagtccaaagagagtgtttggacagtgctacaagaaaacttcaaaccagaacaagacaattatagacatcgatcctcttccataatcaatgaaagcaatctataggtttttgatgcttttattcatttgtgcaaagggaagaagaaacctttcacatgattgatacaagctcatgcatatagaaacggtttacggttctgactacaaaaaccaaccaatcttgaaatgaataagttttggagaaagggcttgcattaaacaagatatacaacttaattggtttttatgctcaagcgtagcttcatctcacttggaatcaaattcgatcttcttagtatataacttaactcgattagtagcgattacttgaaaaatattagagaaacagattccagaagttatctccttcactcttcagattcgtaatgaatgtgattaagataacaaaagaaaagtaaacaaatggtagtatcaactaaaagctaccattaaattccattaaatagcttcacatgggatataactgatgctgaggtattagattttatggaaggtcaatggtagtatttgacattttgttatataattattttattttctgctaaaacaacatattcctagcttttttatattcttataatcttgtgaagcaaattcaaaaattaaagaggccactttcacaaatcatcccagtttaggctgttgtataattgccattaaagttttgaaaccctgttgcataactgtcgttaaattttttagtctataaatcattttaaatttgattgtcctcttaattgtgaaacatttaatacacgagagattcctaagttattaacagctatattatgtcctcgtgaggtctgtattttagttattggcctcttgtattaaattctagtaactgtttgtttcattttttttaatttgttactctttcgtttgctattcaaagttctaaaattcaaacgttatccctctagcttctcaaataatatatataggagattttatataattatgaaaattctacttcaaatgacggtttaaaacgcaagttacaaacgtctgtttaattgatcataataaacattttgagagtactaatcaataaatcatactcatatccagttactttccattgttcaaatgaaaatcaatggctatcttgatcgtaacaatttagaaaaatgaaagttatgcaaatatgtgaaacattaaaagtacagtaataaagtttattgtaccataacctttcgtccaaataatttcctgttttaaaataaaaagacaggaaattaaagtcaagtaatttaactaccatcattagattaatcaaaggaaatgttttttttaaaaacattaatggatatccttttattcttctaaattattgctaaacattttgtgataatttttacaatgactagtgaatctggtagttagaaacatcttaatggttttcacctttgaatatccaatttaactaccagcaagcactacttacatacatctatctacatctttcattcttttatattgtcaaaatttgtcaccaccaaaaacattgatttatattcaaaatttggaaagtaactcaaagtagttgagttttgtgggtaccttcagaatgtccatttgattatcaatcaaaaagaagtttttagctggcgcatgaaaccgtcgttggaaactttgaaacggatgcttcactgtataaacgtactattattatttaatttttaataacgaaaagtaaattgtagatgaattctttttatttgattcatttttagttagtgctagccattatttctatctttaactatattcaaaattgttttttcatactataaactattattagaccattttcttgaatgaaccatactttctagacactatttctaaaatgactataaatcacaccatgtagttctatatttgtattattgtagtttattgatttaacattgaaaatttaataaattatacaattaaaaaattaataggttttaatacgtgtaaaattataaaacaaaatttataatgaaacagagagaatagtaaaaacatttatgagaaaaatatgtattggtgtcactaaagttattttagacatattttcattcaagaaatcagttgaataatagtcttactgtgacaaacaatttaatagataaaacattgagtagtattaactaataaatgaatcaaacaaacaaagtctaattgataaaatacgccatataaataaactataagtttctttaaaatatacattaaatatacaaaacgacaaatttatgaaacaaaaaagtgaagtcataagattaaaactattgtgaaatggatgacaaattcagtttcttctttattctttaaaccctaagtttaaattctttcaaacacaaatcgtagtatttgtaaaactgttattttcttgaaatataatttaacgttacattaacaaatcaaatggatgacatattacttaaaatttagattaccaataaaaaatcataaattcttcttttaaattgtaagatttaagtcttcccctttacatttagcaataaatagtttgctgcactggtttaaatgcactaatgcattgtttactgaattgtcttttgtttcatatatttgtctctactatacttttactaactttcccacctccaattaaaaaaattattacgaaataaacaaagtcatatctctctccacaacataattactttattcaacaaatattaattcctagtcatattttagctcctcttcttccttatatattacatacatacattttctttagaagtcattaccatcaacccatcccctagaaaaacacagagaaaaacaaatacaagaatacaaaaaccctctcgacgaaaccgaagtatcgaa

SEQ ID NO: 3643 - DNA, 1976 bp, Unknown; identical to SEQ ID NO: 3636
  misc_feature (1)..( 1976): cDNA_ID_1821379_gDNA_ID_1620654_Annot_ID_163569 3000 nt of promoter + ATG

SEQ ID NO: 3644 - DNA, 3000 bp, Unknown; identical to SEQ ID NO: 3635
  misc_feature (1)..( 3000): cDNA_ID_1843191_gDNA_ID_1620654_Annot_ID_163568 3000 nt of promoter + ATG

SEQ ID NO: 3645 - DNA, 3000 bp, Unknown
  misc_feature (1)..( 3000): cDNA_ID_1030715_gDNA_ID_1620654_Annot_ID_163601 3000 nt of promoter + ATG
tggttcggttaagttcggtcatggtgatggttcggcttatttgttcgatcctgatatttataccgatggacggatttcggttcaagggattgacggtgttttgttcccggaggaaaaaactccggtcgagaagaaaaccggcgttccagttgtcaagaaagcacctaaaccaagaagaggtaatcaaattttgatcaatctttagtctattaatttttgtccttacctatttgatcgtgacattttaaccccaaattatagaaattaaaaaaatacataccactactacaaaaatacaaaagttttggtatagacaccattacaaagttataaagtcactcgcttagggaattttttatgttctatgattttgtcatattaaatggataactaaatcattgttatagaaagataatggtgattagtccatatacaattagtctttcaacgagagagtactaagtaaacaagtgagatttggaaaaagtacaaacgtgtgagaatggagacaaagtctctctaacaaactttgatataatatataaaatttcaacaatattatacaaaattttggagataattaggatttataactacttaatgatccaccgacgaaagtatcccatgttaaagtgaatgaaaatcacaaagtgttcctttttctttgttttttgttctaaagccaagtatgagtcatataatcatattgtaataaagagagaaaattttctttatttatttctaaatatattatttttgcattagttagaaacaatcattttaatagtccttcgttgttattgttaataaaacaaaaaccaaaccgtttgaaaaaattaataatttgtatgatttatattatattgcaggtaaattgatggaagtagcatgtacaatgctgggatcacaatttccaacatgtcaatgagatcaaattaaatccgggacatgagaattttataattctgtaaacatgtgataaaaatgtgaacagaaaaaagaaataatgtaaatgattatttttttgggctcgttgcaatatgattgttaaattgtaattttcagttgttttgagctgacgtaaccaaaccagattgggtgggtcttttcttttctgttggatgctactgtattggatcgaatctgtccatttagagatcttctaatggactactagattaagcagccctaggtggtaggttatgcattggaaatactgtaaactgtaaaggcaacaatgtccataactctaagaaaataatccatctaattcagaacatcaatatacccaaatccagttttagaaacaaagtaaaaacagtataaaaaaaaagccaaaatgtgatgagaagtcacatgtcatctcgagttgatattccaacaagttgctaacattaaacaacatgggatagcatatttgatattccaattcacaacatgagcatgcccggtccacaactcaagctacccaaacaatggctaagatcatcaaaagagatgagtaaaaatacaaaatattataggtatttgttattaattcattttttgttggtcttttttttaccatatcacatgagttttaagctttaaagttaataaatactaattaagcggattggtaatgaatttttagtaaaattttggttagaaaaaaaaaaacgaaaacaaattttttcttcttctttttgtatgaatataaaactatattcaaaaagacgtttgcacaaaattttaatttcgattgattccattgttatttatttttatgttggcttggattccattggtattaaggtaagtgattttagtgacaaaatggaagaagttgctttgaagaaaaataattgaaaacaaaaaaaaaaaattgactattgtttttattttcttacaaactatttatggatttaaaagttgttttatcaagttttagtatgattttttttatattatattattagtaaatttgcgagaaaaatataaagagcatggtttttttctttacgtaaacgttcaaaattatcagtccggctctaaacatgagatagtagattctaattctcgtcatgagatcgtagattctgattgacaacaagagataggagattcctgtttacagtatgagattgtagatttcattcacaacatgacatcatagatttcaattcacaacatgaagcaaatcattaattattttcaaatgtcataccaatctcgtcttctcgaatgtttggagcttcatgaccaacctttgagtaaagagcattacaaagtcgtaatcgttttaaaaacaagttaaagatttcgtttctttggatgattttatgaatagtataatacaaatttacacaactcaccacataatatcctttgtatgatccaaccaatttcagatggagaaaatatagttgcatgagtatctacaatctaagacacaaagacatagatggatctaagggagactgaactcttgtataatggattcacaatcacaagaaacaaggagagaaacacaaattgaacgttattatttccagcttaatggacttgaagaatgaccatcatgtttgtgcctaatctgattttctccaaattctttagaattctctctttgctaatcctgaccaatatgagaaattcaccatttttttgctcataggtgctatcaataacagtttcaagtttcaacaattcaccatttatataacattaccaacagtccaacactagtaacataatcaccaaaatatattagtaataaattttcatcacagctttatatttttgtgattagaaattaggatcttacagaaatctttcaaaaaaaaattcataacagttccattttttttggtaagattcataaaaaaattcaagttaaatgcattttataaaaatgtaggaaaaactttcatcaaaaatcgttgagaagaacatacagtatatcttatccactctcttcctcatccacgcggcaaaggcacaaacctctttagaaaaatg

SEQ ID NO: 3646 - DNA, 3000 bp, Unknown
  misc_feature (1)..( 3000): cDNA_ID_2169438_gDNA_ID_1620654_Annot_ID_163600 3000 nt of promoter + ATG
tttaacaactcaacccatcaaattaaatgagttatgagttgacccaacccatttaacaaaatgagttgagttaacacataactcatttaactctaaactcatttgattatgagttgggttgagttgggttacccattttgacacctctaaatatgtgtctctagcctctactatttttaaaaactaaattttatataataaatttttttatcttaataataaccaagttgaacatattttagttctaaaattaactactcggtttaatattaaactttagaccaggacatgccggataacatggtcttagtgttgtcgtacgtcaccattagagtttcaatttgcataatacaaggtggttgacccaataaaagaaatttgattcaatttcgatataaacaggtttgttttggttcagttttacctattactttttattttgtccaatcccaaaactattatttcaaagacaaattggagaagaaacaaaaaaaaactaatggttggacaaaagattattatatatcaatttcaccacaaaaaacttagcattaaaatattcgaaatggacagcgacgaattcaaaccttcgtgttaattgtctccggcgactatgaattctaaaatcttccactttgcctaaaatatcaatacatcacattcatcctagccttatccactctttcttggaaattctggtctggtttcccttcagcaattcaattaacttcatcaaaccgaccggttcaaacaatcatctagaaattctattttattgttagactagatcatgaaattttgaccgagtcagcacacataaaatctggtacttgacgtggtttagttaacccaacaaagttgttttggttaaacggatttattgacaaacgtgtttcggttcactcactaaaaaacccggttaggtagatactacttcattgacaacaaacgaagcatcctttaatttcaaaaccgcgttttaatcagacttttccttttttattttcagttctaatgtttaaaactttccttttctttttctccatatttgactcgtcaatataaatacaattgtaacaaacagattttgatcaaaagattttacttttctcaattcctttcaactttcaaaatcgaagatctcttaagccatgaacgatcttctctccggctcgtttaaaacctccgtcgcggacggttcatcgccgccgcactcacacaacatcgagatgtcaaaagcgaaagtctccggcggaagttgccacggtggtaacaacctagacacgttcttcctcgacgtggaggttgtaaacgaagaccttaaagagctagatcgtctctgtcacaacctccgatcgagcaacgaacagagcaagacgcttcataacgctaacgcggtgaaggagctgaagaagaagatggacgctgacgtcactgctgcgcttaagacggcgaggcgcttgaaaggaaacctcgaggctttagatcgggctaatgaagtcaaccgaagtttaccggaaagtggaccgggttcgtcgtcggaccggcaaagaacttcggtggttaacgggttgaggaagaagctgaaggatgagatggaaaaatttagtcgagtgagagaaacgatcacgaatgagtacaaagagacggttgggagaatgtgcttcaccgtcaccggcgaatatcccgacgaagctaccctcgagcgtctcatctccacaggtaataattttttccaattctttcttaacaatttttttggtcaatttcaaaattcaaattctaaacgttaaagagcaagaaaatagcgcaagttgttaaacctttttaagaaattgttagtttataatttggttaaatcatgatattgatataaattggaattatattgtaggtgaaagtgaaacatttttgcagaaagcgattcaagaacaaggtcgtggtaggattttggacactattaacgagatacaggagaggcacgacgcagtgaaagatattgagaagagtttgaatgagttgcaccaagtgtttcttgatatggctgtgttggttgagcatcagggtgcacagcttgatgacattgaaggcaacgtcaaacgagctaactcgcttgttcggtctggtgcggaccggcttgttaaggcacggttttatcagaagaacacacggaagtggacttgctttgccattttgctattgctcattattgtggttttaattgtggtgtttactgttaagccttgggagagtaatggtgggggaggtggaggtgcacctcgtcaagctactccggttcaagctcagccaccgccacctccggctgtgaatcggcggctactacgctaaataattttttttttgaggttccctctgtctatgcatgagcatatctatgttttgaagattgttttttattttacagtattttgtctttaatgtttttgtaatgttttggttggttaaactctgtgtatatataatgcgatcaccacatttctttgttttattatggaacgatttgcttattttttacaatcgacttaagttaatttgaccgtctatgatattattattcggagagatctatcaaaatcgatggtcaaaatgaatttccagagaatatggaaattaaaaaaattgaaatatatatcaaatattatcatacttaagtatagattatttacagttatctctatagtattatttacatttatatttattttaaattatgaaacttagattaatttgttctctatataaataatttagacaattattcttatgggagtctttttttttttttcactgaaatgttgcctttcattgataccaaattcttatgggagtctaacagtaattattcataaatacttttatcttcgtactcccataatttatcgaaccatattgggccgtgggaaaagccgattagtcatacaaagcgtaagaaaaaaaaaagtttcattgtgttgtgccattgtttcactttctctcgca

SEQ ID NO: 3647 - DNA, 3000 bp, Unknown
  misc_feature (1)..( 3000): cDNA_ID_2993217_gDNA_ID_1620654_Annot_ID_47805 3000 nt of promoter + ATG
agaatgtagccgaagggaaggttgcgactcatcttcttcgtaactctggccattgggtacacacagacaatccaaagggactcctagagattgtgagtcccaacttcttctccccacacgagtagacgatgcgctacgaaaatggcattagtctttgcttacaatttcactcctgttcagtatctatatgcagaaatagcaaatccaatcgcaactattttgacgatgcgcggtttttcccgtttgtgtttcctaattttgcattagcatatcctttcaacaatgtacaaacgtttaggaggatctaataacatcaataaacttatcacattcataactttatacacaagatttgaaagacaatgactgctacgttagtacgaggcacaacaccagtaagaagactagagacgattaaaaatccaagatgctcaaaaactagcacttttgctcacttttatgggccgtaatatgttgggtctgtatatatattgggtctcaattaaattatccataaaatcactactttaaccctaacaaaaattcagactattaaagcaaattctgatccgtctctttcgctagctaaaggtaaaaggcggaacaacaaaagaaaccctagcttccctttgtacctctctctgttccaaaccatggtaagtttgtctaaagcttataattaattttcatggatttagtgattaagaagatatataatctgtaaatccatttctggtattgtgtggtggtctgaagtgagaaaatgtttaataagcaatccttattcttcgaatttcgatctgagatcatatgaattttctgagacattggattttttttgtgtggctctagcgttgagttatcaaattgagaagtttttattagatattgcaaatgcataatgctagtttttgtttggttttgtagtcgaagagaaagaccaaagagccaaaggttgagaatgtgactcttggaccagctgttcgtgaaggagagcaagtctttggagttgttcacgtctttgcttcattcaacgacactttcattgtgagtggcttctttatttttcaagcaaagttagatttttatgtacatttctgaacttcttatatctgcaattgcagcacgtgactgatttgtctggacgggaaacacttgttcgcatcactggtaatcatctctttcaactctcactctctaatcctttggtgatgatccctttgttaacttgtatgcggtagtctctgttgagtgtgaaatgaagttcttgactgcctaaaggttctgcttagtatctgctcttttaagttttttcgaggaatccgttgatatctttatagaaattgctttgttcttgacggcatcaatgttcctgcttatagaactaagttagttaccattgttattagtattatggtcttctctatagggtgtgagctgaagtgtctttagtctttgttcgtttaacttttgaggaattccttttgtttatctgtttggaaattgcattgttcttaaataacaatgggttgctaaaattgctgtttcgatttcctacttctgtaggtggaatgaaggtgaaagccgacagagatgagtcctcaccttatgctgctatgcttgcggcacaagatgttgctcagcgatgcaaggtaaaggcaaagaaattgcattaccaagcagacaacttgataatcttttatgtttctatatttaatcgatttggtgaatatatttatgcaacacaggaacttggaatcactgccatacatgtgaaactccgtgccactggtggtaacaagaccaagacccctggacctggtgctcagtctgctctaagagcccttgcccgttctggcatgaaaattggtcgcattggtaaaacagcagcaatcttcaactgtaattgtttaattgcatctttgattgaataaatctctgacattgttcttgttttcctcagaggatgtgactccaatcccaaccgacagtacccgcagaaagggtggaagaagaggaaggaggctctgagttatttggcctctcgttggatctccttatgtagctttctcaatgtttcattttgttttttcttagtttgaaaagagttttggaattactatgctttgttatagtctcaactctgaacagctttggatctttttctgtatgaccataagatattcaaaaattggtagtcattttatctcacaaaaaaaccttgaatttgtgctgtatgattttgtaaagtcttaggtgccaaatctttgattggagttgataaaatatttttatttggttgtaattttgtaatatcccgggatatttcacaaattgaacatagactacagaattttagaaaacaaactttctctctcttatctcacctttatcttttagagagaaaaagttcgatttccggttgaccggaatgtatctttgttttttttgttttgtaacatatttcgttttccgatttagatcggatctccttttccgttttgtcggaccttcttccggtttatccggatctaataatatccatcttagacttagctaagtttggatctgttttttggttagctcttgtcaatcgcctcatcatcagcaagaaggtgaaatttttgacaaataaatcttagaatcatgtagtgtctttggaccttgggaatgatagaaacgatttgttatagctactctatgtatcagaccctgaccaagatccaacaatctcataggttttgtgcatatgaaaccttcgactaacgagaagtggtcttttaatgagagagatatctaaaatgttatcttaaaagcccactcaaatctcaaggcataaggtagaaatgcaaatttggaaagtgggctgggccttttgtggtaaaggcctgtaacctagcccaatattagcaaaaccctagacgcgtacattgacatatataaacccgcctcctccttgtttagggtttctacgtgagagaagacgaaacacaaaagatg

SEQ ID NO: 3648 - DNA, 3000 bp, Unknown
  misc_feature (1)..( 3000): cDNA_ID_1821375_gDNA_ID_1620654_Annot_ID_47807 3000 nt of promoter + ATG
ttatatggcgtattttatcaattagactttgtttgtttgattcatttattagttaatactactcaatgttttatctattaaattgtttgtcacagtaagactattattcaactgatttcttgaatgaaaatatgtctaaaataactttagtgacaccaatacatatttttctcataaatgtttttactattctctctgtttcattataaattttgttttataattttacacgtattaaaacctattaattttttaattgtataatttattaaattttcaatgttaaatcaataaactacaataatacaaatatagaactacatggtgtgatttatagtcattttagaaatagtgtctagaaagtatggttcattcaagaaaatggtctaataatagtttatagtatgaaaaaacaattttgaatatagttaaagatagaaataatggctagcactaactaaaaatgaatcaaataaaaagaattcatctacaatttacttttcgttattaaaaattaaataataatagtacgtttatacagtgaagcatccgtttcaaagtttccaacgacggtttcatgcgccagctaaaaacttctttttgattgataatcaaatggacattctgaaggtacccacaaaactcaactactttgagttactttccaaattttgaatataaatcaatgtttttggtggtgacaaattttgacaatataaaagaatgaaagatgtagatagatgtatgtaagtagtgcttgctggtagttaaattggatattcaaaggtgaaaaccattaagatgtttctaactaccagattcactagtcattgtaaaaattatcacaaaatgtttagcaataatttagaagaataaaaggatatccattaatgtttttaaaaaaaacatttcctttgattaatctaatgatggtagttaaattacttgactttaatttcctgtctttttattttaaaacaggaaattatttggacgaaaggttatggtacaataaactttattactgtacttttaatgtttcacatatttgcataactttcatttttctaaattgttacgatcaagatagccattgattttcatttgaacaatggaaagtaactggatatgagtatgatttattgattagtactctcaaaatgtttattatgatcaattaaacagacgtttgtaacttgcgttttaaaccgtcatttgaagtagaattttcataattatataaaatctcctatatatattatttgagaagctagagggataacgtttgaattttagaactttgaatagcaaacgaaagagtaacaaattaaaaaaaatgaaacaaacagttactagaatttaatacaagaggccaataactaaaatacagacctcacgaggacataatatagctgttaataacttaggaatctctcgtgtattaaatgtttcacaattaagaggacaatcaaatttaaaatgatttatagactaaaaaatttaacgacagttatgcaacagggtttcaaaactttaatggcaattatacaacagcctaaactgggatgatttgtgaaagtggcctctttaatttttgaatttgcttcacaagattataagaatataaaaaagctaggaatatgttgttttagcagaaaataaaataattatataacaaaatgtcaaatactaccattgaccttccataaaatctaatacctcagcatcagttatatcccatgtgaagctatttaatggaatttaatggtagcttttagttgatactaccatttgtttacttttcttttgttatcttaatcacattcattacgaatctgaagagtgaaggagataacttctggaatctgtttctctaatatttttcaagtaatcgctactaatcgagttaagttatatactaagaagatcgaatttgattccaagtgagatgaagctacgcttgagcataaaaaccaattaagttgtatatcttgtttaatgcaagccctttctccaaaacttattcatttcaagattggttggtttttgtagtcagaaccgtaaaccgtttctatatgcatgagcttgtatcaatcatgtgaaaggtttcttcttccctttgcacaaatgaataaaagcatcaaaaacctatagattgctttcattgattatggaagaggatcgatgtctataattgtcttgttctggtttgaagttttcttgtagcactgtccaaacactctctttggactttttattcctcattatacggaaaattaaatctaaataaattacataacgataagtgacataccgcattatccgtttttcaattaaagctctcgcttgttcaagatcatctcttcttcatcaacttgattcttcattcaataatttgttttagacttttggaacaataatgtttctttgtttttgctatgacatctacattaacaaatagacatgcaacgtcaactattgaactataataaaatcaatatacatctttagaaatcacaatattaataaaaatttgcagcttgtatcttggtgggctagacttttggatgatttttcagatgatttatatatgcaatgtattcgtatagtttcatggttcaattagtcttttttctcgggtcaatattcgcatagattaataatgtttacgtgggttcatcaattactatcaacttgtatgcatgctaaattacaccattgaaattaaaaatgataaatacaccattttaacaatttaaataatttttaattgtacaattttgaagtctgaatctgaattgtaagtactaaattaaacttaaagagtcatataaacatctgacagtttggccgagtggtctaaggcgccagatttaggctctggtccgaaagggcgtgggttcaaatcccacagctgtcaattccttttttttcttttgttccttcgttttatttacttcgccggagagattcgaagctaccaaagaagaagaatcaatg

SEQ ID NO: 3649 - DNA, 3000 bp, Unknown
  misc_feature (1)..( 3000): cDNA_ID_2993863_gDNA_ID_1620654_Annot_ID_47808 3000 nt of promoter + ATG
aaacatcttaatggttttcacctttgaatatccaatttaactaccagcaagcactacttacatacatctatctacatctttcattcttttatattgtcaaaatttgtcaccaccaaaaacattgatttatattcaaaatttggaaagtaactcaaagtagttgagttttgtgggtaccttcagaatgtccatttgattatcaatcaaaaagaagtttttagctggcgcatgaaaccgtcgttggaaactttgaaacggatgcttcactgtataaacgtactattattatttaatttttaataacgaaaagtaaattgtagatgaattctttttatttgattcatttttagttagtgctagccattatttctatctttaactatattcaaaattgttttttcatactataaactattattagaccattttcttgaatgaaccatactttctagacactatttctaaaatgactataaatcacaccatgtagttctatatttgtattattgtagtttattgatttaacattgaaaatttaataaattatacaattaaaaaattaataggttttaatacgtgtaaaattataaaacaaaatttataatgaaacagagagaatagtaaaaacatttatgagaaaaatatgtattggtgtcactaaagttattttagacatattttcattcaagaaatcagttgaataatagtcttactgtgacaaacaatttaatagataaaacattgagtagtattaactaataaatgaatcaaacaaacaaagtctaattgataaaatacgccatataaataaactataagtttctttaaaatatacattaaatatacaaaacgacaaatttatgaaacaaaaaagtgaagtcataagattaaaactattgtgaaatggatgacaaattcagtttcttctttattctttaaaccctaagtttaaattctttcaaacacaaatcgtagtatttgtaaaactgttattttcttgaaatataatttaacgttacattaacaaatcaaatggatgacatattacttaaaatttagattaccaataaaaaatcataaattcttcttttaaattgtaagatttaagtcttcccctttacatttagcaataaatagtttgctgcactggtttaaatgcactaatgcattgtttactgaattgtcttttgtttcatatatttgtctctactatacttttactaactttcccacctccaattaaaaaaattattacgaaataaacaaagtcatatctctctccacaacataattactttattcaacaaatattaattcctagtcatattttagctcctcttcttccttatatattacatacatacattttctttagaagtcattaccatcaacccatcccctagaaaaacacagagaaaaacaaatacaagaatacaaaaaccctctcgacgaaaccgaagtatcgaaatgagaaacaagaatggtaaaagaggtagcgttgagccctcggcgaggaccgtggcgtcggtggttgctaatgggaggtttgaaggaagatcaccatcgagcgacacatcatcatcacaaaactcgtgcctgacgaggacggaggaagtgaaggaggaggttgcatcgtcgtgggttgatgaagaagaggcgccggagatggtggtgatgggatgtcgaagttgtatgatgtatgttatggtcttacaagaacgtcaacgttgccccaagtgcaaatgcaccgacttgatcttcttttagagaatttgttttaagttattattcaatttggacttttgagtttgagatgatgaatttaattttctttgtaaagtcctctatataaatcatattgtttaaattataatctctattttaatatgttaaattgacagacagatcatttctgtttgtggccgtccctcttggttcattttgttaagttgtccattttcatgttttagtactatggaagccaatgacatgaacgaggatggattttcatcggagttgaattcgattgtttcaaacgctagttatggcgtttgcgtttatatttatttatttgtatactccagagaaacatagtttttcaatgtaaatgaaaaacgccaaaaaaaatagaaagtttatttttaaaaattacaaaatataaatttaaacacaagtaaaaaaatcgacacgtctcgaattagggtcttaagaatcaaattggtagtatgctaataatggtattgctttggtttcatcggcattcaatccgatgaaattttcaataattaaggttaaaagttgtatcttcatcaattaaaacgttatttattcaaaacaattcaccatcaaattcaataaaatttaagaacttttacaaacttcaaatattaaattatttaagaaaatatttttaaacctaaatttagtgaaaaagtagcaactaaaatttgttttaatgtattttatgacatttttctatttataagtactaaattttcaaaaatctaataaataattaatttctgtttttcatatatattaaggcacatgcgacgacatatatacgtgacaacattttatcctaaagttttaacatgatttttgaaaaagaaatttacattttacgataatttagttgcaaatcaagcgagttttaatatttcaataattttcatgtatatagaaattttgcattgctagttaaaataataacaaatagatgttgtcaaaactcgaaaataaaaggggtgtttctgtagttatcataatttaaggaattatatgatagaaaaacaaatttgggcggtaaatttgaaaaaaataactttttccagtctccccaaaagtacccgatttgccaaatttgaccctcccattttagctttctgtctattcaccagattctctctattcgattctccctttacttcttctcgtctctcttctctgctcgtcagatctcaaaatcaatcggatatcgaaaccacaacttcatcaatt

SEQ ID NO: 3650 - DNA, 3000 bp, Unknown
  misc_feature (1)..( 3000): cDNA_ID_1821355_gDNA_ID_1620654_Annot_ID_47815 3000 nt of promoter + ATG
gatgggttgatttcacattctgttcttctcgtaaacgcaagtgctttagaatcatctggggtctgacccttgttaaagcattcacattttgacgactgttctggtcatacactttctcgaaaggactggtttatgcaaatggatgttcttttgttagggcaaacaaagtttgctaatttttattaaaggagaaaagggttttagattgggtgagcctgaagtaaccatctatattcctttgctctcatcattcaaacacttttgcgttcaaatgatttttggtctccctttggatctcttttgggtctaagctaataaacaaagcccctttcctttctttttttctgtctcaaacgtagacagcgaggacgaaacagtttatgagtttgtgtttattctcataactttcttatttggtcccactagtcgtctgtaactaaggcattggtatgtattctgatatgaaaacgagtttaatacctagcattcatgataattaacttataaattcaagataattcggtgtccttttatacaccatatatacatacatatataatcatgtttcttttgaatcataactttggactgatctcacaaaattcatttgctttttcctcaataatgattgtaggatcatttctctttgttttatggtacattatttgtatgtttttccccattttgagttaatacataaatgcatgggtaaatgatactttagcttcttttgtagaagcattgggagagtgagtgagtgaaatagtacctgttgcagagaatagtggctttcaggtgaaggcttacataaaaacaagtaaaaagctgaaaaaagatgattggggaatgaaaggaagatttcttgtttcttgtgagaggatattgtaatttttattctctattcttcaaattcaccataagaaaagataacttctttacaaattttatttgtcttttaggacatacatatctctatagtgggaatctatagcttaatatgattctcttatcaaagtgtataaatcttattgaagattcctaggcaagttgaatggtggtgtatttttctcttctttctatgcagtggcatgcttcatgtgagagagagagatatgttttcatcaaagtagaagtataataggtaaagctccttgtaccaattactgcaatgatctcatgtttgaataatccatacgcggaatcatttctttttgttcattgattataatagcatattccttaatcactattcagattatggttttgtgtgtttttgtcaatggattcttcaaagatttaagtggcatctgcatctgtttagctttgtgtgtgtatatatatctactatctagtgttatcaggttaatatatataaacatggcttgatatgtttgttagtggtacgagaatcaaacttttcttatctcttacttatgttgcaattataaaataatccatatgcagttctgcttctatgataaaattaatacacagttctgtttcttgttcttgaattacttatttgcttttgttttggtttgtggtttcctgtcacttatctgaaactctgatttcattaggcacttgaaaatgattggtcgtgttgatagcaaatacaatcaaagactgtccccaccaagaaactgactgccttgttcgctttcttttattttttttcttgttcaaaacacattcgtttcttcttcttcttctctcgttttaaaattgaaattaatatatggtccaaaagctacacacttttatgaaagtatcaaagggaaagtgaatgatgcatatatatagtgtctgtgttgggtcagatggtttgatttgctttttagtgttttgatattttagggggttgagtttctaaataccatgcagaaattcaaaaacatacaaagaccaagctagtgatccttatatattctgtgtttcctgccccaaagagtttggttggcaaaaatgattatgaaactaattttaaggtcttattatcaatatcattactagttgtctgaggaaaactagtcgtcaacatttttgatttttgatgatcgatggaacctaattttgtatagagaatgggtcatacatttaatcataatcaaatacatgttaacacttatattaaactgttttcttgatcaaaaccaacaatattcttaggtttgctgagacatagtttggctataaatatacaccctttttccttccaaaatctgttcactcccatgtttttatggctactagattgttgcttacatgtggacttgagtttaagcttacttgactggatctagagtaaaagtctgttgtctgaaaaaagtgttgggagttggctagtagtatagcttcaaggtgctacaaagggagagtgattaaatccccaattttccataaaatgttcttggggctattatttatttatatattatataagtgaatgatgatttgcatctttaattaggttcttttctaaataagtgatacactttgcagaaaagagagagacccacttagctgcagtacccattacatcttaatttttgtgaaatttgagaaagaaaagaatatatgggcaaagctgagttacctttgccttttgatactgctttgtcatcacatgcattccactttgcactacaaaatccactttggaccctcaaaaaaccccccaaattttttgcctctctcacaagaaaagcatacacattttcctccttctccttcctcatatatttgaagaccaaagtccatttttctttctctctctctttctctctcgctctctctatatccttactcttttcttaggtttaagacttagccccaccttccatatagacgccgtgttattagacccttcttctttgggtgtttttgttgtccaagataaatggaatgaagccaagattcttgaagcttttaccatagagctctcacttctgagtattagtactatccccaccttgtgttattttagggtgttttgtcact

SEQ ID NO: 3651 - DNA, 3000 bp, Unknown; identical to SEQ ID NO: 3638
  misc_feature (1)..( 3000): cDNA_ID_1821346_gDNA_ID_1620654_Annot_ID_47821 3000 nt of promoter + ATG

SEQ ID NO: 3652 - DNA, 3000 bp, Unknown; identical to SEQ ID NO: 3637
  misc_feature (1)..( 3000): cDNA_ID_2992655_gDNA_ID_1620654_Annot_ID_47824 3000 nt of promoter + ATG

SEQ ID NO: 3653 - DNA, 3000 bp, Unknown; identical to SEQ ID NO: 3645
  misc_feature (1)..( 3000): cDNA_ID_1030715_gDNA_ID_1620654_Annot_ID_47826 3000 nt of promoter + ATG

SEQ ID NO: 3654 - DNA, 3000 bp, Unknown
  misc_feature (1)..( 3000): cDNA_ID_3043246_gDNA_ID_1620655_Annot_ID_47830 3000 nt of promoter + ATG
aaaccacagtttcttgtttttgttatcaatgtctagttatatgcaccctcttctagggcaagaactgcatctacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggttttatttatttattttttgtttctcttaaaacttggtgtgtgaaaaaagaaaacgaacgcttaaatttcctttttctgtttgtttttatgaatagaattggtaagtttcataaaaaaaaaatagtattaatttgtgatttaatatctaaacttacagaaaaatgtcaaatcgaccatattaatcgtgaaaaatgttattattagggaaaaatgttatttaatacctaaacttacaaaaaatggccaaattaaccgtgaactcgtgaaatggccgttttatctctcaacaaaaagttgacttctattttaacttttaagtttgcgttgactcgggctaataaaccaccgttaaaaattcttctaacagcgtaattaacagccgttacagaacatccgttaaggtgatacgatgacgttttgtgctaaagagaaatcaaaatcgagaatagaaattcccaaaacaaaatcaattaccctaaacccaaatcgaaacctaatcctgcccccaaaatcaaaatcgaaaccctaattgcttcaattcgttttctgaaatgccattagttagaaagaatggcgtcgttatgaggattggatctccaatgcttcacgaatcagagaatttggtgggagatggagtcgaagcaccaccgcgaggagaaagagatgaaattggagaagaagttgggggtgaaacgaatgtggtatctgagtcttgtggcggagaagagggagcacaagatgcagctaaaacaacgccggaaggagaagcagatcgaatttgagagagaatgatttttaggatttgggttttgatttggagatttttcagaggtttcgtcgactttgaagtctgttgatagcacaaaacgtcatcgtatcaccttaacggatgttctgtaacggctgttaattacgctgttagaaggatttttaacggtggtttattaaaccgagtcaacgcaaacttaaaggttaaaatagaagtcaactttttgttgagagataaaacggccatttcacgaattcacggttaatttggccattttttgtaagttcaggtattaaataacatttcccccctaattattaggtgagtaatacggagaaaatggactttaattatattcgtaaattgatgttcacacattaaggctctaactaaatcttccgattattgtcatataaacatgttctaatttgtgataaaactgaacttccactgtctcgcagagaagggaaagaatattttgggagaacaactaaaaccctaatatctatgatgatgtcaacttcaaaacacattgaaacttgagaaaaacaaaaatcaaagaaaataaaaataaagcctgcatgcaagagaatatgccttccctccaaggttaaataaaaacaagcttatgtgagagattaagtatgttcataacttcacaattgtgtccattagtcgctgctcacgttagtcaggagttatttctgttgggtcttatcaaaactgttgtttatgtctattttgattatggacttacctttacatttgcattttatattttcattcttagttataaaaaaattgcttatacttttctgttgtttgacccagcaccaagtataagaacaattaaaaaatttgatacctaagaaactaattctataagattaattgaagaattattttcattcaaaatcttttgacataattgctacgtttaatgtgtaatgccctggtctattcgataagattaagaagataattgcaataatggaacaaaattagctgagaatgcaatccgtttgcatggatccgacccggaatgcaatccgtttttaattatgtaaatgacaattatacccctggcactcgacatgtttgacagtttgagcaaagagaatttttttcttgttgaggatcatcgattatcagtttctggatttcgctactacagatttgtcccgtcttgagttacgaaatcatg

SEQ ID NO: 3655 - DNA, 3000 bp, Unknown
  misc_feature (1)..( 3000): cDNA_ID_2049893_gDNA_ID_1620655_Annot_ID_163639 3000 nt of promoter + ATG
aatcttttcagattcaacccaaaattgaagacaaaaatgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaataaggtttgtttgaaaggtgggcttaagactcctgttggtggtggtgttagttctcttaacgtccagcttaggaaagagcttgacctctttgcttctctggtcaactgttttaatttgcctggtttacctactcgccatgagaatgttgacatcgttgtcatcagagagaacactgaaggtgagtacgcggggcttgagcacgaggttgttcctggtgtcgttgagagtctgaaggtgagaattccgatttctgctcctcgttttggattcaatctgtatttgtggaatcatcttcgtttgcaagtggtctttgtatgttatgtgtgattgttctgatcctatttctatgcttaggtgatcacgaagttctgttcggagcgtattgcaaagtatgcttttgagtatgcctacctgaacaacaggaagaaagttacagcggtgcataaggctaacatcatgaaacttgcggatggtttgttcttggaatcttgtcgcgaggttgcgaaaaagtatcccagcatcacctacaatgaaatcattgttgataactgctgtatgcaacttgtagccaaaccagagcaattcgatgtcatggtatgtttcagagttatatacatatgaattttcatgacgttctttaagtcttcgatgttttactttgagaaaaagataccagtcatctctccctagtttggtatccctctagattgcctgttttagagtcatattatcttattggtatgagactgatgttgtgttgccatatactatagttaatcgccccatttgcatactatttaatctcgtcatttgcatatcatgctttcagggaatcttttaaattgtacttctgtgaccttgtctatgtatacttactactttgcatacactattgttcgttagagcagtaacttcactgttgctaagtattaacctttcattactgtatgtagtagcgtcttttggcttttccccccttttataacagcaatttatgaaatgttttgcaggtaacgccgaatctctatgggaatttagttgcaaacactgctgctggtattgctggaggcacaggagtcatgcctggaggtaaaaaaacatcctgtattgatattctctcgagctatacattagtggataaagaatagttctaaaatttatacatctgcgacattaaatacaaaaacaggaaatgttggggctgaccatgcggtattcgagcaaggtgcatcagcaggaaatgttgggaaagacaagatagtattggaaaacaaagcaaacccagtggcattgcttctctcatcagcgatgatgcttagacaccttcagtttccttcatttgctgaccggctcgaaacagcagtgaagaaagtcatcgctgaaggaaagtgccggacgaaagatcttggtggaacaagcacgactcaagaggtcgttgatgcggtcattgcaaaactagactgactttgacaaattacgtgttcccgctctgcataaatcatcaaattcctgatacagattttgtgttgccaaaatatggggtatgatccaagcacaacggttatctggttttgtacctcgagttttattatattctttagccgtggaatatttcgataagaaaaaaaaacatgttccaaataattcatgttgctacgtttgttggcgccttttgtcatgtcaaagtttcttaaacacttgttcgtggaatatgcaaacttttatggattcgtaatttcaagaatatgaatgaaaaattgatggtatctttgatcacctcgaatggtggtttcttaagagcatccacattggttaatttttgatggatgtttttaaatataaaactttattttaagaggtttttgagtagttaagaaactctaacgtgtcattgtgtgtgtggttgaacattgtgacaacatcatttatttatttttcttttcgcgtttttctctcttttttagtccatatgatttttaatatatatatcatatttgtttaaaattttaatatttgtattatttattaagttttataaaataaaatataaataatttttattttaataataatatatttttttaaaagacccacttaaacattagaccaaaaaaaattaatggtccaacaaaaacactttaattttttataatttaaaattttaaaaaacccttttaagggctcaaccattggggttgctcttactccaagtctttaatttaatttgtgaattaacattgactaattttaaaatcacttgaaattgtttcatcggatttgggatgtcacatttggtacccggcaagttcgaaaatgacttttaaactttgacacctcttgcctcttggtagagttttggatgaggcttgaaacttttgtattgcagcccataactgaaaatagtttattagtataatatatcttctcaacaaacattgcaaatattttgaaaatccagctaaaactatacccgatcagaattagaaaatttgagcccaagcccggcccgtaagtattattatagaaaccgatataaagtttcctttttcttaataatatttattccgtggcagcaaatgcaagccaatccaatgtcaaaacaccagctgacgtggccaaacgcacatcaactgtcgtctctctatctctctctccctcacttgtctctctctcttctcttcgacactg

SEQ ID NO: 3656 - DNA, 3000 bp, Unknown
  misc_feature (1)..( 3000): cDNA_ID_3071577_gDNA_ID_1620655_Annot_ID_163638 3000 nt of promoter + ATG
tttctttccaaaagcttgccttgacaccgaagcacaacaagatatgctcaagtctctgtctgcgacccttcagcaggatttcaggagcttaaatcttttcattgataaagagcttgagctagaagttgtatttcccgttagagaggaagttgtttttgcagagaacccacttatcaacgcaggaaccggagaggatatgaaaccattgcctttggaagaaatttctcaggaagattcttcatggatctcacacatgataaaggcaaatgagaaaggtaaaggcgtgtcactttcttgggagtaccaaaaagaagagccaaaagaagagtttatgcttacatctggatgggataacaatcagattggatcaggccacaataactttctttcagaagctgagcagtttcaaaaggtgacaaattcaggactcagaatcgacatggatccaagttttgaatcagcttcctttggtgttgggcagacattactaggcagtagaagaccaggtgagaagagaagaacaaaaacagaaaagacaattggtttagaagttcttcgacaatactttgcaggaagcctcaaagatgcagccaagagcattggtggtaagaaagaaaacttatagttattatgtctatcttatcaatctctcagaaagtgatgattcattcacgcagtttcattttcatgttgcagtttgtccaactaccttgaaaagaatatgcagacaacacgggataacacgatggccttcccggaagatcaagaaagtggggcattcattaaagaaactccaacttgttatagactctgttcaaggtgttcaaggttctattcaacttgattcattctatacaagtttcccagaattaagctccccacatatgtctggtactggcacttccttcaagaatccaaatgctcaaacggagaacggtgtttcagcacagggaactgctgcagctccaaagtcaccaccatcatcttcttgtagccacagctctggttcaagcacctgttgttcaactggagctaatcaaagtaccaatactgggactacctcaaatactgtaaccactctgatggctgaaaatgctagcgcgatcttgaagagagctcgtagcgaagtgagacttcataccatgaatcaggatgaaacaaagtccctctctagaaccctgagccacaaaacattcagtgagcatcctcttttcgaaaatccacctcggttaccggagaatagtagcaggaagttgaaagctggaggggcctcaaaagtgaaagccacatttggtgaagccaaagtacggtttactttgcttcctacttggggcttcagagagttgcagcatgagattgctaggcgttttaacatagataatattgcaccctttgatcttaagtacctggatgatgacaaggaatgggttcttctgacatgtgaagcggatctcgaggaatgtatcgacatttatagatcatcacagagccgcacgatcaagataagtgttcatgaagcttctcaagtcaagctgggaggttcttttggtagcatcggtcttggtccctcgttataagctatcaggtataaggttgttacctgcaagaaaagaaaagaaaagagcaggagattcgactaatttactagtgtgttagaaaaatattactcaccattttatagcaatgggcatcgtttgtaaacatattttcagtgcccccattttgcaagcagcagtagtggactggtttcctgcatcggcttagcagattttttgtataataaggcgatgcgtaccagagaaacatgcttatatgtatgtattattattgtctgtacatcatttgtcttctggattctactaagctctgcaagtatgttaaattgatatatcttctacatcgtcacttgtatttattttcttacttaactatgcatgaaattcttaagggtgctttttggggcatcaaagcttactgtgtacaaacattacagtcaataaggagttagtattcagaaagaaacaagaaaaaacattatgccagtttgaaagtaagaaaaggctagacgttttacttatataggcaatgatagtcatataaacacagaagctatttttggcagaaaaagtagagaagaaagtgtatacttggatggtgaggacacatgatatttatagagattctcttggtttttaagcaggaatatgtgttcaagagagagaaccacctagtggagtgatcttccaagttcctaaccagagtatctctgttaaatcctcaaatcagtatttgttaaagaaacaagtaagcctgcagacaaaaggttctcgttttggtttgtttttgtttctttctgattcagtgagtgacacaaaggaagatattgatcctgaacctatcattgccacctaaacttcagagacaggagaaaacaacatggaaaacaaaaaacctatgtcaagagaatcagaccaagtgtacctgattgtaccatttggtactaaaaatcaggatgacgaaggagttgattcacgtgactatgcttcgaatctcttaacattgccaatctccgtgtttctaagacttctttcaccaaagccttgatgaaattcgagggtgcaagttatgattttgcaaataatgtagtactctgcatgatcaatgattttgcggcaattttgtaaatatctgaagtgaaaaataagcaaatgtcaaactaaattaattactgagtaaatgttgatgaagttaaatgattggggggatttgtataaatatcttaattgacgattctgaaacaaagtggtctaatcggtgattatctattgttttatggaaatatcttaatgagatgaagattttggggcgaattgtgtaaataactaaattttaacaataaacgcttttcgtccgcctccagctcccaaaagccaaagggcgaatcttcttcttctctttcgatcaaatcttttcagattcaacccaaaattgaagacaaaa

SEQ ID NO: 3657 - DNA, 3000 bp, Unknown
  misc_feature (1)..( 3000): cDNA_ID_3071593_gDNA_ID_1620655_Annot_ID_163628 3000 nt of promoter + ATG
gaaggaatctgacttaaaaggagaaactaaatttaggggagacaaaagagaaaagtcgaacaacaaaggaaagctacaatattttatgtttatttatttcagagattgaagtaagaataaaaatagattttttaagagctttggtttggtcggatagattagattcgttggatgagaatgtgatggtgttttattttacggcggcgattgagcgaagaaaggtcttttattagtgctcaccagctactacttctacacctctctgactctgtctctctccgctgtttcctctcaccttctttcttctgcttttgcattattaaatttaaaccagtttctcttttgtttatcgtttaaattgtaattgaaaaaaaaaactaaaattagaatgttggtttgtacaaaatcaaaatgcatttctggttttactagttaccgttaattgtaaaaaaatttaagtattaagcacgatggttttattctcgtcgtatgagaagactaatttaaatacatgtgatctacttgtaaaagaagcaaccgttcattcaatctcctatcagaaagaatagtaatctcttgagattttttcttaagataaagatatgccaaatatttaaacagtattatggcgtcactgactattatgacgtaagagattgacttttccatatattgcaactttctggagccccgcacataatccctaataagttttacttttgggccttgtttattcactgatccagcccaatgttcaaatacaaaattcagacaccccaaaggccgtattattgtattgttttagactttagaccttacaataaggcctaaaatgataacatattacacatttcaattccagataaaaaaaagaaccgaaaattttaattataaacgctatcaaattgacattttcacaagactgaatcaaatttgacacctccacgtacacaagcaaaattatattttgggttttgtatcaatgtgctggctgattttttttagcaaaactgtcctgtaacatctctccaacttggtttgaattcgttttaacattagtttggtgacaaacataacgttattgaatttttcatttttccgtaataatcattctgatttttttcttttcaaaatgttgttactagatgtttctttcccaagaataatatcttaaatcagtaatcactactaccagtaaacataaatggtacgtttctcctcattctacggaatttttaagaagcaatgatgatgattaattgaggatgtggacaagaatctttatatattcgcattcacatgccataactttcaaagtctatgaaaaaagattctattgcgtgtttatattctgtggtgtgtactgtagttccaaacataacgcttgtactacgttcatttccggaaaatatctaagaaatatggagtcataaatatttattaaccaattagatgtttttcctatgttctaaatacatttatggtaatctttgcggtcaaatatacgaactttaacaacgacgtttaacaatatatcttttgttttatacatatcaagttttgatatacggacgatagatatttattttcagaaaaccagtagttgtcgtagtcacatggtttgtttttcgttgatcaaaatttgttaatgttattcatttagaattagagactgtatatcgaatttggtactcggttctaaaaaaaaaaaaaactcaatatgattttttatacattctttttcttcccttttaatctgtaagaagaatagtaaagtgaagaagaaaaaactattcattatattgtaacatacgaatacgactcacaattaactaaagttaaagtgtctcattgtatttggactttggacattattctccattattgcattgtttctttctttcttgattaattatgtaaagttgaaatgatttgaagatgctttccggatgtaaacaaactaaactttactttaccaataactttgttttcagaaaactcagatatttatctctagtttctcgtataagtcccaatgaatctaagatttcaaaaaccaatcctatatttgtttcatatttacaaaaaaacaccaaatatttttccccaattatgccgacattaaactcatctttttacatacaaaatcccaaattaatatccgtttttacctttacttcatgaaagcgaagatggtaaaaagcagaaacatttcgagatattaatttgattgtataggcccgtgaataaactcgtggacccaaatcgaaaagataacaaaatttaaagatgtacttaattctctgaaaaaattctgtacgcaaacacgagaaagagaagagagacatacacacacaatacacatacgtggtttgagaggacaggagcaaaacggcaggtgtcactaatcccataggcttctctctctgttcactgtccttccgcacaaaaaaaaaaagtattcatttttatattctcacggttacttcgaaatctagctttcgttttctttttttttgatttaaaccaaaagggtaaacaatgctttatgattgcttagtgacgccattgaagcagcggctcactgatagtggcttcttctgcctccaattccaagttgctaaccctagttttcatctctctctctgtatatcatattctctcgtactttcttactttctcttctacttggtagagataaaaagtagtcaaattttattcaaagttttgattttgacatctgaggtttcacctctgttttttttttctagaactcctttgggtatgtgtcttttacgtcactaaagggtttgttatagtcttaggtcatgctttttggtgttatctctctctgttttatcttttagctcaccaagtgattgtgtctgattttcgaattttcaggtggattttgtttcactcactcatcgtcgttgatcagtgactctgtttttgcgaaattctcttcagatttcttgataaaagatagaagacggaatt

SEQ ID NO: 3658 - DNA, 3000 bp, Unknown
  misc_feature (1)..( 3000): cDNA_ID_1821411_gDNA_ID_1620655_Annot_ID_163626 3000 nt of promoter + ATG
aaactagggttagcaacttggaattggaggcagaagaagccactatcagtgagccgctgcttcaatggcgtcactaagcaatcataaagcattgtttacccttttggtttaaatcaaaaaaaaagaaaacgaaagctagatttcgaagtaaccgtgagaatataaaaatgaatactttttttttttgtgcggaaggacagtgaacagagagagaagcctatgggattagtgacacctgccgttttgctcctgtcctctcaaaccacgtatgtgtattgtgtgtgtatgtctctcttctctttctcgtgtttgcgtacagaattttttcagagaattaagtacatctttaaattttgttatcttttcgatttgggtccacgagtttattcacgggcctatacaatcaaattaatatctcgaaatgtttctgctttttaccatcttcgctttcatgaagtaaaggtaaaaacggatattaatttgggattttgtatgtaaaaagatgagtttaatgtcggcataattggggaaaaatatttggtgtttttttgtaaatatgaaacaaatataggattggtttttgaaatcttagattcattgggacttatacgagaaactagagataaatatctgagttttctgaaaacaaagttattggtaaagtaaagtttagtttgtttacatccggaaagcatcttcaaatcatttcaactttacataattaatcaagaaagaaagaaacaatgcaataatggagaataatgtccaaagtccaaatacaatgagacactttaactttagttaattgtgagtcgtattcgtatgttacaatataatgaatagttttttcttcttcactttactattcttcttacagattaaaagggaagaaaaagaatgtataaaaaatcatattgagttttttttttttttagaaccgagtaccaaattcgatatacagtctctaattctaaatgaataacattaacaaattttgatcaacgaaaaacaaaccatgtgactacgacaactactggttttctgaaaataaatatctatcgtccgtatatcaaaacttgatatgtataaaacaaaagatatattgttaaacgtcgttgttaaagttcgtatatttgaccgcaaagattaccataaatgtatttagaacataggaaaaacatctaattggttaataaatatttatgactccatatttcttagatattttccggaaatgaacgtagtacaagcgttatgtttggaactacagtacacaccacagaatataaacacgcaatagaatcttttttcatagactttgaaagttatggcatgtgaatgcgaatatataaagattcttgtccacatcctcaattaatcatcatcattgcttcttaaaaattccgtagaatgaggagaaacgtaccatttatgtttactggtagtagtgattactgatttaagatattattcttgggaaagaaacatctagtaacaacattttgaaaagaaaaaaatcagaatgattattacggaaaaatgaaaaattcaataacgttatgtttgtcaccaaactaatgttaaaacgaattcaaaccaagttggagagatgttacaggacagttttgctaaaaaaaatcagccagcacattgatacaaaacccaaaatataattttgcttgtgtacgtggaggtgtcaaatttgattcagtcttgtgaaaatgtcaatttgatagcgtttataattaaaattttcggttcttttttttatctggaattgaaatgtgtaatatgttatcattttaggccttattgtaaggtctaaagtctaaaacaatacaataatacggcctttggggtgtctgaattttgtatttgaacattgggctggatcagtgaataaacaaggcccaaaagtaaaacttattagggattatgtgcggggctccagaaagttgcaatatatggaaaagtcaatctcttacgtcataatagtcagtgacgccataatactgtttaaatatttggcatatctttatcttaagaaaaaatctcaagagattactattctttctgataggagattgaatgaacggttgcttcttttacaagtagatcacatgtatttaaattagtcttctcatacgacgagaataaaaccatcgtgcttaatacttaaatttttttacaattaacggtaactagtaaaaccagaaatgcattttgattttgtacaaaccaacattctaattttagttttttttttcaattacaatttaaacgataaacaaaagagaaactggtttaaatttaataatgcaaaagcagaagaaagaaggtgagaggaaacagcggagagagacagagtcagagaggtgtagaagtagtagctggtgagcactaataaaagacctttcttcgctcaatcgccgccgtaaaataaaacaccatcacattctcatccaacgaatctaatctatccgaccaaaccaaagctcttaaaaaatctatttttattcttacttcaatctctgaaataaataaacataaaatattgtagctttcctttgttgttcgacttttctcttttgtctcccctaaatttagtttctccttttaagtcagattccttcctaatcccattctttcagtcttctctttcgcccttctgagttcaacaactggtaactagatcctctttttgctttacttcattctctgttttgttattcctttaaaagatccatcgaaacttcttagctctttgtcttttttttggttattttgactctttgatctgatgtgggttttgcgtctttctttacttgtggtattgttaaagttcgttactttgttctcgtttagcttcttgtatttggtctaatttaagtcttttgacttttgacagtgttatctctatgaacagttcctttgatgaagaacacaaagtgaaagttgctgtctttataaccaggatttggtaattcccattgtttcatg

SEQ ID NO: 3659 - DNA, 3000 bp, Unknown
  misc_feature (1)..( 3000): cDNA_ID_2025381_gDNA_ID_1620655_Annot_ID_163625 3000 nt of promoter + ATG
ctgatgtcgaataaacctacataccgattgataaagttaaaccctgtgtcaaaaagtgacaggggaatgaatgtgcatttttttgcaaatacactaccttcacgatattgtctgcatatttcatcaccatcgacacagcaatgccacttcaaaacaaacaataaaagagtgttttggtgttagcttcactaacttacatcagagttaagaaaaaagtctggcctcttaagcagcttttacctgagagcatggttaagaatcatgagtaatgtgatgaaggagtaaccatggaagaatcccctgaaaatggaaaaccatcccattcaataccagaacagaagagtcataacagcataatacgcagttagtataatataatggaactataggacaccgaggatatagaggtgtagtactagtatgttctggcattttatagcaagtatgaaagaggatggtttttggatttacttatttgcaacggcatcaaaatcttggatcactatagcaacagcattgaaagccatcccaaagacatatagccagaagttctgtacatttatattccttgaaggtcgctttttaataatggcctgccaaaatggaaagcaaaacctttataagctttatatatcataagttaatttatcaatggaaggaaccaattatactgtattagtgttgacacacacacagagaaaagaaaccaaatcagctttgagtatttacagtatacagtcctaatatcccacctctgtgtacactccggcgaaaccacttaaaagagccatgacctagaaacaacgagtgattatattaattgatgtggacatgaaagctgcttcacaactcttagttgatattagcttgcaaagggggctaacagcttacaattgccatagtccagccaggaagagatgtctgaagaacacgatcagaactgcaaaagcaatttcaaatatgagacatatattggaaaaatcagcagagacctgaaagttcacagagcaggaaccggatatgagcttttgtgtgttacgcatcatatgcaagaatcgttaaagctcaatttaatagaattcatatgaaaatcaagggtaaagttttactttgaattcaactgagcagtggtgcatccgcaacacaatagaatgaaacccgcccactgaatctcgctcaatctgttagagaagatagtaagcaaagcagttcacacttgcaagaattgaaggaaactgaaacagctcactgatggatttccagaacaactattcattggaagctgttaaatccatttggatgattaaaaaaacctactttctcttcagtataattctgtacaagacaccggtacttatgatgttcaagttcttcaatatctgatagcctggggcgtctacatatgcaaaaatataatactgccacgtaaaaggtgacacaacaagtagttagagacatattaacatgaaaaacataagttaagaaaaatcgaccaaagccacagaaaaaaataacaaactcaggacaccccacctgtaacaaattcttaaaaagatacaatgctgcgggaattggaaagactttaacttcatcaaatgttgtgcttaacctgttatagagacaggatttgggtatcagtaacgaaaaattcagtgagctatctacggtcatgttcaaagaggaattagatataaaactcatggaaatttctctaaaactgataacaacagattgagtaacaaaataattcgctacctgttgtcgtcagtaacaccttcatttttccatatccttgtcaaagcaagaagagataacgcacatttcagagttcaacctgatgtccaccaaagagtaaacaaaatcactatatcatcatgattcagagattaaaaaccacacaaaactggcctcgcttgcaacacatacagtacactcaatttaatgcatctatgaaactcaccaaaaagttggcggttgtaacactatactcatacttcccagctcgtttcgaccacacgataagtatcgcttgagaactcgtcagaatcgtcagtgcacatgttactacacccctaattcaacacaagctatttaaagaacttgaattttccaaaaaaaaaatgaacaaaggaaaaaaacttactttcgtttccagttgatccgttcactggatccaacacccagagtagccattgcaatgttactcgaagcaactgtcaaatcaaagcaccaatgagcacattaaagaacacgagaagtggaatttgagaaaagaatatctcaccggtatgagattttcctttcacactctcgatatcagaagcaacgtcatgatcgtcctgaagaagctcggaacaaaattgagcattaaagagagtccaaatcttaaattaaaagcagcagaaagacaaagtgaaatggaagtaacgaacctcatctttgattttccggtactccattgtttcaagctctcagatctctgtgatctcttctccgaacatacacactcgatagctattaaaaaaagaaagaataaagtgcttaatttcgattttgggcttgaaatttattgggccttagtctaatacctgattaggcccgtctgggatatcttttttcttttttggatttttgtatgtgattgttcttttttctgtcaacataaatttgcttggctatggacattggacagattctgctacatttttctgatttttattataaaaaaatcaaagccaatgcaatttcaacagatttctgtactgggaaaataacctttaaaataaaattacaaagaatttttttaattaaatttgtattgtgacttgtgatggaaccctacctgaaaacaatgtttatctatattcactaaaaataaaattgttatatttccaatattataggtgcattcattcatacacaaaacaactaactatacaaatcaacaaataaacataacaatacaaattatttaatacaaaaacaaacagcaacaacaaa

SEQ ID NO: 3660 - DNA, 3000 bp, Unknown
  misc_feature (1)..( 3000): cDNA_ID_1807806_gDNA_ID_1620655_Annot_ID_163623 3000 nt of promoter + ATG
ttgcttcgagtaacattgcaatggctactctgggtgttggatccagtgaacggatcaactggaaacgaaagtaagtttttttcctttgttcattttttttttggaaaattcaagttctttaaatagcttgtgttgaattaggggtgtagtaacatgtgcactgacgattctgacgagttctcaagcgatacttatcgtgtggtcgaaacgagctgggaagtatgagtatagtgttacaaccgccaactttttggtgagtttcatagatgcattaaattgagtgtactgtatgtgttgcaagcgaggccagttttgtgtggtttttaatctctgaatcatgatgatatagtgattttgtttactctttggtggacatcaggttgaactctgaaatgtgcgttatctcttcttgctttgacaaggatatggaaaaatgaaggtgttactgacgacaacaggtagcgaattattttgttactcaatctgttgttatcagttttagagaaatttccatgagttttatatctaattcctctttgaacatgaccgtagatagctcactgaatttttcgttactgatacccaaatcctgtctctataacaggttaagcacaacatttgatgaagttaaagtctttccaattcccgcagcattgtatctttttaagaatttgttacaggtggggtgtcctgagtttgttatttttttctgtggctttggtcgatttttcttaacttatgtttttcatgttaatatgtctctaactacttgttgtgtcaccttttacgtggcagtattatatttttgcatatgtagacgccccaggctatcagatattgaagaacttgaacatcataagtaccggtgtcttgtacagaattatactgaagagaaagtaggtttttttaatcatccaaatggatttaacagcttccaatgaatagttgttctggaaatccatcagtgagctgtttcagtttccttcaattcttgcaagtgtgaactgctttgcttactatcttctctaacagattgagcgagattcagtgggcgggtttcattctattgtgttgcggatgcaccactgctcagttgaattcaaagtaaaactttacccttgattttcatatgaattctattaaattgagctttaacgattcttgcatatgatgcgtaacacacaaaagctcatatccggttcctgctctgtgaactttcaggtctctgctgatttttccaatatatgtctcatatttgaaattgcttttgcagttctgatcgtgttcttcagacatctcttcctggctggactatggcaattgtaagctgttagccccctttgcaagctaatatcaactaagagttgtgaagcagctttcatgtccacatcaattaatataatcactcgttgtttctaggtcatggctcttttaagtggtttcgccggagtgtacacagaggtgggatattaggactgtatactgtaaatactcaaagctgatttggtttcttttctctgtgtgtgtgtcaacactaatacagtataattggttccttccattgataaattaacttatgatatataaagcttataaaggttttgctttccattttggcaggccattattaaaaagcgaccttcaaggaatataaatgtacagaacttctggctatatgtctttgggatggctttcaatgctgttgctatagtgatccaagattttgatgccgttgcaaataagtaaatccaaaaaccatcctctttcatacttgctataaaatgccagaacatactagtactacacctctatatcctcggtgtcctatagttccattatattatactaactgcgtattatgctgttatgactcttctgttctggtattgaatgggatggttttccattttcaggggattcttccatggttactccttcatcacattactcatgattcttaaccatgctctcaggtaaaagctgcttaagaggccagacttttttcttaactctgatgtaagttagtgaagctaacaccaaaacactcttttattgtttgttttgaagtggcattgctgtgtcgatggtgatgaaatatgcagacaatatcgtgaaggtagtgtatttgcaaaaaaatgcacattcattcccctgtcactttttgacacagggtttaactttatcaatcggtatgtaggtttattcgacatcagtggcgatgcttctcaccgcagttgtctctgtattcctcttcaattttcatctttccttagccttcttcttgggttcaacgtaagttaaccacatttgcttttgctaatacaatcatctcaacttttgatatcaaaagtagccaccaacatttatgcacataagagccactgactgcgtaaaaggtgtctcataaaatgcattactgtgtttgcactttgcagggtcgtctctgtttcagtatatttacattccgcagggaagctacgatagtaaagatcttcacacttacatctaccaagaaaacaccattattctagtacagagataaagcttttgaacgattacgattttgtttttcgtgtaggtatattcacatttgtgcttctgtattgatttttttttccgtctcatgaaaccttctattctcatttgtacgataccaaaacttatcaagaatagttacaatttcagaaattttaagcctctacgtaattttttttataaaacacccctccggatattttaataatcattaactgtctgaacgtgaagctgtatgttgaaaattgcacgcttagaacaaaaggcttaaccaaaaatgatccaaccgtgaagactcggagaccggcgtacttagtttttaaattaatcattgtctttgcttcaaagccaatcctatgagactttgtcttgtctccaacttgtatataagctctattcctctactctgtttcacaccatctcttcttcttcttcctcttctctcagtgaacaaatttggctatg

SEQ ID NO: 3661 - DNA, 3000 bp, Unknown
  misc_feature (1)..( 3000): cDNA_ID_2049939_gDNA_ID_1620655_Annot_ID_163620 3000 nt of promoter + ATG
aatcgttaacttttcttcttccatcttaggtgagtctcaaagatggaactgtgaagggctttgatacacgtgcttctgatttatcaccaagtttcattatccatgctcatgatagtgaagtctcctccatatcatacaacatacatgcccccaatgtacacacatatatctctctttctctcttgtctcctaccatattcatagtgtagtcgtttaatatccgagctgtgcagcttttggctacgggatctgcggatgaaagtgtgaaactttgggatctttcaaacaaccaaccatcatggattgctacaaacaagccaaatgctgtaagagccatgaataagaacttttgctgccatatgtttgtttctggtttctttgtttaccattccaaactttgatatatcaaacagggagaagttttctcggtctcattctcagcggactgccccttcttactcgctgttggtggctcagaggggctaaatgtaagtagggattttgatggtacaagaaataacaaattctgtttttgagataaccaacgtatatgtatacgcatgcttgtgcaggtgtgggataccttatcagacactgctgtgtcccgaagatatggtagcagccgaccatgaaccacatgggaagatactttgtttcttgaagctgacgcccacttttttatataattaagaacttgtttatgtcgacttccttcagatcctcgactcccatttgaaatgatccgtgttttttttatatctaaacgttgttgattgttgcatacaataatctcaaacatattttcattcaaaaaaataaagtttcaaaaatattttcttatttatgtctcagtatctgtctagttttgctaatttctctagttaattctattgttttaataataaaacaaaacaaacccaaagccagtttattattcaatcgggttttgtttggtacattgctaatttcaaggcccgttctgatcaaaggtttggatgttggataaacattttttcagagagagccaaaccaatcgaagcgacaaaccctaattcccaattttctgagcaaaagacaccgtcagcaagagatgatgcgtgcttccgtgtatgccaaggtacgcgaatatgaacagaacctgcagctgaattctctttgtttgatccgctggtttcattgattatatatgattccaaatgcatttcagtattgtgtatccctgatctcgcaatttttcaaccagagtaggggtaagcaagaataatgtgtatttttttttctcttggatatgaatacaaatttcatggaaccctaagatataagaggttcaaatttggattgagagaatcagaacaaagtttaagattaagcgaaaggagtttggagaagacttataaaaggctagtggaaaaggaacaacaactttgtgaccggctaaatcaggtaattaataagcataaccaataacgggcatttttagtttggatatgatcataccaattttatttgatcaaaacaaatttagagatcgaagaaagtaaaacaacgtttgaaagaaaccgagttgagtttggatgagatttctgcaaagcttgaggaaagacatcgacgactctttgataggcttgaggtaactaagaacgagttttttttgtgtctttcttttataaacactaattatattgaccctatgttatgtttggtagaaatcagtacaaaaattggaactaagtgaaacgaatttggaagagtgcttgaaaagctacgactatgccattacaaagttgaggaagtgtggatgaaggaatcgatgaggaagagtagtactgagagaatcatgaatcaaaacctttggaataataattaattagtaaaatgtttctagaagtcttgttacggttttaggttcctttgatcctattaggactaggtcttatttggatgattgatacaaggtaaaacgttacatcttccttccatcaccatttggtttatccaagcaaattcaattgcttcctttgaaaatgtcaatttatgtataaacccactactgcaaaatgaatgcaaccaatcaaatataattatattaatgtatgcatataatatatacttttgtagaaatgacgatatattcctatttcttagacagcatattgcgatgtccttacggtcgagaatattgcaagacaatcaatgtatatcatcaaaatgtcgtcgtgtttggcgtttggacaccagtatagttggattaaacccacaataatctatggcctagaaaccaaaataatcatttgacttgttacacttgtacttatacaagtcggattaattttagtcgtagtgaattgattgataagtcatacccaaattttggaatcatcttttttctctctctttggtcgtctatctatagtttcttaatccctaaatcaacatttcataaactatcttttattttacccatatacgatactaaatgttcgaagaataaccaatgcattaatatgactaatgactacattatcgtgggaattgaagaaaatcatagtcattacttactttactttactactgttacgttcaaaaaaagtcatacaagaaagctagaaaatgtataagtgcaattatgtttctactttctagattactacggttacgttcccatcaaagtcaatttgattaagacgcattactatactttttaataacgtgaccattagtatacatttgtatggtatcaatatttaaaaacatttgattggatcatagttgccatatgggacgtgggagatgagtgggtaataagacagtcacacgcgcctctctataacacatgatctccacgcgctcttcctcttcagcaggaaagcttttaccaattcagcaaatcaagaagctatataaatgccgcacttaacgtattgaaacttacgatcaaatatcaatctctctctctttcgaccaatggactaaatcaaaacttttgattttccggcgatg

SEQ ID NO: 3662 - DNA, 3000 bp, Unknown; identical to SEQ ID NO: 3654
  misc_feature (1)..( 3000): cDNA_ID_3043246_gDNA_ID_1620655_Annot_ID_163616 3000 nt of promoter + ATG

SEQ ID NO: 3663 - DNA, 3000 bp, Unknown
  misc_feature (1)..( 3000): cDNA_ID_2025191_gDNA_ID_1620655_Annot_ID_163615 3000 nt of promoter + ATG
aactcttgattgattcgttaagaggactttgttatatgttgttacagggttcaatgcagctgtggctggatgcttctttgcagttgaatccgttttgtggccttcttcatcaactgattcatcaacttcacttccaaacacaacttctatggttattcttagtgctgttactgcttctgtggtttccgaaatcggtctcggctctgaacctgcgtttaaggttcctgactatgacttccgctctcctggaggtaatatgcattgccattcttatgctttttacgcaagggaaccagaaaccaaacttatgagagctggtcactgattttcagaacttccactctatcttttattgggcgctctgtgtggcttggtctcgttggcattatctcgatgtacatcatccatgacatctgctgttgacagtcttaacaaggatgctgggataccaaaggctgtatttcctgtaatgggtggattaagtgttggtatcatagctttggtataccctgaagtattatactggggttttcagaatgtggatattttgttggagaaacgtccatttgtgaagggtctttcagctgatcttttgcttcagctggtagcggtcaagatagctgcaaccgcatggtgtcgggcttctggacttgtcggtggatactatgctccttctctctttattggcggggcagcaggaatggcctatggaaagtttattggacttgctttggctcagaaccctgatttcaatctctctatcttggaagtggcatctccacaagcttatggtctggtactgttcttatgtggtcaatgtttcaaaattgtcttaatttcagactttcttgattggttacctatcaatactttgaacagaatattttttcgggttaactgagaatggatgctagtttttttgtagcttcattgccaatgatcctgtttgtctcattgtttaacaggttggaatggctgctacacttgcgggggtttgtcaagttcctcttacagcagtactactgctatttgaacttacacaggattatcgtatagtgttacctctactgggagctgtaggcatgtcttcatggattacatctggacaatcaaagagacaagaaactagagaaacaaaagaaactaggaaaagaaagagccaagaagctgtacagtctctgacgtcatctgatgatgaatcatcaacgaataacctttgtgaagttgaaagttctctttgccttgatgattctctcaaccaatctgaggagctgccgaagagtatttttgtttcagaagccatgcgaacaagatttgcgacagttatgatgagcacttctttggaagaggcattaactcgtatgctgatagagaaacaatcctgcgccttgattgttgatcctgacaatatctttctcggtatacttacactttcagacattcaggaattcagcaaagcaagaaaagaaggaaataatagacccaaggtacgaaattgaatagtctgaaataactatttctttgatcattaattgaagcatttctttggcttaggatatttttgttaatgacatctgttcgaggagtggaggaaaatgtaaagtgccatggactgttacacctgatatggatcttctcgctgcccaaacaatcatgaacaagcatgaactttctcatgttgcagtcgtttcaggcagcattgatgctcccagaatacaccctgttggggtcctggatagagaatgtatcactctaacacgcaggtaaacctgcatctatttcccctcggtttaactgtttgtcccaagatcaccttttcatatggattgtttttaatgaacctaactgactaacctagtcttccatatgacaagagtgtgtagagagtctgtgtaactataacttgggctgccaggtttcccacattggatgtagtagaagttaaattagttaaaaaaaattacttgcaactttttgtttgctcatcagaggaaaggagtgagtcgcaaagtccagtttgctagatttttaattttagagctttcatctgtattagagttgataccgaaaatattgacccagcaaataaggttcctcaattcatttgaaacttttcggtgtagatgctgcattggagatgatactggtttttcttaaccttttctcttgcttgacctggcagggctctagcaaccagaatgtacctcctaaattcgctgtatctgtaaatggtcttgctttgtaactcttctgagctgaccagggtgatttcaatttgtttcttctgtgaggctccgggccaatttttgttctttgtattaagagatttggggagaatgagttggctggtgcagcgtggatgttttttgtctactccatctgttggtttaaatggtgaagcccccatttctcacttaaggtgctgagcaatccaaagggaatcgaaacatggagcgtggttctgagaaaatcttcagaaattttcctgaaaccaaagatatgtgctcaggtgattcgttaccatttacacttttttcttacagattgttactgtaccttacttagtattgtctattttgtaaagtgctttctgacttatatcatattgagaaagttttgactacttaaagactaacagtgtcaacaattgtaagggtttccttgtccactattttgtatattgaagaacattgaaatatattggaatgcccttatttctggtgtgtgtgtctctctcggtgagccgcaagggcatgttgacatctaattgtatggatatttttctctaagaaaattcctagagaaaacagtagtcaggccattgtgttggttaaacaaccctcctaaaaccttttaggtaaagaagaagcaaccccgcatgggttgaatgacctacctaacctatacttacctccatcatgatatagctagtaccctctgaacatgcatggatacacatgctatataatcattcgggtgtgattccatttataccggaaa

SEQ ID NO: 3664 - DNA, 3000 bp, Unknown; identical to SEQ ID NO: 3661
  misc_feature (1)..( 3000): cDNA_ID_1821423_gDNA_ID_1620655_Annot_ID_47833 3000 nt of promoter + ATG

SEQ ID NO: 3665 - DNA, 3000 bp, Unknown; identical to SEQ ID NO: 3660
  misc_feature (1)..( 3000): cDNA_ID_1807806_gDNA_ID_1620655_Annot_ID_47836 3000 nt of promoter + ATG

SEQ ID NO: 3666 - DNA, 3000 bp, Unknown
  misc_feature (1)..( 3000): cDNA_ID_1015955_gDNA_ID_1620655_Annot_ID_47837 3000 nt of promoter + ATG
agtttgaagaaaacgtgcattatacttcctctgttttgtgaaccaatcgatttagcttcgtctttgttaagctcaagatctctgatgaatataggttttcttgaaaggatccatgaccaaccccattcccaccattctttcacagagcttcctgcttgttctcccatggcggaaacagatttggatctcgggaatctagctgcgatcgctgctggttggtttgagaggttgagtgatagagaagagagacgacggcggatgagaccaggctcatcgtcggcggtggctgctgcattagggcgttgagaaacggggagggaagtgggtttacgaatctggagagtctccatcattgagctcataacttctttgttcttctttgtgttgagagagattgaagaagaagatgaatgtgaatgtgagagattgattagtgaacacagctctaacacaggctggggttttattccactttatttttgtggggtccatttacttttatgcccccagccaattacattcattttgttgttgctgtttgtttttgtattaaataatttgtattgttatgtttatttgttgatttgtatagttagttgttttgtgtatgaatgaatgcacctataatattggaaatataacaattttatttttagtgaatatagataaacattgttttcaggtagggttccatcacaagtcacaatacaaatttaattaaaaaaattctttgtaattttattttaaaggttattttcccagtacagaaatctgttgaaattgcattggctttgatttttttataataaaaatcagaaaaatgtagcagaatctgtccaatgtccatagccaagcaaatttatgttgacagaaaaaagaacaatcacatacaaaaatccaaaaaagaaaaaagatatcccagacgggcctaatcaggtattagactaaggcccaataaatttcaagcccaaaatcgaaattaagcactttattctttctttttttaatagctatcgagtgtgtatgttcggagaagagatcacagagatctgagagcttgaaacaatggagtaccggaaaatcaaagatgaggttcgttacttccatttcactttgtctttctgctgcttttaatttaagatttggactctctttaatgctcaattttgttccgagcttcttcaggacgatcatgacgttgcttctgatatcgagagtgtgaaaggaaaatctcataccggtgagatattcttttctcaaattccacttctcgtgttctttaatgtgctcattggtgctttgatttgacagttgcttcgagtaacattgcaatggctactctgggtgttggatccagtgaacggatcaactggaaacgaaagtaagtttttttcctttgttcattttttttttggaaaattcaagttctttaaatagcttgtgttgaattaggggtgtagtaacatgtgcactgacgattctgacgagttctcaagcgatacttatcgtgtggtcgaaacgagctgggaagtatgagtatagtgttacaaccgccaactttttggtgagtttcatagatgcattaaattgagtgtactgtatgtgttgcaagcgaggccagttttgtgtggtttttaatctctgaatcatgatgatatagtgattttgtttactctttggtggacatcaggttgaactctgaaatgtgcgttatctcttcttgctttgacaaggatatggaaaaatgaaggtgttactgacgacaacaggtagcgaattattttgttactcaatctgttgttatcagttttagagaaatttccatgagttttatatctaattcctctttgaacatgaccgtagatagctcactgaatttttcgttactgatacccaaatcctgtctctataacaggttaagcacaacatttgatgaagttaaagtctttccaattcccgcagcattgtatctttttaagaatttgttacaggtggggtgtcctgagtttgttatttttttctgtggctttggtcgatttttcttaacttatgtttttcatgttaatatgtctctaactacttgttgtgtcaccttttacgtggcagtattatatttttgcatatgtagacgccccaggctatcagatattgaagaacttgaacatcataagtaccggtgtcttgtacagaattatactgaagagaaagtaggtttttttaatcatccaaatggatttaacagcttccaatgaatagttgttctggaaatccatcagtgagctgtttcagtttccttcaattcttgcaagtgtgaactgctttgcttactatcttctctaacagattgagcgagattcagtgggcgggtttcattctattgtgttgcggatgcaccactgctcagttgaattcaaagtaaaactttacccttgattttcatatgaattctattaaattgagctttaacgattcttgcatatgatgcgtaacacacaaaagctcatatccggttcctgctctgtgaactttcaggtctctgctgatttttccaatatatgtctcatatttgaaattgcttttgcagttctgatcgtgttcttcagacatctcttcctggctggactatggcaattgtaagctgttagccccctttgcaagctaatatcaactaagagttgtgaagcagctttcatgtccacatcaattaatataatcactcgttgtttctaggtcatggctcttttaagtggtttcgccggagtgtacacagaggtgggatattaggactgtatactgtaaatactcaaagctgatttggtttcttttctctgtgtgtgtgtcaacactaatacagtataattggttccttccattgataaattaacttatgatatataaagcttataaaggttttgctttccattttggcaggccattattaaaaagcgaccttcaaggaatataaatgtacagaacttctggctatatgtctttgggatg

SEQ ID NO: 3667 - DNA, 3000 bp, Unknown; identical to SEQ ID NO: 3658
  misc_feature (1)..( 3000): cDNA_ID_1821411_gDNA_ID_1620655_Annot_ID_47840 3000 nt of promoter + ATG

SEQ ID NO: 3668 - DNA, 3000 bp, Unknown; identical to SEQ ID NO: 3657
  misc_feature (1)..( 3000): cDNA_ID_1821407_gDNA_ID_1620655_Annot_ID_47841 3000 nt of promoter + ATG

SEQ ID NO: 3669 - DNA, 3000 bp, Unknown
  misc_feature (1)..( 3000): cDNA_ID_1821403_gDNA_ID_1620655_Annot_ID_47842 3000 nt of promoter + ATG
ttgatttaatatttgtttaatagattcgagaagattaattgaaaactgtctcggattagggttcgtgcatgttgtaattagttccgcgtgtttacctataatgcatctgaatctttagactaataattttctttaagattcaatctttatttaagcattgtttatgttaaagctagctggtgaaaacaaggttatcttagatataagtaacactaagattctctagcggaataagatctaatctatatacgatagaatggtaagagttttaagaaaataattaaaaatagaatggttggagtcttggagatcgtggtgagtttgagatcaagtcaaacaacgaaatttggcaagaataatactaattaagcttccgtgaaattaaaatgttttcccttttcttagttggcttaaattttacaaaacggctcaatatctgcttatgaatttcatgttttaagagatcaattctgttctctagtatttggttggatatacgtttgaaactttcttttacattttggtacaacacaagttttgttttctttcttgattcaagtgtttttttcttttcttttctgatctgattcaaaattaattaatataccagaaaatcagtgcatttcgaaagcacaaaactaaatatttttctttattaagcatatatatagcagaatatcctacatacgttatacttatcatcaaatcacaacatgtacattgacctattaattagaaggaaacatccaatatacctacagacattatatatatatatagatactaattagagtcctaacctaagatctaaacaacaccctgatgtgtccgaagtagaaagatcctgtattgttggaggaacattcaaatccaaagcaccactgatcatcggctcctcctccttttcccaatgacatctcatgtgacctcctaaagcttgaccactcgagaacactctaaaacagatattacacttatgatgccctgaaaacgtaaggatttttccctgatgatcatgcccactagaagtagaaaccgtcataggatcatcggttacgtttgtgatagcgaaacagcctttaacgtttttatgactcgctctgtgtcctcctaaagcctgatgtgatccaaacactttcttacatcctccacactcgaaccgttcaatactcgatgatgatggtgtaccattagacagcattaagagacaagaagcgacttcatggtcttcctcggacataaatgagacccaatttggtaatatctggtttaactgttttgaagaagccgcggtgggcacacggtagttaggaggaggattaatgccacgccattgacgctcagggtgacatctcatgtgaccaaagagagccttccaagaccaaaactttctgccacattcagtacatggacgtgtgattttgggggcatttgggtctggttttttggtgtattttggttttgacgcggattttggtgaagaactagaggatgaagcaacggttttggtgcgtttcttcttaggactgtgatcgtagcttgaagataaagcaaactggagatttggattagggttgcttgtgttagaaggatgaagtggaatgtgaaaactgcgatcatcataggaatgattgttgttcattgtgagcacgtagaggaagtgatggaagaaaagtgggaaaaaaaagagtagaagttagagaaagggttgcttaagtagaagaagaaggagaggttacgtgggaaagaagttatggaggaacagggagacagttaacttcagttgaggaacagagcggtttactatgtaaggaagagacttatctctttgcagtttgaaaccaccacgttttttatgtatcagttttgctgcttattatttgttggcccaagtttatctttgatgggccttataatactagagttcattatttcttatgggccttataatactagagtccattatttctgataggccttataaatcttgcgtctattattaaattctaagcctatgcaagaatattgaagcaacaaaattccaaagccaacaaaattccaaagccaattggaagatttggaaaaagtaaagattttagtggagtttgagcttccattactcaatttcggtggaggttccacacttccacagaaataaaatcgccactctcccatcccatgattcacactattgaaattggacatttgattacgatttgtttcctagattattatttttgtttctatatccgttagattttctttatcgtgcgttttcttatcttcctgaaacatttaaataataacaagaattgtttttggtataagtaaacttgtctctcttttttggtaagaaggtttaaggttgcctatataggacaacaaaatcagaaaatgccataagcatctgtaatttttattggtttggggtaaaaaaaggttacaaataaaagaatggtccaacaacatacattcatttttggagttatgtcatatgtggaacatgggaagatgttttaaatacctgaaccaaataatattcgaaatatccagactttctcattgtcgcatgaaagaccacaaaatataatactattacttttcaaaaaagaaaatgaaacaataaaataaatttaaaacagtcattggatcaaggtataacggaatccaaatacaagtataatatataattataaaatactgattcaataatcaaaagtataatcatacaactccatgacgcaaacgattaatggtcccaaagatgatttggttaattatctctttttttgggttaatgatttcactagccaataaaagattatagactaccattatagattatagtaaggaataatatgtttctcatcatcatcttctttactttggctgggaaccaaaagggtcacttcgtcacttgcaaacaaaacaaaaagttttcatttttcactggaaacaaaacttacaagttaagaagttcacatttttcaatcgataatg

SEQ ID NO: 3670 - DNA, 3000 bp, Unknown
  misc_feature (1)..( 3000): cDNA_ID_1821395_gDNA_ID_1620655_Annot_ID_47844 3000 nt of promoter + ATG
ttaattattgaacacagtttatagagtttaatgagcagctcctttttactcttcgtcatcaacgacctacatttgcaatttttttttattaatattcgtgtttctttcactatgaacactctctcttcttttcaacaaaaaaaatctcttttcaatcaagtttttgaataaaatgctttcttcaccagtcaccacacgttattctagcacaatagctctctaaaagatgcttcattcttagctacttcacactcttttcatatttgtttcaacatgatatcttctccaattttatctgtatgtgtgtttgcaacaaatgcctttcttcttctttctagtagaagaatccaatgcacaaacaaagatatatatatctaatatttttaacttttcaaaaattaagaaaaataatatttcatatcaagcatatatgtatatccgaaagttaatatatcatatatacaatcagatatatatcacatatcgttttaaaccgttcatatatacataattttttataaattaacctactgtctgtagtgttggaactatggaaagtgatattttgaaaattaacctgtatacagtattgttgaaactatggaaaatgatattttaaactgttattaattgaaattactgtttctttttttttggacaaaaaaattactgcttctttgtttcattttcctttaattgtacacactttgagaaaaaaaatcatatgttcaaaaattaagaagtttaagaagatttctaaatgattcaagtacttctgggatccatatataacacacataaattccttttaaaaaatctaaatttatgtaaaaatgtggttattttcatatctgttttggtcaaatatcccaacatttgttattgaacttcaataattcaagtaatttctaaatgatgacactttatagccatcatggaaaatggaaagtacgacgtctatcattatagtttttaaaaagtttgctatgataaattagtgtgaacttttataaaaaaaaataaaaaaaattcaattaggcaattagctagtgaacgaatcattgtataattcggaaaaaaactatttcagcctcttcttccatgaatcagactcacatggatgccatttgaaagcatgtaattaactttcagaaaagcattaaagttaacaatttcaatgaatatatataacatagtttaaaacctcttttgtactgaaatcaatacaaaactcaatcttatagaagaagagtaactattggctaattattttaatttgtatccttgtatcaatctatgtgcatacacacacacacacacacatacacatgtatatatacttattagttattacgtacagagagatggaaaaataaacaccatggcaaattctgaaaccaaaagaaagatgaataaaaagcaataatttattcaaagggcgtttaagaaaatttcaaactttgtaaacaaaaatcaatcaaacaaattaaataaaaaaactagggctgaggtcagaaagggattattgtttttgagaggagtaaattaaagaaagaatcttgaaggtcaaaataattaatgaaacctgttcaatgacagacattgtcttctgcaaagaatctttctccctcttctttccattgatacatttacagatcgagtttaaccaatcaaatgtacatatttgcttacgtaatcaataattaattatacctaattaatatattaaaatttggaagaatctcaaacaaataggccaaaagacatcaccaactacatcattaagaagaacaatcatctcagctcttaaaaaaaccataacttctcaaaactctctttttttctatttctcaatatcttcgcagaacaaaacagagaagcatggtgagattattttttgctaaactaatgtaagtgtgaattttaattagaagaaacagtagagagatctaattggatggtaataaaaagggtccactttgttcttggggaaagattctgcacgcccacatggtgagattaaaatagactaatattacccttcatcacctacttgtgtccagagagagagaaaaaaaaagaacttgtggtgatgatactatcatctatttgagagctaaagaatttttccttaagctttttttttttggttcagaatcttttcatcatttatgtgtctgtgtaccaataaacatagaccaaacaaacaaaacctcttaataactgaaaaacagagcaaaacttttgtttttctgtcagttaacttacttcttctgtgtgtttgaaacccaaagtcaattcttttttttcttcctgaaattctctctacttgctcaaggaatcttgataaagtaagtaacttttttctctttcaagatagtaactatttctgggttttttttggatacttgttgtgttatggagcatcagaagatttttttgttctttggaaactgatgtcatgaagcgcatcatattcttaattttataattccattatctttttttttcttcttttcttgtgtgtggcatttattgtctgctggaatttttttgtatgaattgtctttgaagggctcaataattggccctcttggagtttccatgtccattggggaatattgtacttgagaagctgatgttagtacttgatgaatccttctttcaagtcaactctctctagcttttatatactctctctatatatgatctcacatctcttaaaatctattatatacatgttgaaacacacttttgatcttccagttgacaaagactgagttttttttggctcttatcttgtttcttgtttggttcttgatcatgtttctgcaacctttgcagatcggttatgtagacaacgacgaaaggaaccttaaggggacctcaaagacgcttggtcttgctggttcttgaattactacaacatcaaagaacaagtctttgaataatttgattggtaggcttttggttgatacaagagaaagagattgttttgat

SEQ ID NO: 3671 - DNA, 3000 bp, Unknown; identical to SEQ ID NO: 3656
  misc_feature (1)..( 3000): cDNA_ID_2999324_gDNA_ID_1620655_Annot_ID_47845 3000 nt of promoter + ATG

SEQ ID NO: 3672 - DNA, 3000 bp, Unknown; identical to SEQ ID NO: 3655
  misc_feature (1)..( 3000): cDNA_ID_3014067_gDNA_ID_1620655_Annot_ID_47846 3000 nt of promoter + ATG

SEQ ID NO: 3673 - DNA, 3000 bp, Unknown
  misc_feature (1)..( 3000): cDNA_ID_1821387_gDNA_ID_1620655_Annot_ID_47848 3000 nt of promoter + ATG
tgtattatttctctgtccaaatatgctttgttcttgagcaaatggactgacttttagtgtggagtaaagttcggtttatattctaagacaaaacagaaaaaccaattcgaatcttattagatttggaaaatttcatactattcaaaagaatcgcaatcacaatggacaagttccaaaatacaatgtggcagaacaaggatcatccataagaatcttgttctcatcgattactttagtaaatccaaacgaacttacttttcttcccttgcctttgttgttcatttggatagtattgatacattccgcacaaaactgcaacatgagatttttacaattaactctgaaactccaaaaataaaactcacaaaacttctgttctttcacgtctcggagtgatcacatcacacgtctctttccaacttttcgtaaacgataattttgtaccattgcaaagtaaataaatcacatccatgattttcaaatcatactggtcgccttctgtttttactttttaccgaactatttgcagaaactatataacgtacgcagcattataaactaatctaattagttatcaaataaatactgatatttaacatgcgaagttttatgttttgcctcatcgttctcgtgttggctcttaaaaaaccatgttatgtagatcggagataaaagtagtgaacgatttacgtgaaagagatattcgttaaaagttagtgtttcatgatatccaattatgcatggccaacaagatactaggcttagctagataactatagtacgataaaatagagaagtactatttccaatcattagcctggccactgaccacttcaaacattaatgattctcgtgaaactataataatatttaaacccaatcgtctcaagagtaatctcgactatacctgcgccaatagttctcggttcttgaagctgccgtgcctaacatgattagcgaactatttccaatcattagcctggcctctggccagcttcaaacatcaatgattcgtgtgaaactataacaatatttaaacccagtggtctcaagagtaatctcgactagtccatgcgccaatagttctcgtcttgaagctgccgtgcctaacatgaatagcgtgaacttgacgtctcatgtgtcaatcttttttttttgtttctctttattagtaataataaaatgaaataaagttaataacatgcagagaataagtgccagaagttattattgcgatccaaccaaaggttaaataatcagtacttatttagtattaaaatataagtagagatagtgcttgagcatctaatcatataagaaaagccaattactctggagaatcatcggatcacttcactctttgccttttctacacaaagagacagctcttgtgttcttgaaagcttaaagctctgttttccccaaagctatatgtgatgggtattacaaatagcaagcatacttttcatttccatacatctaaattgagaatataccaattattgtccttttgggtggtcattggagtttattcattaagattttgcagttttttttttccaaacctttgatcattttttaaatgatactattatattattttctcaatcaaattattttaagataaatatcaacttatcgtttaatagtaatgtgtatataatgtaataattgattttaatgttgaaaaatagtatttctaggtttccaaactaaattaaaatgaaagtacaaatgtttgataattttacggtgtattttctgtaggattttggtgttatatccacataatctatctataattaataaaatatatacaagtaaaccgttgaaagtttggaagcttaatccatattttgaccatgttttgtagtactaggctagccgtctttattaaaaaaagtaccgcgtaactacatctagttcaaatttggtaatctctaatatgaggttctaaattagcaaaatcatattttaaagaatttataacatttagccatatttgtcttaggttccaaataatacatagttccaaaggcaaataaactgtcttttatggtttagaaagatttctgccttgagagtaaacttcttaaaataaggttaattccaagagatttgattccagtttatttctaggaataacacaaagaaataatcatttttggtaaacaagataatcagaactcaaacggaaagaaatatgtcagtctgtcaaatccattaagaaaattgatattcacttctactctatttagaaggcacgtcaataattcagaaaaataaaccaagtgcatgcgataatgcaaaagaacacataaatccaaaatatcacaaggttacaaagtcaacttctaaaacttcatattttcttcacacgcttctctttacatttatacacaaagtacgaattaccttttgaaataagttgctaggtacttaatatttataagaaaaacaaaacaaaaaactttgggttgaaatgggaatgttcgttgaataaataagaaaaaaatcgagaaagcaaaagtaggaatggttgatgataagtcactccattcacaaacaatttgagctgtcaataatgtgattttccaaaatctcttttggtaccacaatgttttaaatcattggacatcggaatcaatttattgtattatagtatcgtagtatacaaaagaagttggcttcttctgtttttttttggctctgcagttttcaaatccattgttttaaaataaaacataattcgacttcataattataatcaaagtgttaatctttgaattttaataatctaatattagtggtaccatattgacaagaaggagacaatgtcacagaaacttacctcaggagtcaaaacagaagaattgaaaagaaaaaagaagaaataaaaattggatttttatatttgtttcgaccactatcaactctttctctctcttacaaggagcgaaagagaaacactttccgacttgggtaaggaaaaagagtttg

SEQ ID NO: 3674 - DNA, 2202 bp, Unknown
  misc_feature (1)..( 2202): cDNA_ID_2687174_gDNA_ID_1620656_Annot_ID_47851 3000 nt of promoter + ATG
gaattcatgccctaagccttcaacttctagcttcatttgagccatagcagcaggaccaggaagctttttccgcagaagtcctctaagcctatgacactctgcttcaagttttgcaatctttttcacaccttccagatgctgcttatttgcgatatccgccgacttcaaactcatgtttttctcttcattgcggatctcaacttctttggaagcaacgtgaagatcgtacttcagataactaatctccttctcagccaactgaagattagtcttcaacttttccacatcagcttcagctttagacctctcctcactaatccttactatcatctcagatcgttcttgcaacgatctagtgagtgctgcattgtcagaagctgcccggtgtagtccttcactcaattcatcgatctttccttcaagctcggctttgatcttatcccattgactggtcttagcaagaatcacatcctgcagcttcttatcactctcttctttcacaatccttatctgccttgtacactctttcaacgcatcatccaaatgcgatgctcgatcctctgcagtgagctttaagagtgtaacagattcgagttgacgtttaagtgccaaagtttctgcatcagccttctcccatcctaaaaaaagaacaaaagactataatcagcaacaaaaaaaacatctcaaaacaaacaaaaatgctgaaataacattttacctgaaacagcttcttcagcgactttggcatgttgaagaatcaaagattctttagtgttgatctcagagtgagcaagagtgagtttttctttaagatctttaacttgaacttcaaacaatttgacctgatcctccattctactcatatgtgtgtatgaatccatagttatctgaacatagtttgtgtttttacacttctcctgacacacaaatcaaacacacaaaaaaagacttcaaatgaaaatttctatctcacagaaactgacagattatcacaaaactatataaaacagaggtttggtgtaaaattaaagcacctgattctcaagagaagccaagtaggacaaagaacaaacaggagttgactcgattccaacaactggtttctcagtcgtggctttgtccgaagactttctcttccatggccaacctctaccctccattttttttgctccaaaataatagtactctgcagaatccgtagaagaaggaagaaaataagctttaataaaaaaacagacaaagaactgatagaagttttgaaatttgaactaacgtacaaaaaaaggaaacaaaatcttccgtaaatgttactttcaatttcatccgacaaaatcccgctatatatttattatactgtatcacctcaacaatgaccgttttgttgtttctttctttttttccgcagtgattcacatttaatgatttctttccaaaactatgtaaccaaatttattgaaaagtctactaaaaaaataattcaaatcccatcgcaatgggcgcgagcgagtccttcacattaaacctgatcataatcatcatcagctaccacagtatcgcacttagaacacacacaatcaaattcaaacaaactttcgcttgacaatttcaatcgaaaccatatcttttcaagtttagctaactatcggaaagaaattacataccgagactaatgattccacagacttgagagagcgcaaagatcgaagaacattcgtcgagagaaagaagaagaaagtgggaggagcgtgtatgtgccagagaagaaggagcagtggatgatttatgcgcttgggctgtcgctttttttcaactttgacgctccacaaagacacaacaacgacatctctctatttcaaaaaagttttatttttttattcattttaaatacattttaaaaaaattaacaaataaatcgccatttgttgttcttttttcaaaaacggaatacgagggtgcagttatcctctacgagcaggtgcatgtaataccatctgatggatttgacttatcgtttatccacaaaagattcaaaatcttcccggtttttaagtttgggcttcataaggcccaattagtggcaaatccatcacagtccactagggtttttgagagactggatataaaatttgattttgttcattgttgtcattcgccgtaatctgaagaagacgaagcaaatcctcccacaaagaatcatccatg

SEQ ID NO: 3675 - DNA, 3000 bp, Unknown
  misc_feature (1)..( 3000): cDNA_ID_1821498_gDNA_ID_1620656_Annot_ID_47852 3000 nt of promoter + ATG
agcaccagttcttgcagagctttcagcttccctaggaattctggaactgcacctaacattttgcagtctttcaagttcaatacaatcagtttctggagcttcaccatgtcggtaggaagtttgccaattgcagttccatctaagtgtagagtttctaggttatctgaaatcacctggaatttctgaatgcttgagcaattggtgaggatgagagttttcaaagagatcagattcatacgcggaagaacccggagactcgtgcatcctctcatgttgaggaaaataaggcttttcatgcgtttcatctcacgaggcaactcctccaaactcgtgcacccttcaagatttagtctttggagactctcagcatttagcaaccctgacagattgcataactttcttgagtggctaagatcaacccactttaacttctgtgtatcctgcaatgaacagtaagaaaaattaagcaacactaatcaagtaagctaaaaatcataacggtgaaattataaaacaaagacacacgtaccttagccccctcccagagctcttcaatctcgctgtaaggcaggttaaagtcggtaagattcttggggttgaagtcttttggaagtttcatcaacgggaattttagccaatagaggtaacgtatctcatccaacggaaactcaagtccctccggaaagtttagtttgctatcagcttcacattctcgatcacaacgagaactatagaatttgaggtatctaagattgcgcatcttgatgaaggtacttctgtccaaaggaagtttcttcttcagttcagacatgtcaagaaaaatacctctcacggctccctggttaaccaattaaagacaagaaatcagcaagtagaagtcgagtgctgagtgagcttctaattatcatgaaaagagaacttcaaattttgctacagtcgctatcaaacagttctacggtttatcttaccactctattcttcagcgcacctacaacggctttatggttccacagcctacgcgacccttgtgaaccaagttccttaccaaatgtatacagtaaatcatgcatctccactcgtccgccagaaatgtttatcaagaatttgctggcaagatcctttatttcactcacagtatcaatggcttcagtgtcacaagattccactaaacacctcacgtaatactcatcccctgatctaaagaaacatgcgacatcaagaaagacatctttgtgagacaaacctagttcatcatagcttacccgcaagacatcttgtattgtcttattgggactttgcatcagcttgctaagtttctcttcccagtgagtcttgtcttttccatttagctccttacccaatatcttgagagctaatgggttgcctttagcataatccgcaaacaatctagacagattcatgaaagttctcactggaggacaaagcttaccactaaaggcaaaatagctaaagtactcaaagctgtctctaccagtcaatctcaggacctcatatgtatcatcaaccatcccctcgatcaccgacctgtcgctagttgtgataaagattctactacctctcttaatccagtctgattccccgagaagaacctctatctgtttcttgtcgctcacattatcaagaacaacaagagatttcttactcagtaggagtgccttcaaggattcaggtgaaaagtcagcgacttcttggttcacgttatcatccttcaacaactcttcaatgaaaatgctccgatccatcatgcagtctttccacatcttacggacatcatgaagaaaaacacagcgtaggaaatcgtgttgccacttttcataaagcatactagtcagagtggtcttaccaataccaggcatcccaacaacaccaatggtaagagtatccttgcactcaaaatccaacttctcttccaattgcttaagtcgtgtttcaatgccaaacagaggaggaggcgagtcaggagcagcttcaggtacttgttctcctgttggaaaaggatcatcaatggggatttccctttctagatcaggcataacatcagatgatagcacctttatgacttcccctacaatttgattgatggattcgccttcatcgctacaagacaagtgaaaagaatcaatcacataaaccataagatccctaataggcaaacaaagtaatgtcctttgacaattcaaggataaagttacctcatttcgctcaacgtaaagccaagctttttaggaacatcctttaaagcttgtttccacttatcgagcttttcaccattacaagtcttagccaatttccagaacgtgtaaccaaaagcgccctttaggtttttgacatcgtctgtgtccaccatgtagaagatgggaataacgacaagtgtgcctaagtcaacacaatccttaatcttcacaagctcgtccaagcaccaatacgactccgtatacatgctagagaaaatggcgagcgcgatcctcgactcctggattctcgagaaaaggttactgagatctctacctttggtttcgtttctgtcgataaagacgttgattccatccctcctcaaggctttctccagatggctgacgaaaccgttccgcagttgtttccctcggaaattgaggaagacttgatgctgcggcggagataattgaacggatgaagaagaagaagaagaataatccaccatgatcgatgatgtctcgcgttgaaatcgaaagcatggaactaggactctggtttttcaagaggcaagtgtggaagagagaagaagaccattgactaaaacactaaagcaaacagcgacttggattgatagtttaatgacttctcgtgaccgttacctaataaaaaaatatattaaattcccaatacgaaaaatacatatattttatttgtaaccaatggtgctaatggagtcaataatggtggtcttcttctttgtgcagacgaaggtcttttttctcttttgcaatcgtactctaaatg

SEQ ID NO: 3676 - DNA, 3000 bp, Unknown
  misc_feature (1)..( 3000): cDNA_ID_1821494_gDNA_ID_1620656_Annot_ID_47853 3000 nt of promoter + ATG
cactgagagaacagctgcagagcctcattctcattaaagctctgaacctcatacacatgattgatctgacaaaggcggaacacttgtttatctctggacgttatgatgattaggcttcccgggccgaaccaatgaaacccttcgagaaaagactcggcaaccaaaggattgtgcacatcatcaagaacaacaagagttctcttcttgcttaatttgtccctggggaggctaggtctcgtaatgctactgcatacacgaggcaattccttcaaaattttcccaaaatgttcctccagcaaacggtgaagccccttcccactaaaagccttgtcaaagtgtttgatgaaacaagaagcttcatagccaccagagatttggtcaaaaaatgctttagcaagtgtagttttgcctatgccgggcataccccaaattcctatgcgacggacaccccatggttgcttgcaaagcaaatgttccatctccagcagcctcgagttgattccgatttgttccgtgggaaagagtttctcatgcacatctttgacaatctcttccacaagttcgctctcactgcattcctccctgtttgcattgatttaaaaatcacagagtgaattgttgcggaaaacactaatgaatattgaagaacaaaaaatgttttggataaactgcctcacattttgtcaatctatcataataacattattagttccatataaaacctttgatttgtataatatttctttgtggtgttagatttgtataatatttctttgtggtgttagatttgataggtggaaaacattttgaagtagagacttttaatcttctcaaagtgcaaacgacatattaatcaatccacagttacctattgtggtggcctggtaattctctcagttcttggagtgcgctactccattctcttatccggtccactgacttgtgctcctgcaccaccacatctgatgaactaatgccataatacacaggaaccaccagctggccggttttcctccgacactgaaagaccctcacgagcatgtccaggcatgaggtggaggagacgcagctctttgagaaaaccagcacggaagcgctaactctctcaatcacatccagagtctcactgtaatttacaaatgcagaaattcctttccggcgaaaatccatggagaggtggctggcgaaggagtattgtagtgtatcttcgcagtatatgtagacagtgggaagtaatccattaggtggcggaaaatccacgttgtatatatattggatcccttgttcctctaaaagtctttgatcttgtgttgtgatgataatccgacttccaggaccaaaccaccgagcttcgtttgccaaggcatctaattgtcctatgctgtccacatcatcaagaacaagtaccactttcttgtctttcaacatttcatgtgcagcttccaattgaagaatctcaccagtaaacttgtgatttaatagttgagacagtaaatggctttgtaactgcagtttcctgtcgtcctcattgtagcaagttcttggatagcatcctttgatatcaataatgatagtactcaattcgaattgaggaaggagttgttggtataaacgtttagcgatggtggttttaccactcccaggaagaccacatatacctatcaatctgactttatttgagtccagacctagcagctctttcatcttttccatatgagcttccatcccaactaagccttgggaagcacttgattgagtggaattattcattatactagaaatatcattagctatttttttgaccatagccttttcatcatccctaaacatatagtaaataaatagtcatgaataacttaaaaacaaaaaattgtttgatgcattaagaagaggcaagtggtaatgaaaaactgaccagtcgcgtgaacggtaaccatcgattgtggccacttgctccaaagctttaatccatctatcaatgtcctctttgttttttctctcacattcttctctgtgcttgttcatagccgtatcatcaatctttatggacctaaacatagtcatcaaacacatattaaaaaactgtgaattactttcatgtgttaagaaagattaagaagactaacaagcggctggtaagtttatagactctaggcaattccgccaaagctctagtgcatttccaaatgtcttcatctgttttaccctttcgtgtttttctgaaattatccccaaaatctccagtctgcttcaatacatcaattggatccaaattatagaaaatagtcaccactctttgacccaactcttctttgcacttcattatctccaccaactcgtcgagacaccacggagagagagcgtagttccttgagagcacgacaatcacgattctcgagacactaatcgcgtttctgagctcaggtccgatcgacacgcacctctcggtttcattatcgattagtggctcgaaaccctttcttcttaactctttcctaatcctactgagaaaggatttgggtacatctacagagctgaagctcgagaacacattgtgttcccaattgcgagacgaagccgttatcttcttcttcttctgcggattggatctgatgaatttttcataaatcagaaatgaaaccgtacccaaaatcgtgattgcagccgcacagatcctaaggagggaagcagaggaataatccatttagagtacgattgcaaaagagaaaaaagaccttcgtctgcacaaagaagaagaccaccattattgactccattagcaccattggttacaaataaaatatatgtatttttcgtattgggaatttaatatatttttttattaggtaacggtcacgagaagtcattaaactatcaatccaagtcgctgtttgctttagtgttttagtcaatggtcttcttctctcttccacacttgcctcttgaaaaaccagagtcctagttccatgctttcgatttcaacgcgagacatcatcgatc

SEQ ID NO: 3677 - DNA, 3000 bp, Unknown
  misc_feature (1)..( 3000): cDNA_ID_1821490_gDNA_ID_1620656_Annot_ID_47854 3000 nt of promoter + ATG
acaaaaaaaaaaaaagttcctattaaacccaattaatattatttttaatttatcctctaccaattaatattatttagtagaaatactttatttctttaacatataattttaagaattatatgtatgaaaatttaatttagaaaatcataaactttttgttaataatcaagagtcaacgacgaaacaacggcaataagtgcaattttgaagcccaacaagttatgtccaaacacgtttgttgaaattagctataatggcacaggtccaaagcatgcaggaccagattagttcactttgctatgtttttttttctttctttctaattctgtatcttgttgttggcaagtcatttacaacttcttcagtaatcaatgtctataacgacatatatatttctgaagaacatgtgaatatatgacaaaaattgggactaccatatttctaaatgttacaaggacgctcccaaaatagatcaaatcattttggtaccaaaataagattataactttattcttgtttcgcatgatatgtgtatatattagtactagctttatttgtcttctacgtaaagataatagttctacaaccaaccagtggctgacacgtggtggctggtgttcgatttcactcccttctcgttggttcttgtcgctaaatgattggagaagagaaggctgtcaccggagatgctgtttaaactacgaatatacccttagaaaagtcgaagtggtgaggatacttttggtaaatcgacggatgatgtgaagttcacaggcatgtgaagcgggcggttttgtttaatctctaccacgtggcagagggaaattctctgttgtgccagcgtggcacgttccagaatgtcagaatgtttgcaacattaaaacccgtgatcttattggtctgacggaattttttatataatcttttaaattttcctttatttttctttgctgaaatactatagagcagttgcaactcgctagttttgaactacttaaacctagtccttgtatatgaattaaaaaaaatgtaaatggtacatatcattcctatatgtacaaactaagttaggtcccaaagctgaaagaatgtcagagttatttggcagttttggtagagatgcaatgtacatataaacccaaaatataaattttggtagtttatttactctttttttttgcatgacacaaaattaaagatgtttatattgattttacaccaaaagaaatatatatactggtaaaaaggcgtacaatgaattgaattttgatttcgacaaaaaaaagtggaaagaattgaataccatatttgactaaaagaaatggatcattccttaattgtgcgtgtgataacttcgatttatattaacgtccaatatccctgtagtatgcaaaaatcttgcaaacctagaactgatgacaataaaaaaaacatgattaatttgagtttttcttcaaatatgtatgcaattatgcaaatattcataatacatcaatctgaaaaatcagaactcagaagtaataagtttgatatcttaaagtctttaactccgttttactcctaataaaaaatatattatagctaaaatatatatttttttaaaaagtgaagaagaatgtgaaaagaagcgggaggagggtgacgtacgcaaatggggacatggagaaagccacgcgcaattgagcggtccacactctctataccttttatatgtcatcgaatcatcaatttctcactctctctctctctttctcttcacattcaccgaaacttataaccaagatcaatatcagttctctctctcgatgaacatcatcttctacacagccatctttctttgacttcttcttcttcttcttaatataacggctcgtttcttttgtttccaaacgagtaaatagtgtcctatacacatatctataattccacaggttgaagaaaaggtaaaacctaatttacacgggctttcaagctcagaagagtccatttgcatcgtctcatcaacttacatgtgcatttttattttgcaccaaattaaagcatcgatctctcgtcgtccttttttctatattttccttggttctttagcttgtcgtgttgaccgatctgcataatgttttgtatatccattataatatctctcaggtatttttatttatcatgattcaaggctcgttaatttgtataaacctaatacctatatttttcttttttttcggataccctagtaatttgtatctgcatataattcgaatttgtacgtatatatttatatgtgtgtatagtatatttagtacagtcttgagctttctttaaaatgaagataaaacagacatagactttgaaaccattataactgtttgctaagacttgatgatttcttttgcttttgttatgtagaaaaagctgtttttgtttgtattctataaggctgtatatatataatgtagctaggtttgggtcgctataaagtatagtaatatatgtctacaaaagaataattccggttctcgatatgatcattgccaccattcataaaccacgttacaacaggaacgcatgatacaacaaaactctcttttccgttttcttttagcgtcaatgcgtcatatatgaacagaagccctcatgcatgtcctctttgatttcttcaacttttaaacctaacttgcatgatcttgttccattttcttaattctttgtaagaaatcaaaaacaatacctgagtacatgtgtttaataagtgcatcaacatgaaaagtaagtagtggaaactaaccaccaaatgagctgatgattaaactcaattacaaataagttcttctttttttttctccctgtttccatgaaaccaattatctaacttttctctacctctctctaatatataaccccatctctttgtgatgtagcatgcatacacatgtacatatcattatatatacgtatatataacatatagtgatctcattgtggtattggtgttatgcagaaataatg

SEQ ID NO: 3678 - DNA, 3000 bp, Unknown
  misc_feature (1)..( 3000): cDNA_ID_3071629_gDNA_ID_1620656_Annot_ID_47856 3000 nt of promoter + ATG
gttcgtgtgactctgcatggaactcctaatctctgcacgacctaacctatccacgacactcagagagccacaagtcgatgtgttttatcatatgttgcctcactttgttcactgcatctggtgaactgcaattctgggcatcacctgcaaatgggaggaaaaaaacaggaaaagaatgggacatcatattttcttaacagttgttctgatgcttgtcattgacttcaggcatcggaaacagagaagaagccggtaatataccttcaatgaccattgcagattgggggcatcctcgaagatcacttccatgcccacagttgtgacaagtcatgatgtacgaaggcactgtgtcatcaaacattatctttttagtgtcccagacaaaggatttgtctgaatactgctacataacgacataggctatgcctgagttattgctatgcgattttgatcaaactaaatgaagacttacggtcaggagatgaggtttgtttggatgcatgacgccatggatcctgtgacccatttgtgaagataatcttggtcgctacaaaattgagaataagaagatgcgaagaaactgttggaatgtgcacaagtctaaaaggatcgtcgagaagttttccgatattacataccagcaattttatcgcttccatagtacaagtttgttgcatcgacttcagggtagacacctttcccaaagaggctcttgcatagatccaaatgatacctatgaaatgaaaagaagtgtaaatgggacaataaatagaaacgacaaaatcagaattctgaatatgatatataagcttgggtctgtgcatactctgtattgatctgatgagaccggatgctatcgtttgcaggtgccacctggaaataagccacttcagtacaaacttggaaccaccaaagcctatctgcactctctagggtgaccgcagtgtctagtagatgtttccggctatatgttttagagctttgcccgaaaactcccatgcaaaactctctaacatatttagcatatgcttcctgcattaacacatccaatgttatgtatcaccaaatacaattcttctgtttgcaaaccatatgatgaatgtcaatatatatacaccaagcataagtaaagagcgatctaaaaaaacaaagaacttaccactaaatcaccaccattcttttgagcttccacgagtggtacacatagtttatctgggtttccgtattgaatctgccagataaacatctaaaactagaaagaaaatgaaaattttataaatatgaaatgaacctgcttaccgccataactcctgcatccgctattaagtataagaaatcagcatcaacatcaagctacagatttcagaaacttaatcagattggagatagacttcttacttccttaagattcaaacaaaagaaaacagaaacagtaaagctagacctccgtggcattgaagagagctttaacagccctgttattcactttaagccctagttccaagagtttattagtctcttgtagcgcagtttcacattccggtccagccgactcagctatctattcaataaggtataaaaatctcgattctgtcagcaactaaactctatatgaagaaacacaacatttcttcacttaaagttgaatattgtaacgaatacctgttgatcaaattcggggaattcgtagacagcacgaacaactgctgaactagcgaggcttccacaggtcaaatgagggaacttaagccggaaccaagcacttaaagctccagaataagatactccaaagaaaaaccacggattctcaacattgctgcttctattaaacttaacattcaaagagtcctgcatccacaaacaaatcccaaaacatgctaataaacgcagcttcttaaacatttgatcctagagaaagtaataaccataagagtataagactactacttgcctggtaatattggcggaaagtagctaaatcggaaagggcctgtttggaagaaagatacttgagattcttagtggctaacgacttaaatggtgagctctttccatagtaacgatgctcgagtgaaacaatgcctgcatcaaacttctttgccaacacctgaagaacatgtttaacaaacaaaaccaatgcaaatttcagagattatgagaataaattaatcaatcaaatggatatgtttcacggaaaaatatcttacactaatatagttattggtgattccattgcaaggtccttcgccgcaaatcatgagaaagataggtccgtcaggaactcgtaaatggtcaagatattcatagtatctctgtctgaatttgcgatgatcctgaaataaaattagaaacagctggaactggtaactaggattttgcagcgaattttgaatttcaataacgaaagagaaacagaaactaaaatcgaagaagaaacgaaattgggaagattgattacagatggagagtagtgatctaaggtttgagtgaaccagagctcatccctcgtcaagtacttgctacttttggacaatccatgagaaatcctacgaggttgcagtaacccattagaaaagcttaaatacgacaagagcaccgtgaaggtggtaagtaaagcaaagccaagctccgacgacatttctcgccgtgaaaatcgatcgccgtagtttaaaacgagtggaccagaaaacaaaacaaaataatgtgattttctctgtttgtatttgtttttaaaaaaaaaaacttgcaaggacaatataatgattagaataatgttttttcccctccaacaaatagtatcatttttttagtaaatgcatggattatagtgcggacttcaaattatctacagaaccagatttttgtatttcttttactttaactttactctttttctgctcattctctctcccagaaaaaaaccacactcatggcgacacttctctcaccttcttcaagctaagttttcattttgttcactgccacagatctatggccatg

SEQ ID NO: 3679 - DNA, 3000 bp, Unknown
  misc_feature (1)..( 3000): cDNA_ID_3071613_gDNA_ID_1620656_Annot_ID_163680 3000 nt of promoter + ATG
tacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatggggactggagattctgcttcgagactgattctctggttctgcttagggtttttgattctaggtgttggatttgtgcaatgtggagttacttatgaccggaaagcacttctcattaatggacagagacgaatcctcttctctggctccatacattaccctcgaagcactcctgatgtaagatttaacaaaagccctaaacttttctcttttttcttcttttgggtttaacaaaaagaccctatgtttctttcctttatgttctgttttatacaatttatcaaaaaggttttagctttattaattttaactgttgttcttgttgttagatg

SEQ ID NO: 3680 - DNA, 3000 bp, Unknown
  misc_feature (1)..( 3000): cDNA_ID_1821441_gDNA_ID_1620656_Annot_ID_163679 3000 nt of promoter + ATG
agagttttgtttaacaacgttcattataacttacctccttggtcaatcagtattcttccagactgtagaaatgcagtcttcaatactgcaaaggtaagtgtatatggttgaaactcagaattatggttcctcaaattctctgtgttttttctgattcttgtggatttctcttgtttaatttaaggttggagttcaaacatcccagatggaaatgttgcctacagacacaaagaatttccagtgggagagttatttggaagatctttcttctctagatgacagctccacattcaccactcacggactcttggagcagataaatgtcacgcgtgacacaagcgattatctttggtacatgacgaggtaaaagaaaaacccgtctgctaccttatacaatgtaaactttccctagcttcaaagtgattctcgacacgtgctaacaaacatgtggaattggtatgtagtgttgatatcggtgacagtgaatcattcttgcatggaggagagctaccaactctcattattcaatctacaggccatgccgtgcatatatttgtcaatggacagctttcaggtatgatacttccactagtttggcctgttaatttgttctattagagaatttctgatgcaaacttataatatatgaattgcaggttctgcctttggaacaaggcaaaacaggagatttacttatcagggaaagatcaatctgcattctggaactaacagaattgcgttgctgagtgttgctgttggattaccagttagtagtcttttctctcttccgtgtaaacgatgtttttcgtttttctcttatcctgacccctttcctctttttcgtttttgaagaatgtgggtggacactttgagtcatggaatactggaatcttgggtccggtggcattgcatgggttgagtcaagggaaaatggatttgtcatggcagaaatggacataccaggtgttttatctatcctattttctcgtgatttctctcttttgatcccttttttctgtattaagttgtttaactctgttttcatcaggtgggactgaaaggtgaagctatgaatcttgcatttccaaccaacactccctctattggatggatggatgcgtccttaactgtacaaaagcctcagcctttgacatggcacaaggtttgattgaatccaacacaactcaacaaagctttttttctaattaagaatctgaactaacgagtatattttgttttatttcagacttattttgatgcgcccgaaggaaatgagccgcttgctttggacatggaaggaatgggaaaaggtcagatttgggtgaacggtgagagcatcggaagatactggacagcatttgcgactggtgactgcagtcattgtagctacactggaacatataaaccgaacaaatgccaaaccggctgtggtcaacctacacaaaggtggtaccatgtgccgagagcttggttaaagccgagccaaaatctgttggtcatattcgaggagcttggtggaaacccatcaactgtctctttggtcaaaagatcagtatcaggagtttgtgctgaagtttctgaataccacccgaatatcaagaactggcaaatcgaaagctacggaaagggacagacatttcatagacccaaggttcatttgaaatgtagtccaggtcaagcaattgcatccatcaaatttgcaagctttggaactcctttaggaacctgcgggagttaccaacaaggagagtgtcacgcagctacctcatacgctatcttagagagggtaaaagatataatctttacacagctaaaactggaatcagactcttcttctttttttttctaaccacggtgtgttttgatatatgcagaagtgtgtagggaaagcgagatgcgcagtgacgatatccaacagcaatttcgggaaagacccgtgtccaaatgtgctgaaacggttgactgttgaagcagtttgtgccccagagacatctgtaagcacttggagaccttaaagacaaccattgagccctttgtctacaaaatgtataaccaaacaatacagagagagttgaagaaaagaaattgtaagctgtgtttaaaatatgtgtgtgtgtgtgttagtttgaacagagacatttgtgggttagagtagtttcagatagataagagagaagagtctgtagagttgtgatgagtctcgggcaattccgtggctcattaaaaacgttcaggccaccggtcaccaccgaccattttaaccggttatggagaccgggattggtgggtctgaatgaagtcagtttaaggtttggttttgatttgtctttgtaatcaactaaagagggttcaggtttaggagaaaggagatcctatggtgacccatttctttcaaacctattgtcgtttcactttctaatttagttctattttccctttttctttttatctaacaaaatatttatgtttcataaactattttttcttcgtaaattataaaagctttttctccgaagttaaattggagaaaatctttaatattaaaaaaatcgagagaaataccctagaatagctattttttttttgtcggcagaatagctatttttccaatatatattttacaataaagtaaaaaataactgaattattccccttaaactaaattatgaaacctttatgacttgaaaccaaattttgacttttaagaagcgataaaattatgctatacgaggttaattatgcaacattatcccaaaaagtttgtttcgaaaatacgaccatgataatctcaataaccgtttaatatctataactaggctataagaatcctatttctattcgaatattctttaaaatccaactttatctcttcttttgcaaaaaaaaaaaaaacttcaatttaagttctatataaaacgttgtcacccatacgtttaatcagaaaacagaaagaaacatactcaaaactttttaagcagcgacgatcatagatcaaatatg

SEQ ID NO: 3681 - DNA, 3000 bp, Unknown
  misc_feature (1)..( 3000): cDNA_ID_2049971_gDNA_ID_1620656_Annot_ID_163677 3000 nt of promoter + ATG
ctttctagtttgctacaaaaggcaggtctgtaactatagttccacctttgtgtgtagatggaaatggtttcaagacaagtacaatgagacttggagctgatgccatggtttttagtcgctcaactcgtggagggtattgatatatctggaacatttactgtctggatttggcggatgctcttgtttttaacttaaacatacttttatcttctctgttttagcaaatctacacagagcattggtcttctgtcctatacattccttaggaaaactggtcaggatgatgtgatcgttcctatggtaaaatcctcagcttatgtagctttttgtttggaaactcatgaatctgcaacgattattttgtcttgatgttatcatatctgcaatgcagattgatttcgatatatccagtgatagcccccaaccaattatttatgggtctcccggagattggtctaccaaccttaacattcttctcaaatggtccccgttttcaacaatggtcgaacttttgcagcaggttgtttcctttaaaaaactctggttccgagtgttatattaacgtggcttgtttattcattcatttatttccattcttcatctaccagttcgaggatattggaacacatggaacaaaagtaattatatacaacttgtggcttaatgatgaaggaatctatgagctgagttttgacgacgatgatgtggtacttacacttccttaaagggtttatgatgaagttttttgcaaaagttgggttttaaagtatttcaattattttccttaatattggtataggatatacggctccgagatgaaaatgcccaggacgggaaacggttgcacgctaaaacattggaagtaagatctcatatttcgtaccgctatcgacattctctaagggtaatccttctgaatatcttctttctaattagttttttttactgttgcaaggatgtgcaaaggctgacatagtttctttatccttaggcttacatttccatgttatatctcaaaaagttcaaaaacttcaaaattattcttcggggagtctctgtggcgcaattcaacattgctgatgaattcagacatcctgagacaataatgtacaaaccccaagcagctgcagtggattatgtaatacaaactaagacttcctctttttctttcgttttactcgctggttttattttaatgttttagactgcgagtgcaaaaccactaagctttcttatttattacaggctgccactggaattaaagttggattcatcaaggaggcccctaaacttccaatttgtggtttcaatgtctatcacaaaaaccgtctcatccgggtacgttttgatgttgcagttatatttatatgctcttaatctcaagaagcaactttcgtaagtttgttagtatattttcacttaagcttccatttgtatatggcttgattaagttgagatctctcttgcaccattacagccattctggaaggtcgttctggaagggtcaacgagaggcaatggtgttatgggtatagtgattcattctccttataatttctatatgtcaattgaatatgttttgtttgggctaaaaccctggaggggagactcattaccaaaatctgttccccaggagttcttgaggcaaacttcatagaaccagcccacgacaagcaagattttgagaggtcttctctatttctgcggctggaggcgaggctgaaaaggataacctctgattactggtctcttcttcctctccaaaacctttttcagtcatctctcaatattttgtcaatatgattttggttccaaactgcaatacctttgtttgactattccactgcttgctatggggaagaacaggcaaaatcactgtcacattttcggataccaaactgctcaaatccctgcagataagtcgaaaaggacagtaatacctgatcaaccgcctactgtcaatacatacaatccttcgcctttgccttctgatagaatcagtcatggtggtcctataatacgtgaaatcaatcttagtaacgccacttcaagccgaacagctgctgttgccgcgccacatttgagaaattacacaggtttaagaaataacttccaacccgtgcagctcaacccacaaccacctgcagctggcgtaagtgaattcagtcaatgatatagttttattcacaagtttgatctaaagtcgatgattttttttttccgcaggatactggaaacaacctcgttggcaagttagcggctgagatacgcgaagagaacttacaactcttcatgaggtatatttacaacaagagaaaaacacatttcagtatcatatctctcttggggatctgaattaaatattattcttcaacaggtgcgaggaatatgtaaagaaagagaatgaagtagaacagacggtaagtttgattccgcagtacaaaacatccgtttattacatggactctaacaccggtatacattggatgataaaacaggtaaagagcttagaaaaagaactggaagaaattaaaagtaaatgtgcacaacttgctctgcttgtggatgctaagaagaaggagatgcaacaagtttagtaaaagcgttacgagttaaaactctctggaacctaaaaaaccctagtttgattcagatttttttggtgttcttgatttttgtttttcaactttcatggtgttcttgtatttgcttaatagcctgtcatgtgcatatatgtaacggtatgtacataagcgtattactcatataaacatttttgagaaatgggcctataagtatttgagatatggagcccaattagactgttgacccaaaaaaagaaacgcaaggcaatgaataatgatgacgaagaagacgtttgcgtttcttcacgctgtagttgaaaagtctgtctagactaatcggagaagacgtttgtttcacaaaattcgaattcgttttctcgattcactttcaccgtcgacggtaatgcctcctatg

SEQ ID NO: 3682 - DNA, 3000 bp, Unknown
  misc_feature (1)..( 3000): cDNA_ID_2049991_gDNA_ID_1620656_Annot_ID_163672 3000 nt of promoter + ATG
agataagagatcctctggcggtgaaagacgggtactttggtcagaaaagctcttaaatttctcacgttcttgttcgtcttcttttctttgtgacgaagacgactctaaagaagtgtcggcgttagagaggtcgagaagatcgtcgacggaaaaatcaccgagaaatgcttctacacactccatttttgtctctagccgtatgaaagcactacaagtattttaaataaaggaggagcgaagcgaatccatatttgaaaaagtttgttcgtgttccaatatattttacacaaatttcattctttctttttcaaaattttaaattctttacgtgtctatcgagtgagagagacagtggagagtggacagcactgattggggtttgtaagcaagagtgggttttaggtttttgtgattttggaagacttgtttggtatttgtctcgttacaaatctcgtaacaaatcatgcattgccatgtcagcatttcacattgaaaaggaaaccaaaaatacgtttccttcgtaagtaaaatgttttttttttttttttttaaatgttatctgaacttatccgtagaattttatttaaagataaccgctctttgtagtcaattcaatttattagagttcttaatgccaaattttaagttcataatattaaaagacagcaaagatttcttcataatttagaactatcatttttgacttaaccatcggcgcagagtttgcaagtctttttaagttcttttactatcaaaataactgaataaagtcattcagaactagtggtattctaacgatctaatggctcaacctaattaatcatgaccgttgaaagtgttgttgggccaaaaatatcgtcggttaatacaactttccctctatataaagctagtttcttgcaaaatatggtttttttttgttaacataaaaaagaaactagtagcacatatatatatatatatatatatatatatttttttttttttttgttgtatcagtatttcgaaggttttacagaaaagaagaaaaaaattaacaataattcatacgtcgagagtaatgattggactatcaggcttctcgggcccactcgaccgtcggtggaaggcccaattttaccaaaacaaacaaaaacgttattagtaagggcctattatttatttcttctttaatttcaaggaaagagtgaccatcatatgttgagcgcgtgaaaatatcgctcatggttatatatttgttttttctttgagataataatttccattagaaaaagtcggtttcaaagttagaaaaaaaacatctaaacattcacgtaaagtttaccaggagcaatggagcataaacatattcaaattacacacatacctaaatagtaaataataataaaatacatagacttgtatttttattataaatataatgaactacattccaaacaattgggtgtttggtctagtggtatgattctcgcttcgggtgcgagaggtcccgagttcgattctcggaacacccctctttaaattctctactgctacatcaatttttttcccctcggattaaattaacgcaagaaagtcgtagactgatgacatacaatatggtggtggctcactaaactgactatatgcctaattagcccgatgggccacatgggctcaatgcaagtcggtaaaaggtggaatgttattgaatgcgatgtatgttggcagaggagtaaccgtacaaattagactattttatacccatgaaatcattatcgttcgataacataagatagtaaactttcatgatctcgttctctatgcatccatctctcatctgtgtagtgtagctttttttttcttttttccccacagtatttatctcgtaaactatactttcatatagtcatatatgtgatatgaacattgacactgtacgtaacttatatgatgattaagtttacatgaaaaccattcaagtttttttaaaagcgtaaatacaaaattacttcatgaaatttacgtttataatttaaaatgaacttcgatttaagttatttgcattcagagaaaatagaaattaattaaatgtagcaacgatgtaagtgatagccataaaaatatcacattctttgtatatcggaaatttggttgagcttttaagtcttgaaccctcggataaaaaaaaatgtacacttgaaaccaatatagcattgctccataaatatcaatatcttagacccaaaaaacgatattgttattccatatcggattttagtcatttcgactattttcccaactatttttcctactgaaagattaattacagatctactattggccccaacatttggttcactagacaacctgtaataatatagttcaagtagtactattcacgtttcaacacactaacttttattgagcttcccaactacatttacaatattaatcgtatcactccacataatatcatctatactctagtttattcgacataaaagcatatttaaaaattgtagatgtgaatttgatagttgacaaaccaaatattttactgtacatatgaatttgatattagttgcccggaagcatttaatgaccggtgccagtaaccagacgtttcggactatgttaggtgagacaatgaatagagacacatcaataaatgtcaccgatacatatacttcatataatctaaagtatttcttgaaaaaatctaacatgtgaactaatgaaaatctatcaattacaacattaaattcaacgatatggacttccatcttcttgataacgatcttcaaaagtaagtaagacagcaaacctatttaatatttttaccttattattccccaactagttccttttccacttttaaccatcaccctataagtggttataactagtaacttgaaatagaaacactctatctctaaaagaggcaaccaaacaaacaaggtctagctttttataaccaaactctgcttctgaacagagttagtcaaagagagagaagcc

SEQ ID NO: 3683 - DNA, 3000 bp, Unknown
  misc_feature (1)..( 3000): cDNA_ID_1808602_gDNA_ID_1620656_Annot_ID_163670 3000 nt of promoter + ATG
actgtgtttgcccaaatcttgaaacagagcattgcagatcttgtcttcgttgtctttaaccatctcgtatatagctccgatctgtgccttcctccacttcagactcctcgtcctcccactcgcaaacgtctctctcatctctctcaagctctcctccacagtctccttcatagcttccatggcttctctctctttgactaactctgttcagaagcagagtttggttataaaaagctagaccttgtttgtttggttgcctcttttagagatagagtgtttctatttcaagttactagttataaccacttatagggtgatggttaaaagtggaaaaggaactagttggggaataataaggtaaaaatattaaataggtttgctgtcttacttacttttgaagatcgttatcaagaagatggaagtccatatcgttgaatttaatgttgtaattgatagattttcattagttcacatgttagattttttcaagaaatactttagattatatgaagtatatgtatcggtgacatttattgatgtgtctctattcattgtctcacctaacatagtccgaaacgtctggttactggcaccggtcattaaatgcttccgggcaactaatatcaaattcatatgtacagtaaaatatttggtttgtcaactatcaaattcacatctacaatttttaaatatgcttttatgtcgaataaactagagtatagatgatattatgtggagtgatacgattaatattgtaaatgtagttgggaagctcaataaaagttagtgtgttgaaacgtgaatagtactacttgaactatattattacaggttgtctagtgaaccaaatgttggggccaatagtagatctgtaattaatctttcagtaggaaaaatagttgggaaaatagtcgaaatgactaaaatccgatatggaataacaatatcgttttttgggtctaagatattgatatttatggagcaatgctatattggtttcaagtgtacatttttttttatccgagggttcaagacttaaaagctcaaccaaatttccgatatacaaagaatgtgatatttttatggctatcacttacatcgttgctacatttaattaatttctattttctctgaatgcaaataacttaaatcgaagttcattttaaattataaacgtaaatttcatgaagtaattttgtatttacgcttttaaaaaaacttgaatggttttcatgtaaacttaatcatcatataagttacgtacagtgtcaatgttcatatcacatatatgactatatgaaagtatagtttacgagataaatactgtggggaaaaaagaaaaaaaaagctacactacacagatgagagatggatgcatagagaacgagatcatgaaagtttactatcttatgttatcgaacgataatgatttcatgggtataaaatagtctaatttgtacggttactcctctgccaacatacatcgcattcaataacattccaccttttaccgacttgcattgagcccatgtggcccatcgggctaattaggcatatagtcagtttagtgagccaccaccatattgtatgtcatcagtctacgactttcttgcgttaatttaatccgaggggaaaaaaattgatgtagcagtagagaatttaaagaggggtgttccgagaatcgaactcgggacctctcgcacccgaagcgagaatcataccactagaccaaacacccaattgtttggaatgtagttcattatatttataataaaaatacaagtctatgtattttattattatttactatttaggtatgtgtgtaatttgaatatgtttatgctccattgctcctggtaaactttacgtgaatgtttagatgttttttttctaactttgaaaccgactttttctaatggaaattattatctcaaagaaaaaacaaatatataaccatgagcgatattttcacgcgctcaacatatgatggtcactctttccttgaaattaaagaagaaataaataataggcccttactaataacgtttttgtttgttttggtaaaattgggccttccaccgacggtcgagtgggcccgagaagcctgatagtccaatcattactctcgacgtatgaattattgttaatttttttcttcttttctgtaaaaccttcgaaatactgatacaacaaaaaaaaaaaaaaatatatatatatatatatatatatatatgtgctactagtttcttttttatgttaacaaaaaaaaaccatattttgcaagaaactagctttatatagagggaaagttgtattaaccgacgatatttttggcccaacaacactttcaacggtcatgattaattaggttgagccattagatcgttagaataccactagttctgaatgactttattcagttattttgatagtaaaagaacttaaaaagacttgcaaactctgcgccgatggttaagtcaaaaatgatagttctaaattatgaagaaatctttgctgtcttttaatattatgaacttaaaatttggcattaagaactctaataaattgaattgactacaaagagcggttatctttaaataaaattctacggataagttcagataacatttaaaaaaaaaaaaaaaaaacattttacttacgaaggaaacgtatttttggtttccttttcaatgtgaaatgctgacatggcaatgcatgatttgttacgagatttgtaacgagacaaataccaaacaagtcttccaaaatcacaaaaacctaaaacccactcttgcttacaaaccccaatcagtgctgtccactctccactgtctctctcactcgatagacacgtaaagaatttaaaattttgaaaaagaaagaatgaaatttgtgtaaaatatattggaacacgaacaaactttttcaaatatggattcgcttcgctcctcctttatttaaaatacttgtagtgctttcatacggctagagacaaaaatg

SEQ ID NO: 3684 - DNA, 3000 bp, Unknown
  misc_feature (1)..( 3000): cDNA_ID_1821468_gDNA_ID_1620656_Annot_ID_163666 3000 nt of promoter + ATG
aatgtgttcttactttatcttacaaaatacctgaagaataatcaatcttatgaattgctactttaaaaaaaggttttttttcctgaatacatttttttttaatgtgtatgctattttaatattgagcaaatatcagctaagcatatatttgtatattaaataaaaaaccaatatcttcatttgtttcggaaaaatatccaaatataataattataatattcaattgtgcaaatgtgacaaatcaaacatattttcaaaccacttttaagtgttaatcatattgaataaatagctaaataagggtcttgataaataaggataaatatcgcagtgtgtgtttaaagacttttgatagtttgatttttccttattatactaatcaaaggtgaaaaggaaatgtgtgtctttttgcgagtagttgttggcttcagacagttcatagcggagttactctatacgcgaagtacttgtctcatactgataattttgatggcaattaaggctttaaaagcttatgtattttcttataaccattttattctgtatatagggggacagaaacataataagtaacaaatagtggttttatttttttaaatatacaaaaactgtttaaccattttatttcttggttagcaaaattttgatatattcttaagaaactaatattttaggttgatatattgcagtcactaaatagttttaaaagacacgaagttggtaagaacaggcatatattattcgatttaattaggaatgcttatgttaatctgattcgactaattagaaacgacgatactatgagctcatagatggtcccacgacccactctcccatttgatcaatattcaactgagcaatgaaactaattaaaaacgtggttagattaaaaaaataaattgtgcaggtagcggatatataatactagtaggggttaaaaataaaataaaacaccacagtattaaatttttgtttcaaaagtattatcaatagtttttttgcttcaaaaatatcacaaatttttgtatgaaatatttctttaacgaaaataaattaaataaaatttaaaatttatatttggagttctatttttaatttagagtttttattgttaccacattttttgaattattctaatattaatttgtgatattattacaaaaagtaaaaatatgatattttagaatactattatcgatatttgatattattgaccttagctttgtttgggtggagacatgtgattatcttattacctttttattccatgaaactacagagttcgccaggtaccatacatgcacacaccctcgtgaaacgagcgtgacttaatatgatctagaacttaaatagtactactaattgtgtcatttgaactttctcctatgtcggtttcacttcatgtatcgcagaacaggtggaatacagtgtccttgagtttcacccaaatcggtccaattttgtgatatatattgcgatacagacatacagcctacagagttttgtcttagcccactggttggcaaacgaaattgtctttatttttttatgttttgttgtcaatgtgtctttgtttttaactagattgaggtttaattttaatacatttgttagtttacagattatgcagtgtaatctgataatgtaagttgaactgcgttggtcaaagtcttgtgtaacgcactgtatctaaattgtgagtaacgacaaaataattaaaattaaagggaccttcaagtattattagtatctctgtctaagatgcacaggtattcagtaatagtaataaataattacttgtataattaatatctaattagtaaaccttgtgtctaaacctaaatgagcataaatccaaaagcaaaaatctaaacctaactgaaaaagtcattacgaaaaaaagaaaaaaaaaagagaaaaaactacctgaaaagtcatgcacaacgttcatcttggctaaatttatttagtttattaaatacaaaaatggcgagtttctggagtttgttgaaaatatatttgtttagccactttagaatttcttgttttaatttgttattaagatatatcgagataatgcgtttatatcaccaatatttttgccaaactagtcctatacagtcatttttcaacagctatgttcactaatttaaaacccactgaaagtcaatcatgattcgtcatatttatatgctcgaattcagtaaaatccgtttggtatactatttatttcgtataagtatgtaattccactagatttccttaaactaaattatatatttacataattgttttctttaaaagtctacaacagttattaagttataggaaattatttcttttatttttttttttttttaggaaattatttcttttgcaacacatttgtcgtttgcaaacttttaaaagaaaataaatgattgttataattgattacatttcagtttatgacagattttttttatctaacctttaatgtttgtttcctgtttttaggaaaatcataccaaaatatatttgtgatcacagtaaatcacggaatagttatgaccaagattttcaaagtaatacttagaatcctattaaataaacgaaattttaggaagaaataatcaagattttaggaaacgatttgagcaaggatttagaagatttgaatctttaattaaatattttcattcctaaataattaatgctagtggcataatattgtaaataagttcaagtacatgattaatttgttaaaatggttgaaaaatatatatatgtagattttttcaaaaggtatactaattattttcatattttcaagaaaatataagaaatggtgtgtacatatatggatgaagaaatttaagtagataatacaaaaatgtcaaaaaaagggaccacacaatttgattataaaacctacctctctaatcacatcccaaaatggagaactttgcctcctgacaacatttcagaaaataatcgaatccaaaaaaaacactcaatatg

SEQ ID NO: 3685 - DNA, 3000 bp, Unknown
  misc_feature (1)..( 3000): cDNA_ID_3071625_gDNA_ID_1620656_Annot_ID_163664 3000 nt of promoter + ATG
actcaaaccttagatcactactctccatctgtaatcaatcttcccaatttcgtttcttcttcgattttagtttctgtttctctttcgttattgaaattcaaaattcgctgcaaaatcctagttaccagttccagctgtttctaattttatttcaggatcatcgcaaattcagacagagatactatgaatatcttgaccatttacgagttcctgacggacctatctttctcatgatttgcggcgaaggaccttgcaatggaatcaccaataactatattagtgtaagatatttttccgtgaaacatatccatttgattgattaatttattctcataatctctgaaatttgcattggttttgtttgttaaacatgttcttcaggtgttggcaaagaagtttgatgcaggcattgtttcactcgagcatcgttactatggaaagagctcaccatttaagtcgttagccactaagaatctcaagtatctttcttccaaacaggccctttccgatttagctactttccgccaatattaccaggcaagtagtagtcttatactcttatggttattactttctctaggatcaaatgtttaagaagctgcgtttattagcatgttttgggatttgtttgtggatgcaggactctttgaatgttaagtttaatagaagcagcaatgttgagaatccgtggtttttctttggagtatcttattctggagctttaagtgcttggttccggcttaagttccctcatttgacctgtggaagcctcgctagttcagcagttgttcgtgctgtctacgaattccccgaatttgatcaacaggtattcgttacaatattcaactttaagtgaagaaatgttgtgtttcttcatatagagtttagttgctgacagaatcgagatttttataccttattgaatagatagctgagtcggctggaccggaatgtgaaactgcgctacaagagactaataaactcttggaactagggcttaaagtgaataacagggctgttaaagctctcttcaatgccacggaggtctagctttactgtttctgttttcttttgtttgaatcttaaggaagtaagaagtctatctccaatctgattaagtttctgaaatctgtagcttgatgttgatgctgatttcttatacttaatagcggatgcaggagttatggcggtaagcaggttcatttcatatttataaaattttcattttctttctagttttagatgtttatctggcagattcaatacggaaacccagataaactatgtgtaccactcgtggaagctcaaaagaatggtggtgatttagtggtaagttctttgtttttttagatcgctctttacttatgcttggtgtatatatattgacattcatcatatggtttgcaaacagaagaattgtatttggtgatacataacattggatgtgttaatgcaggaagcatatgctaaatatgttagagagttttgcatgggagttttcgggcaaagctctaaaacatatagccggaaacatctactagacactgcggtcaccctagagagtgcagataggctttggtggttccaagtttgtactgaagtggcttatttccaggtggcacctgcaaacgatagcatccggtctcatcagatcaatacagagtatgcacagacccaagcttatatatcatattcagaattctgattttgtcgtttctatttattgtcccatttacacttcttttcatttcataggtatcatttggatctatgcaagagcctctttgggaaaggtgtctaccctgaagtcgatgcaacaaacttgtactatggaagcgataaaattgctggtatgtaatatcggaaaacttctcgacgatccttttagacttgtgcacattccaacagtttcttcgcatcttcttattctcaattttgtagcgaccaagattatcttcacaaatgggtcacaggatccatggcgtcatgcatccaaacaaacctcatctcctgaccgtaagtcttcatttagtttgatcaaaatcgcatagcaataactcaggcatagcctatgtcgttatgtagcagtattcagacaaatcctttgtctgggacactaaaaagataatgtttgatgacacagtgccttcgtacatcatgacttgtcacaactgtgggcatggaagtgatcttcgaggatgcccccaatctgcaatggtcattgaaggtatattaccggcttcttctctgtttccgatgcctgaagtcaatgacaagcatcagaacaactgttaagaaaatatgatgtcccattcttttcctgtttttttcctcccatttgcaggtgatgcccagaattgcagttcaccagatgcagtgaacaaagtgaggcaacatatgataaaacacatcgacttgtggctctctgagtgtcgtggataggttaggtcgtgcagagattaggagttccatgcagagtcacacgaactgcgttctgcaaataaataaaacatcagatgtacgctccaaacttatatctgtgtaactgtaacctctgaaactgagtcacgtagcaagtccactcggtatctcgattttaagctttcatccactaaggcgaatacagtagcacgagatatggccactcgggaatggaggttcagattctatctcttaatcggtggtccatcttggcttctgcctctcattgttgaagacaatcgaccttgtgtcaagttttatctgttttgccctgttttaattgtttggttgttctgttactctgtttccatctttggttttaatttctacgacgacaaaaaaaaaaaaaaaaaaaaatttaaagtccgcgttataaaaaaaaaaatgatttttgttacaaattactaattagggaaacattattctaatcattatattgtccttgcaatttataagtaaaaacatttcttttctggtccactcgttttaacttccggcgatcgattttcacggcgagaa

SEQ ID NO: 3686 - DNA, 3000 bp, Unknown
  misc_feature (1)..( 3000): cDNA_ID_3071629_gDNA_ID_1620656_Annot_ID_163662 3000 nt of promoter + ATG
aacgcagttcgtgtgactctgcatggaactcctaatctctgcacgacctaacctatccacgacactcagagagccacaagtcgatgtgttttatcatatgttgcctcactttgttcactgcatctggtgaactgcaattctgggcatcacctgcaaatgggaggaaaaaaacaggaaaagaatgggacatcatattttcttaacagttgttctgatgcttgtcattgacttcaggcatcggaaacagagaagaagccggtaatataccttcaatgaccattgcagattgggggcatcctcgaagatcacttccatgcccacagttgtgacaagtcatgatgtacgaaggcactgtgtcatcaaacattatctttttagtgtcccagacaaaggatttgtctgaatactgctacataacgacataggctatgcctgagttattgctatgcgattttgatcaaactaaatgaagacttacggtcaggagatgaggtttgtttggatgcatgacgccatggatcctgtgacccatttgtgaagataatcttggtcgctacaaaattgagaataagaagatgcgaagaaactgttggaatgtgcacaagtctaaaaggatcgtcgagaagttttccgatattacataccagcaattttatcgcttccatagtacaagtttgttgcatcgacttcagggtagacacctttcccaaagaggctcttgcatagatccaaatgatacctatgaaatgaaaagaagtgtaaatgggacaataaatagaaacgacaaaatcagaattctgaatatgatatataagcttgggtctgtgcatactctgtattgatctgatgagaccggatgctatcgtttgcaggtgccacctggaaataagccacttcagtacaaacttggaaccaccaaagcctatctgcactctctagggtgaccgcagtgtctagtagatgtttccggctatatgttttagagctttgcccgaaaactcccatgcaaaactctctaacatatttagcatatgcttcctgcattaacacatccaatgttatgtatcaccaaatacaattcttctgtttgcaaaccatatgatgaatgtcaatatatatacaccaagcataagtaaagagcgatctaaaaaaacaaagaacttaccactaaatcaccaccattcttttgagcttccacgagtggtacacatagtttatctgggtttccgtattgaatctgccagataaacatctaaaactagaaagaaaatgaaaattttataaatatgaaatgaacctgcttaccgccataactcctgcatccgctattaagtataagaaatcagcatcaacatcaagctacagatttcagaaacttaatcagattggagatagacttcttacttccttaagattcaaacaaaagaaaacagaaacagtaaagctagacctccgtggcattgaagagagctttaacagccctgttattcactttaagccctagttccaagagtttattagtctcttgtagcgcagtttcacattccggtccagccgactcagctatctattcaataaggtataaaaatctcgattctgtcagcaactaaactctatatgaagaaacacaacatttcttcacttaaagttgaatattgtaacgaatacctgttgatcaaattcggggaattcgtagacagcacgaacaactgctgaactagcgaggcttccacaggtcaaatgagggaacttaagccggaaccaagcacttaaagctccagaataagatactccaaagaaaaaccacggattctcaacattgctgcttctattaaacttaacattcaaagagtcctgcatccacaaacaaatcccaaaacatgctaataaacgcagcttcttaaacatttgatcctagagaaagtaataaccataagagtataagactactacttgcctggtaatattggcggaaagtagctaaatcggaaagggcctgtttggaagaaagatacttgagattcttagtggctaacgacttaaatggtgagctctttccatagtaacgatgctcgagtgaaacaatgcctgcatcaaacttctttgccaacacctgaagaacatgtttaacaaacaaaaccaatgcaaatttcagagattatgagaataaattaatcaatcaaatggatatgtttcacggaaaaatatcttacactaatatagttattggtgattccattgcaaggtccttcgccgcaaatcatgagaaagataggtccgtcaggaactcgtaaatggtcaagatattcatagtatctctgtctgaatttgcgatgatcctgaaataaaattagaaacagctggaactggtaactaggattttgcagcgaattttgaatttcaataacgaaagagaaacagaaactaaaatcgaagaagaaacgaaattgggaagattgattacagatggagagtagtgatctaaggtttgagtgaaccagagctcatccctcgtcaagtacttgctacttttggacaatccatgagaaatcctacgaggttgcagtaacccattagaaaagcttaaatacgacaagagcaccgtgaaggtggtaagtaaagcaaagccaagctccgacgacatttctcgccgtgaaaatcgatcgccgtagtttaaaacgagtggaccagaaaacaaaacaaaataatgtgattttctctgtttgtatttgtttttaaaaaaaaaaacttgcaaggacaatataatgattagaataatgttttttcccctccaacaaatagtatcatttttttagtaaatgcatggattatagtgcggacttcaaattatctacagaaccagatttttgtatttcttttactttaactttactctttttctgctcattctctctcccagaaaaaaaccacactcatggcgacacttctctcaccttcttcaagctaagttttcattttgttcactgccacagatctatg

SEQ ID NO: 3687 - DNA, 3000 bp, Unknown; identical to SEQ ID NO: 3677
  misc_feature (1)..( 3000): cDNA_ID_1821490_gDNA_ID_1620656_Annot_ID_163660 3000 nt of promoter + ATG

SEQ ID NO: 3688 - DNA, 3000 bp, Unknown; identical to SEQ ID NO: 3676
  misc_feature (1)..( 3000): cDNA_ID_1821494_gDNA_ID_1620656_Annot_ID_163659 3000 nt of promoter + ATG

SEQ ID NO: 3689 - DNA, 2202 bp, Unknown; identical to SEQ ID NO: 3674
  misc_feature (1)..( 2202): cDNA_ID_2687174_gDNA_ID_1620656_Annot_ID_163657 3000 nt of promoter + ATG

SEQ ID NO: 3690 - DNA, 3000 bp, Unknown
  misc_feature (1)..( 3000): cDNA_ID_1821472_gDNA_ID_1620656_Annot_ID_47859 3000 nt of promoter + ATG
atgcaggactctttgaatgttaagtttaatagaagtggcgatgttgagaatccgtggtttttcttcggagcttcttattctggagctttaagtgcttggttccggcttaagttccctcatttgacctgtggaagccttgctagttctgcagttgttcgtgcagtctacgaattccctgaatttgatcaacaggtatttgtttcaagattaaactttaaatgaagacatggtgtgtttcttcatatagagtttagttgctgacagaatcgaaatttttgtgccttattgagtagataggtgagtcggctggaccggaatgtaaagctgcactacaagagactaataagctcttggaactagggcttaaagtgaataacagggctgtgaaagctctcttcaatgccaccgaggtctagctttgttgtttttctttctattcgttggatatttaaaaaattatggaagtcaaaagtctgtctctaatatgtatatgtttctgaaatctgcagcttgacgttgatgctgatttcttatacttgatagcagatgcagaagttatggcggtaagcttgttcatttcgtactcttatgattttcattttctttctagttttagatgtttatcttcaaaaattttggcagatccaatacggaaacccagataaactatgtgtaccactcgtggaagctcagaagaatcgtgatgatttagtggtaagttcttttctttttagatccctctttgcttatgcttggtgtatatatgatcaatgattgatcatatatgctagaagaactcgttttgcaaactaaatatttgtatttgctgatacattagatgtggtgtattaatgcaggaagcatatgctaaatatgttagagagttttgtgtgggggttttcgggctaagctctaaaacatatagccggaaacatctgctagacactgcggtcaccccagaaagtgcagataggctttggtggttccaagtttgcactgaagtggcatatttccaagtggcacctgcaaacgatagcatccggtctcatcaaatcaatacagagtacacacagtcccaagcttttatccataacttttttcatggtttatatttattgtcctgcttacgtttcttttaatttgataggtatcatttggatctatgcaagagtctgtttgggaaaggtgtttaccctgaagtcgatgcaacaaacctgtattatggaagtgacagaattgctggtatgtaataacggaaaacatctcgatgctactcatatattttcgcacattccaacagtttcttcttattcgtaatttgcagcgaccaagattatcttcacaaatgggtcacaggatccatggcgtcatgcatccaaacagacctcatctcctgaacgtaagtctccatttagtatgatcaaatccttataacattatctcaggcttagtctatgtcgtacagtagcactcagacaaatactttctatgcgacactaacaagttaatacttgacgacacagtgccttcttacattgtgacttgccacaactgtggccatggaagtgatctccgtggatgccctcaatctcccatggtcattggaggtatattactggcctcttctctctttccgatccctgaagtcaaagacagactagtattggaacaactgttaaaaaaatattatttttccctgcttttttcattctcatattcaggtgattccaagaattgcagttcacctgatgcagtgaacaaagtgaggcaacatatagtagatcatatggacttgtggctctctgagtgtcgtggagggattaggagttccatgtaaagagtcacacgaagtcagaaactgcggttatgcaaataaataaaacatcagatgtatgtttcaaacctgtatctgtgtaactgtaacctctgatgtatgtttcgaacttgtctctacggacctaatacagtagtttacacgatgagacgatagaattaccgtcaagccatgaattgagaaagctgtctaaaattattttagtaacatatcagtctctttcgtaattactgtctaaatatattataaattgttacctatcacaaatccgttgtagtctagctggtcaggatactcggctctcacccgagagacccgggttcgagtcccggcaacggagatttttttatttctcgggattgactttgtttgtgaaacgagtcaacagagtgaaggacagatgtctcctgctattggaccggaaggaaaatataacggatgactcatatagtcacggattcatctttctcgggatttcgaaatttgacggtgatctgatttccaacgattttttctcttccatggctttttttcgctgatcggtaaatcaaacgtttgtttcggtttcgatggtggaagctacgtcgaatttgacgccgactcagagatatgcggccggcgcattgtttgcgatcgctttgaaccaagcgcaaatcaaccagactcagccgctgggaaccccggcggcggaagacgacgacggaggcgatgaagagcgaagaagcaattgcagtagcggagattctgtctccgatgaccccagcctttgggtacacgagacgtctggccttcttcgccccgttttcaggtgctttcccaaaatctcttgtcgatctcatcgattttgaaattcctttcgagtcttggttgtctatgaccgttgaaatcatctggttgattagtagttcgctttagctctgtttgtaattcgtttctatccacagatgtcttgagattgattcaccggcttggcttggtctcgagcaaacagcttgctcttctccggctaagcaccacatcggggcggtatggctatttccggagttcaaattttgctgttatggatccgatactcactgttgagttattgttcattaacttctattttgtttttattgtagttcacgaggttactctcagaagaagcgaatgatgcttctgccgag

SEQ ID NO: 3691 - DNA, 3000 bp, Unknown; identical to SEQ ID NO: 3684
  misc_feature (1)..( 3000): cDNA_ID_1821468_gDNA_ID_1620656_Annot_ID_47860 3000 nt of promoter + ATG

SEQ ID NO: 3692 - DNA, 3000 bp, Unknown; identical to SEQ ID NO: 3683
  misc_feature (1)..( 3000): cDNA_ID_1808602_gDNA_ID_1620656_Annot_ID_47862 3000 nt of promoter + ATG

SEQ ID NO: 3693 - DNA, 3000 bp, Unknown; identical to SEQ ID NO: 3682
  misc_feature (1)..( 3000): cDNA_ID_1821461_gDNA_ID_1620656_Annot_ID_47863 3000 nt of promoter + ATG

SEQ ID NO: 3694 - DNA, 3000 bp, Unknown
  misc_feature (1)..( 3000): cDNA_ID_1821457_gDNA_ID_1620656_Annot_ID_47864 3000 nt of promoter + ATG
gattagactctttctctaaaagactcaaatatgccatgttattatcaacaaaaagccacatttaaaggctgagaaaatgacagccattacagtataatataatttcgtttttttctccattattgtctcgttcttgttgttcccatttgctccgatgtactcctgtcatgaagcaaccatccgataattaagaccttctagagaatagacttacaaacgatgtactcctttcatgaagcaaacacctttcaatttcccttattcacataaattgtaaattcatttaatgtattaaagttgactatatagttagagtttcgtggttttcctttgtttgttttctagtttcgtagtttgatcaattacaatcaatatatatttcattatctcatctgcaacgacaatctcagcttttatatggcttacgtccattcaaccccaaccctaaccccaagggacactatttgttatttattcatgaaactaaaaaacaaaataagatatttaatcaaactatatgaagagaaggagagagtttggttgcacacacagaaaaaaaaaaaaaaaaaaaaagaagaagaaagagagagtcaacgcaaaggagaggcaaacacgaacacacacagggctcgagagacctctcgacatgtttaagggacagacagcgagcgacactgaacgtctttttctcgggcctctcccacttatcattcccttccctgtctcttttttttttgtttttcttatttgtataataatcattagattttacaattttaaatagctttttctttccaaaacctttggactggactaacctggatcggtccgatcttgataacgccggttttataaaaatcttaatattttttagggtttaaacttaatttgtacgatcatggatggatcatcatgtggtacgagtccactattaattcttctaaacacctaaacaaaaacgatatacttacatgattgtttctggttggattcgtaggtggcattgtgactacactcgttcatcaatatgggccgatttaaaaatgactagattttttttttctggatcttgaaaatccagactaatccaacaggtttttggtctaccacaacatttcaaacaaagactatttattagaaaccataaacccggaaaaactacgaataccaaatattattacaatagtttgcttcgtcgtttacgtggaaatttatataattcacagtaaaaagaaaggaatacaaaaaagtacacgtaggtggcgcagtgttcccttgtatagccacatagagtccaaagagtaacatgcttttttttttcatctttccttagttttttttttgtaaatatttctttaattattcaaatcactcgataacgatataaatatgatcatttgctacaatcaataaaaagagagcctctttttcactgccccgaatctctctgttttcataactactccatggtgaatgatttgatacactattgactataactctaattcttaatgattttatacacatggatttaagttatgatttatagagggtaacaagcagaatatttgaatgtttttattgcggatatttaaatatataacttaccggaaaaagtggcagtctaaattagaagagcttgttaattatgcatgtaaaattaaatttaaatatggtttagtcatccctttgtggacactattgacgtttttccaaaaattttcttttcacttgtaagtttttttattttaagaatggcttgttttttttaactatttttaaaacaatctattgtctactcaaatagcataagcatcgataaatatatatatatttacatgtatgataatgatatatggaatattttatgaaggaaaaaaagagttgttctgattgatcacaagattacttacctcagaaaaaatctaaatatggctttacttaattagggtaaatgtttgaatacgtaacattagactttcgaaacatattaaccaaacaaatcgttaagaacgctctaataaatttgatcaagatataaccctgaggcagctagatgagcaattactattgtttgagattaaacaaaaaaaagcttaaggacaaagaaaaagaaaaaaagaagaatttaattttctaatcgcgtaggatttcaaattaacctaaattaaatacggttcattaatacgtacggacacatgagctagctttttttttttgataaccacgaaaaaaatatgtatgctaactttcaaagaaaagaattgaattcatccgttttaagataaaacaagcttaagcacattcgccacttggcaaactctggtccatgggatgagaacaagaaagctaggaccggtggatcattccccgtgggtgtgaaactctgagtcggtagagagagaaagaagagatagcagagagagaaagtctttgtttaatcctttttttactttcatacggacagaactagaagcgttttgttcagacaaagccgaagtgagaagaggaaagaaaagcttttcactttgggtttcatagaatctgcaaaaaccaaatcagagtagtggagagagagagagacttaaattctagggatgagcagagcagaggagagagaaatctaaaaacgcccatggcggcgttgcagaaatttatagagaaaaataaagattcataaataagtagacagcttaaattcttctttctttcttctcttctgtttctttttcttcttcttactttctctcacttcaactactcactaccaagaaacacactttgttccaagagagagagagaaagagagatcttgtagaacattcgaatttagattcggagagcagcaacaacacccacaagctaagggagtataaggctgaatttgagtgagaagaagaaggagaaaaaaggataaggatttcatggtaattagggtttctgaattatggatatagttgggtcaagattagggtttgaagttttaggtcttaaaaaatg

SEQ ID NO: 3695 - DNA, 3000 bp, Unknown
  misc_feature (1)..( 3000): cDNA_ID_1821445_gDNA_ID_1620656_Annot_ID_47867 3000 nt of promoter + ATG
acctttatgacttgaaaccaaattttgacttttaagaagcgataaaattatgctatacgaggttaattatgcaacattatcccaaaaagtttgtttcgaaaatacgaccatgataatctcaataaccgtttaatatctataactaggctataagaatcctatttctattcgaatattctttaaaatccaactttatctcttcttttgcaaaaaaaaaaaaaacttcaatttaagttctatataaaacgttgtcacccatacgtttaatcagaaaacagaaagaaacatactcaaaactttttaagcagcgacgatcatagatcaaatatgaggatgaacaaaattttacttgtttttgtgtttctaagcattgccactgtaatcaatagtggaacaacaagcaactttgtccgcacagctcaaccatcaactgagatgtctctcgaaacttttccatctccggctggtcataatgctccggaacaggttttgatttcttagttctactttttgattttctggttcttagatcataaatttgtgtttggtaatttagggtttaagtttctgaatttaaaagtatcaatatcagtaaggtctgcacatgggaataattagtaacgattaattatgttttacgtacagaggccacacgttgttttttctattattatttttgtcttttttgttgaagtccctgattgtatattttgtatcttaacaaaacaattaatccatcttgatttcttgtatctttggctaggttcatatcgtccaaggagattacaatggacgtggtataatcatatcgtgggtgacccccttaaacctagctggttcaaacgtggttacttattggaaggcagttgatggtgatgtgaaaccgaaaaagaagagaggtcatgcctctacctcgtcttaccgattttatgactatacttctggttttcttcatcacgccacaattaaaggactcgaggtttgtaatttgtataatttaacttgttatataagtaacaacatcactttcttgtttcaaaagtttttataaaagtttctttcttatatcttttcggcagtatgataccaaatacatctatgaggttggaactgatggatccgttagacaattttccttcactagtcctccaaaggttggacctgacgttccatacactttcggcattattggtaattaaattttcttttacctatcttttgaaactagatataactaatacttccaactcgatctaataattacattgtgttttgtaggtgatcttggacaaactttagcttctaacgagacattatatcattacatgtcaaaccctaaaggccaagctgttctcttccctggagacttatcttacgcagatgaccatccaaaccatgatcagagaaagtgggattcgtggggaagattcgtggagccttgtgctgcttaccaaaccttcatctatgctgccgggaatcacgaaattgattttgtcccaaacattgtaagttcacattataattctctcaatttattgctttttttctgatcagtagtttcaactttaataaccatatgaatcttaattagggggagcctcatgccttcaagccctacattcaccgttatcataacgcctacaaggcctcgaagagcatatctcctctttggtactctattagacgtgcatctgctcacatcatcgtcctctcctcttattctgcctacggtaattagtaaacacgtaacatctttaagattattgtttcttgttttttttttgaataacgtgttattcatatttcaggaaaatacacacctcaatacgtgtggctcgagcaagagttgaagaaggtgaacagagaagagactccatggcttattgtcatggttcactcgccgtggtacaacagtaataactaccattacatggaaggtgagagcatgagagcaatgtttgagtcgtggttcgttaacagcaaggttgatttggttttgtctggtcacgtccattcctatgagagatccgaacgtgtctccaatattaaatacaacatcaccaatggcttgagctatcctgtgaaagacccttctgctccaatctacatcactatcggagatggaggaaacattgaaggaatcgcaaataggtaaaaaagaaaaacattttatttgattgctttgttgtcatattgttgatatgatactaagatcttgttgtggctttgatctaattttgcagttttactgatccgcaaccgagctattcggcgtatagagaagctagttttggtcatgcagttttggagatttacaatagaactcacgcatactacacatggcataggaaccaagacaatgaacctgttgccgctgattcaattatgttgcataacagatatttctttccagtagaggaattagaatctggcaacactagggcctaaacttctttagtcgttggtttcatttagaactttatttttttttgttttctttttagattacgtattttgttttctgcttggatttttgctgttcttttatttatttacttttagactttaataaagtttgtgtttgatttttccaactctcaaaatatctcggatcagcttaaacaatttttgtgaagtactatcatactatcattaacacttttggattcagtaattaatttatgttcgatacataatctccagacattatatatctaatgggttatagccttataggcttttagcatagttgggcttgggcttttgacccaactaggatttagtgatctgcaccgtaagagcaaagcctttttttttttttttttttcgccataagagcaaagctatatacagtatcggagattaaaattttcttactattagttaaactgactcttaaagcaaaagctctagtgatctgcacacaacgcgttgttttagtttcaaatagggaaacatcacgctgttttgttcgaattcgttttgtcgccgtcggtaatg

SEQ ID NO: 3696 - DNA, 3000 bp, Unknown; identical to SEQ ID NO: 3680
  misc_feature (1)..( 3000): cDNA_ID_1821441_gDNA_ID_1620656_Annot_ID_47868 3000 nt of promoter + ATG

SEQ ID NO: 3697 - DNA, 3000 bp, Unknown
  misc_feature (1)..( 3000): cDNA_ID_1821437_gDNA_ID_1620656_Annot_ID_47869 3000 nt of promoter + ATG
tttagatctagcgttacacataggtcgatatagctagcacaagaatgaaaactaactttatttgtcttgggaacaagcgaaagatcgaaactccgacagacgtaatcttaattcgctgagaggcgtgtgagaattgcctttttccttgaatataaaatgcactcccataatgtaatcaaacaaaagatataaatagaataagaaaaataacaactcagcgtaacggagtccgattaacggagtgagaaatcatctggtttctcgagagttctaagccaatgataatcgaaggaaacgaacggtgttgtgtgtgtgtggttaagaaaagaacaaactcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatg

SEQ ID NO: 3698 - DNA, 183 bp, Unknown
  misc_feature (1)..( 183): cDNA_ID_3093431_gDNA_ID_1620656_Annot_ID_47871 3000 nt of promoter + ATG
ttcatcaaaggtttgatttgtatcccaatcaaattccctggcactagactctacaaatccttaaaggtaaaatatttccttataatacatgagcatatcaatatctgatttcattttgttagtgtgtaaatactagggtttaatacttcaatcatgcaggcgaaagagaggttaataaagatg

SEQ ID NO: 3699 - DNA, 3000 bp, Unknown
  misc_feature (1)..( 3000): cDNA_ID_1014414_gDNA_ID_1620658_Annot_ID_47897 3000 nt of promoter + ATG
taaagtagagataacatgaaagaaagggaaagctaaaactctccagtcagtgggaatcaacagacagtaattatatttgaactcacatagctgaatgttgaatatcaactcatcaaaccgaaaaggcaaataataataagtattgacagaatctaacggaggtataccgatcatgagatactcttaatagcgttgaaagtcaaatgtctcagagtctaatttggacgaccaaaaggatcgtaaagcaacaacactcaacgaccatcgaagctaacaaatagctagcttcttataaagataaaaaaaaaaactcaaactttccaataaaaatgtcaactttgagcacaatgcaattgcagagaattcgaaaggttatgaaacattgatcaagtcaatcaaagggaccatcttcagggcatagagttaaacaagaaaaccagaaattgaacctacctggtaaataaaggatgcgactttagtcaaacccaatacaaaaattgagagaagaaatggtggaagcttccatttcacagagcaatcaatttcagaaaataaagagagcagcagaagaagaagatgaagacccacgttggtgctgctaatctcagatacaaacaatgggttcttataaccagagaatctaaaaaagatttgaaaagaagcatcaaaaataataagaaaatgagacaagttggtcatgttaatggtcaaaggaggatcagtcctgggtatatactcttttgttctctcgcctgaattttcttcattatcagagtgacagaaggagagtgtgttctaaaagaaagaagttttctccaaccttaggccttgactattagtttaatcatagtttatctcttaattccctaattatttggtatttaactacattcctcaacgccattattatatcgagtttggccatagttgcacgcatgatctatgtcttcctcacgtctttttgtctcctcccctttatgcatagtggagtggtacaagactttggtagagttcacctacaacattggttcgcatttgaaccgtgatttggccggttcaatttaaacgccggtttacgagttttaacctctggctgattaagtaaccaattttggcaaaatccaaagacgaaggcaaaactctctggctgatcaagaggattcgattaggctctttgaccttgtcaacaaagaccttttagaataaaagcattcaaagtatctatagaagctaaaaacattaaaagttacttatggaaaacgaattggcatgtcattgttccttgatgattgatgataaaaggtggaaaaaactcgaattttaaacttgtcttgtctcgacgctaaaatcttcatcccctgtagtcattcatcatgaaatattcgatcaggacacattattttcaaatttcaattatctaatatctctataaacttaaaatctattattattttcttatgttgattctccttttttccgtacgaaatgtcttcccactttcaaattggttttggagttttcatgctcttgagtctagtattcgtattactattgtgtattctgaatgtaaacgactagtgttcaggtcaatatatcaatgattattttctccattctcgttttgtttgatgcaaaaactaaagaacaaattctgtcaaaaatataagaatatatatcaatattgtgttgcactacataatattctttttactatgaatggccatctttttttaagaaaaaaatggacgaaaaaggcagagtttgtccaatgaaaactggataaatgacattagtaaatagcaaatgacatataatttatttataacttattaataggaaatttgcaaatgggtattttcttacaatttgtttcttttgttgtgtgtgtggtcaagatcttcttttaatacatgatcgagtgtagaaactctaattatatggcgatgatgaaatttgatagtggaagaacttttaaatatgataatttacaatgttgaattagatacaaatatcttaatttattaatggctgaaatgacttgatttattaattacataaaggtttaaatgcaaaagtaacctttgtgtacacatttgttttgaatagtttacaaagttactctaaaataatctgctttgtaatatgaaaatatcattttttggtaaagaatgatattgaaaacatgtttgcaaaacaacagacttacctgtcagatacatacacacatcaacttaaacatagtttgaccacactaaaaatgcctatgttcgttgacattcacgaacaaaagaaaaactatttacccataaattccgtgaaatttttgtctaactatgataaaaatccattattttggattaaaattcaaataaaatccaattgaaaacgctaccgaaactcaaaatgaaaaagacctacaaatatgttttggtttatataaacccatacatatgttacacggaaaaaaagaaaactactattacgtactggttttagacttttaggtttttaaccacatccaaattatccaaattgaatatgaaattttatgatttgatctatgtacacctttagttataataaagcatagtctcttttttttttattatgtttttatttcgtttttggaaactcatatgctgacgtaccaaataaatttgggatatataatccagtattgaaacaattattattataacaacagtggagtagtattttaatgcatttaatggaaaaaaagaaaacagagtaaacggataagcgtgtcgtggagaagaaggaccaaagcaaagtaaagaaagtcatatattcctgaaaatctataaaagacatttcgcatttatccacttcctcgattcaatcaaaactgcttcaagtaaaaagcctacgaaatagcatcggaccaaaagacaaactcaccgagtaaacatacgcaacctgtcgtgtaagtaaaaacaatttgatagtgatctctctatgtttggtggaggaagagggcct

SEQ ID NO: 3700 - DNA, 3000 bp, Unknown
  misc_feature (1)..( 3000): cDNA_ID_1821626_gDNA_ID_1620658_Annot_ID_47898 3000 nt of promoter + ATG
agtcgagaaacgaaaccgaatataagtcttgtatgatatagtcatatagttaaccgtcgtcatatattaaagaagaaaatggcaaccaccggtcggagactccgtcctccatcgcccaataataaccggagccggactataagctcttcaatctctctcccagtgtccttaaacgcctcgttatcgtcttctacttcttcatcttcttcctcttcgccttccaattcaagcaaacgagtgatgataaccagatcacagtccacaacaagatcctccagacccatcggatcatccgactctaaatccggcgagaacataatcccggcgagaaacagcgcatcaagatctcaagagataaacaacggtagaagcagagagtcgtttgctcggtacttggagcaacgtacgcgtggtagtcctcgtagtaacgcttcatcgagaggggtaaagccgggagccagctcaccatcggcgtgggcgttgtctcctggaagactttcgactatgaagacgcctctgtccagctcagctccgacgacttcaatgtgcatgacgccgcctgagtcacccgtaagcaaggccaagataagaagcggtggcggtggagcggtggcaggagttttgaagtacttcatggcgcagaagaaagtatctccggtacaagaggaggattatcaccggtttaggatttttcaaaacagattacttcaatggaggtttgttaacgcaagaactgaagccactatggcaaaccttaagatcaacgttgaggtacaaaaactatatgaaaaatatttaaatttgtatcttataaatatctattaatttgtttctgtgaatggtttcaggatcagttgttttgggtttggcttaggatatacaaaatgaggaactacgttgtagaaaatttgattgaaattcaaaggctccgtcaagatatcaaagtacgtgaagttctcagcctccaaatgcctttacttaatgagtggtcaaaaatagacgcaaaaaactccgaagcgttgagcaagctaactcgaaaactccatgctttgtctgtccgattacccctcgtacatggtgccacggttagaatttctctctttgggaaaccaatttgtttataaacattttgtgtatttgtcaagaaagcagaaactaataatttggaagttacagatagatatggtgtcgatacatgaagaaatggtcatagctatagaagtcatggacgagatcgaagacgtcatcatcaagtttctcccacgagtaagtccactttatctatacagatcattttcctaactttttttgtatagatacatgtaaaagaaattaatttaagaatgtcttgggtgattaaatatcagcaggttgaaataatcctctatgagctgacagaattgatcggcatgttcaatcaagaattgttatattttgaagaaatggacgagagccttttatccattcctctcttcacggtaattcattatctcctaatttcattatatatatgtgaccggtccggtagttttatctataacttgaatggtttgttttttattggttcaatttggatgtggaagctccataggctaaaatggtgagataattttcttttaacaggcaaaggagagtagcttgagggtccatattctccaaaagactgaagaacagagataatgtttctctaataactcaaacgttaggacatgtaattaaaatgttaatcacattgcacattttgcaaactggattgttgttgatgccagaactcgctatctaattcaagacgcagtcttctacttctagatatatacgattgaagccatgtgttaatgtgtattacaaatttcgttatgcaatttctacatacaccttaatgaaaatatacttatacaaaaaattagacatgaaatctaaaaatgtctatccaatcacatatacacacgtagaagtgtttacttctcacaaagaatgtataaaaataataattgtaatttccaaagctataaatataaagattgacttaacttactaaaagcgctattaagtcatttggttatccagctattcagtactacagaggtctcgggttcgaagccatctttttcctaaatccccaattttttttttttccctcgtttccgaatcttttaccggcgagactctgccatggattcaggcgaacaaaagtctaaggtaaacctctactgattctatcttcttgttctccttcctaatttcatctcaaatctcgaaaaatttgccgcgaaaattgcgtttcactgaccttactccgttccatttctcgtcagcggaggttccaaccaaatcctccgaggccttctcgccgtcttccgatcgctccaacctcaaacacgtaattcgttcttcctcgatcatttcttgtttatgcttgtagaaatctttaactgcttatacatgtaaaagctttaaattttctctaaacacagcgaagctgaggaggatgaagagaatataaaagcatctcgccaatttgacagacgtatcgtcggcgtatgtagagaagcttctcagttctcaaatcttgctctctagtttctttccttatttaattttgtcgaaaattcgttaacagtttaatcgtaacttccctaatttcacttaaaataatcaaaatcttatacattagattatgatatatgcgaaataccaaaacggtgtgctttcttcatcgtagctaacaaggaattttctttttggttctgacctttactagttttgaatctgcctcatctcctttgctagcttttgttgatcgcatcaatttaactgccttgttaagtgactatgaaatgagttggtccaggacccctaacatgttcattgtagcttatactggcttagttcttatctctattacttaatccaaatgctcaatgttgaaaactaaacttttttgtgttgttgttattgctgactggccagaggagacccaaaaccgaaacgaaaggtatg

SEQ ID NO: 3701 - DNA, 3000 bp, Unknown
  misc_feature (1)..( 3000): cDNA_ID_1808441_gDNA_ID_1620658_Annot_ID_47900 3000 nt of promoter + ATG
ttattatttttatacattctttgtgagaagtaaacacttctacgtgtgtatatgtgattggatagacatttttagatttcatgtctaattttttgtataagtatattttcattaaggtgtatgtagaaattgcataacgaaatttgtaatacacattaacacatggcttcaatcgtatatatctagaagtagaagactgcgtcttgaattagatagcgagttctggcatcaacaacaatccagtttgcaaaatgtgcaatgtgattaacattttaattacatgtcctaacgtttgagttattagagaaacattatctctgttcttcagtcttttggagaatatggaccctcaagctactctcctttgcctgttaaaagaaaattatctcaccattttagcctatggagcttccacatccaaattgaaccaataaaaaacaaaccattcaagttatagataaaactaccggaccggtcacatatatataatgaaattaggagataatgaattaccgtgaagagaggaatggataaaaggctctcgtccatttcttcaaaatataacaattcttgattgaacatgccgatcaattctgtcagctcatagaggattatttcaacctgctgatatttaatcacccaagacattcttaaattaatttcttttacatgtatctatacaaaaaaagttaggaaaatgatctgtatagataaagtggacttactcgtgggagaaacttgatgatgacgtcttcgatctcgtccatgacttctatagctatgaccatttcttcatgtatcgacaccatatctatctgtaacttccaaattattagtttctgctttcttgacaaatacacaaaatgtttataaacaaattggtttcccaaagagagaaattctaaccgtggcaccatgtacgaggggtaatcggacagacaaagcatggagttttcgagttagcttgctcaacgcttcggagttttttgcgtctatttttgaccactcattaagtaaaggcatttggaggctgagaacttcacgtactttgatatcttgacggagcctttgaatttcaatcaaattttctacaacgtagttcctcattttgtatatcctaagccaaacccaaaacaactgatcctgaaaccattcacagaaacaaattaatagatatttataagatacaaatttaaatatttttcatatagtttttgtacctcaacgttgatcttaaggtttgccatagtggcttcagttcttgcgttaacaaacctccattgaagtaatctgttttgaaaaatcctaaaccggtgataatcctcctcttgtaccggagatactttcttctgcgccatgaagtacttcaaaactcctgccaccgctccaccgccaccgcttcttatcttggccttgcttacgggtgactcaggcggcgtcatgcacattgaagtcgtcggagctgagctggacagaggcgtcttcatagtcgaaagtcttccaggagacaacgcccacgccgatggtgagctggctcccggctttacccctctcgatgaagcgttactacgaggactaccacgcgtacgttgctccaagtaccgagcaaacgactctctgcttctaccgttgtttatctcttgagatcttgatgcgctgtttctcgccgggattatgttctcgccggatttagagtcggatgatccgatgggtctggaggatcttgttgtggactgtgatctggttatcatcactcgtttgcttgaattggaaggcgaagaggaagaagatgaagaagtagaagacgataacgaggcgtttaaggacactgggagagagattgaagagcttatagtccggctccggttattattgggcgatggaggacggagtctccgaccggtggttgccattttcttctttaatatatgacgacggttaactatatgactatatcatacaagacttatattcggtttcgtttctcgactcacttgcccctgtccttaagactcttatagtaaagctggaattatatggttcaaggaatcgtctagtctatatacactggtttgaacaattgtgatatataatatagttaggggtatattatatttaatctgttagataacggttggggtacttgaagatctgtaggagttgacagcacgtagaggcagaggtaagaacacttctgcatgtagtgtgtctacataataaaatatagagtgtattttttacacacaccaaaaagagagattataattaatgtattatgtcaaagcatatatgaaggtcagcttagctagagacacgtcttttgtttatctctcgactaaacaacatggcgttttaataaaatcaaaacttaaaaggtccaattcagaacggccccatagtatatagtctacgttgaataaataaacctcaagatagcgtcaaactctttagtctttacccaaaaatatttttttttaaataacgtcaaaactctaagtcttgacctcaacaccaatatatatttgccttctccaatatctgatttttttaattgtttatccgagtcttcttggtcttttcgaatgtttgcccgaaccagaccttcccacgttcggtggttggtggccgcctcggcctttggttgatttctgtccacattttggtccttttcattcatgtaccatgttctagggtcatttgacttgttgaccataaatctactaaaacaggcctaataccgatgggccgtagcccgttaataaacaagacaatttatatttgtttcacttagcttgggagccacggatctctagaaacatccagagaaatatcaatctccccacttctccagaacattcactcactgacaatatcccaccttcaacacttaactcctgtatatagtcctcccctgtctccagtttcgtcgcacacagttctcagataaatactaaactcactgttaaaactttctcaacaaagcttcctgtttctctacaa

SEQ ID NO: 3702 - DNA, 3000 bp, Unknown
  misc_feature (1)..( 3000): cDNA_ID_1821611_gDNA_ID_1620658_Annot_ID_47903 3000 nt of promoter + ATG
gtctatgcggttgggatgtttgtggcaggtcacttgggcgatcgtttggatctcaggacgtttctgaccatcggtatgatcgggaccggccttttcacagctctcttcggggtcgcattctgggcgaatttccacagcttctactatttcttggcggttcaggttatggcggggttgtttcagtcgataggttggccttgtatcgtggctgtgctcgggaattggttcgacaagaagagaagaggaatgattatgggtgtttggagcgctcacacttccctcggtaacattgcagggtctctgatcgcgtctgggctgcttagatatgggtggggttggtcatttcttggcccggcttttctcatgacttttcttgggatcgttgtttaccttttcttgccggtgaatcctccaaccgttgaggcagagagagatggaactgaaattgactctaccatgaggctcggtgacaccattacagagagcttattggaatctagaatgagtactggattcgatagaaaggcagtcgggttcatggccgcttggaaaatccccggtgttgctcctttcgccttctgcctcttcttcacaaagttggtctcatacactttcctctactggcttcctttctacgtcagccacaacagtaatgtttctcatcatctctccttccttttacctctagtgttgtagcctgactatatatgcattgtctgaattatatgtgatgcagtgatcggaggagagtacctgtcagaggagacatcaggaaacttgtcgacaatcttcgatgttggaggcgttgttggtggagtcttagccggatacatatctgatcaactcaacggcagagccatcacagcagcaggattcatgtacttggccatcccagctcttttcctctacagagtctttggacacatctcattgaccatcaatgtcatcctcatgttcacatcaggagtcttcatcattggaccatttgctctcatcacaacagctgtctcagctgatctcggaacccacaaatctctcaaaggcaatgcaagggctttggctacagtctcagctatcatagacggcacaggatccgtcggtgctgcgattggaccagtcctcactggttacatctctgccataagctgggacgcagtgttttacatgttgatgactgcagcattgatctctggattgttgctcactaaactaatcatagcagaagtcaaagcgttattgtttggatcagaagatgaagtagctgcatcatcatcatcaccaccagcatccagacctcccattgatgtcctcgtttgagttttttccttcattatttatcagtttctttgacaatttcacactttttttatccttttaaagttcgttcctttttccccagttgtcttcatttcttaagtttgaatgagaataagattacctaatttggttgtcgaatgatatttaaaccaatcaaaacagctgaaaattgcagcaatcggaataaagaatcatcatttggttctatatgatcatcaaatttcactgaatttacacataaaccttaagaagtagcaaaattcatttttaaaaaaggtacaagagacggtgaattcaccggagaagctgctaagtggaatctgtcaaacgtcgtctctgcttttgggcttgcgatatttctcctcaacttgcttggccattgaaacggcgcagtgaccgagctttttgatgttagggacgttgtaggtctgagcgatgtagatcccgcacactgttcccatgatgaaagagaagctgctccttattatccccatcttcttctccgtagatcggatttttttttttgggtttattgaattggagatattttgatcggagagattgacggaattaaaagcgaaatccgccaagatcatgagaattctggaaattaaaagtcgaagaattgaagatccattactgggcctgtaaggcccaaatatattaaaaatttacatgggctttttgcgttaaatccatatgaatttagcttttgtttgtttttatatgggaaaattcaaactagtcaccaacttaagaaatctttaatgagttaaaggtgtttttggttaaaggggtcatattcaaatttgttggtgtgtcaaaatcaaactattgctcttaaagaaaaaaaatgtttactgagatgtatataacattttgttgttgttaaaaatggttagaaaatattataactagagtttttggtttcaccaaaaccatatataacaaatgaattaaataaattttttgatgttatatagattttttcagtaggcatacatatgttgaaaataaactcaacaaaaaaaacatgtgttgaccgtatcagtttattttctaattaataagaaaagtattctattgttttccaggaaggaagaagatatcgaattttgctctttctacttttcgattctctctcgatcgagaggagaaaaagacagagaggcacggtgacacgctgctttcacagaatttccccaaccgacagacaagcttcgcggattcaggtttttctatgattcgatccatttcttaagaactctgcattttattccttgtaaaatcttcctcctagctcctttcttcaattttcgatttttgatttatattgtttcaattttggatcatatctttttatttcttgtgaatcgggtctttgtacttggtacctctatgtagcatttttggcttctgtacaaatctgatttcacctgtatgcatacgactcaatctaaaagaacccaagttttggattttcctctgctttggagctcaattttctttacattctgaaaaaaaaatcatctttttatggaaatgttcaatttttgtagttgtttgtatcgtccgagtcttaatacttatgagagatcatgtctttgcagatggcgtcatgctaatatgactaaatgagattctggggattaagtttaagtgggaaggctgtaatagttccta

SEQ ID NO: 3703 - DNA, 3000 bp, Unknown
  misc_feature (1)..( 3000): cDNA_ID_1821607_gDNA_ID_1620658_Annot_ID_47904 3000 nt of promoter + ATG
cgttggtagaactgaaaatgaggtgaaccctcgcacagtggaagtctcaagtgatgagcagttagcccgtcagcttgaaagacaaaacaatcctgtacatgcactagccactggattatttcctgctgaggtgccagattctgtcgaaaatgatacttcgaggttcagttcattcttcgttcttgattttcttattaactacaccaaagtaacaatttatttagaacttcatgattcttttcctgcgactcccttgatcttggtactgagatactaaatttgcactgccttaaagtaacgttattttaaaatgttttgaatagcaagttatatttggtttctgacgaccactatttgtgcatatttcttggatttattttactggattgtataagttctcatccctttctttcacaaaataggaatttaggattggatccaagttggctgcagacatggtcaagtcagggttctgatgtcgctggtccttctaccacttccaggacagttggacttgggcgggttcagatgatgatgaggcatcttgcatctgttggcgaaagctatgctcaaactgcacttgacgatgctgcttggagtctatggccgatgaacccttcacaagcatccacttcttctacaactgtacctcctggtaatggtggaaggacaggtggtctgcatctgagaactgtatcaaacacgacaaatgaaagcttaacaaatatactagctatggccgagacagtgagggaagtcatgccacacgtgcccgatgaaattattttccaggtaaattttaagtgcatattggattatctgtaagctttgatgggatgtgcatacatggttgagttgagttggtggctcatttagattgtcttctgcattgactggaaggaactattttttgcatatattcatacctgaagccgaattttatcagtttatgtatgtggtcaatttgcctgaactggtctctatattcactagactggtccttaagctatggatagttcagttttaagattcacgtgacttgatacttgaacctgttatgtttcaatttcttgcaggacctgcagagaacaaactctgttgctgttaccgtgaacaatcttctccagatgtgatgatagtttgtgtaaaatatactaagcacttccatttcaaccttaggtatagattaatgattggggacatatccttatccgtaagttttacacaccacccaacattccaagcttcacccgctgtagatataaggcactgtgtatcactttttgctatagagaagaagaggctctagtgtatagcttctgttcattgctctcttgcgaaaataagttcggatatttacataaggtgatgatgccctggtggtctggagatatcttgttgcagtctgaccttggctccaatctcgagggagagtaaccactctttgcagctgctcttttggctgctgccacctctcctgtataagaatgtgtaatttacaataaagaaaaaagaagtaaatgaaagagtctactgttattgatccaatagcctgtaatgtagtatcatcaaatgtgtgaactcaatttttttttcttctgaagaattatcttcctacattaactctatacccgttttgacgaacggataaacagtgaagagacaaattaacatataaaatataatttgtcataaccatttcgagtagatataatcaatagaaaagtatcatgttggtacttttaacgcaacttcaagccgaaaaagattgtgaagagattgtttctttcgaaggaagcaactttgattttgtccatgccgtgtgtaaattagcaatagcagaagagaaccacttaaacttattttaatacgcttctagatagctctacttggttcgataaatttttatgcacgttaagtaagtttaatctgtttctaataactaaaatatatgatgtagttggcataaaaaaaaccataaaatctattcccaacaaatgaggaatattcacatctaagatattctttttaaaaccaaaggaacaagattaacatgagaccttagacaaagggaatggccatgaaccattccataattccatttagagatagcaagtggcagatatatatgtgtaattcgaaaatatataagtatatttgatccattctagtcttcattaaaagatacacaatattatcatttatcaattaagtggagggactgactctacatcaaagatagaaatagggtaatttagttaagcaagactcaagtatcaggaagtgagatcactactttgcaacaatctcttgatagccatctgaaatcttcttcagatgctaatctcaactcatggaaacatccatggcacggtgtattgacataatgtagcaagttacaaacttacaatgcaacatatggggaaaatctgaggaaaaacataagaaacgatgaacaacataaacttaactaataagaataatgtggtattatatattatgaaaaaattcaataatctgtttttaatgtaagttaaatcccgaccaagaaatgataaaaaagatatttgttcccacattcttctggtacatgtttccaggtcttctcctcaatctttgcattttaacgctcttcctttaatacatttttttttacactgtattaattatgagataaaccccaaaaaaagtacattggtacacaagcataaatacaaaaatatgcatgcttttttcagaactgtttaaaggtaaagcctttttctgcaaattttcttttcgtgtatgaccaaaaaaaaaaaaaaaaaaaactttattctaaaaaataatagaaaagtagtgtgtcttcatattgcagtgtcttgtaagaagaaattcaaaaacccacactgacactttaacacattgcttcgtcttctctaccgtttcgatttcactcttaattatgtcaaatccgtaagcttttgtgatcatcaacaccaaaaaaaaaaacctaacttt

SEQ ID NO: 3704 - DNA, 3000 bp, Unknown
  misc_feature (1)..( 3000): cDNA_ID_1821595_gDNA_ID_1620658_Annot_ID_47908 3000 nt of promoter + ATG
tgttgatggaagtttagggaagaaggttgataactctgtttttgtcacaagtaaaagagatactgttggaggtggaaatgaggttgtactgaatgctctagcaggatacttgaggtacttggagggtacaagtcgagatgactggcaagagtacgtggttattcttaattctggcgttattgtgcttcccagatgcttccatatgaaagtggttattatggaatgaatctggtatattttatatcttgttgaagagtgatgggcgttggttttgatgttgaccagggtccatgcgagacttcgtgatgccgagactaggcccggagcttcatttttcaaactttttggacctgtcctctgtcttggtatcgtatccagaagaagtgtccactatgaagcaatcgagtatgaaaaagaaaggaatgctggatttatttctccttttggatattcagctgccacagtgtctgctgcaactgatgctgtatgctctatggaggtacaataactcatagacatgatatatctatgctcctactttcttttcgaaaatatttgaagatgttggatttgttttggcagtggtattatctcctggctctaagtagagagaggattgatgaaaaaaggcacgctataaggatttggagatggaagggatatcttattcaggtttctgttattactcatatttctccaagtccaatggcctacattggccatttttgtaatcccactgcttgatctttttatatttgctatggaattttaatagaagtcacttccttgtttcagtacacagtggttggtaatgaagggcctgccgttcttcttgtgcatggctttggtgcttttctagagcattaccgcgataatgtagacaacatcgtaaatagcaaaaatcgagtatggaccatcacagtcttgggttttggaaaatcagagaagccaaatatcatttacaccgagcttttgtgggctgaattactgcgggatttcatggctgaagtagttggggaaccagcacattgcgtagggaattcaatcggtggtatgcaccctaagttattgagatgtaatatatgcgttaaaatggcacaaatgattaagatactcctctaattgtatatatattttttcctctatcagggtatttcgttgcattaatggcctttctttggccggcgttggttaagtccgttgtccttgttaacagtgccggcaatgtggtacctggatactctcctctcccaatctctagagtatgtttcatgggaatgcatgaatatctgaattttcacttttcaaaaaaaaaaaaagaatagtgtgggctcaggaattaagttattctaattatcacatcctactgtctttctttttttaggaaaggcgagttccatttggtgcacaatttggttctcgacttcttctctttttcctacaactcaatgtcaaaaagctattaaaggattgttatccagttgtaagtaataggaagatttcaacatcagtatgagaaagtgtaaatgctcatcattgtgtcggatttctaacccaactgcttgtttatgatgcagaaacctgagagagctgatgactttcttgtcactgaaatgctaagagcagtatcctttttttgcattaactgattcatgatctacaagtaaaatattgaagatagtgagattaccttaatacacataatagtctcgagaccctggtgtggttatggtcctggaaagtatctttggctttgatctttcgcttcctttgaattacctactcaaagggtttgaggaaaaaactctagtaatacaggtatcaaaatttcaaacattgtttgcatcctcattctaacttctattaggagattacacaggatcaatattcatcggtttcattcatgtattagggaatggaagatcccatatcggatccgcagaagaaagtagccttactgaaggagctttgtccagcgatggtgataaagaaagttaaagcaggtaaaacataaaactaactgctaaagctctatacacctccgatccactagtctatataccattcttcttgactctggtctcatttgcaagtaaaggtcactgtccccacgatgaaatctcagaagaggtaaatccgattatctgcgaatggatagtgaaggtcactaatgatgatcgagaactaaaagcctcatcatcccagcaactttaccacagtaataaacaaaactaaggatttggtcatcagaaagcagtttttgaaatggtatagtttggttgtgtcaacaagacatcgtcatagatgtcatcaatccaaattgaagaaacatgaccatgttataactcatttaaaaggaaccgtcatttttctttctgactagtatatatattgtttatttatcttttgaagatatgtacaagttttcgtaagcctgaatccgtaatgtcactatttaattatttggacgttatgtcacattttacgtatgtagctttttagcttgtgcccagtgttgtcccctccgaaatttgctcatctctgccccatgtggtagtgcactgcgtttaagcaacatccagaatttcagattatggaagtagggacaagaagctgtggtggaacacgtgctgttttaggaggctaaaaacgacacagcgttcgcgtctttaaatggtaaactttcacgttcgcttttacttgtgtcattttcagttttttgacctattgctaataaatattctcgcaggtcgctttgtgaaatataaacacaaatcccaccaaaacggtgtcgcgagaacgttgaagaaattaatttggcgcactgcttcatcattattttattcttcgtgatctgtttttttccgacgatatttcttgctcgattctgaaaaatctaaaaatccaaaatcgaaacctgaaataaaggaaatcgcagacaagtggaggtagaagacgacgaagaagatgtggagacgcgtggctttactttctccgatg

SEQ ID NO: 3705 - DNA, 3000 bp, Unknown
  misc_feature (1)..( 3000): cDNA_ID_1821583_gDNA_ID_1620658_Annot_ID_163719 3000 nt of promoter + ATG
gagattgaggtataacttaagtttgctcaaaatgttcatggtaagcgatgacaaaaagctttctctatccggcagaataatctgcagatctctagcagacctcgagtttcttggaagtaaaaatctccgtcaagaatgcagcagagaatccaaagcgtgaaactgtaccttctaagaatttggatcttccaaatgcccaaaagtctcattccaatggcttacagcttcttcctgtgttcgcataatccagatatgtttttccgcagcagctttctcttgctcttccagaattctctgcaattgtcaaagcttaaattttcttggacaaaacagacacattcatacacaaacagtagaaactgcaccaatgttatgtgcataaaggacatggtgcagaaggacattgtcccatgttcagaaacaaaatgtatgctaaacataaaagctgcaccaggtaacaccgaattcgaattataattggaaaaagtgtgattcacataactccaaatcatggttatatgagattaagctagtctatgtgatatccaatagatgatgctaaaagacaaaagtaatgaagaatgaatcatttgtaagaacaaagaagctacaaacctcggcttcagaagctctttttgtcttcaaggaaagacaatcaaagaggtcagagaacttcttagtacaatcatcaagttttccaacccggtaatactgctgcatttgataaaatggtgctgcaaaaagagattgtctgagttaaatctatgaaaatcatgtcaaaggaatcaaaaaggtcaatgaagccaagagaacattatagatgaagtgaatgcacataaatcttaaaaattcatttacaaagtgatacaacttgctaaatagtgtctaagaactatgtcattttatacccaaatcgtttcctgtgtcatcgccattgctggttatgttggaccatctagacatcccttcatcaaaacatacattgaggaaatggtttcagagatcctttaattggtgtaaagctaatccatttctaaactctcaccaaggctttttattagtctataacaagctcgttaacaattccaaaaggcaaatgacaaagcaaagattggtatatgactgattgatcaaatctcaatcaagttcaaattttgtgagctcaggatatataattttgcagtttagagatggtgagaggagatggaatagaagatgtagaatcagagaatgcgatcagatgaggagaaacgaagacttacaatagcagaaccagagagcgtcgaagcatttagtgcaggacacgcgccgtcgcacagatgaagagtcttcgttctccgagctcatcgtgtctgcttagtgccggaagaagaaacgggtcaggtgttgttgtattcgggtttagatttagggtttttgccaccaatcatgtttattttttcctttctctctttttttttttttcctttaacaccaaaataaaataaaataaatacatcaactataaaatcaaaataactcaaacaaagaaatatattcaaaggataatttttaacaaaaatataatttaaaagactttaattggtaagattgcataatagcataataacataatgatataagttgcataataaaaattcgtaaaatgaaaacttgcagaatgaaaaatcgtagaataaaattatttttaaaatatgttggttgattttatttggaagagaatattatacgagtttcatttcattttgcatatcaatttatttatttttacgattgtacaatttttatatgttaggacttttgacatctcatatatgtatgtaacatacatataaaatacaaaagtacttgtctactacagaaaatcaaagaataattttttggcagatacatgcgaatacaatttagatttcaagaacaaaactcttactagcaaaggattcttgacaaaatgtgatagctagtcccatggaacaacaatggaggatagaccggtttatatcatcaaaatcttatcataagtcaaacgtgtgagatgatgattcatggacaagtgaaaatgaactctgacacgtaaaagaaccagagtttgtgaaagtttgggaggaatatttcttcaaagggtacttcatctttagtcgtcaaccagattaccacactaaagtgatatattatgtctctatttttaataatgttaatattgtagacaacgaaaaaaaagaagcaaattggcatggctcaaacgttacgttagctccttctttacagcttttttttttcctattttaatatccccaaaaagatttacttactaatacagaaaaacattagttgaccaacaaaataagtacatatttatcccaattgtttggttcgtaaccaaattacaaaaactaatttcacctaacgctataatatcaaccaaaccggaacaaattttctcccttaaccaagtaattaattattcgaattaagtcaaaatttttcattttattttattcaaacctacagttacattttttcctttatttctctctctttctttttctacataacaaaaattataatatcccatctgttttattccatagttttatttttgttttctctttccatttcttgccaaaaccctaatttcaccttcacttaagaaatttctcccccaacttaaaccacccccttagaaaaaataaacaaaaaaaattagatctttcttgtttgcttataatatgtatgttttaggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccgg

SEQ ID NO: 3706 - DNA, 3000 bp, Unknown
  misc_feature (1)..( 3000): cDNA_ID_1821587_gDNA_ID_1620658_Annot_ID_163717 3000 nt of promoter + ATG
gcaaatagccaacatctctctctctctctctttcactttttctcatctgtttttttgatagatcaagaaacctgactataatatgagtgataacagaaacctgaagaagagtgcccttccatctccaaatccctatagagggccttttattcataagtcctctctctatttagagccacgagagagattaccactgccaaaacaaatcaaacagcttcacatattttgagatatcatgtcaacggattagtagcttccatgaactggaagcagtgagactagagaagactcgttcaagtgttgtggtccgcagagaaacaccaacgacgtcgtacttcacttattgctccagtctttgagcaaaacgctaaaaccttttggtacaaaaggacttaccaattattatttttcatttcttagatccgactagtaaaagagaggaattcaaagcaaaagttgagaagaaaagaaaacaactcttagaggagaaattgtcaaacaaaattttttagtgagaaagttctcctatatatgtcgacagaggaattgggcaaatacattttagtgagaaagtttctccaatgagtcgacagaggaattgggcaaatacattctaatggctgtgggtattagagtaacttttttctggaaagtttaatattatttccagtcatcgaatcattgatgtaagcaactaagcattagagatgaatagtatacgagttgttctcattttcacgttttcagaacgtgattccgccaggagcggacccatatgggggagttgccactgtcaaatattttgaaactagtgttattttataaaagatttttattgtgcccctattaaatacactatttattgtccccattattttttatttttttacagccaccttttaatacaaaattggcgcaagttttgacttttgtattatattgtattaaaatttaaaaatttattttattatataaagtttcgttgaaaaagttactatgataccgacatatatcaagtcaactgatcagattttgatacgtataaaacaaatagtacaataaattataaatcctaaagtaaaaggattgcaatttttaaaggtatataaaaataaaataatattttataattgctaattctgaaaagaaaaaactacaattattattctttgaaaatatatattgaatagaaattatatatacaaaaaaataaaatcatataatcttattatataacaattgatgtttcaaagttattaaatgatttctatatgtgttgcttaattgatgagattttgatttgtaagaacatttctcccaattatattttgacacatgctattatgctaatataaaaataaaactcacatatctttaacataaaataaaataatataaatatatattaaagtatataacttaaaaggatatatttcaattaaaataatatttataaaaataaaaaaacttacgaaaaagggaaagtgtaaaaaagcttacaattacaaaaaaatatattaaaatgaaattatacggaacaaaaaaataagtaatatatcttataatataatgtttgatgtttcaagcttagtaattaatgattgtgtcatttttatttataactatgtgataggagtatgtaaactttttcttttttaggtaggagtatgtaagatcaatataagtttatttttatttttatctcagctttgaattatctaagcatcatatatcattgtgcttaaaaaaaaaaaaattaatgatgtcaaattatttttcttttaatttcgcaacatttattggtatgtaaacattcatcgtaattgagtagcttttctttattttagttttcttaaaaacatcattaattattgttgtgtgatatatttttcaattgattttttatgtcggaaattttaatgatttaaaaaactatacaagattgaaagtaagagatatattgttggacgtaaaaatagaagacgtgttgttggtttaatgtgtatataaacattttataagtagtggcaaagaacatatttcaacagtaaaatatgattgagatgtaaaagcactagtggtaaatgatataagaggacagttggatctgtggtttgcatgtaatacattttctaaaagaatttgtagaataatatacagtaaaacctctataaattaataatgttgggaccgcaaaattctattaatttatcgataaattaataaatattaatttatagagagatttttctaatttggtaagttttttaaaatttttttatgaaaatataaacttccattcattatttgaaatatctttctagaactaattacaaataaaaataattatcatgttttgaaaacaacacgaacagtttttaatatagtaaaaattattaaaattaaattaaaaataactaatgtgagtttaagcaaaaagaaacaactaaaattatatttcattaaagttgttatatataattataatatatatatatatatagttgatatttttatataattattaatttatgatattaataagaccatatgtttctataggattttcaaaaaaattattaatcttattaatttatcgagttgtgtcactttttacactggtcccaactcgagaccggaagaatttattaatttatagaggttattaatttatcgaatattaatttatagaggtttaactgtataaggggaggccggaaaattacgttttttgagatacggtaataatagtaaacaaaattttggcaaaagttgtggtgatcgataattttaaccttactatatattattataataaaatgttccaactagatataaaatatagaaacgtaaattagtatagtaaaacaaaaacgaattaataaaatactaactcttgtttctagactttgtcatccatcaaaagctctataaaaccaataatcttcattggatgtaaaattatctatttacatttttctctttcaagaagaagcagcc

SEQ ID NO: 3707 - DNA, 3000 bp, Unknown
  misc_feature (1)..( 3000): cDNA_ID_2155902_gDNA_ID_1620658_Annot_ID_163715 3000 nt of promoter + ATG
ttgttatataataagattatatgattttatttttttgtatatataatttctattcaatatatattttcaaagaataataattgtagttttttcttttcagaattagcaattataaaatattattttatttttatatacctttaaaaattgcaatccttttactttaggatttataatttattgtactatttgttttatacgtatcaaaatctgatcagttgacttgatatatgtcggtatcatagtaactttttcaacgaaactttatataataaaataaatttttaaattttaatacaatataatacaaaagtcaaaacttgcgccaattttgtattaaaaggtggctgtaaaaaaataaaaaataatggggacaataaatagtgtatttaataggggcacaataaaaatcttttataaaataacactagtttcaaaatatttgacagtggcaactcccccatatgggtccgctcctggcggaatcacgttctgaaaacgtgaaaatgagaacaactcgtatactattcatctctaatgcttagttgcttacatcaatgattcgatgactggaaataatattaaactttccagaaaaaagttactctaatacccacagccattagaatgtatttgcccaattcctctgtcgactcattggagaaactttctcactaaaatgtatttgcccaattcctctgtcgacatatataggagaactttctcactaaaaaattttgtttgacaatttctcctctaagagttgttttcttttcttctcaacttttgctttgaattcctctcttttactagtcggatctaagaaatgaaaaataataattggtaagtccttttgtaccaaaaggttttagcgttttgctcaaagactggagcaataagtgaagtacgacgtcgttggtgtttctctgcggaccacaacacttgaacgagtcttctctagtctcactgcttccagttcatggaagctactaatccgttgacatgatatctcaaaatatgtgaagctgtttgatttgttttggcagtggtaatctctctcgtggctctaaatagagagaggacttatgaataaaaggccctctatagggatttggagatggaagggcactcttcttcaggtttctgttatcactcatattatagtcaggtttcttgatctatcaaaaaaacagatgagaaaaagtgaaagagagagagagagagatgttggctatttgcaaaagcatgaaacagaggagaaacagagtatatacactacaataggaagggtcagaaaatgtgattggtttcttggggcacaagccaatatttttatgaattgtttccttttagagtctcataacatcaaggtaagcttttccatcgagctcacgggaaaacaagccattgaaatactcttcagtagtcacgcttttgaaaaatgcagccttgtgcctttccacgagacttctcataggaccaatttctttacccaatcctatattgtggaatgccgccaccgaaagtctctctttctctgagttcacaactccacgatgctctatacttcggtatgtcccattcgttattatctacattaattaccattcatcagagccatttacaaatgataccaagaatagactctctcgtccttataacttacctctaagatgtctccgacattgacaaccaaagcatttgggagaggtttgacagaaacccacttggcatttttcttgatttggagaccttcaacttcattagcctgcaacagtatggtgagtcctgtagaatcagaatgcggagttagaccaataaccttatcgggctctggacaacgcgggtagtaattcagcctaattctctgccctaactcatcatcaaacaacttatccatttcctcgggtttgatcttcagagctaccgctattttcccaagtaagatcttagcaatgcttttcacttcagccgaatacatgtctagtgtatctctgaagaaacataaaccaagttttaaacagagaaaatttgtgtatttattaagaatgattttatacatttgaggcaaacctaaagggcagaggtaacttggggaacaagtgaggcttgcgtaatcgaacaggttgcattgtaaggaagaacatatctgcccaatcgagtttctgctcttctgaaaccacaaatacttgtccaaacccttcgatctcatcgggttgttgccacaaattcttcttctcttccatgggaaggttgaagaagtcttgaacctctgactttactttgttcaagaaacttgactccattccatggtttacaagctgttgaatattcataaacacatgccacaaggataaatttgaattccatatgaatttgctaacacaaaagaagatggggtagttttgtaaagagttgagtattttcagggcagtttggttaaataagaaaatagtgtagctttagttgagacttgcctgaaaaaatccccactctttgcaagcagagtcaagcttgtcaatctcagaatccatggaggttgaagaacacagaagactcatgtctatgattgggatctggtttcttagaccagaatcaacggctatctcagctacgtcttgatcagaccgtacatacctcggaggaaccgtcgtgatcatcttctccttcaccatctcttgaacagaaggaactatgatagagctccgggttgctcctttgacttccatggccgcttcttcttaagaaataatcagaatgtaaatagatagtctcaaatctaatgaagacagtcacagttgaacacaaaaaacgaaagaaagaaaaaagtgaagtacgacgtcgttttgaatgttaggtgtttctctgtgggactgagtattgaccacacacttggaaagagtcttctccaccacaatccctctctctctctctgcttcgacttcatggatactactagtactaacccactgattctggttttcttccaccgtcctcatg

SEQ ID NO: 3708 - DNA, 3000 bp, Unknown; identical to SEQ ID NO: 3704
  misc_feature (1)..( 3000): cDNA_ID_3071649_gDNA_ID_1620658_Annot_ID_163714 3000 nt of promoter + ATG

SEQ ID NO: 3709 - DNA, 3000 bp, Unknown; identical to SEQ ID NO: 3702
  misc_feature (1)..( 3000): cDNA_ID_3071661_gDNA_ID_1620658_Annot_ID_163709 3000 nt of promoter + ATG

SEQ ID NO: 3710 - DNA, 3000 bp, Unknown; identical to SEQ ID NO: 3701
  misc_feature (1)..( 3000): cDNA_ID_1808441_gDNA_ID_1620658_Annot_ID_163705 3000 nt of promoter + ATG

SEQ ID NO: 3711 - DNA, 3000 bp, Unknown
  misc_feature (1)..( 3000): cDNA_ID_3071668_gDNA_ID_1620658_Annot_ID_163703 3000 nt of promoter + ATG
tttctagagatccgtggctcccaagctaagtgaaacaaatataaattgtcttgtttattaacgggctacggcccatcggtattaggcctgttttagtagatttatggtcaacaagtcaaatgaccctagaacatggtacatgaatgaaaaggaccaaaatgtggacagaaatcaaccaaaggccgaggcggccaccaaccaccgaacgtgggaaggtctggttcgggcaaacattcgaaaagaccaagaagactcggataaacaattaaaaaaatcagatattggagaaggcaaatatatattggtgttgaggtcaagacttagagttttgacgttatttaaaaaaaaatatttttgggtaaagactaaagagtttgacgctatcttgaggtttatttattcaacgtagactatatactatggggccgttctgaattggaccttttaagttttgattttattaaaacgccatgttgtttagtcgagagataaacaaaagacgtgtctctagctaagctgaccttcatatatgctttgacataatacattaattataatctctctttttggtgtgtgtaaaaaatacactctatattttattatgtagacacactacatgcagaagtgttcttacctctgcctctacgtgctgtcaactcctacagatcttcaagtaccccaaccgttatctaacagattaaatataatatacccctaactatattatatatcacaattgttcaaaccagtgtatatagactagacgattccttgaaccatataattccagctttactataagagtcttaaggacaggggcaagtgagtcgagaaacgaaaccgaatataagtcttgtatgatatagtcatatagttaaccgtcgtcatatattaaagaagaaaatggcaaccaccggtcggagactccgtcctccatcgcccaataataaccggagccggactataagctcttcaatctctctcccagtgtccttaaacgcctcgttatcgtcttctacttcttcatcttcttcctcttcgccttccaattcaagcaaacgagtgatgataaccagatcacagtccacaacaagatcctccagacccatcggatcatccgactctaaatccggcgagaacataatcccggcgagaaacagcgcatcaagatctcaagagataaacaacggtagaagcagagagtcgtttgctcggtacttggagcaacgtacgcgtggtagtcctcgtagtaacgcttcatcgagaggggtaaagccgggagccagctcaccatcggcgtgggcgttgtctcctggaagactttcgactatgaagacgcctctgtccagctcagctccgacgacttcaatgtgcatgacgccgcctgagtcacccgtaagcaaggccaagataagaagcggtggcggtggagcggtggcaggagttttgaagtacttcatggcgcagaagaaagtatctccggtacaagaggaggattatcaccggtttaggatttttcaaaacagattacttcaatggaggtttgttaacgcaagaactgaagccactatggcaaaccttaagatcaacgttgaggtacaaaaactatatgaaaaatatttaaatttgtatcttataaatatctattaatttgtttctgtgaatggtttcaggatcagttgttttgggtttggcttaggatatacaaaatgaggaactacgttgtagaaaatttgattgaaattcaaaggctccgtcaagatatcaaagtacgtgaagttctcagcctccaaatgcctttacttaatgagtggtcaaaaatagacgcaaaaaactccgaagcgttgagcaagctaactcgaaaactccatgctttgtctgtccgattacccctcgtacatggtgccacggttagaatttctctctttgggaaaccaatttgtttataaacattttgtgtatttgtcaagaaagcagaaactaataatttggaagttacagatagatatggtgtcgatacatgaagaaatggtcatagctatagaagtcatggacgagatcgaagacgtcatcatcaagtttctcccacgagtaagtccactttatctatacagatcattttcctaactttttttgtatagatacatgtaaaagaaattaatttaagaatgtcttgggtgattaaatatcagcaggttgaaataatcctctatgagctgacagaattgatcggcatgttcaatcaagaattgttatattttgaagaaatggacgagagccttttatccattcctctcttcacggtaattcattatctcctaatttcattatatatatgtgaccggtccggtagttttatctataacttgaatggtttgttttttattggttcaatttggatgtggaagctccataggctaaaatggtgagataattttcttttaacaggcaaaggagagtagcttgagggtccatattctccaaaagactgaagaacagagataatgtttctctaataactcaaacgttaggacatgtaattaaaatgttaatcacattgcacattttgcaaactggattgttgttgatgccagaactcgctatctaattcaagacgcagtcttctacttctagatatatacgattgaagccatgtgttaatgtgtattacaaatttcgttatgcaatttctacatacaccttaatgaaaatatacttatacaaaaaattagacatgaaatctaaaaatgtctatccaatcacatatacacacgtagaagtgtttacttctcacaaagaatgtataaaaataataattgtaatttccaaagctataaatataaagattgacttaacttactaaaagcgctattaagtcatttggttatccagctattcagtactacagaggtctcgggttcgaagccatctttttcctaaatccccaattttttttttttccctcgtttccgaatcttttaccggcgagactctgccatg

SEQ ID NO: 3712 - DNA, 3000 bp, Unknown
  misc_feature (1)..( 3000): cDNA_ID_1014414_gDNA_ID_1620658_Annot_ID_163702 3000 nt of promoter + ATG
gttctaaaaagagtgttttgttcctaaagtagagataacatgaaagaaagggaaagctaaaactctccagtcagtgggaatcaacagacagtaattatatttgaactcacatagctgaatgttgaatatcaactcatcaaaccgaaaaggcaaataataataagtattgacagaatctaacggaggtataccgatcatgagatactcttaatagcgttgaaagtcaaatgtctcagagtctaatttggacgaccaaaaggatcgtaaagcaacaacactcaacgaccatcgaagctaacaaatagctagcttcttataaagataaaaaaaaaaactcaaactttccaataaaaatgtcaactttgagcacaatgcaattgcagagaattcgaaaggttatgaaacattgatcaagtcaatcaaagggaccatcttcagggcatagagttaaacaagaaaaccagaaattgaacctacctggtaaataaaggatgcgactttagtcaaacccaatacaaaaattgagagaagaaatggtggaagcttccatttcacagagcaatcaatttcagaaaataaagagagcagcagaagaagaagatgaagacccacgttggtgctgctaatctcagatacaaacaatgggttcttataaccagagaatctaaaaaagatttgaaaagaagcatcaaaaataataagaaaatgagacaagttggtcatgttaatggtcaaaggaggatcagtcctgggtatatactcttttgttctctcgcctgaattttcttcattatcagagtgacagaaggagagtgtgttctaaaagaaagaagttttctccaaccttaggccttgactattagtttaatcatagtttatctcttaattccctaattatttggtatttaactacattcctcaacgccattattatatcgagtttggccatagttgcacgcatgatctatgtcttcctcacgtctttttgtctcctcccctttatgcatagtggagtggtacaagactttggtagagttcacctacaacattggttcgcatttgaaccgtgatttggccggttcaatttaaacgccggtttacgagttttaacctctggctgattaagtaaccaattttggcaaaatccaaagacgaaggcaaaactctctggctgatcaagaggattcgattaggctctttgaccttgtcaacaaagaccttttagaataaaagcattcaaagtatctatagaagctaaaaacattaaaagttacttatggaaaacgaattggcatgtcattgttccttgatgattgatgataaaaggtggaaaaaactcgaattttaaacttgtcttgtctcgacgctaaaatcttcatcccctgtagtcattcatcatgaaatattcgatcaggacacattattttcaaatttcaattatctaatatctctataaacttaaaatctattattattttcttatgttgattctccttttttccgtacgaaatgtcttcccactttcaaattggttttggagttttcatgctcttgagtctagtattcgtattactattgtgtattctgaatgtaaacgactagtgttcaggtcaatatatcaatgattattttctccattctcgttttgtttgatgcaaaaactaaagaacaaattctgtcaaaaatataagaatatatatcaatattgtgttgcactacataatattctttttactatgaatggccatctttttttaagaaaaaaatggacgaaaaaggcagagtttgtccaatgaaaactggataaatgacattagtaaatagcaaatgacatataatttatttataacttattaataggaaatttgcaaatgggtattttcttacaatttgtttcttttgttgtgtgtgtggtcaagatcttcttttaatacatgatcgagtgtagaaactctaattatatggcgatgatgaaatttgatagtggaagaacttttaaatatgataatttacaatgttgaattagatacaaatatcttaatttattaatggctgaaatgacttgatttattaattacataaaggtttaaatgcaaaagtaacctttgtgtacacatttgttttgaatagtttacaaagttactctaaaataatctgctttgtaatatgaaaatatcattttttggtaaagaatgatattgaaaacatgtttgcaaaacaacagacttacctgtcagatacatacacacatcaacttaaacatagtttgaccacactaaaaatgcctatgttcgttgacattcacgaacaaaagaaaaactatttacccataaattccgtgaaatttttgtctaactatgataaaaatccattattttggattaaaattcaaataaaatccaattgaaaacgctaccgaaactcaaaatgaaaaagacctacaaatatgttttggtttatataaacccatacatatgttacacggaaaaaaagaaaactactattacgtactggttttagacttttaggtttttaaccacatccaaattatccaaattgaatatgaaattttatgatttgatctatgtacacctttagttataataaagcatagtctcttttttttttattatgtttttatttcgtttttggaaactcatatgctgacgtaccaaataaatttgggatatataatccagtattgaaacaattattattataacaacagtggagtagtattttaatgcatttaatggaaaaaaagaaaacagagtaaacggataagcgtgtcgtggagaagaaggaccaaagcaaagtaaagaaagtcatatattcctgaaaatctataaaagacatttcgcatttatccacttcctcgattcaatcaaaactgcttcaagtaaaaagcctacgaaatagcatcggaccaaaagacaaactcaccgagtaaacatacgcaacctgtcgtgtaagtaaaaacaatttgatagtgatctctct

SEQ ID NO: 3713 - DNA, 3000 bp, Unknown; identical to SEQ ID NO: 3129
  misc_feature (1)..( 3000): cDNA_ID_2107558_gDNA_ID_1620658_Annot_ID_163698 3000 nt of promoter + ATG

SEQ ID NO: 3714 - DNA, 3000 bp, Unknown; identical to SEQ ID NO: 3130
  misc_feature (1)..( 3000): cDNA_ID_3071670_gDNA_ID_1620658_Annot_ID_163697 3000 nt of promoter + ATG

SEQ ID NO: 3715 - DNA, 3000 bp, Unknown; identical to SEQ ID NO: 3132
  misc_feature (1)..( 3000): cDNA_ID_2999601_gDNA_ID_1620658_Annot_ID_163693 3000 nt of promoter + ATG

SEQ ID NO: 3716 - DNA, 2606 bp, Unknown
  misc_feature (1)..( 2606): cDNA_ID_1441291_gDNA_ID_1620658_Annot_ID_163691 3000 nt of promoter + ATG
gaattcacaacatatataaaaaaatgataagaagagagcttaattttgagcgagtgttacaaattaattaaaaactgtgtctagtttaacacttaaaaaaattgcaatttaaatgataactacccctggattattttcataacaattttgtacatgaaagaatttaagataatatattattttaccaaattagaaaagctaaaaaaataagtactataatttgttgtatttagtgaaagaataaatgttgctgggaaaaaaagtgaaagaataaatgctttgggtatataccttatattaaaaacaaaacgaaaaaaaattaatgatatttgttaccatatatattatatacaatctataaacagaaattaagataatttatctgaaaagtgttttcaatgaggaaaataacaataaacagaaaaaatgaggtgtatgtacaaagatttgttaccaaatttaaagtattcaaacagaaagtacccatctgtttaggcaaaggattcgatcatcaaacgtcctacaatatcttgttttgcgatctcacccacaaatttatttcctataaattctcttcctctgtctgatctcttctattcaagcccacttcttttctctttctcttgtcttcgtggagttttcggatcttacacaacaatatctttgtcttactgtatttcttgtcctttttcttcttacctttctaacaattattaagaagagtaaagcttgaatttaaataaaaatgatgggagacaatgaaggaagaagaactccgttattgaatcttggggttcaagtatcgatgagagtgttaaccatcggagctgcaatggcctcgatgtgggtcatgatcactaaccgtgaagtcgcatctgtttatggcatcgcttttgaggctaaatacagctactcctctgcctttaggtatatatttttttaaatttattctccttttctatcatcatctacttcttattttatgaaggtgcaatgatctagttattgaaataattcatatatgatacaacgaagcatccatctgcatgaaatgtcatcattcacgttgaaaatatgaagaaaacagatcacacattcggtagaaaagattgaaaagatgaacacatttttctaaaaaaaaacatccctcacgtatgatgtaggaagaacaacatgtgggacaaatcataatttggcatttttcattcatcgatatgatcatctttattgaaagtaagagatcgagtgattaaagtgtatgatttgatgtttgacaggtatttggtgtacgcacagatagctgtctgcgccgcgacattgtttacgcttgtatgggcttgtttggcagtccgcagaagaggacttgtttttgcactcttcttctttgatttggtaactatattacatgtttttgatctaaacattttcatttctatacgtgaatactctttatcttttaatttgaattagcatgttcacaaattatataaataaacgttttgagatgggtttgatattttgatgtacagcttacgactttgacggcgatatcagctttctctgctgccttcgcggaaggttacgtagggaagtacggtaacaaacaggccggttggcttccgatctgcggttatgtgcatggttattgcagtcgtgtcactatctccctcgctatgtccttcgcctcttttatcctcttgttcatccttacggtcttaactgcctccgctgctcgtcattactgattttcttacattttatatcatacaattcaattccttctactccaagataattcagtctttgttatatataattggatttcatgagatgcaaaattgatttgatataatgaaatgaaattgtatgattacttgcatgtatttatctttgagatcacttcttctgttctttgctgtgcttaattagtctcctatttgtttttcttggagaaaatctaagaaacaacaaagtattgacaagaaagaaaacgaaattaagatcttggtaatcggaagagcatttttctaaaacgtataattgtacaataatccttctgccaccaaaagagtgataacatgtttcaaacatgcatagataaaacataatcttattaatgttacatatctcttcacaaaatctattcttccacatatttctcctaaatagggttttagcagagccaacagaaaataaaatgcatacgatctcatcatcactgtatgatggatttccaaaagagaatgttacatatatacatcatcataattcataacatttgcatcagaccaggctcaactagatgcaaaagaaccaagatgggcccgttgaagtaacttatattttggactgggcctgtcacttggcaactgtgggacccacatgaacatgtgccgaagataggcctgaatctccgagaacaaacctccgccacaaaaacagaagacttgttgcttgcgtatcataatacgacgccgtatctctacttgctcgaacaaacccaaaaagatacatatcaagagattaaaccttatccaactaagagaagccatttttattttttttgggtctctgagttgtgtattgagcttcatctccttcaaatg

SEQ ID NO: 3717 - DNA, 3000 bp, Unknown; identical to SEQ ID NO: 3707
  misc_feature (1)..( 3000): cDNA_ID_1821591_gDNA_ID_1620658_Annot_ID_47909 3000 nt of promoter + ATG

SEQ ID NO: 3718 - DNA, 3000 bp, Unknown; identical to SEQ ID NO: 3706
  misc_feature (1)..( 3000): cDNA_ID_1821587_gDNA_ID_1620658_Annot_ID_47911 3000 nt of promoter + ATG

SEQ ID NO: 3719 - DNA, 3000 bp, Unknown; identical to SEQ ID NO: 3705
  misc_feature (1)..( 3000): cDNA_ID_1821583_gDNA_ID_1620658_Annot_ID_47912 3000 nt of promoter + ATG

SEQ ID NO: 3720 - DNA, 3000 bp, Unknown
  misc_feature (1)..( 3000): cDNA_ID_1821580_gDNA_ID_1620658_Annot_ID_47913 3000 nt of promoter + ATG
tgacgtcggagtttcctccaaggaaacgaggaagaggacgtggcaagtctaatcgatggctcaagaagtctcaaatgttccaattcgatagaagtcctggtaaatatctttttagaaccttcctttgatgtctgttaaaagttagtagtgtaactgacatggatctatatgtggggttgacttgtacgatgttggaataagaagagaactttttgtgtcagaagtcataagctagtgaagagaaaggctacgactttaggggaagtagattagaatatgcacatcacaacatttcccaaaagctcagggattaggagagaacagctttaattaagtacagtcttggtcttgtgtttgtcttatagatcagttacatcttgttttagtttgatatttgtctgtcttgtgtatatcttagtgttttgttgtctcaactttgatttttgacttgtctggattcagttgataccaatttggcaggtgtaggaactgctgattttgttggtgccaactttacacctcatgtactgatcgtcaacgccggagaggtatgtttttttctgaatgatcatatagtcttcaaatcgcttactatgatcagttattaagctaagctgttgacctgtggatttgtgtaggatgtgacgatgaagataatgacattctctcaacaaggatctcgtgctatctgcatcctttcagctaatggtcccatctccaatgttacgcttcgtcaatctatgacatccggtggtactctaacttatgaggtccacatgctctcttctatcatccatcttctccattttcatatatatatataaagaatgcattctctgtatttggtttccttctaatgttttttgtcttattgtgagcagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggttcgtttaagtttccagatagtatgtggtctcagaacatgagttatattttgtgtctgacatggatttattacaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgtagtatccttgttagaaacaaacttactgttgcaaaactctccttcaagaaagttttcactttgctttaccaatttacattgtcactatttcaaatagatatgtatttctctcaaatgatgcatcaaaatcggtgattagtgagtggtttagtggtaggaacttcccactaactctcatgtaactttttttgtcacccactaactctcatgttagttagttttttggtttcattctctatatatattgcagaatgttagatatgtgtgacatttataataacttgagagaagtttctagaaagaaaaggttttgaaaaaaagttaaccgaaagggcattttcatggtgttaagtgagtgatgtttgtttttgttttatttctcaaattctacctcagattttcgatgacttcttgacaagttatatcactaaaccaagataaggtataaattattttgattttattgcgtttgtatttaatagcttacattggtatacttgactttgaatttggttctggcatgtttgtgtcactagtcatcgtggttgaagaaaatgttaagtttcttttttttcaacttaaaatctatcaaaaatatttcatttttatgattttagtagcatagatctatatggtaattgttggaaaaaaatatactttgaaaacatatgataattttagtatatgttaacctttcaaaaatataatattttatttaacacgtctcgagctaacaactttgaaaaccaatatttatatagtaagttaagttttcagcctcttacttctctagaatatgagactttttaaattcttcccacaattaaatatattataccaaatgtataattatttttgttgacacgtctaacaatcatgtggtttagtaactttaaaaactaaattttatatgataagataagtttttttttttcttataatatgaaaattgacttttcaaattctttccatatgttaatatgttatacttgtaaatatggttaatctcattgaacattttatttggttagtaactttcaatatcaaagtttatatagtaagagaagttttcacctttttttatttatacagaaaatgtgaaatgacttttcaaattccttccacatttcagtatgttatactaaaagtatagttaatacgccagttaaagtttcaattaatgaaaatatcaatatgatctaattagaaaagggccaaaactgtaatttttgtatgttttgactggtagagctaacagagaaaattacttttacagagagtttttggtctataaagagagcttgcatggcttcttcactacacttcaatcgttatcacttctaaacaaaacccaaagaag

SEQ ID NO: 3721 - DNA, 2782 bp, Unknown
  misc_feature (1)..( 2782): cDNA_ID_2992357_gDNA_ID_1620659_Annot_ID_47914 3000 nt of promoter + ATG
gaattctttggaatcattcagcggatttactgcttgttttcatcatctacaacaaggtggaaactttttaaagagatggttggaggtctcacactaaagccattatctgagactcgttgggaaagtcgcgttgaaagtgttcgggccattcgatttcaggcctaaaaataagagatgcattggactacttggctgaaaattgtgatgacccgaaagctcgcagcgatgcagactgccttgctacaagtgagacacacagaattggtggatttgagttcttgtttggtatggttatttggtacaatcttctttttaccatgaacacagtaagtaaggcgctacagtcagagaatattgatattgaacttgctcttgttcaactgaaagggttagtctcttatctacaaaattacagagaaactggttttcaagaagctaaagcagaagctacattaattgctgaatctatggatatcgaaccaaaatttcctgtgaaaagaaagcgcatcattaaaaggaaaaggcattttgatgaagagatggagaatgatgttgaaactgaattgcttagcgaggaagagaattttaaagtcgatttttttccttagaatcctagatcaagctatagtatctgcaggtgaggtttgagcaatttgaagagtatggaagaatttttagatttttgtttgatctaaggaagctcaaatctgcaagtgatgatggcttaaaggcagcatgtataaaccttgaaacttctcttaaacatggagatagttcagacgttgatgggaatcatttattcttagagctgaaagttttaaaagaacttttaccgaccgagatcacgaaagctattgaagtgttaaactttttgaaaaagtttgaaggttgttatccaaatacatggattgcgtttagagtgatgctaacagttccagtttcagtcgcctcagccgaaagaagtttttccaagctaaagttgataaagtcatactcacgatcaacaatgtcagaagagagattgaatgccttggcgatattgtcaattgaaagagatttagttggagagctcgactatataagtttgatgaacgactttgcggcaaaaactgcaagaagatctattttcgaaatccgagatgatgatgagtagcaagtgtagtttcagtttttagaaaaacttgtgtttcatttacggtttatcattggttttgtactttttgtttagtatggtaatgaaaatttttggccctcattttggattttgctctagcccttctaatctcagggccggccctgatctttggtacgattacaatctacatccaaaagatggaatattctgattaaatttgagagatttgctaagaagcactttactaatgcaccaagacactttctgattatcatgtcgatttagatgttataaaataaaataaaaataaaaatcacttataatggacttcataacctttattatcgttgcacacaaaaatcgaacatcttttaggaactggattcgctagaaagactttgttcgccaaaagaacatgattcactaagagaacttggtttgctagagtatgacataaaagtatcatgataatagggatatgcatagacatgtaattatgaacaaacaaatatctctaaccaaaaatacgatttaaccacataaccaatacactatatgtattgatatgaaattacttatcacctcaacatcgacaaaactttccactactccctcaacggaccatgaatgtaagaaataaaaaggttaacattttcagtgtttgtttcgtttttacggaaagtcacagttttacctgataaaaatagtaactgtcaatctaagtttctaatttaatttctatagttaaaataattgacacaaatattagttttcctttttttttattttattatatcactacaaaattttgagtgtctaaagctctcatataatgattattattattattattatttctttttattctatttcatttttcattatgaataatcacacaattagtttatacaaacattaataatgtcgcatcattttattataaaactttttttgttttaatatattgataaatatattttatacaataggattataaatgcaagagaaatttttagtatcttcaatttacacatatattttttattacaaatacttaagtaatattatcatttttagatttcttttttttctaaatgtacaaataatatgtcaagctcgtgtaaaaaagttagtttcaaagatgtgaataaatttcataaatatatcaatggaaattacttaaattaagaagaaattatgtttgaattgtgtataggccacaaataattatgtcatccttcacttgttagtgtcaaagagaacattaaatctcttaaatgtattgatggaaattacttgttttatgaatttgttttgtttgacttgtatatggttcaaagaaatatttactattctactaaagtattcaggtttgaagggatttaaggaaacataattactatctataatttattatttgcttaacccctagctgggtgtacaactatatatatgtgtatactctactctaatgaatcattgagacatattatatatgtagggagaaggtgattatcccaaatgatttcttaaaaaaattcttcaactactatatctcaataataattgtattcatataacaaaaactaatgattgattaaaaaaaaaataactaatgatttcatttctctattttgtaggttgatg

SEQ ID NO: 3722 - DNA, 3000 bp, Unknown
  misc_feature (1)..( 3000): cDNA_ID_1821667_gDNA_ID_1620659_Annot_ID_47919 3000 nt of promoter + ATG
ctgcttctttgctttaatggcgcagatacagaactagggcttagggttttcctcaatggctttacttgttagtgttgatccaacctgaggatttgtatcatcaattttacagaatctcaccactgttagctcaggacatttcctgctgcaagaatctgtttacatatacttgtgtctgagactctgaaacagacaagttcacttgtgtctgaatcatgtaatttttgtgttagtctctctacaaatgattgattcttaaattagacgaataaaccagagaaaaatgttatacattgcatttatggactgagttgtgatgtacattgagtaggtgggaaggtgctccaagcaagtttccatgggagtttaagaagacagagacaatatatttcatggaagggaaagtgaaagtgaatgtagacggatacgacgaagaagaagaaacctttgagatagggaaaggagatgttgttgttttccctaaagatatgaaagttgtttgggagataactgaagctgtgaagaagcaatatagcttagaggagtagtgactttgtagagagaatttgagtcacattgatgtttgtttgttgtacttggttactactttgaactaataatatctatggaattgcaatgttgattaggattctgattatagaagtaagaaaactatatattatatacaatttaattaggaccccaacagctcaagtacatgactgttctaagagattcttcagccttcttagccttctcgctctcaccagaggaggtaacggctgcggagacagaagacgaagagaaccttttcccttgagaaacagatctaacgttgttccggagatgttgattaaccgaccggagtatgtagttccaccgacaaagacctagttggtcttttaatgcctctacggctccgatgctcactgccactgtccatgctttgcttgtagaactcatctttcttcagagaattaaacttctttgtgttttgtgttttgtgtattgagaattgtttttgttgatgatgtttagaaagtgaagtgaattggtgtgtttatgtaagagagaagaagccaacaatattgccgtgtagttggagttaaaactagaagctgtggccgttggttttggttgtttactactgtctggatagtaaaatgacgttgttagccttttaagaacgaattggataaggggtaatattgggattctggtagttcctggattaacgagtgccgctatcatgtgcacctggttttgagattgttcacttgtttgggtttcgtgttgtgtccaagttttgaaatatagtaaatgttttctttatctccttgtagaataatgcatgttggagatgaataataatataatatcaaaaatcatttgccgaccaaaaaagtaaaaaatatattaaacacaaaatgtaaataaataaataaaaattcaatcaaaagaaaaatggttttgcgatgacttactttttttttttttctttctttcatacagaagatgaataccatttaacatgagtattcaaaaaatcaaaagtaaaactagtatcatcaaatatttccgctaaattagtaaacatatttccgctcataacaattagaatgagaattttagaatgttggttctgtgacaaccacacaaatttccgagtttagtagatttggaattggtgtttttctttgcgatttactggtatgcgctcttgagcaatcgtatacaattagagtagtaatattattttacttttctgtaaattgctttaatccgttctcagttctctttataacttctgtcaaaaatttaaaatgatataaaatttaacattttactaaaaaaaagagattgtaaaaaagaatatagagatttgttttattttatcctttaatcagtcattttataaataataaatttcgtttcaagtagtacattaatttttaaaatttttatagatttaatatacagatcattctagtatacacaaaaattaggatctatattattatttaaaaaaaaaaaaagcagctcaagtcgatgaactaaacatgggcaaaatcgtcattgaactaaacattcatagtttcagcagaaaccaagaaaaccagcagctacaaaacccactttttgtctgcactttcaaactccaaaggcacggcactttttgtctgctttctcttcttttataaacaaaacccactttgattcacttctcattcatcatcaacaaacacaaaatcgaaaccaaatcacttaaacaagaaagaaacaaagagaaatgagctctgcaagcaaaacgtggatggttgctgcaagcatcggagccgttgaggcattgaaagaccaactaggcgtgtgtcgttggaactacgtgatccgatctgcgaatcagtatctacgcaacaacttaagatccgtgtcgcaagctaagaagctctcttcctcatcaatcgattataccaacaagaccaagcaagctgaagaatcgctgaggacagtcatgtacttgagctgttggggtcctagttaatggacaatggagggatttgaaaaccctaatcatagagttttgataatgtctcttttagggtttaaaacccttaaaaaggttaaaaatgtatagaatttgctctgtaaagtgactcttgagtcttgaactaatgattaatctcttttcataagatttgttcaaatcggatttttcagttactgcaactaagtaagaaagacttaaactttgaatataaatacagagaatttggtacgttgtgtgtgacaaagatttatttctgttgatataattaggaccctaaattggaggtttgttacagtcaaaagtttgtactgagtttttactacaagttagggattttgttaaatgcttatcccatttttcatgcagttctgttgctaattctccagcttaataaagagaggttaattttgtttggtttatgtgtgtgaacatttcttgtctgagtaaagatg

SEQ ID NO: 3723 - DNA, 3000 bp, Unknown
  misc_feature (1)..( 3000): cDNA_ID_1821656_gDNA_ID_1620659_Annot_ID_47925 3000 nt of promoter + ATG
acagtactacggtagaatcgaaagagctataatgaatttatgccctttggccctagagctgagctcactgtgccactatacgcactattctacctccttaaactgagagaaaatctcaaactcaacctccatattgatccaagttgagccataaagaacaactcatagcaccaaaaatcagcactcaaaccatacacattaccagaatgataaatcagccacctaaattatgcgaatccatctttataccatacgtaaaattgtacaaaaagaaaggagattatcactagccccaaatctacattattgatctaagaacaaaccaaacactaccatttacttggaagctgcaacaaatcctaaaagttcatcattttaaccacttgtcgatttcatttgtagtagctttcacaagcttcttcgtgctaacaacaagttcatcaatcagtgaatcaacttcattcctgtcaacaaatcaccaaagtcaaaatcatcatcttcttcttcaaatccttaatcactaaaaatctaattgcagacaaatactcacagagatggttttccaacgttgtaataagaacgagagtgatcataagcagctcctcttccaacaccatagccaaaacctacaccaattccacaaccagctccaaatccaagaccaaattgtaatccaggaactcctggtccgaatcctacacctgttttcatcaaaccaatctctactctcttaaaccaaaactatctataaatagcttcgagcgattcgcgagtctgcgatcaaaattgggagaaattagaaatttacctccgataagaccggcgccgaaaccaaatccgcaaccgacaccgagtccaaaagctggaccaacttttccaatgtctctgatcctaacttggggaagtttccagagcaatcctttgtcatcgtctccggttcttcttctgttgctcatcgtccctttcgctctctctttcggcgtggattcgccaatacatactttaaatgggcctatattataaggcgcactcttatttctcaaggcccaacttcagcccaatagtcatatagatctcatttcacaagcgatatttgttatgtttattttattttaatcttttgttttatatcataatgaattttatagaagatatctgttatgtttatattcataatgaatttgttttatatcataataatatggattttcattaacaacattttttttaatacataaaactaaaaaacccacaattattctcaaattttcactttgttttcagttactttatatatatttgccaaacatattatataatatatgaagatttgttcttacatatatttaatggattgatgcctcattagttttattctcaatttcaaaactaaaattaataacaaatctttcgtaaaactattaaattttagattcaactagattaaactccatccaatatgcatgtttaatttttaaaactaaaataaatttaacaaaaagatatattaaaatcttattgtaagtagaaaataaatatataatattttattttgagaattgtttatttatatattcgttttttccttattcgaaaaatattatacatggaaattactagtcaaatcatcatctaatttacatctatttacaaatctatcgtctactttaccactaaaaatgtgtttactcacaatcatattttcttgttgaagtattctcattcccaccacgtataaaatgattatatgaatgcataaagccaactacatgtgtttttattttcactttcacatagttttttaaccactaaaattattgattcataaaatattttgaaagaaaatatatcacatagcaataattaatgatttatttataagaaaaactagaataagtaaaaattactcgatcgcaatgagtctataataaaccaataaaggttgagaaatttgattggacaaaattataagcacaatgataaaagattaaggcttatagattctatcgcaagtaataattcttttcattttatataaaactattttgcatttaaaaatatgtttatcattatttgttgcatattttgtacgagaaaattatttgaaaaaattctatgcatgttttaatgttaaaaaaaactctgttgagtgtattcacgagccactcaatgtaatttttatctgatgtgaacataatatatgcctaaagaaaagtttgaaactcacccttatattcagattgatgttgtggactaatgttgaaatatattctagtataagttctagaccacatgatttcatataaacttaggtccaactttcaccaattattatgaaacatttgtattgggtcttaaatttttgcgacccatttgcagatatttttgttttgtttaagcctcgaaattagcaaaactaccccaaaattaacaaaaatgccccataattaacaaaaataccttataattagtaaaaagttccataattgacaaaaaatgtccaaaaattaataaataaaaattatcaatgtctcataattaggaaaaataaatcagtttttattttagaaaagcgtcaatttgttttgtatttggccttggattttagattttagtacatttcttattatattaaagtatgtatattaatcaatattaaactactatcttattgatcatcatttaacagtttattcatctaatattttcatcattattcatctaattcatctggttcagtatatcaaccaccatttgacagtttcataatagtcaaaatattttccttcttccttaaatcgattttttaataccaataagtggaagtttgacccaaaaagaaaacaaacaagttaatgggcttactacggcccattaataaacaaaaacgcaccaaaacttcatcttcaacgccggggactttgatatcatctgcgccgaacaaaaactctgcagaaaccctaattttcgtcagtgattgattcttccgtttccaccatg

SEQ ID NO: 3724 - DNA, 85 bp, Unknown
  misc_feature (1)..( 85): cDNA_ID_3071685_gDNA_ID_1620659_Annot_ID_163766 3000 nt of promoter + ATG
tctgtcattacatagagctccggttatagaaagcttctgtcataagctaagtaattcggttttgaaacctgaagatatcagaatg

SEQ ID NO: 3725 - DNA, 3000 bp, Unknown
  misc_feature (1)..( 3000): cDNA_ID_2050676_gDNA_ID_1620659_Annot_ID_163760 3000 nt of promoter + ATG
taagcttcttcgaacatttgcagtttccatatcatgcgttccatcggttggataagcacaaaaccatcataatccaacgaaaaagttattttctttccaaaaaccatcaatataacactgatatccgaaatcattttatcttatcggtttaatactcggatgataatgtatatcaacagccattgaggctagatttgcttctaagaactatatcggagctaactgccaaacttgtccttcatgtacagtttttttaaataaaaaaattatagaccataatttatgaacacaactataaaagtattattttatttgttttataatcgaggttctattcgaatgttccacttgcatgtactacatgcgaaaggaatcaaacaagcaaaaaaaaaaatgaactctacgaaggatgattcctctctctctggcaatagcaagcatttaatgaacaataattaaggaaaaaattacatcaatcaagattcaagacgaggaaaggtgaattcgaaagcaagcattccctgccactaaattacttttccaattgtctgaaatttaccctaaaataggctaatttagacggtctgaggaatctctttttgtatgtctagttaaagtaactaaagtaattaaaccctttttgataaaaaaaattaaacccttaattaataatttgatttaattccaataatcacaatcaatggaacaagtatagttgctttgctttatgttgaatagaactaaacaataatcactttgagttttgacaaatctcctttttgtttattatcataatacaactcacgaagctcctccccacgtttcggaataatcattcactttgatattatacggtataattgtacacacaaaaagaaaaagaaaagaacctacgaggaaagagggggaggtcataggaataaattaaagagatatatcttcatcttttattttgttcaaaaaaacagagtgcattgtacaaattgcattttttttggggtacctaatgtaagagaataataagcaaagtgacacaatgtcatttgtgtgtatatggtataccacaatattgtatgtattcttttgtcatcatagatttagttaagtatgttaacttattagagaaaggggtgtaattaatgttttttgtatgatatctcattttgcaagtagtgttaatcaattatatttataaaatgtgatatcatgtcacaatatattttgaattaaacttcttttattcgaattaaacttcatattctacagcattaaatacctttttaacacagaaaatccattattttttgccatcaactatgtcaaatctaaaaaatcaagccactaacacgttttcatttggccaactaagaaaatcttaatcgtgagaaatagcacaagagatttactcatgtcatcgaatgccagttttgcaaaatattgcggacctaagttatgttggacctgttttacattgtagaatcatcgcgacgaaaatcccattgaaaagaatttagataaagcgaacttatgtctaaagcaattgctttaggtcaattatttgatagtaatattgtcaattttcaatgcttcttcactagacttacacaaagggccaacttatgtctaaggtgattgctttaggtcatttaagttaatctcttattttcttttctttttttggacaaaaaagtcatttaagttagtctaaactagttatatcttgtattataaaatttagttaagataattcttttttaactcaaacacctatttcctatcctatgttttaatataagtgatgtttaagattttggcacaaaattaaaagtcatttccttttttatttaatacaaaaattatttttaactaaatattatcgcatcaataataaaacaaattgtacagataaaaaaatattactttaaaataataaaaaattgaaaatatcaaataaaatgaaaaaaaatcagtgtgaagaatattaaataaataaatatatatatatatatatatatatttgatatacacttaaatttaagttaattttatatatgaaaaaaaaaatgaaattggttctatttaaatattgttacacgaatcaaacgctcttccctagacttaagagaaattttatattcaattattggagggtcgtggggtggcgaatgagtgatgccctcaccgcgcatgtgcaattcctaaccgtcacacacggagagaattacttagatccaacggtaacgaatctgcctgtgacaaaagcaccggtgactttagcagttcaacaaaatctcaaaaagagagtcagtagatgaatgaagctgttatataaaagcaataagatattggagttgacttttttttcttataattcatttttttgggttcaatgcataataatctcttttctatataaaacacaaacacatataaatataacataagctcaaagactaaccaaacccatcatcttcattccaacttcttttctctttttattcacaaccttagctttgagaatcagtctttgttcagtgttaacgtaggcatatctctctatgtgtgtgttgtctttgctttttataagattcggtttctgagtttggtttttatttcttaaggtggctatctttcttgttcttcttcttaaaacgtagtaacagctttataaaaatctttcaaagcatgtaaatttaagtcctagctccattttcgttttcttcttctcaaaaaaaaaaacaaaaaaaaagtttttgatcgattgatgagttttctcatttattgatctctctagttttaacttgtgtttggtgaaaccggtactggcgaagtttaaaacacaagtgtaaacacaaatttataaaaatttcaaatcatgtaaatttcgtctctatcaatttatttcccctcaccaaaaaaaaacaaaaaaaaattagaatttagtacttttattttaaacaaaaaccaaaaaaaaaaccaaaaaaaaaaacgttggaaatg

SEQ ID NO: 3726 - DNA, 3000 bp, Unknown
  misc_feature (1)..( 3000): cDNA_ID_3089400_gDNA_ID_1620659_Annot_ID_163757 3000 nt of promoter + ATG
tagttatattataagaagagtacatttggaacattgtcaatcatttatttacttcaattacgtgtagaaagtgtttaattgcatttagaaatggtagttttggaattaaagtaattgaaatcaaaatcaattataatttaatttagaatttttttaaaattttgctttaattattttagaggtacttcgaagattttttttttttttttctaaactccccactcctcttatcaatgaaattgggtttagatttttttttttttttttatgtactatgtattaattcagatgtcttaaaaatatgatcaaacctttacatcattatcatggagccttttgaatcttcttagaacttcagctttaacactttccatgcatcttttgaagtcttggaatcggaaatgtgcgctagtactgaaaatttctccagaaacaaaacactgaacaacagttgaagagcaatttcatctttcatttctagttttccccactccaacaatattttctttgcatcatgtgcatgtatgactaacttgtgactcggtgatacctccttcaatcactactttgtgcaactccttacacttaagcagccttcatctttatgatccacatactataattttcccatcacacaccacatttctacttagcttcatgtatgatcttatgtttacctgtttgatttctttgtgtttgttattattgctcgatcactcgactcactttctgcctttgatttcttttcagtattgtaggtcaccgagaacaattagctttgataccaatgaaggattttgttcaccctcttagcttaaccttttttttcttaattttaccttgattcgttacattcatatttatactacttttacctttaaacctacttattcctcgattattgtacttaggattacatattaaactaaacaaaagattcccaattagacaattgggccttcaataacacaacatgactggccttttttttcctcttccttatctaattaatattggaaattttcaaatttttaatagtaatttttttttctaaaccggaaaccgtggttaaaattatataaattgtgctatcatcattttttcttagtatgagaaaaataaaataaaataaaatttgtatctattttgaacaaaacttgggttcaagggtgaacccttttattcacctccttttgcattaaccaataaaaacatgttatgtcaaatcctacttaaattacataataaattaaagctataattataaatccaaaccgatatataatctcgtttaattacaaaatctaaaccctaattcttctttgtaaacccaaacctcatttaaactcatttaatcgtaaaaaactaaaccctaatcgtattttctaaatccaagccgatatttaacctcgtttaattgtaaaatctaaatctgtttataaatctaaaccaatatttaatccgtttaattataaaatctaaaccgtaattgtactttataaacctaaaccgatatttaacctcatttaatcataaaatctaaaccctaaccttttataataaactcaaaccgatacctaatttcgttttagtggcaaattagattttataattaaattacatattattatttttattattatgtatcagattttaattgactaaaataaaggaggtgaatataagggttcacccctaaaaatgaacccaagtattttttatttatttttagtgaataccattcttactaataatcgtgatattgagcacatattgtcatatactaacttagtatatgcaagcatgcaatatatttcgtttatatagtttaactattcatttttaaacttagaatatatgatcatcatatattggatattatgttatatgtcatgtagttggctatcttcttcccttatgattatgcatccaaagataattttgaggtaaatgtcgtaaaccttttttttattttattagaaagtacttttttctaaaattcagtaggaaactaatgttatacttaagttaagaaaaatatttaaatatgattttatagagtttgagatattaatatatcggcgagcatataaatttaatatgtataaattctttttaattaaaggtagaatttgttcatatataattattttctcataaatgagaataacaaccaaaacgaacaatattaaaaccatcaacaaccaaaacgtgacactaaatcaacaaacttcagcttagttgtataaattgtttgtttaacttcaatttcattggttgacgaattttatacacaaatgtaacaagttgatttcatcaaacaaacatctacatctactcactctacctcacataattcataaacctacctacacacgcaaaacttcttcaaaggcaacaataaaaatttagagaatcttttgaatcagttggtcagtcaacatcaaacactatttccatttgtacattttcttacttttagaatggtcaatttttttttctcttaataaatagcacttatacatttatgtcccaaaaaaaaaaaaaaatctactttttatttatgtccaattcaaccaaaccaagtccttttagccacgtctgtatttaaccaaaacaatctacagtacttatttttggtacacaataaatgcttcttttcaaaaatcaacctttttttttaatttccatataagaaaacagagagagataataaaaaaaagcttgaaactttgacaaattaacaatctgagattgtaattgagcgggaccagtagtatcgaacgacccagaaaagagatttgattcctttcctcatctttgttcctcaggtttactcctttgaccccaattctaggttttcgaatttgggtaacgaaaaagttttcatctttccgattctttgtgactcatatataagtttctgattctgggttttgttctctgtttccaattagctctgtttgacccatttatcatatcaaaggaagaaactttaaa

SEQ ID NO: 3727 - DNA, 3000 bp, Unknown
  misc_feature (1)..( 3000): cDNA_ID_2997358_gDNA_ID_1620659_Annot_ID_163753 3000 nt of promoter + ATG
tttatatgaaatcatgtggtctagaacttatactagaatatatttcaacattagtccacaacatcaatctgaatataagggtgagtttcaaacttttctttaggcatatattatgttcacatcagataaaaattacattgagtggctcgtgaatacactcaacagagttttttttaacattaaaacatgcatagaattttttcaaataattttctcgtacaaaatatgcaacaaataatgataaacatatttttaaatgcaaaatagttttatataaaatgaaaagaattattacttgcgatagaatctataagccttaatcttttatcattgtgcttataattttgtccaatcaaatttctcaacctttattggtttattatagactcattgcgatcgagtaatttttacttattctagtttttcttataaataaatcattaattattgctatgtgatatattttctttcaaaatattttatgaatcaataattttagtggttaaaaaactatgtgaaagtgaaaataaaaacacatgtagttggctttatgcattcatataatcattttatacgtggtgggaatgagaatacttcaacaagaaaatatgattgtgagtaaacacatttttagtggtaaagtagacgatagatttgtaaatagatgtaaattagatgatgatttgactagtaatttccatgtataatatttttcgaataaggaaaaaacgaatatataaataaacaattctcaaaataaaatattatatatttattttctacttacaataagattttaatatatctttttgttaaatttattttagttttaaaaattaaacatgcatattggatggagtttaatctagttgaatctaaaatttaatagttttacgaaagatttgttattaattttagttttgaaattgagaataaaactaatgaggcatcaatccattaaatatatgtaagaacaaatcttcatatattatataatatgtttggcaaatatatataaagtaactgaaaacaaagtgaaaatttgagaataattgtgggttttttagttttatgtattaaaaaaaatgttgttaatgaaaatccatattattatgatataaaacaaattcattatgaatataaacataacagatatcttctataaaattcattatgatataaaacaaaagattaaaataaaataaacataacaaatatcgcttgtgaaatgagatctatatgactattgggctgaagttgggccttgagaaataagagtgcgccttataatataggcccatttaaagtatgtattggcgaatccacgccgaaagagagagcgaaagggacgatgagcaacagaagaagaaccggagacgatgacaaaggattgctctggaaacttccccaagttaggatcagagacattggaaaagttggtccagcttttggactcggtgtcggttgcggatttggtttcggcgccggtcttatcggaggtaaatttctaatttctcccaattttgatcgcagactcgcgaatcgctcgaagctatttatagatagttttggtttaagagagtagagattggtttgatgaaaacaggtgtaggattcggaccaggagttcctggattacaatttggtcttggatttggagctggttgtggaattggtgtaggttttggctatggtgttggaagaggagctgcttatgatcactctcgttcttattacaacgttggaaaaccatctctgtgagtatttgtctgcaattagatttttagtgattaaggatttgaagaagaagatgatgattttgactttggtgatttgttgacaggaatgaagttgattcactgattgatgaacttgttgttagcacgaagaagcttgtgaaagctactacaaatgaaatcgacaagtggttaaaatgatgaacttttaggatttgttgcagcttccaagtaaatggtagtgtttggtttgttcttagatcaataatgtagatttggggctagtgataatctcctttctttttgtacaattttacgtatggtataaagatggattcgcataatttaggtggctgatttatcattctggtaatgtgtatggtttgagtgctgatttttggtgctatgagttgttctttatggctcaacttggatcaatatggaggttgagtttgagattttctctcagtttaaggaggtagaatagtgcgtatagtggcacagtgagctcagctctagggccaaagggcataaattcattatagctctttcgattctaccgtagtactgtgtgtgaaccggcactgtgaaccaagatgattaaattttcgtattctctatgtacatgatcctgcggctcaatcgcttcagtttcgatccacatgatgtatatgttatagaattgtgggaaactccttgtagaaagagtatgttcacgtctaggactagtcggatgattcgtttctctttttggtgtaatgagtatgttcataactgttgatacaatgtgaaaatctaaccgttgagcttgggagttttacgtctatatgaaaattccggttgtcgtctacattacggtagtaaacaggaccacagtgattccaaatgtcccaaggaatttactgaaaaccccaactaggactgtgaaaggcttgtggatgacatttaacagttgagattttcatgtgtttgagattcttgtaacacattttgctgtataggtgaaagcttagccacacaaaaggagaaacagaggatatggataaaataaattatccaacaaaaaccaatctaaaagccacatcagcatccacaaccaatcagaggacagaatcatatttcacattttcaatccagaccaatcaaaatcctgaacgaatcctactctccaccttataggagcagtttcgtctcttcctccttctttcacttagctcttcctagtgttaaaccagagtaaagcttgaaactttggactaaaaga

SEQ ID NO: 3728 - DNA, 3000 bp, Unknown; identical to SEQ ID NO: 3723
  misc_feature (1)..( 3000): cDNA_ID_3089404_gDNA_ID_1620659_Annot_ID_163751 3000 nt of promoter + ATG

SEQ ID NO: 3729 - DNA, 3000 bp, Unknown
  misc_feature (1)..( 3000): cDNA_ID_3071695_gDNA_ID_1620659_Annot_ID_163742 3000 nt of promoter + ATG
actctccctttgaatttctgcgcttttcgacagtcgaaaaactttgtttagataactccaaaacacacacaatcatgtcgaatttgatcccttacctttgtgtagtatctgcaacctttctctccatcagtaacaataagcagcttaagcttatcatgcataagagacaaaacaacatcatccttctccgcatctccacgcgttagaaacgttacctcatcatcgcttacctacacatcacgaaactcgaacactaagatcatcgaaaacacgagtccggttgttacaacaaaaacaaacataccttgataatatcagcctcattccaaatacttttgatgccttctatagcagcttcagtagaaggccaaagaggcaaccgaacgttcgggtcataagagagtaagactcccgcatctttagcggttttcatcgcagccatgtgagctgttctacatggctcagagatcaagctaatggaaccatagtggaaaatcttagctttcttgataagatccttgttgagttcagattctttcaagagcatgtccgcactagggttcctgtaaaacataaactctctctcaccatctttcttcaaagtcacaaaggccaacgcggttcttgcattggtatcaaagcaaacaccttcactgttcacaccgttcttcttcaatatgttaaccaacatgtgtccaaactcatcatcaccaaactataaaagacattacacaatcacatatcacttttcaccatcagttaatagattctaacataaattatacaaaccttgccgatgaaagctgatttgccaccgagtttggtgatggcacaagcaacattagcaggagcaccaccaggggctttgagaaaaccggtggactcagctaaagaaacaccagaagtgtcagggacaaagtcgataagcatttcaccaaaggaaactatcaatggagtattagccatctttactcagacaagaaatgttcacacacataaaccaaacaaaattaacctctctttattaagctggagaattagcaacagaactgcatgaaaaatgggataagcatttaacaaaatccctaacttgtagtaaaaactcagtacaaacttttgactgtaacaaacctccaatttagggtcctaattatatcaacagaaataaatctttgtcacacacaacgtaccaaattctctgtatttatattcaaagtttaagtctttcttacttagttgcagtaactgaaaaatccgatttgaacaaatcttatgaaaagagattaatcattagttcaagactcaagagtcactttacagagcaaattctatacatttttaacctttttaagggttttaaaccctaaaagagacattatcaaaactctatgattagggttttcaaatccctccattgtccattaactaggaccccaacagctcaagtacatgactgtcctcagcgattcttcagcttgcttggtcttgttggtataatcgattgatgaggaagagagcttcttagcttgcgacacggatcttaagttgttgcgtagatactgattcgcagatcggatcacgtagttccaacgacacacgcctagttggtctttcaatgcctcaacggctccgatgcttgcagcaaccatccacgttttgcttgcagagctcatttctctttgtttctttcttgtttaagtgatttggtttcgattttgtgtttgttgatgatgaatgagaagtgaatcaaagtgggttttgtttataaaagaagagaaagcagacaaaaagtgccgtgcctttggagtttgaaagtgcagacaaaaagtgggttttgtagctgctggttttcttggtttctgctgaaactatgaatgtttagttcaatgacgattttgcccatgtttagttcatcgacttgagctgctttttttttttttaaataataatatagatcctaatttttgtgtatactagaatgatctgtatattaaatctataaaaattttaaaaattaatgtactacttgaaacgaaatttattatttataaaatgactgattaaaggataaaataaaacaaatctctatattcttttttacaatctcttttttttagtaaaatgttaaattttatatcattttaaatttttgacagaagttataaagagaactgagaacggattaaagcaatttacagaaaagtaaaataatattactactctaattgtatacgattgctcaagagcgcataccagtaaatcgcaaagaaaaacaccaattccaaatctactaaactcggaaatttgtgtggttgtcacagaaccaacattctaaaattctcattctaattgttatgagcggaaatatgtttactaatttagcggaaatatttgatgatactagttttacttttgattttttgaatactcatgttaaatggtattcatcttctgtatgaaagaaagaaaaaaaaaaaaagtaagtcatcgcaaaaccatttttcttttgattgaatttttatttatttatttacattttgtgtttaatatattttttacttttttggtcggcaaatgatttttgatattatattattattcatctccaacatgcattattctacaaggagataaagaaaacatttactatatttcaaaacttggacacaacacgaaacccaaacaagtgaacaatctcaaaaccaggtgcacatgatagcggcactcgttaatccaggaactaccagaatcccaatattaccccttatccaattcgttcttaaaaggctaacaacgtcattttactatccagacagtagtaaacaaccaaaaccaacggccacagcttctagttttaactccaactacacggcaatattgttggcttcttctctcttacataaacacaccaattcacttcactttctaaacatcatcaacaaaaacaattctcaatacacaaaacacaaaacacaaagaagtttaattctctgaagaaag

SEQ ID NO: 3730 - DNA, 3000 bp, Unknown; identical to SEQ ID NO: 3722
  misc_feature (1)..( 3000): cDNA_ID_1821667_gDNA_ID_1620659_Annot_ID_163740 3000 nt of promoter + ATG

SEQ ID NO: 3731 - DNA, 3000 bp, Unknown; identical to SEQ ID NO: 3727
  misc_feature (1)..( 3000): cDNA_ID_2997358_gDNA_ID_1620659_Annot_ID_47927 3000 nt of promoter + ATG

SEQ ID NO: 3732 - DNA, 3000 bp, Unknown; identical to SEQ ID NO: 3726
  misc_feature (1)..( 3000): cDNA_ID_1821648_gDNA_ID_1620659_Annot_ID_47929 3000 nt of promoter + ATG

SEQ ID NO: 3733 - DNA, 3000 bp, Unknown; identical to SEQ ID NO: 3725
  misc_feature (1)..( 3000): cDNA_ID_2050676_gDNA_ID_1620659_Annot_ID_47931 3000 nt of promoter + ATG

SEQ ID NO: 3734 - DNA, 85 bp, Unknown; identical to SEQ ID NO: 3724
  misc_feature (1)..( 85): cDNA_ID_1821629_gDNA_ID_1620659_Annot_ID_47935 3000 nt of promoter + ATG

SEQ ID NO: 3735 - DNA, 3000 bp, Unknown
  misc_feature (1)..( 3000): cDNA_ID_1821740_gDNA_ID_1620660_Annot_ID_47937 3000 nt of promoter + ATG
tgcttccacaatatcacttgatgaagccccaagtgaagaggacaatcctagcggattcaagtgctgtgtctcggaagccatggaagatatgttcttgtgtgttgataccaacatcggatgatcaaagatacaagtgggaccggagctgcagtttccactgtaaaaatataaggtacacacgggttctccatgtcgaaagattggagcaaaaattgagcaagcgataaacacagatgatagtaatgagattagaaaaacagagttcagtttgaagtcgaacaagcttttggtgttggttagttcaaaagaatgaggtttgaagcaaagaaaactaacgtctgctagattgctactgctagtttaagaaatggctcaccgtccgtgaagggaggcctttggagcttaaggaggtctcaaggacatgggtttctctctcactcggatgatggaatttacacatactgtaataccaaagttgcagtctcctgtctgcatgtaacatgggcatctggtaaaacatggaatccccaaacaaacatgggaagcttagagattctgctaatggatgatacatccatcaaacaaactcccagaacaatgtgtatgagtaatctcaagctgttttcgtttggtggatctaaagtccaagatttcagaggtttggagttgctgcctttctcaggttgctctcagttatcagacatgtatctcacagattgtaatctgtacaaattcccggacaattttagctgcttatcctcgctgcagtctttatgcttgagccgaaacagtatcgagaatctaccaggaagcatcaagaaacttcatcatctcaaatctctttacttaaagaattgcaaaaatctcatttctcttccagtgcttccatcaaatcagtacttggatgttcatggctgtatctcactcgaaacagtttcaaaacccatgacgcttctagtgatagctgaaaagacccattctactttcgtattcacggattgctacaagctaaaccgagatgcacaagaaaaaattgtggctcatactcagctcaagagtcaaatactggcgaatagatcttttcaacttaatcataaggtccaatctctggttattctgttattattccagtgacattgctatccttaatggtttttccaggaactagttttggaacctttatctgctgtaagttttccagggaatgatttgccactatggttccgccatcagagaattggatcttcaatggaaaccaacctgccttcacactggtgcgacgataaattcattggtctttctctctgcacggttgtctctttcaaggactatgaagatagaaccagccggttctccgtgatatgcaagtgcaagttcagaaacgaagacggtgattacatcagctttacatgtaatcttgggggatggaaagagcagtgtggatcgtctagccatgaagaatcaagaagacttagctctgatcatgtgttcatcagttatagcaactgttaccatgccaagaaaaacgatgatctcaatagatgttgcaacaccacagcctcgttcaaattttttgttactgatggcagagccaaaagaaaactagattgctgtgaggtggtgaaatgcgggatgagcttgttatatgcaccagatgagaatgattgtaggttgcatgggttacacgagaataatcttgagaaagagatatctggaaaagatacagaactaaacgaaaccgccttggataaagttgttgtgtccaagagaggccgtttatgtgtacaagaagaagagctactgaacaggaaaagaataaaggaagacgtctcttttggtaattacgattgttctgtaacttctattcttagttacatggagccagcaaagcctcatctctggaaataactaatttcagaaagctgatttcagtcaaggtttgtttcaaacagaggtcgaatcatgtttttaatctatcttattcttggttccatctcttaagtgaattgcagaatcagtttcaagtgaattggctactctgaaacaattttcaagaagaagtaattggatgtttgttgtgtaagttctctttcctaaacacaaacagatgtctacaaagatcgaaacagtttcctcagcacaaaaaactcagaatcagatctattttttcgtattcttaaatgtaagcttaagtttgacttgtaataagattcattgagacttgaagtaaggttccaatgcaaacttattgcgatatctgtatgcacaataattgataagattctttgagacttaagtaaagttccaatacaaatgcacattacaaattcattagccacctcgcatatgttaactttatccacaagcttcaatattatacaacaaagtatcctatcccatgcctttgagtgatttggtttacgtcttctaatattaagaatgaagtgtagcctaaaaagttaagaaagtcaaatgcttaagttgtaaaataccaaaaaatccgcactcaaaaaaagaatgaatatcatcacagaatcaaaagtcaaaagcggacgccaaacacactaaacaacatactattttgcttcaaacattaccaatgttttagaccattgacctaaatttactattttttaaaaaatatcatgagaattacgagtgttcacaacttcacatactgtgttgaaaagtcacgcaacaagtcacatgaataatttcccatatatgcaaccaaaataaccccacaagattaattgaagcctcacgtttctttcttggtcattttttgacgttaccaaacccactgaataaaaatttataaaatactgaaaacaactttattagatcgtctccactttatcatttttacttatattgtaagcttataattaaaatcccaaaagatgaaaaacgatactctacttttttatgaatcctttaattgaacaaacggaaccaacacaacaacagattgtgaagaagaaagaaaaaacaacaatg

SEQ ID NO: 3736 - DNA, 3000 bp, Unknown
  misc_feature (1)..( 3000): cDNA_ID_1821728_gDNA_ID_1620660_Annot_ID_47940 3000 nt of promoter + ATG
tggctccatgtaactaagaatagaagttacagaacaatcgtaattaccaaaagagacgtcttcctttattcttttcctgttcagtagctcttcttcttgtacacataaacggcctctcttggacacaacaactttatccaaggcggtttcgtttagttctgtatcttttccagatatctctttctcaagattattctcgtgtaacccatgcaacctacaatcattctcatctggtgcatataacaagctcatcccgcatttcaccacctcacagcaatctagttttcttttggctctgccatcagtaacaaaaaatttgaacgaggctgtggtgttgcaacatctattgagatcatcgtttttcttggcatggtaacagttgctataactgatgaacacatgatcagagctaagtcttcttgattcttcatggctagacgatccacactgctctttccatcccccaagattacatgtaaagctgatgtaatcaccgtcttcgtttctgaacttgcacttgcatatcacggagaaccggctggttctatcttcatagtccttgaaagagacaaccgtgcagagagaaagaccaatgaatttatcgtcgcaccagtgtgaaggcaggttggtttccattgaagatccaattctctgatggcggaaccatagtggcaaatcattccctggaaaacttacagcagataaaggttccaaaactagttcctggaaaaaccattaaggatagcaatgtcactggaataataacagaataaccagagattggaccttatgattaagttgaaaagatctattcgccagtatttgactcttgagctgagtatgagccacaattttttcttgtgcatctcggtttagcttgtagcaatccgtgaatacgaaagtagaatgggtcttttcagctatcactagaagcgtcatgggttttgaaactgtttcgagtgagatacagccatgaacatccaagtactgatttgatggaagcactggaagagaaatgagatttttgcaattctttaagtaaagagatttgagatgatgaagtttcttgatgcttcctggtagattctcgatactgtttcggctcaagcataaagactgcagcgaggataagcagctaaaattgtccgggaatttgtacagattacaatctgtgagatacatgtctgataactgagagcaacctgagaaaggcagcaactccaaacctctgaaatcttggactttagatccaccaaacgaaaacagcttgagattactcatacacattgttctgggagtttgtttgatggatgtatcatccattagcagaatctctaagcttcccatgtttgtttggggattccatgttttaccagatgcccatgttacatgcagacaggagactgcaactttggtattacagtatgtgtaaattccatcatccgagtgagagagaaacccatgtccttgagacctccttaagctccaaaggcctcccttcacggacggtgagccatttcttaaactagcagtagcaatctagcagacgttagttttctttgcttcaaacctcattcttttgaactaaccaacaccaaaagcttgttcgacttcaaactgaactctgtttttctaatctcattactatcatctgtgtttatcgcttgctcaatttttgctccaatctttcgacatggagaacccgtgtgtaccttatatttttacagtggaaactgcagctccggtcccacttgtatctttgatcatccgatgttggtatcaacacacaagaacatatcttccatggcttccgagacacagcacttgaatccgctaggattgtcctcttcacttggggcttcatcaagtgatattgtggaagcatcagccaagaaacccagaatatacaagaacacttcttccgtagcgtctgatacaccacactcgaatccattaagattttcttctccaattggagattcatcaagtgagcttgtggaaagatcaactaaagaaactgtaatcaacaagaacacaccttccatggcttctgagactctgcatgctaatccactaagattttattcttccattagagagtcatcaagtgattgaagtgaacttgtggaaacatcagattagaaacccatagtgcataagaacacaccttccatggcttctgagacaccgcacttgaagtcggtaggactttcttcttcgcttggacctttatcaagtgagcttgtggaagcatcaactgtgtctgaagtcacacaagaaaccgttagtagaggtgtcattgaagtgaagacttaaaatttttgtggttaaacaaaatgttgtattttaaaatattgttcttctaatatatattttctaatattaacatatgcttgatccaaaaatttccatgagtaatatatgaaaacaacataattaagtaaaaaaaatacaaggcatttttccaaattaactcaaacaaaaatccataggatatttttcaaaagtataaacaaaacaaggcatttttccaaattaactaattagaatattacaaattttgttagagaactatttgatttattgaattgaaaagatatttgtaatatagtaatattaattttactagtaatgaaaatcagttattcataattacagaatcaaactgacatttatccttttctgtagatgacgtggatacctaatgcaccgtcgattaaatctgcgtagtgaaaccccgcactgctcacagcaccacctctctcgaaccatcgagtctcgaacccagagaggactttcctcagtgagtcctccgttccttagcttctcttccagatccaaactctcaccaaactttctcacaacacacacacaattcgattcgatccacactcttaaaatcccaaagatctctctgattttgaaattcgattcttccccagatcaacttgtgaatttttccacaattttggttcatgattttgatttcgtgaaggactt

SEQ ID NO: 3737 - DNA, 3000 bp, Unknown
  misc_feature (1)..( 3000): cDNA_ID_1821724_gDNA_ID_1620660_Annot_ID_47941 3000 nt of promoter + ATG
gctgaagcttcatgtcgagctaatcctcaaatgcatccggtcgttaccatccgacaatgccaatcaatcagacatcccaaactggggacaactagatgaattctttgcagagcactttagagaagaagaagcaggcgaagctgagtgatgaagtcgtcattgtacagcaatttgtttcttctcacatcctttataaagtcaaaaattcagagtttgggtttgaggatggactattcgcctgtagatttaacttacaggtaacaaattcattccctctgcctccattaccaaaaaaccactctgctaccaaaagtgtttaacaaatcaaatagaaaatgtgatctgtaatatctcatcggtttacatcaagatttgtggaagtgaaccaaattagtatcctgaaaatcaggcctttcttttgttgagatactgcatagaaacttaaagagaactctgatgggttggacccttaaaatgcaggcatactacagttcttggctcggatgaatattataaagccaacagtatctctataaagtaacaatctctcttcttgtttgaattttctcatttgcctcaattgttgcttttttattatcctttttgtttttgagttgtatgagatacgactgattgaactgaagtttttgaaagaggtaagcagtagattcttagacgtatataatgtattttcagagcgaggaaatatttagtcatttggtgtgtccactgcataagcatttcaagtctttattatgaacttgcacctccagaaaactaatggaaagattggctaacaaatggttccaaaacctccgtatcaaaaaatcctggagtaattaactaaggaatttgtaatgctaatgagtagacacaatttttcaatttcttaaacatttataaatataaaaaaatattttcaacaaaacaaaataataaaaagatgtaacattttaaagataatgcggtcctcatattttttaaataacaaataacaaaaaaagtgatagttttagcaaaataataatataaataacaaaatatatacatgaatagtagatagcgaaagaatgaaactttatatacaaagtgcaaacaataagtaattattaatatatacatttttacaataattcaattaaatgattataatttcatttacatacattttagtaatttaaaatttaaaataaatatatgaaagttacactaagagacgctcttgtaaataattaaatgttataaagatttataaaataaagtaaaagttgtaattgttcgtgaaataaactaaatattgcaatagttcaactcatcgattaaaactatttatgaagagtgactacaaaaggatgcaacggtagaatactacatttattcgggttgcaattttctaaaaaacataaccataaaatatttatttttaacttttaaaataaataacaaaaagttgtgataaaattacacactgtttccaactgcaaaacacatttatgggtgttatctttcaaatagattatgttagttgaaggtgatacatgtaagtgagtgaatggtgattagtcgagttatgtgtttttggagacaactatcttcttcctttcatcaatatacatatgttgtaagtagttgaatatcataatatggctagatttataattattaattttgttgatgaattagtatttaagaaattaacaaaatttgatggttccgacattattaattcgtagagattttgctgtacaaactattcaactagtgggacatatccactttggatattcattaagagacaaagctagagttatttatttcatttctaacattatagtgctacaattctaaataaatgatcgaaactatatactctctcttccttttcaatttattttatagaaaaaacgcacatattaaaaaatatatattaaaactgattataaatgtattaataatgtgatttcaaattttctatagttctaaaccattgatatttaattatttgtcttgaagtttaaaattcatcaataataactactcattctgttcttttttaattaattttctagaaaaacacacatattaataaaacatataaaactgattataaatgtattaatttttgtgatttacaattttttataattttaaaccaatgatattcaattatttgtcttgaaatttaaaattcatcaataataactaataaatagtgcataaaaaacttaaaaaattaaacaatattgttttctaaaagatcaagtaataaggaaccgaaggagtactaaatagtgcatagaaacctaaaaaatcaacttttttgaaacaaatttttttcctaaaaaatcaaataataaggagcaaaaggagtataatctaatctctaaccgatatataatctcatttaactataaaatttaaatcttaatcttctttgattaacccaaaccgatatataatctcatttaattacaaaatctaaaccttaatcttctaattagaaactcaatccgatattaaacccgtttaattgtaaaatttaaattttaacaatactttttaaatttaaactgatatttagttttgtttaattgtaaaatttaaatccgtttataattcagatcgatatttaattataaatctaaaccgatatttaactttgtttaatcatataatctaatcctaaaaaattcttatataaactcaaccaatatatcatttcgttttgatagtggagtatattttataattaaatgaattttagttttattagctagctgattatgattggctaaaatagaaagagtaaagagtgaataagaaggttcatttttggttttcaaattatccatctttattttttgtcctggatactggataggcctttatctttcattcttggggtttcgcatctcttccactaatttatttgagatggaattccattgagaatattcgtctcttctttctttcgttctcaattcccatcccatattcccc

SEQ ID NO: 3738 - DNA, 3000 bp, Unknown
  misc_feature (1)..( 3000): cDNA_ID_1821716_gDNA_ID_1620660_Annot_ID_47943 3000 nt of promoter + ATG
aaaaatcacaaatatcaaatttagttatcaacatacaaatatctgaacgaatattgataatataggaattagctgaaccagagccggccctaagcagaggctggtgaagcatattacttgctttatctctaattattaaaaaaacaaaaatatatgtaccaccctaaattcaggagttacttgctctatcttcttgtctacgtggaagtttttcaccacgttgaaatattttataggtgagaaaaaaaattatataaaatatttgcaaattaaatttggatataatagaaacaattattaaattatttgttttatacaaacagatcttggatcccatctaataatgttacctataatggctttatctgaatagtttcatcccgcgtgcatgcggatcgttgtctagtatttatgggtaatcaatagccattcaatggccattcaagtgtttgtttccagtgaaattcagttgccgacgaaaaacaaattaaactaaattgattgaaaaatgttttaaaaatcttcccaaattaggaccactttttatgtggccatgttttatacagcaatatgttttcgttatctatatgcatatatatttttttggcctttccatttattagatgagaccaagacgaggaagggcataaaatggttcgggagttaaaataagtgtagattaatttattgcaaataaaaccctgcaatttcttaatagttttttaaagaaaaaatctacaacaatcgaaaacttctttcaactcatacgtactatagtctatttgaattgtttataatattcgtaccatttcacttttatattttatctcttctttctcgacattcgtgcgctttaaccacacatcattattttcttgaaaacaaaacgaaacggtttcgtctctctctcagtttctctgacaatctgtacagattctctacatataactttcaatcgattttgtcccttagttttattcatcataattacttattagtcctcatctaatttgatataatcgttttgtacccaaaattctaggctttttgtccttctgcattttttgggtttttgtcccccacttgttgtgaaattttttgaacttcatttccaaggcattagccacgagagcataactgaggaagtcgtgaaaaatctcaggatgagatttgctgtcgacatctatgaagagtttgttcagcctctccgtggttgatgcccctttcaatatttttgtttaagaacttatgtttttttgtaatttttatttattctactttgttttctacttggatgctactttcttgatagttctataactcttgtctttctttgtaatcttaattaacattctagatctctaaataagattaacataagaaatatgtatcggcaaaactaatgataaatcgcgggagacaacgtaatatagaatgcattaggggacatgtttacttgttcgcggggaacaacgtagtaaggattacattcaaatgatcaagtaattcgaatgcattctatattacgtcgtccttcgctaaccggtaatcatgtcccctaatgtattatatattacgttgtcccccgctaacaggtaatcatgtcctctaatgcattctatattacgttgtccctcgcagaattttcgatagccaaattatttaaacaagtcaacttttaaatatccaataacaacagtaaaagtcagctgctctccactatctttcccctaatttcttatgtttcttccatgatttttttgttctgtgtcatcatatcaaccaaaagatatctctgtctatgacatagactctgtcccacacttgggcatttttgtccataattccacgcgagtaattgcaatgtagtagattttaaaataattgaccaaatgtagcagattttgaatgttacattctgaaatgtgggagattttgaaaaattcccctttttttcaaaccatgatgttcttataaaggaaataaacaattgaaggcttttacatcttggtcggattgatcaaattgtttttttttcttatttgcgagggttactaactttatcaatttgtaactgaaaactagtcaacaatgaataagtgtaaggacacattatgtcacattttcttattaatattatattcctaacatggcatcttaaaatgattaatattttcattcatattagagataaacttatactttggatagtttatatgtgtttgaatttacttcagctccgaaaccatgtaaaacaatataaaactcaataatcttcttgaaaggataagtttgtgtttgtcttttaaactctttagaattaaactgtttacaataatatatcaatatttaatagaatttttggtataaaaatagggttgtttttgcaaacaagaaagaactttctcaaaatttcacttactttttttttgtcgtcttagatttattatttattgcaaattataaaagctgttatataaacgattctactacggacaattctttctgacccttattagatttacgacatatgatacctcattcttcttttcaatgctcttgatggagagcttcaatgatattctctgcgtagaatcctggcgaacggttataattgtacatcgttggaaatttcatgcacatttgctttcattaatctgcaaatctgctaataaaccgcagtatctgggattcgaatctcagtatagaagcgttaataaatccttggtcaaccaatatgtatgtcaagggagcttccaccattgactttgtttgtttgttttttttttttttttaatactttaaaacttccaagaaacatcgaggaaaacgaaaggaaatgtttgggaaaagaactttgtacacgttagttgaaagataaaattattgttaacacgtatttacattttcaacgaacggcctgtatataattttctgtatagaatccataaaacgggaaatcatttttgaaagtcttcaagcagacgctctagaataatg

SEQ ID NO: 3739 - DNA, 2933 bp, Unknown
  misc_feature (1)..( 2933): cDNA_ID_3071717_gDNA_ID_1620660_Annot_ID_163801 3000 nt of promoter + ATG
ttctgcgccagctatatgttttccggtcagacaagtaccgcccaagccaatcacatcctacttgtaaccctttcaacttatcaactacagaagaaaactcagcatcaatcccaccaaccagtagcaaagggcaactagtaactaacttaataactgtagccttactaagacccaaattctcataaccccttagcttcatcgccaacatcccagattcatatctaaaaatctctctcgcttctttatacatacggccaatcttaccacgcgggatcccatagttgcaaagagcatgaaagttctcaaacatgataccatcatcactcaaaaacattagcttccgtggaagaaacgtttcaaactcataaggacacaaacccaaactctcgaaaaacggttcaaactcgtttatcggattgtacctaaggaacttagtcaatcccttggatacatctttctgattatcatcaatcttagacaacaaagtcgacataaaacaaggagaattcttacttatatgctctgcatcagtaaaagtaaagcttctagtataatgcaagtaatcaaaaagagcttcttgagcttgattcctactagcccttgataccggattaacgaaaaacctagttggtaagtgagacgagtgttgttgtaacttagatttatcctgacgaacacagctttcaatctgaaaactccgaaatggaactgaaacacgagaaaggtcgaacctttgaactgggttttgacgaggaatagatgagaaagttatacagtagttgagatttgaaatcatattcaacagtttatgaactcttctctgatttctggataataacatcgcaacctaacaacaaagagaaacaggtgaaagtcacaatcaaatagagagctatgaagaattctcaatgcttactctttcaagtaagaaatttacctgaaattagggcttattaagcatttgaatcaaccattttcccaagattcttagggttcatagccaaatctcagttactttgcttaaaccttgttctggcttcaaattaaggtggaaatttcagagaagcccctaaacgtttataatatatccgaaacgaccataatcttatttttctatacttcaatatgtgcctaagagtttccgaaatatcataaaggtaccaattagtgcatcatcaacacttggccttaaaagacttgacgtgagatattattattcctcttttgataccgaattaatagacttgtcaagtttagacttgtcaaaagtgataaacatatcacacgaaatcgtgttattatcacgagcgttacaaattcttcaagtatatcactataaaacgacttcaaaacccaaccaagtggtgatttctttgagctgactatatgtatgcaagataaaggcagcaagaaacggtgagttttcttcacgagcataaatggtttgttcgtctttctgatttttgattttatagatatgtaacttttttattaggtcaatttcaagtggtccatggtagattcaattcatgttaggtcatcatcttcaagctaaaacgcctaccaaacatataataacaagtattcttttaatcactagttttagtttcaaaatatttctgactatcttaagtgcatttagattttagttcaacatgatggaaaaagataacttgactcttgtttaacttgcatatgttttgtttgactatttgttatgtttgagaggaatgatttttctttgtaaaacagctttatataaaacttgtggcttactcggatgaattttatatttgttttgattatttttcaaatgttgtttttttcaaaaccttttgacagtaaattacaatataaattattttcaaagatcttaatatgtcttatttaagtgaatttttaattataattataagtaaattattaaatatagattataacaatgaagttaaatcttattcactatatctttaaatatttttttctcttatttttttaatattttattcactatttgtaacaaaattataaaagccaaaattaccaaatttctgcaagaaaaaacaaaaaacaaatccttggctcctcctaaaatccacctaccttacccttttatatataagatacaaccaaaaacaagatgatttggtgctttcaatataaaagatataatatttcataattaacatattctcccttaggttttcctgcacactcgatttaaatcgtctaacaaggtcagaatccataatttatacaaccattttctgcttcctttgtttcctccctaattacatgttattaactattaagcatatccttaaaacaaaacccaaactgaattatctttgtcaatagttgtcttctctctcgattattcttaagataactactttggtagttttgtttttttaattactactgcaccctcttgcgcttcaagttacttggtaaaaaactctcttaactttggataatttctcgaagtctctgaagaaagaaccctttttttcttctctcataatcgtctctgtaacgtccttctccttcttcatcttctttgcgtttcttctgcagccttttgcggttcacgtgttgattgcttctgtctctactttttgtccgttttaaagtttaaacttattgttacaaaattggattttctctgatcaaacgataaaaacagagtcttttagtatcttcttcttgggtataacgaagatttttgtggtttcttctgatgtaattcacaaaaccatttgtataatccttgaaaagactttttgttcagaaatgaagtttcttactttgctctttcttttctatatttcagtaatgatgatgataaagcttgagagaagtgattagtctgtagaagaagaagagttaaaaccattcaccaaagaagaaattgagaactagagacagtcatg

SEQ ID NO: 3740 - DNA, 3000 bp, Unknown
  misc_feature (1)..( 3000): cDNA_ID_3091045_gDNA_ID_1620660_Annot_ID_163794 3000 nt of promoter + ATG
aatgcatctagttctttgtccatatttatccttctagaaactagcgcagaacagtattaagattattactgagtcctttttccatgttgtcctccctcctcacccagacgattgctacagtctgcatgttccttgcgggaaaagtggaagaaactcctaggccgttaaaagatgttattgttgtctcctatgagataatacacaagaaggatcctactactgcacagaaaatcaagcaaaaggtctgaatattctaaactttctctaatccggtttcctgtttagtaataagcgaatttgcactgtttctcgcatattctattttactatgacataagttttctactaaacccaggattgcacttgtttgtgaacaatcctcctatgatcattgtccttgtcgttggatctctcatctgtgctggtcaccgtctctattatttctcttctttgtactgaacgtatttcacttttgcaggaagtatatgagcaacaaaaagagcttatactaaatggagaaaagattgtactttctacgctgggatttgacttcaatgtttatcatccttataagcctcttgtagaagcgataaagaaatttaaggtcgcacagaatgctctggcccaagttgcatggaattttgttaacgatgggtacgttaaaagtctgtttccttgaaagcttcagatagatctatctgtcttgtattttcttcttcatacaatgaaaagatgcttgcagtctgcggacgtcactctgcctgcaatttaagcctcaccacattgcggcgggagcaatttttcttgctgcgaagttccttaaagtgaaattaccatcagatggagagaaggtctggtggcaagaatttgatgtcacacctcgacaactagagggtgagagaactatctttatctttgaattaattttatgaaactgtttccactttttctgtttgacttgtatgccttattttgcatctgatgctaagagctactcccttatgtatactgcagatgttagcaaccaaatgcttgagctctatgagcaaaaccgtgttcctgcatctcaagtaagcgaagtcgaaagtagtgtaggtggaggatcagctcatcatgttgggtctaggccatcagcacgtctaactcatgaacattcaaattctgataatctcgggggctcgacaaaagctacacaaaaccggagcaatgataatgggagtggtgaggcaggtagtgtcatcaccgagcagaagggggaaagagatacagaaacgaaagatagcatgcatactgaaagtcatccagcccataagtctagatcgggagttgaggcacctggggaggataaaatagagaaagcaggtgcacattttccagaagatgataaatctagaattgttggtacagctgatgtcacggtcagccaatccccaaaagacataaaaatgtttagagataaggtgaaggccaaactagaggcgaagaaggtccaaggtgaaaagacgagaaagaaggatttggtggatgaggatgatttgatagaaagagaactggaagacgtggaattagctgttgaggatgacaaagatatacaaaacaaaagctccatgggtacagaacatggcgagattcttgatggaaacaacttggtggtcaataccgaggaaggtgaaatgatagatgatgtttcttcaacaatgcctagccggaagagaaaaatggaaagtccttgtgaaaaacagttaggagaaggaaagagacgacacgacaacagtgagaatgtggaagaaggtcagaagacaaacccaggaggaagtagtcatagttatggtgacagagagccaagaagacactcccaagagaggtagatgatcaaaaccttctcatggtctattagagacatttcccaaccatgatgcgaaatgagtccactgtatttacaatgttggttatcttttcattttccttggcacttgtattcaacagttgagaaactaaatcaggtttccatccatcccataggatttagggtctctataattttgatctttgttagcattcccttttgtatatcgggggaataaaaaagaattttgacgaatttatttagagccaagacaatattagtgttttgtcattcattgccgaaggatgttttgataataacaatatgaaacagagtggtcaattgatttgtcaatgtgtagttgtttttgtaaggtttgttttatgttaagtccactcgtaaccttgttcccattgtcattatactgcttttcgtatgtatcggttagcttggtgaccaatccggttaaccacaaaatcaggcggaatagttgtcaaattaaagagcaaaaaagactcatgaaaaagagctgtaggggttttcattttttcaattcgttttcaaaattttcaggtttaaaaataaatacaggtctgaattaattcgctcggtttgaattttcgggtttagtccagtgtgatttagtcggttaagttgctcaaaattttggatttggttcggtttattcattatcaaacacaaaaacacaaaaaaagccaacctaaagaaggaacaacaaaagacctaaaaaccctctcgtcttctcttcttcttcttcttcttctccttgctctctcttgtcgtcggcggcagattatccaatcgttaggctatcgttccgacactctacagtcattacaaacatttcaatacaacaaaaactcatccttttcttctcttattaaccataatttcggattccctttctaagtatacagctttcccagaacgagctcttgcaaagccaaagaatgtaagtatttgtttctttagggttttagcgaattcaatcttagtaagtcatcttcttcttttttcgacctttgtataattgcaggtcgaggatttgtgttaagaatttgccaaaacatgtgaaagaggatcaacttcgagatcacttttcacagaaaggagaaatcactgacgccaaattg

SEQ ID NO: 3741 - DNA, 3000 bp, Unknown
  misc_feature (1)..( 3000): cDNA_ID_3071742_gDNA_ID_1620660_Annot_ID_163786 3000 nt of promoter + ATG
aagttcaaaaaatttcacaacaagtgggggacaaaaacccaaaaaatgcagaaggacaaaaagcctagaattttgggtacaaaacgattatatcaaattagatgaggactaataagtaattatgatgaataaaactaagggacaaaatcgattgaaagttatatgtagagaatctgtacagattgtcagagaaactgagagagagacgaaaccgtttcgttttgttttcaagaaaataatgatgtgtggttaaagcgcacgaatgtcgagaaagaagagataaaatataaaagtgaaatggtacgaatattataaacaattcaaatagactatagtacgtatgagttgaaagaagttttcgattgttgtagattttttctttaaaaaactattaagaaattgcagggttttatttgcaataaattaatctacacttattttaactcccgaaccattttatgcccttcctcgtcttggtctcatctaataaatggaaaggccaaaaaaatatatatgcatatagataacgaaaacatattgctgtataaaacatggccacataaaaagtggtcctaatttgggaagatttttaaaacatttttcaatcaatttagtttaatttgtttttcgtcggcaactgaatttcactggaaacaaacacttgaatggccattgaatggctattgattacccataaatactagacaacgatccgcatgcacgcgggatgaaactattcagataaagccattataggtaacattattagatgggatccaagatctgtttgtataaaacaaataatttaataattgtttctattatatccaaatttaatttgcaaatattttatataattttttttctcacctataaaatatttcaacgtggtgaaaaacttccacgtagacaagaagatagagcaagtaactcctgaatttagggtggtacatatatttttgtttttttaataattagagataaagcaagtaatatgcttcaccagcctctgcttagggccggctctggttcagctaattcctatattatcaatattcgttcagatatttgtatgttgataactaaatttgatatttgtgatttttctaaaaaaataatactaaaactaagtgcctgcattggcaggggccataatgctagttatcttctatattagagcgtaagtcaacgatcctattctgtaaggtctaccatctagaattgtaacaatttcgcaatcatccagcttttgctgacccgcccgccactcatctactagtcgtttgtatcacaattccaggtcagctacaatttggccaagttacttctagataagaatcctctggtctaaagtcctctcatattgtacgtaacttacaaaattttattgcaaaaaagaaaaccctctcataattaaataacgacacatggatcattttcaactagcaatggcccattgctagttgtttttggtagtatggcccattaacagtttgatttaagacctgtttttaggaaatttttccaagaaaactcttcaattatctttttataaggaagtttaatacctaatatttctgggttggaagaataatacatatatttataaaaatatgtaatttaacactcaaacaattaaatgttttatacttacaatctcataacaaaaaataaaattctaattaccgttaccatctcaattaattattaatttttagatgatttgacattaatttataattttgaatataattttattttatgttatctcaaaaatataaaatttcatttttatcataattaatttattttaaaattcaacataaaaaattatgagaaaatctaaatactttaaaatagtcatttttacaatcttatttcatcgtctcaatatcaaaaagatgttttttcttgagattcaatcttcgattctagatttcctcaattaatcgctacgagaatcgctgataaacaatttttgtcgccctcttttgccaacatcaaattcgataaccgttcacaatctccttttaatcgccactaaaattaatttgatttcattcgtcgtaatgaatatgatatcaacgaccattgatatgaacttcttcttcgtcgtgagaaactctctattcgaatttaaatccttgacaaataaacaattttcgacaaaatctcaatttgaatctcattgtatttctcatgatttttcaattcataaaaatggctaattttatttttacctttttcaaagttttttttgcttttttcttgaatttaaaaaagataatatttttttataaaaacttttgggataatatagaaactaaatgttaataaaataacttttaaaaattaaataaaattaatgcttcatcacctaaacattagtagttaattgagctagaaatggtaaaattggaattgtatttttgttctgagattaaattgtttgagtattaaactttacagttttattagtactgtatgtgtatttttcttcgaaccggaaagtaatgggtagtaaacatccaaataaaaaaataattgagttttttttgagaattttcctttcttttattaacatattttactttttttgattaaatttttttaaaatatatttaaaatctttgtagaagcacactaatccatttgctaactaatttaaatatgtttctaacatgttcacatatattaaaaggcacgttttgagcatacatatattttggttctcagttcttgatcatctagtgcattatctctcaaaaaccctaatcatttggcctcttcttttccccctaggctaatttacatataatatccttagaacgaccaaaacaatgtgccacagggactaattaaattaaacagcttgtaaaaattgtaattatcttggaattgttggagttggttaaaacactttttagaggcctttttattcccatctccgaccattccaccaaaacccaaaccatttttgtttcgcaaaatcattctacc

SEQ ID NO: 3742 - DNA, 3000 bp, Unknown
  misc_feature (1)..( 3000): cDNA_ID_3071750_gDNA_ID_1620660_Annot_ID_163782 3000 nt of promoter + ATG
tttaattaattttctagaaaaacacacatattaataaaacatataaaactgattataaatgtattaatttttgtgatttacaattttttataattttaaaccaatgatattcaattatttgtcttgaaatttaaaattcatcaataataactaataaatagtgcataaaaaacttaaaaaattaaacaatattgttttctaaaagatcaagtaataaggaaccgaaggagtactaaatagtgcatagaaacctaaaaaatcaacttttttgaaacaaatttttttcctaaaaaatcaaataataaggagcaaaaggagtataatctaatctctaaccgatatataatctcatttaactataaaatttaaatcttaatcttctttgattaacccaaaccgatatataatctcatttaattacaaaatctaaaccttaatcttctaattagaaactcaatccgatattaaacccgtttaattgtaaaatttaaattttaacaatactttttaaatttaaactgatatttagttttgtttaattgtaaaatttaaatccgtttataattcagatcgatatttaattataaatctaaaccgatatttaactttgtttaatcatataatctaatcctaaaaaattcttatataaactcaaccaatatatcatttcgttttgatagtggagtatattttataattaaatgaattttagttttattagctagctgattatgattggctaaaatagaaagagtaaagagtgaataagaaggttcatttttggttttcaaattatccatctttattttttgtcctggatactggataggcctttatctttcattcttggggtttcgcatctcttccactaatttatttgagatggaattccattgagaatattcgtctcttctttctttcgttctcaattcccatcccatattccccatggcagcttctttttgcggcagccggagatacgatgttttcccgagcttcagtaaggtagatgtccgcaggtcattcctcgcgcatcttctcaaggagctcgaccgcagattaatcaatacgttcacagatcatggtatggagagaaacctcccaatcgacgctgaacttttatcggcgatagcagaatcgaggatctcaatagtcatcttctctaaaaactatgcttcttccacgtggtgcttagatgaattggttgagatccacacgtgttataaggaattggctcaaatagtggttccggttttctttaacgtacatccttcgcaagttaaaaaacagaccggagaatttggtaaggtttttggaaagacatgcaaaggtaaaccagagaatcggaaactaagatggatgcaagctctagcagcggtagcaaatattgctggatatgatcttcagaactggtattttcttttccattccaaccctaatatatatatgtgcctgtgttcaattttggggtgcctctttaatgacaaaattgactattgttattaggcctgatgaagctgtcatgattgagatggtagctgacgatgtttcgaaaaaactttttaaatcatcgaatgatttcagtgatatcgtcgggattgaagctcatttagaggcaatgagttcaatattgcgcttgaaatctgagaaagctagaatggtcgggatttcggggccttcagggattggtaagactaccatcgcaaaagctcttttcagtaaactctctccccaattccaccttcgtgctttcgttacttataaaagaaccaaccaggacgactatgacatgaagttgtgttggatagaaaaatttctgtcagaaattcttggtcaaaaggacttgaaggttttggatttaggtgcggtggaacaaagtctaatgcacaagaaagttcttatcattcttgacgatgtagatgatcttgagctattaaagaccttggtgggacaaactggatggttcgggtttggaagcagaattgttgtgatcactcaggataggcagcttctcaaggctcatgatattaacctcatatatgaggtggccttcccatctgcccatcttgctcttgagattttctgccaatctgcttttgggaaaatatatccaccatctgattttagagaactctctgttgaatttgcatatcttgccggcaatcttcctttggatcttagggtcttggtttggccatgaaaggaaagcacagggaggagtggatagagatgctgcctaggctccgaaatgatttggacgggaaatttaagaaaacattgagaaattacctgcctgtgatacggaagcgcgtttccaatgaagaagggggccgtgagaaattgaaaaagggaaataaaaagttggatttggatgaggagtttcctggtggagaaatttacagtgatgagataccttcgccaacatctaactggaaagatacagatgactttgattcaggggacatcattccaatcattgcagacaaatctactactataattcccaacaggaggcactcgaacgatgactggtgttctttctgtgagttcctcagaaaccgtatacccccgttgaatccctttaaatgtagtgccaatgatgtcattgattttcttcgcacacggcaggttttaggcagcactgaggctctcgttgaccgcctcattttcagtagtgaggcatttggcataaaacctgaggaaaacccttttcgcagccaagctgtaacatcgtacttgaaggcggccagggatatgacacgagaaaaagaatgcatacttgtgttttcgtgccacgacaaccttgatgtagatgaaacatctttcattgaagccatctcaaaagaattgcacaagcaggggttcatccctttgacatataatcttttgggcagagagaacctcgatgaggagatgttatacggatctagagtcggtatcatgatactttcaagtagttatgtttcttctagacagtccctggatcacctggttgcagtt

SEQ ID NO: 3743 - DNA, 3000 bp, Unknown; identical to SEQ ID NO: 3736
  misc_feature (1)..( 3000): cDNA_ID_2132580_gDNA_ID_1620660_Annot_ID_163780 3000 nt of promoter + ATG

SEQ ID NO: 3744 - DNA, 3000 bp, Unknown; identical to SEQ ID NO: 3741
  misc_feature (1)..( 3000): cDNA_ID_1821712_gDNA_ID_1620660_Annot_ID_47944 3000 nt of promoter + ATG

SEQ ID NO: 3745 - DNA, 3000 bp, Unknown
  misc_feature (1)..( 3000): cDNA_ID_1821704_gDNA_ID_1620660_Annot_ID_47947 3000 nt of promoter + ATG
tggaaatgtcgataagagaaggttctgatgaaggtgttcctgtagttgtttcttcaccgggttctatagtgtcaaaagcttatcaagatctagctcaaaacgtggtgaaaggactcaaggagctaagagagaatccagataatgagattcagatgaagctaaatgttcctcattctagccactcatcatagaacaaacacttatatatgaccaaagttttgtcttgctgcctcactttctcatatttttgtaccaaagagaatgtttgcaaagagaagaatgtaatttgctgatgataaaagcaatagagccagtcactgtttatgaaccatgtgaaacagcagatcaatgtggttactttcatatattagataggaagatgatgaattttaaaccagacatgtagagatcactatatagtaatgtcaaaattttgaagaagaaacaaatacattcgtttttctgagtaaaataaaacatgttgagatcacttcacaatgtaagatgtgatcaccaaattaccccttcatcatcttcttcatcgtcatctagatcttcaaattcaagattctcattgccgtagcattcttcgtttcctctatacgcatcttcattactgtaatcctcattccagtctggttcttctgcttcttcttcttcttcttcagaatactgagatttcaaaaggctttcttcactgttttgctttgaatattctatttggtcaccaacaacaactggtttatctagctttgccctcttgggagagttctcctacaaagatgtgaatacacataataaacataagagactaagcagagaaataagaggtccattctatcaccaaaaagcagatatctctgacactttgtattcttgcataaaagataatttacaaattggaaagaggggaaaacttacaggatcaaatagcttatccaagacattgtaattgatttccaaactcggtctctgcatgaattaagacaagtaagagaatttttcagataaataaatttaactacagatgaaaaataaggaagatccaaataaatccgaaaggaaagaaatgcaatagtctagacattgtttcagagagtgagctgaagtaatggtatcactgacctttttattttcagtttctgcattgctttcggttttggttgcagaagttttcttactaggagcaatcttattagcaggatccttctttttcctagtggtgactttcctatattttccctgataaacaatcgttaacaagaacgtcaatgaaagcatgcgaggaacaacatgaagttcacttaaacagaaattaagaagattgaagaagacaggttaagagtaaaaaccttctggtattcagggttcatcaattcccatgctctcttcttcagaatgaattccttattattacttagattctcagcaacctgatgagcagcaataataaccatcaaaatcagaacaagtatacataaattgtttttgttcagaagctaaacaagaagacatagacaagaaaggcaaagcacaagaaaatagttttgactaggttatatggtcggagttcagtgaaaccaaacgcgtgatggacttacatgttaagaaaaatgctggttcgccacaatccaggaacaattgttgtggtttatagagactaaaaaccatagatgggattcaaattagataaacatccacaagaacaaaattataccatccttaagaaaggccgagagatgctagctacgataagcatcagttaatcattatttattttacctcagcatcactgatatcagataagtcctctgcaagatcacctttagactgtcgagaaggaaaaactcctgaaaaatcaaatcacatcaccatttaagtatttaccggaaaataaaagatatcatctgcataatctttaacaatataacactcatggagaggggtctttgcattacctttgttgccatatacttttaggtttctagccaataactttactgatttctccacctgaaattgatacaccaacgatcaaaaacattcaaaacatagcttctcaacaaaaaagagcagattgataccatcaaacaaagttcctcataagtaatggaatctatagttttgtcatcgagccaatatcaataccacaaagagaccacatatggtaaactaagtttcttattacattaccatgatcacaaagctctaaaatttaatctagaatcagatcaaaatccgaataaggagggagaaaattttaccattgttcacgaacccaatgcggcaaagatagatcgccggtgagaatctgggttttaaaataaaaaaatatcagaaacctagaacgcctgggtttgaattaacacgtgtcctagtcaaattggttataggctttgccacgtaagcacagacccttttgataataagatatttatatttgtaccctctttaatatcaaaatcttcgattttcccccaaaaagaaaatttccagaaaacgagcgtagtggtggtgaatcactgactcttctctctttcgctcgtcgctgcgaaagagcatttgttttcgtttacgcgtttctttttctcgttgagtgcatttgttctaggtaaagtaacaatcttttcttctgctatatccgaattgatgatttttttttttgggtcggtgaatttttgctacgcaaattttgttttcttttcctttccgagtcatggcatatgcattgtttcatgaatttttcaccattcgttcatcgaaatttacaatctttaccttttgtttgatgaaaattttcattgctcagacttattctttttttctctgttttgtttgaaaccatttccccttgtaatgcgtctgtttcaatgttgatgtctgttcttcagtatcttgttaaggtttacaacaatctaacagcattacaatttactctgttttttttttccagaatttgtgtattagtctaagaagatcattactgtttacataccacca

SEQ ID NO: 3746 - DNA, 3000 bp, Unknown
  misc_feature (1)..( 3000): cDNA_ID_1821700_gDNA_ID_1620660_Annot_ID_47948 3000 nt of promoter + ATG
actgctatatttttctgtcaccgattcttccttcgtcaatcacatgcgaaaaatgacagacaggtgagtttggttggatgtgaaaaaatggtcactaaggaagtatatgtcttttttcctctgttgttttgagtgaaactatgagtctattagctgtctggtgatttaaaccatcctggcttcttgagattcatctattgatatccatctatgtgtcatcttctttactagttctagtcaaagcgtattagttgattgatcagatgagtctacctgattttattcacgataaaactgtctgtgatagagatcaagctctctgtttcttcccgtttggatcgatgtgtatggttagtaaatttttgtgcttgttttgcgatgattgtattcttcttgaaaagtaagaacaactagactagtacttatgcctttgcctgttacatttgctctccagacgattgcaacagtctgcatgctcctagctgggaaggttgaggaaactccagtgacattagaagacgttattattgcctcatatgagagaatacacaagaaggatcttgctggtgctcagagaaaggttttttcttcttttcatactaccgatcctacaactctccttgtccatttctttgttgactagtttagtaggtcttgaaaagatctattgtttactttcttttgcatattaatgttatttcacttttgcaggaagtatatgaccaacagaaagagcttgtattaatcggagaggagcttgttctttctacattgaactttgatctctgtattagccacccttataaacctcttgtagaagcaattaagaaatatatggttgaagatgctaagacccaacttgcccaatttgcatggaattttgtcaacgattggtatgcttgattatgttacttgaaagctttttgaattatgatggttctctatacgccttgtgttttccttcttcatacaatcacaagtctattgcagtctgcgaacgacactctgcctgcagtatcagcctcatcacatagcggcaggtgctattctccttgctgctgagctgccaacagtggacttacaatcttacagagaggtcttgtgtcaagagtttgatatcacaccttgtcaattagaaggtatgtgttagcttttttcttttcttaaaaattattgactttgatgactgtagaccttgttgatgtggttaatttatcatttgcgttttcagatatccgaggccaaatacttgagctttatgagagaattcctacatctcaagaaagcaaagttgaaagtagtggtggtgtggccgtagtgcatcaacctatatctagagatatggcttccacagagaagtgtccaagttctgatattgaaggaggctcatcgcaagtcaatctaagccagagcgatgatcattcagtccacgatgggtctaggtctgaaggaattggagaggtgaactcagaaagtgaagctcaaaagaatctacaggaccattctgttggtaatataatggttgagaaaagtgatgatgttggggtcgtccaattgaagaaagacttgcaactgcatcaagaggaggttgagtctaaacaagagaaagataagaagtcatttgaaaaagatataacgaaaatagatttgatggatgagaaggatttgactgaaagtgaagtagaagatgagattaacaaaacaatgcagacaggaagacaaatctttatgaaagttgaggaccctgatgacaacatgactgtcgaacacagtgagattcgaaatgcaaacaactcaggtgttgatgatgaattggtggctgatacttgtctgataaatgacagtgatttgtaggaaatggtcgttgaagatggtgaaatagtggtttagatgtttagctcagaagctttcgaagagaaccagttttggtcctgagaagagctttttaactaggtgagttttggagagacaactattatatgttttctccaaaagacgaaggtttagtttcaagatttgtggtagatcatgactttgaatcttttctcactcttaagacttttaactacagtggaacgagagcaagttctccttgcatcgtcaatgtgttgtgtaatgtcctaaagttctcttaaacattgtggtatagtttcaagatttgtggtagatccttttcattcaagtaaattgggtttcatgacttcgaatccttgcttttctctgttttgaacaactgtttaactccaactaccaatggaattagattgaacttggatagagacataagataagtcccttgcaagatcaccatcaaacaaagatgctcatggcagtatccataccacaaaagacaccaaatttgttgaacatgcttaaatctttactgcacagattctgatgactatcttctctaatcacagccacacaattcaagaaaattcaaacgtttgttgtatacaatttgtttaggcctgaagtaattggagaggagaagtcagaaagtgaagctggagatataattgtagaggcaagaggagaagtcactgcactaataaatttttccttttttttccactaactaataaaaattccttttttcccgccataagcgtgacgtctattacacgcgtcactcgtctagtggtttatagaaatgtaaaaaaggaaatcaaatcttcgtttagtaaaaaaggaaaatcaacctataaattactgaattgtatttgtaaatcaataaagtaaattcaattttaccgtcttttaatttcttcctcttctctcgtctctctcacgcgacgtttctagggttcttctgcttatctggagattttgcataaactttctttaatgggtattgttttatccaccgaatcgttgctaatctgtttctgatttcgtgtgattattcgttctgtgaattcctgtttagattctgtaaacaaatccactgaacgcttttttttttgtcgtttccttctctgaagaaactctatcaacgac

SEQ ID NO: 3747 - DNA, 3000 bp, Unknown
  misc_feature (1)..( 3000): cDNA_ID_1821696_gDNA_ID_1620660_Annot_ID_47949 3000 nt of promoter + ATG
gtttctgatttcgtgtgattattcgttctgtgaattcctgtttagattctgtaaacaaatccactgaacgcttttttttttgtcgtttccttctctgaagaaactctatcaacgacatggaatctaacaaggaagaagcgaaaagagcattggatattgctgagaagaaactatcaaagaatgattacaacagagcgaaaagatatgctaagaaggctcatcgtatgtatccaaatctcgttggtttggaacaagtgttgataatgatcgatgtttatatctctgcaacaaacaagatcaacggagaagctgattggtacagagttctcggtgttgatcctttagctgatgatgaagctgtgaagaaacgttacaggaagttagctcttttgcttcatcctgacaaaaacaggtttactggtgctgaaggtgcgtttaagttgattctagaagcttgggatctattgtctgataaatctcagagaagttcttatgatcagaagaggaaatcgaatcaagttaaacagagaacgagtggaatgcagaagcctaagagaagttctacgcctaaaccaacagagtcagacaagccagcttcttcttatggacctacgcctccacctgagcctaggcctaagcgtaggcctagacctaatatacctgagcctgatattcctatgcctatgcctactaggcataaacctaagtctaagcctgatatttcattgacaacggtgaaagttggaaccttttggacggtttgcaatagatgcaagacgtattgtgagtttatgagggctagttgtcttaataagactgtaccttgtccaaactgcggtaagtatttcattgcaaccgtgataccttcagagttagtcaatgggaggctagtcatcagattgagtccttgtaatcagtcaacatggaaaaaagcaagtgatgatacttcttcaacttcagcaatggcaaagactgtacccgaaagagttaaaagatggtttgaccctatgcctgagatggattcttcaacgcaaaaaattggtacgttttggacagtgtgcagtagatgcaagacacattgtaagttggtgagggctaatcatcttaacaagaccttcccttgtcctaactgcagtcaggaatttgttgcggccgagatgattatagaggtaatcaatgggggtccagtcataaaattgagtccctctgtgcagtcaaatagcaaaaggacacgtgatgcttcttccacaacctcagcatctgataaggcacagaggactgcatatcaaaaagaagaagttttgaaaagagaaaagattgatcctgatgttgcgtctgctgctactggagaaaatgtaaaagtagcagagacccttttcaaggagccgatgacaacaggaaacgaaaactctactactgaagaaggaattgtaaaagaatcagagaccctttgcaaggagccgatgacaacaggaaatgaaaactctactactgaagaaggaaatgtaaaagaagcagagacctttttcgaggagccgatgacaacaggcaatgtaaaagaagtagagacccttttcgaggagccgatgacaacagacaatgaaaactctactcctgaagcagagaggcttttcaagaagccgatgtctacaggagacgaaaactctactcatgaagctcaaaggcttttcaagaagccgatgacaacaggaaatgcaaactctaatcttgaagcgcagagatgctttttgaggatatggcaacgggaaatgcaatctctactcttaaagtagagagaacacatgatagatgtgatataagaagtaagacatttggatgtagaagttaatatatatctgcttttgttttttggtatgcatcagtaatagttttttatttgatttttgaaacatgaatttacgacttaaccttttgattgaaatctatttctttttcattgaaatcattcatctcaatctgctgctaccgaatgcttctctgctcattctccacttatcataaaggctctttcttcttatgttcactctcataattcatataatgaactacacagaattgggattataacattttgttgaagttgaattccttgactgaatctgcacaaagaaaattaagcttgggtgagaagagatgaagaaaagataagaagtagttaaagctagaatattaagtgtgtgaatgtgtatcaagtggtgaaagacaaactatatgtatgtgcgtgaggacttgtaacaatctatatctatccttgtgatccaatattatcatttatcaatgtagaagattaaagtaaagtggttatcttgttttctatctccattaaacgaacaaaacaaagtgttagagatagagagaaacagagaactaacctctaaagagtaaaacagaggttaggatgtgagaatgtcaacacattttacttgagattttatagttagagaatgaagtggcttaattaccatattttagttgtgattgcatgtcttcacttgaaatagtaagttttaatactgaatgattacatacatattcaccgagctgataaagtttccttttttccatccatcaagaaaataagcgttacgtgtcagacacgccctagtggttataaaaaatctacattcaataaaaatcaaatcttctttcagtaaaagcaaaatcaacctataaataaattacttaatagttaataccaaaccattattttacgtctttcaatatcttcctcttctctcgtctgtctctcgcggcggctctagggttcttccgcttaactcgagattttgcaaacactttctttatgggtattgttatattcaccgaattgttgcatatctgtttctgattttgtgtaatatttcctggattttttttttgaaactctgttattttgtctgttgcttctttgattgtttatgtagaggaagaaactctttcaacgacatggactgtaataaggaagaagccaaaaaagca

SEQ ID NO: 3748 - DNA, 3000 bp, Unknown
  misc_feature (1)..( 3000): cDNA_ID_1821688_gDNA_ID_1620660_Annot_ID_47951 3000 nt of promoter + ATG
atgttgcttggttaagaagtgggtctccatcaaaaactgggcttttacacttattggtaagatgattttgctttgcacaagaatcccaaaagtttcttccttctatgggttttgtgtagtgtcggaatcttcaaatctattttgtaattcgtacgattactttgttgctttatatacagtaacttgagaaatctagggcttgttcttttgacttggtgatttgcatgtatggttttgcctataattaagatgttacttactagtttacacgagattcttctttttatgaattgtttttatccattcttcgattgttgtttgtgaaattgtgattgattatgtgtaattatgtagtggctttggatagagtaacttcagattcagagatctgtggctaaggacttgtttttctaacttagtgattttcatttacggttttgcttctgtttttcatccttcttaatcctttttcttttggctcctccaattggttttccatagagacaaggtgcaaaatcgtttgaaggattctttgttcaacaaagatatggaatgcaacaaggaggaagctataagagcaatggatattgctaagaggaaagttgcagagaatgattacaacggggctaagctttttgctaacaaggctcaggatttgtatccgaaacttgatggtttaagacaagtgatgatgttgatcgatgtgtatatctcagcaggaaatacaattagtggaggagaatctgattggtatggaattcttggtgttgatcctttggctgatgaggaagtagtgaagaaacagtataagaggctagctcttttgcttcatcctgacaagaacaattgtgaaggcgcagagggtgcgtttaagcttgtgttagctgcttggtgtttgttatctgataaggttaagagaattgcttatgatcagaagaggaagttgaacgaagttaaaccgaaaaggagtcgaaagcagaaacaacctccaaagaaaccaccaaatcagccgaaacaacaaccaaatcagcagaaacaaccaccagatcagcagaagcagccaccaaatcagcctagacagccaccaaaccagcagaagcaaccacaaaacgagccgaaacaaccaccaaaccagcctaaacaaccaccaaatcaagcaagtactaatggtagagctagaagcaaaaagcccacttccaaagtttctatcttttggacaatgtgcaacaaatgcgagacacaatatgagtatgtgagggtttattatcttaacaagaccgtactttgccgaaattgccgtgggaattttaaggcaactgagatagagaaaacaccaactgagaaggaaaaaacaccaactgagaaagaggaaacaccacaagcaacaaacaagaacacaaatggtgcttcgtcttcttgtgatagagattcttcactaaatgttaattttgattctagttttcgacgggattcttctttatcaagaatgagttactttaacagtggaaatgtggcaaatcaagcagaagaaagagggaaaagagaggtaagggagtcagaagaagaagctggtagaggaattgcaaactctgatttgaaagtagaagagagagtttttaagaagctgaggacagataactatgcagagtcaagtagtgaaatcaaggtgtgaagtaagctgaggacagataattagaagtttaacagtgaagtaggaactatgacatttagaagtttaacaatcaatgattttatgattatgatatttgaatattttgcatctagactaggatcttgtacagtggaaccaggttagttcttcttcctgtcatcttcaatgttgaatctgaaatgtcaaagctttattttatttttgttaacaatgtgtgctttaacaacgtgagtcaaattaatcaaagtgggttcacttaaattgttggaagaaattttacttccactaactaaatatttccttcttcggtcccttcattctcaaaagtttttacttttgtccccaaatattttaacggagaagatttagtctcctacttcgggtcatcatatatcacttgaaaatcgggatattcgttaaaaatcccccttttttttttttcttttcttgcttcctccctttttttttttttttgttctttcctttctcgcgtttcttctcctagggttagggttcgacgaacgcagctgttccacgcgtttagtttcaattctccatcgaagaagccataatccggtgcgtaatcatcgtttttgttatatgtttccgattaggtgtattattttccgtttgttttctcgggtttggtagtttcacgaacttttgcatctctcagatctattgtacgttttttccttcgtttgtgacggatttttctgtgaaaagagtttaaatttccatggagaattactcgattatctctaatttaactctttggcaatcaaatttttcgattttattgtttttttctggatgcgtgagcttagttatgaacaaggagggtcaactcgtttacatgattctctattcacagtattttcgtgggaaaggagcaattatgtttttgttttcatgattcatgtctttatgttgcatattttggccccttttactctcatttagactatgtggtgtttgttttgatgccattgttttgattttccatcaattagtaattttttcagtccgaatttcaattcttcgtcattgaccttgttgatgattcctgtgctttcagattcctaaagagcttacatttgttactcaactttaaagttttgacgctagagattactatcctcttgctgggaactcaacgtgaccaggtataaatctcagctcatagataagcaaagtagtttttttctacatctcttagatttgtaccctttttagctcacagtatcagttcaataaccaagctgatccctcttatgaacttacattcattggttctgtttttgctagactgtgtttgaaagatagca

SEQ ID NO: 3749 - DNA, 3000 bp, Unknown
  misc_feature (1)..( 3000): cDNA_ID_1808411_gDNA_ID_1620660_Annot_ID_47955 3000 nt of promoter + ATG
gaattttatatttgttttgattatttttcaaatgttgtttttttcaaaaccttttgacagtaaattacaatataaattattttcaaagatcttaatatgtcttatttaagtgaatttttaattataattataagtaaattattaaatatagattataacaatgaagttaaatcttattcactatatctttaaatatttttttctcttatttttttaatattttattcactatttgtaacaaaattataaaagccaaaattaccaaatttctgcaagaaaaaacaaaaaacaaatccttggctcctcctaaaatccacctaccttacccttttatatataagatacaaccaaaaacaagatgatttggtgctttcaatataaaagatataatatttcataattaacatattctcccttaggttttcctgcacactcgatttaaatcgtctaacaaggtcagaatccataatttatacaaccattttctgcttcctttgtttcctccctaattacatgttattaactattaagcatatccttaaaacaaaacccaaactgaattatctttgtcaatagttgtcttctctctcgattattcttaagataactactttggtagttttgtttttttaattactactgcaccctcttgcgcttcaagttacttggtaaaaaactctcttaactttggataatttctcgaagtctctgaagaaagaaccctttttttcttctctcataatcgtctctgtaacgtccttctccttcttcatcttctttgcgtttcttctgcagccttttgcggttcacgtgttgattgcttctgtctctactttttgtccgttttaaagtttaaacttattgttacaaaattggattttctctgatcaaacgataaaaacagagtcttttagtatcttcttcttgggtataacgaagatttttgtggtttcttctgatgtaattcacaaaaccatttgtataatccttgaaaagactttttgttcagaaatgaagtttcttactttgctctttcttttctatatttcagtaatgatgatgataaagcttgagagaagtgattagtctgtagaagaagaagagttaaaaccattcaccaaagaagaaattgagaactagagacagtcatggagatcaaatcttaccaaaatcaagcagagtattttgttgaacactatttattagcagatccatttcttccatatacttctgttcttgttggaatctgtctttgcaaattggtaagttttgcttctcttcacttacaattgcagaaacttcacttttttctgcattctgtttttaaacagtgtagcttatgttcttaggtatatgatcttacggagttattcagctcaattcatgtcaaatcatactcagctctcacaaaaataaagagaattgaatggaacaacaggtatgtataggttccttgtttcagcctttatatgttatgctctagtctcttatcactttggcttgacaggggaatttctacagtccatgcgatctttatctcattcatggcattatactttgcgttcttctctgatttgttttctgaccaaagaagccttgaaacccttacggtgtttcgtaactcgcctctgtctacctttggtttaggagtaagttttgatctttcttcattttatctcacaagtcctactcatgagcattgatcaacttatatggtactttgttgtgatgtgttttttgcataggtatcagttggttactttcttgcggatcttggaatgatcttttggttatacccttctttaggaggatcagaatatgtaagttagacacatgaaagcttatgtggtcttcaattacttgacaatcttgtgttttttgtttcagatattacatcactgcttatctggaacagcagtagcgtattctttgttctctggagaggctcagctttacacatacatggttttaatctctgaagtgactacaccagagatcaatcttagatggtaccttgacattgctggtttgaaacgatctaaagcttatcttgttaatggagttgctatattctttgcttggttggtgagtttcttaaaacctttgtttttcgttgtaaatgtctgaaaacttgatctccttttttatagcaatgatgttttgtttgcagacagcaagaattcttctgttcatctacatgttttaccatgtctacacacattatgatcaggtaatcaagatttcggtttgattatctctaaaccaaacggtctagcctttaggaaaaataggaattactctgttttttttttttttttgctgttgtattggttaggtttagagataatgaattgatgatcaatggatttttcggcaggtgatagagatgcatacattcggttatctactggtatttgttgtaccgatttcattgagtgtcatgaacttgatctggtttggtaagatagtgaagggattgaagaaaactcttgagaaaagacagtgaagaaagagttgtgtttttttttttatgtaaatataaaactcttatgaagaatcttacaagtttataagcaacaaagatatggtttgtttctaacttttagcttatacactaattatgttcaaaatctcattcccattattcccacaacagtccctatgcatgctgaatacttaaatccatgtacgaaatcaatagaggacttaacccaaaaagacttgggcctaaatctacattgggccaacgattatattcgtagttttttcgtgtcatattaacttgccgtgtaatatttgtttacttgtattttttgttagttctagaaagaaagcaacattaattgaggaggaggagattggttgttgttgacgacgcgtttccgctcactaattttttttaacctttttgtgtctccgtcgtcttttgatcttcaatctcagttttgagctgaagattatcgtatcgacctgcgattctcttcagatcgataatccatg

SEQ ID NO: 3750 - DNA, 3000 bp, Unknown
  misc_feature (1)..( 3000): cDNA_ID_1027071_gDNA_ID_1620662_Annot_ID_47989 3000 nt of promoter + ATG
gttatattatattattcacaaatatcaatttaatatatattttaaaaataatgtacttatagaaaaacttgtacttatagccaaaatagttaaaaattatattttttaggctgtgagaaaaaataagaaaagtacaacatgattgtagttttttagtgtctttataaatttcctacaccccaaccaatcaatcatactcggtgtcttgaagaaaacataaaaaatatttataggaagacatgtaactgaagatgcgtgttttaagtcataattttttttttttttgaaagacacccaacaattcactaatggaggttgtctaaaaagaataaccaagaaaatggtctctgaacccatctctaaaactattttataatgtgtatatgtaacagtaagaagtgaaaaaaaaaatccatatatcaattaaggtgttaaaaaaaaaagtccatatatcaatcacttttctaacatcgtcgatcattgtgacgaaaatcgcttacgtctgtaccgtattaacgtaatgccatcaaacgaaaaagtttgctcactcactccggtttagatctttgttaacataagcaaacttttcagagagtgaactaatagattcacgaaacgacaccgtaattagtatcgaaaacttgactgacatcagcctaagaaaaatatcgcaaattgttataaaatattaaacttaagaagaaaaatgaaaatataatagagtttacttaaaaaaaaataatgggttagctgattttatacccataaactaattgcattctcagctttttcccccacactttttggctcttaaatttctaccataaactttgataattctttaaattacaacatgtactttcggattcatccttaaacatacatttccaattgaaccggtcattaaaccaggattaaccacaaatccgcgtttactgtaccacgatgcgatttacccgattaatcacctctatccgttaagaaaagggttggctgattttatagccataaactaattgcattctctgctttccccctcacactttttgctcctgaaatttccaccataaacttcgataattcttaaaattgcaacatatactttcagattcatccttaaaaatatgtttccaattgatttagattgtcattggaacaatcttcaacctcttttgtctattttggatgatgtattttcggaagttgattctctttaagatgatattatttaggttgactaattgatttggagtcttatctatccttatgattaggagttttatctagttcgatttgtcattttccttaccaattaacacaacacataacatatatagatagattcacattataaaacaaagagaaaacgatgtcgttttcttaacgggtgtgggattagtcgggtaaatcacaatagcggtacactaaacgcggatttatggttaatctcggtttaacaatctaaatcaattggaaacatatttttaaggatgaatctgaaagtacatgttgcaattttaagaattatcgaagtttatggtggaaatttcaggagcaaaaagtatgggtgaaaagcagagaatgcaattagtttatggctataaaatcagccaacctttttcttaacggatatggtgattaatcgggtaaatcgcaatcgtggtacagtaaacgcggatttgtggttaattccggtttaaagaccggttcaattggaaatgtatgtttaaggatgaatccgaaagtacatgttgtaatttaaagaattatcaaagtttatggtgaaaaattaagagccaaaaagtgtggggaaaaagctgagaatgcaattagtttatgggtataaaatcagccaacccaaaaataatagaattaacaagaaagtaagagacttaaggaaagagtaatagataaaaataagcattatccatattttatagatagaaatgagcgatggattaccaccacgcttatacgattgcgataattacatctatacttatccagttttacagaaaaaataatagataaaaataagcattatccatattttatagatagaaatgagcgatggattaccagcacgcgtatacgattgcgataatcacatccatacttatcgagttttaaggaaaaagtaatagataaaaataagcattatccatattttatagatagaaatgagcgatggattaccaccacgcttatacgattgcgataatcacatccatacttatctagttttaaggaaaaaataatagataaagataagcattatccatatttaatagatagaaatgagcgatggattaccaccacgcttatacgattgcgataatcacatccatacttatctagttataaggaaaaaataatagataaagataagcattatccatattcaatagatagaaatgagcgatgaattaccaccacgtttatacgattgcgataatcacatccatatttatctagttttaaggaaaaaataatagataaagataaacattatccatattttatagatagaaatgagcgatggattaccaccacgcttatacgattgcgataattacatctatacttatccagttttacagaaaatataatagataaaaataagcattatccatattttatagatagaaatgagcgatgaattaccaccacgtttatacgattgcgataatcacatccatacttatcgaattttaaggagaaaataatagataaaaataaacattatccatattttatagataaaaatgagcgatggattaccaccacgcttatacgattgcgataattacatccatatttattcaattttaaagaaaatataatagataaacataagcattatccatttttataaatagaaatgagcgatggattaccaccacgcttatacgattgcgataatttcatctatacttatcgggtttataacaccgataatccgatttggtcaaaatccggcggagaaaaaccctaaaaatg

SEQ ID NO: 3751 - DNA, 3000 bp, Unknown
  misc_feature (1)..( 3000): cDNA_ID_3071783_gDNA_ID_1620662_Annot_ID_163843 3000 nt of promoter + ATG
aattaagcacgataacatattgcaccaattggctaaatctgataattaaaactgacttcaagcaaactccaaaaccaatgaccagaaaagtctctcctcaatctgaatgagcttaaactccttcctttatgtcaaacctaccaccccattaaagtttaactcctcctccaaatatcctccttaaactcaactagatggttttgactcgctattttgagccagggttatacagtcatcaatctgatgagcatccatcatccaggaagggaattactatgtttgaaacacgggtttgaaacacaagtatacaaacccgtgtttccttccatagacacaccctatgataagcagcttagaagcttctcctagtagcagaaataatcgaagaccataaaaagagcccatgttaacaaacagatcagagaattatctgtagcaatctagaccttgattgattcgtattagtcatccttccaccattataaggtctaccacgcggagtagcagaagcggctttacgagcaacggttgttgttacaggaaactggtttccttggaaattagacctcttcttagcaaaagcaccctgaaaatatgatataaatcacaacaccacaaaagaaaaaatcttctaagtgacaggaaaatgaagcttagacaacaaattcaccgagaacacaacaacactaacctgtctaacatcagaccgagagtccatataacgctgtgctttcaccgcactattcttcgcagcaccactaaatttctcctttttattctgctcaaacacaatatgccaaatgttcaataaagaatcaaagagagacataaaaatgtaagctttaacaaaccaagttactaaccaatactctctgtttcttgcccttattcacattggtattgctcttttccatcttgataatctcatctatacccacatacaaatgatcatgaagctataaactaaacaaaggatacatctttatatgagtaaataaattaaacataaacacacctaaagacatgtccattttcttctcagtgagagcaacagtctccgtagtaatcggtttctcagtcgccatctacatagaagtggacacaatttaaaccaaagatttcacaaaatcaaatacataaaccctaaaaatcattagttaaggttcaacgaattttgagtttattgaacttatgagaagcaaggagatacaaaagagataaagcaaaccctagtttttgaagattgatctgattcaagaatcgatcaaacaaaaccctcaattaaattgactcgtgtgaagaatggaggagaagctttaagagatgaaatcgtttaccgattttagaaagtcgattgtctcactgagacaaaaaaagagaggctttttatttttaatccgataacgagttaaaccaaagtgaactgagtcaaaacgtttccgatcatgtatacgtggcacattttcattggaagagatgattggttgttttgcatttttttttttcttgttctctcccttgaagttgaagagtttaacttcgctaagaggaacagagatggacttgagtttaatatgttctctgtttctaacaaatgtttttttttttgagttttcacatacaataaaaaatattaaaagttaattataatttataaatgcattattatttgtaatttacgatttaccattttctataaccttaattaatatagtatacaattatttttcttgaaatttataattcatcaataataactaataactattgcattggaaccaatttttttcctaaatatattatttaggaatagaggagtagttgtttttggcaaaatggtagattattataaatctaaagtggtagcagttaaatttgaaaaagatggatggcatagtaactaaaaattatttaccacaataccttaaaaaactatgaagaattgattaattaactaacagactaattaaaacccatatttgtcctttgaaattataattttaaataattttacgaaacctatttaagattacataatattttttttataaacaataacaccttttaaaattattaaaacttattcactatccagtttcctagtttttatatattttgaagcaataatgttgtgcttaaaatatatgacatcatagtgacaaaagagtttatttgtgaaatctcaatcactcattttgaaatgccattaatccgtttagtttccatattattaccaaagcctttcatgtaattggaaacttttgtgtttaagacttaatcttgtgttgcaggagccaaaagaaaaagaaaaaaacaaaaacaaagaaattgtaaagaagtgtaactagaaaaatcgatcactcatcttcaaatgtcattatccatcaagttgtcatattattgctagacagaagtggtcgtctagacttagttgacctgaaaaaagaatagtcaaagtcttttatatgtggacctgaaattagactttgtagtttgtacgtaagtttgtgttgctagagcctatatgagaaaaaaaaaacagtggatattggtgattggtttaatctggttaactccggttatctagatactggtttaatatcatttatcttgtgtatatataaactaaactttagtttattttgttgatgaacgttgtaacaaacacttaattctgttaataaagattcagtttaatctccgatcttttctcttcttttccgttttaccggaacttcgccggtgttaatatggtatcagagcatatcatttgagcttccgcatatcatcggagatgagtctttcattgaatcatctttctcttatgagagtttttcgattcctacaatcgtttgttgcaatttgcaatttcttcgtcagctatctaattttggttctgattcttcttctttccttcgattgaccttttgtggtgacgaatctcactttcttttcatttcgtctcactttctttgatttttctttaacaatttgttaaga

SEQ ID NO: 3752 - DNA, 3000 bp, Unknown
  misc_feature (1)..( 3000): cDNA_ID_3071787_gDNA_ID_1620662_Annot_ID_163837 3000 nt of promoter + ATG
gacaagagccggtacatctgattccatcttcggttttgacggtgaacttaagctcctcgagagatttcaaacaagctcatgggattcatcagtggtggagggaagataacaagtttgagactaaagtttaccagtacaaatgatttgtatcagtttttttttaaatggatttaaccggtattaggcttttactttccggtttagacggttcaatgtatcgcaatcataaataagtgtctctctatagtcggtatatataaaccggaaataggcgtctacgttctaatttagccggttcaatgtgttgtaatcttatatatagtctcttgatcaataagacgacgacgtttcactttatctctgtaaaacctcgcagagcatctgcacattttcccgcgcactttctcaatgtcgatcaagcttctcgttcttgttttctctcttctgataatcttcacgagacccaaattgatcgccgatcatcacttaactacaagaatctcgccgatttatccttcgatttctacgtttcagccttcgattccgccgtttttacctccatcgccgtcgcgcagagcacaatctccgacggtgaagccgtctttgccatttgtaccggcgttgttcgttttcggagattcctcagtcgatagcggaaccaataactttcttggaaccttagcgagagcagatcggcttccctacggtcgcgatttcgatacgcatcaaccaacgggaaggttttgcaatggaagaatcccagttgattatctaggttacaattcttccccagtttctggatattgattatagtcccagttgattcttagaagtgtaagcgaaaatgttgacttcttgtgttcgattctttatacaattgagaggaacaaattcattgaggaaatgttgaatcattcgttttttgttgtccattgaaaatcttgtgaacagctgatcgtttaggcttaccattcgttcctagctatcttggacaaactgggactgttgaagacatgtttcaaggagtaaactatgcatcagctggtgctggaatcatcttatcaagtggatctgaattggtaatactcagtttttcagagtcttttgagttcattttctgtataccatctttcagctttttcaatcctgtgggggaatttttgttgttgcagggccagcgggtttcatttgcgatgcaagttgagcagtttgttgatacgtttcagcagatgatactgagtattggggagaaagcttcggaacgtttagtgtcaaactcggttttctacatatcgattggagtgaatgattacatacatttctacatcagaaacatctccaatgtgcagaatctctatactccatggaattttaatcagttcttggcttctaatatgagacaggagctcaaggttagacctctaatcaatctttatacgttttctcttggtaaagagtttataggggacagacaagtatgattctgagttagtatagttagtataagtgagacatcttgattagtacacaaaacgttgcctttatgaagatcaaatcacaacccttttttctgttttggatctctggtttgtatagttgtagagagcataaagctcattaagctgcatattgatagcctaaacatgattgagttatagtagttgcctcttcatttagctgcatattgatggcctaataagagaagtattatgtttgtttcacagaccttgtacaatgtcaaggtgaggaggatggtggtgatgggactgccacctattggctgtgcaccatactacatgtggaaatacagaagccagaacggagaatgtgcagaagaagtgaacagcatgatcatggaatccaactttgtcatgagatacactgtagataaactcaaccgtgagcttccaggggcatccattatctactgtgacgtgttccaaagcgctatggacattctcaggaaccaccaacactacggtaagcaccacttctatgtcaattctcaattcacaaaaagactgtgactggtaacaagtaacaacatagcattataatcccatagcagtatcttggaactcaaacatagtcttctgagagtgatatatagagttttctgatcatcttcaagtgtgaaagtaacttgtcaagagtcttgttgaatcttagttgtgtgtgtattgtggtgtggacaggttttaatgagacgacagatgcgtgttgtgggctagggaggtacaaaggatggcttccatgcatctcgccggagatggcttgctctgacgcctccggtcacctctggtgggaccagtttcatcctacagacgccgttaacgccattctagccgacaatgtatggaatggtcgccacgtggacatgtgttaccctactaacctagaaactatgcttcattcttaaatcagctgagaggataaaaatgtacataaaaaacatagtaaattgtaaatgaactttgcaattttgatgtttggtccatggtacataaaggaaaactataggtcttttatgctaaagaaagaaagtacggggttagagaagaaaaaggataaatgttttacaaagttgggctcaatgtatttacgtaaatggcccacatgaaacagaaagttaagagattcgacccataaaaagcacgtgtggtttataaatggaaaatttcatcttcagggagacgaagacataatttcaattcttttctcatcaaagtttctaaaacaaaaatcttggcctaaagaggtgacgtcatctccaccctctcgtaatttttccaattttgcccttggaagctgcttcgccttttttttcaatttcatcaagggttctgagatttttttctctcagcttcttcgtaggtttttgatccgaggtaggtaggctttgggtttacaaaaatttcgcctcgattttttgttctcacgcgtcgttcttgttacaggaaatcgatttcatctctgatcatctttgtgacgaaggaaatg

SEQ ID NO: 3753 - DNA, 3000 bp, Unknown
  misc_feature (1)..( 3000): cDNA_ID_3071787_gDNA_ID_1620662_Annot_ID_163836 3000 nt of promoter + ATG
cccaagaaatgataatctcaagcctcttttggcaccgaaagaaatgggaaactcacaaaacaatggaaaacccacagaagccagcaagaccttaccaaaaattagtgctgccaaggggagcagtgtaaaagctgctggatcaaaactgaactcaggaaacaaacagtcggatgggcaacccaatcttacatcaagtaactctaaggaaatggttgaaaatcctgacgatctcaagaaagacaaaaggaaatgggcattgcaggttcttgcaagaaagaaagctttagctggcaacaactcaacccaagacaaagaaggctctcccgagcttaaagggaattatccattgttggtgtgtaattctcatcacttactttgtttcttttaaaaattctggttttttgagatgtcattcgtttgtttctaccatttctatcaggctcaacttccagctgatatgagaccaagccttgcaactagtcgccataataaagttcctgtggcagttaggcaggtacgtggatagctgataatcaagagaaagactattacgtagaattaactcctttaggtagaaatccccaagccgtgcttttattacatttacatacgttaaactgataatacagaaaattgaggctaatctgttattgattttcctgcaaaaacattattaacatcacaacttgtgcaatagctttacttgtttttgttcctaagcaaattgctgtttctgcagacacaattatatcgcctgacagaacatttattaaagaaagaaaaccttctgactattcgaagaagtgcagcgacagaactagccgttgctgatgctataaatatcgagaaggcgattgctgacaaatcaagtagcaaagttgtgtatctgaatctatgctcacaagaaatactgcatcattcagagagcaaaacgatggataatgctgtagaaccaaattcgtcatcaccaatggctgatagtgagtcagaacgtataagtagtaaagattcagataatccagccgtccttgaagcgctcagagcagcaggtcttgctgattcaccaccaaacagcccgacccgttcagtagaagttcttccagagaaaggagacagttccttggacaagaccagggagacaggcccatataatgtatttgacatggattctgttcctgatacagacatctttggggattttgaatatgaattggatgaagaagactatttcggtgctacaatggctaaaaaagcttcagtaatgcagccggatgaaagcttgactaaggtgaaggtagttttatccactgttcaacctggaaagtctttgaatccatccgaagtcgtagaggatgaagagacaacaactgaaaacctgaacgagaccacaaatggaaaagaagatggaaagagctttgttcctatggagcttgtacctgaggctgagggagaaggagaaggagaaggagaaggagaaggagaaggagaagggggaggtgagatcctttctgtagctgaatgtgaagaactatacggacctggtacagagaaactagttgaaagacctctcatcgaaggatttgctgagaatggtgttaaagctaaagcccctgattcagagtgcgagagcaacacacagagagagttcatcgcttcaaactttgaaatcacttgcattcaagagaaaaaacttcccagaagcattcaaaagtgcaaaccaagcgaaaagccgtctaaagaggaaaaaggcaaagctgatggctttggtaactccatcaccaagaaggtactaaaaactgtaaaagtctctgtcatgtcaaaattctcattccctttgtcttcactcttcaatggttttattgttttcgtcaggtggaagcatacatcaaagaacatattagaccactgtgcaagagcggagtgataaacgtggaacaatacagatgggcagtgactaaaaccacagaaaaagtgatgaagtatcatagcaaagccaagagtgctaacttcttgatcaaagaaggagacaagatcaagaaacttgccgagcaatacgtcgaaaccgcttcctctggagctcaccacaaggataagtgcaagtgagaaaatcagatggcgtaaataagaagatgaagtaacaagtagttcagtacaaaaacgtaaatagattttaactagtatctctcttttgtcttctccacgggttttggaaactgagtcttcttctcttagggcgagagaagcaattcttgttgtaccccgaaccagatagacctaaactgtgtctgaaactgagatttacttggtcgctgacaggtttttgaaaaaatatttagagatgaaaatgatatatttattattagttacatactttttcgtcactgtgattattaaactgaactagtaaacttaaaagctaaatgtaaaagaagatgatgatagtttgtttgggtcaaaggctcaaagcaatgaaattcttaaaatgcctattgggcctaacctgacgcatttctttatatttttgaaaattgttaaacgacgacggatctgttttctatagtgactctgacgcacttggataaacatacatgtgcaatgactataatacccttgaaacttgaggctatttcctacagtgacacattttgataaacatttgcgatggtcagttacggagttggagacaaaagagcttctgaatctctctctcttctgcgtctcgccaaatttatttcccgattcaatttgtagggtttctgcagaagaaggaaaccaccattaaaccctaagtacgtcacctttcaagctccttcttctgtaggttttttctgttcttctgattcatgtttacaaagttttttttatgtctcttctaacttcttctccttctcgccgcgtaatcagtccttattgttcttcataatcgcagtaccaatcgcaatcgttttcttcctctctcgatctgttcctcggacgagaaaactggacaacaaacctatg

SEQ ID NO: 3754 - DNA, 3000 bp, Unknown; identical to SEQ ID NO: 3750
  misc_feature (1)..( 3000): cDNA_ID_1027071_gDNA_ID_1620662_Annot_ID_163834 3000 nt of promoter + ATG

SEQ ID NO: 3755 - DNA, 3000 bp, Unknown
  misc_feature (1)..( 3000): cDNA_ID_2144115_gDNA_ID_1620662_Annot_ID_163825 3000 nt of promoter + ATG
ttttccagcacatcaataaaaattaagccaatcaaaacaaaacaaataatacacctcattttctttttttctttttttttttcgtttttaatacacctattttcaattcgttcatattattgtatgttactagatatttgtcgacgtcttgttaaatttcgtcaattttctacctaagtaacgaaattttttcacttttttaataatgtgatatattatcttcttcaaaaattatatgatccattttaagctgaaagcttttaattttcacatcatttaaatcatttgcggcaaaagcaaacaacttgaaatcattttatcccaacttaacatgacgagcaacaaaatttaaaaatattaagaaaaagaataaaaaatgaggaagcacacaatattgtaaagtatggttattggaatacacaaatctttgagtctagcaaattctccatctttctttatatgaaacgttaaatttattaactaaaataaagatgattatgtacgagtgattaagaatattgtaaaatgaacagtagtcatcgagttcttcatgctagaaaccattttcggagaaactttcttaacttggagaaatcttgatactgaaaaaaatctattcgttgacgaatcacacaagtacggagttgtttctagaaatagatgaaaaataaattgtaaatgacaattttaggattactcgaacatggattagacccatgtttttgtttgtttctctcctgccatataaaataaattgttgtttaaaaaactaaacgaagtaaaatttgatcatgtgtatatgattggatatgacaactttttttttgtgtgaatataactaatttacggtatcatataaattagtttaaatggttaagaaagaggatcttgagatagtaataccatagaaaaaacaggtaaaagaaattagaattgagttgttataattaccaaataaataagctttctagagatgattaaattttaccaaatagatgttaaaattatttcggcaaaatataatatagaatgcatagactaattaaatttactagaatattttttggttaataattcataaatataatataaaataatgttaaaataatcaaacaatagtaattttttagtatttgtggaaaactcaaaacgttaacaaataagtatataagaaaaaattagtttggccttttcgagagagaagcgttagggttgttagacttccggatgaagtattattgacatagacttttggaaggaactattattaacatagactttgtggagaaaataatattaacatagactttgtggaggaagtattattttatgactaaaaatcattctgttggatagttctttgactaattattctcttaataatttgaatcttaaccgtaggatgtaattgcattttacacgctaagtgtctaaagtcttttggacaaaggcgatatcccaaatgtgagaaatctatttaagaagaagaagacttccttcattatttctcacatcaaacaaaatctttgaaacatttcaatcttatatatatggctccattgttgcatcaggtttctaattatggttatggtaagtgtgtaaccgtacgcttctgtgatggcaagacgtatgatgccaaggatggagagtctagggcaattaatagagatcttaatgttggtgctgttaagatttatagagactctaaagatgaagatcaagcgtatgtgctgaattacttcccttataatctcgagcttaatgataatcgtggtaagaataaaggtcttcaaggttatcgtgttcttatatggaagcagtacggcactattaatctagatgtattttacgatgaaatgaagatttggtgcaaaactaatgatttagggatatatacttccgatggagaactgaaatattataagtctgttattgcacgtcatcgtgaggaaggaggtatcagcgttataggttttgaaacagccgaaggagcgactactgcagctgctaaaaaggaagaagatgaaaatgaagaagcatcggcgaaggtgaaagaagcaaatgaagaagaatcgactaatgcataagacggcccaacccaaaataccatcaagactaagtcacatttgactaagtatctcgtttttccttttaataaagctttgcaaataacattgtggatttgtgtttttctctttgaggacagaaaccatgtttcctttctattgctttgtgcttccaagtttgtaggagttgatactccaatattatacattgtgaacaaaacaaaaaaaatgaataagtatgtgtttgctttttgaaagcgttgttcttgtgttcgtattgcatcacttttggttttaatccaaaatttattattaaattacgtacatttgattctttgtttttttttgtctcaatatatagttttgatacgtgttaccaaataaattgcttatctcaaaacatttcttcttcaacccgatccaacaaaccctatttgcgaagtattcatacatagctagaatacactagcgtgaattgtcattgtgagttgatttttaaatctatgcctcttgagttttgaatctgtcatgaggcccactggtagggccggtcggggtgttacaagttgttaatagagagaagacatgaggcccactggtagggccagtcggggtgttacaagtggtatcagagccaaacccaaatgagtgtggagtcaagaaggttcgcaccattgggggttacggtcttggtgtgcaacgaggacgttgcgatctgttagtggaggtgaattgtaacaccccgatttcaggaatatggtggtgcatgcagagaggtttaaaagaaatgatttgaccacctacgtgtgcacttatcttttcggtcaaacgtcctaagagaactccacagttaaacatgcttgggctggagtagtttcaggatggatgatattcccagaagtcattgtcggaaccatgcgagtgacaaagcatg

SEQ ID NO: 3756 - DNA, 3000 bp, Unknown
  misc_feature (1)..( 3000): cDNA_ID_1821821_gDNA_ID_1620662_Annot_ID_47990 3000 nt of promoter + ATG
actcaaacatagtcttctgagagtgatatatagagttttctgatcatcttcaagtgtgaaagtaacttgtcaagagtcttgttgaatcttagttgtgtgtgtattgtggtgtggacaggttttaatgagacgacagatgcgtgttgtgggctagggaggtacaaaggatggcttccatgcatctcgccggagatggcttgctctgacgcctccggtcacctctggtgggaccagtttcatcctacagacgccgttaacgccattctagccgacaatgtatggaatggtcgccacgtggacatgtgttaccctactaacctagaaactatgcttcattcttaaatcagctgagaggataaaaatgtacataaaaaacatagtaaattgtaaatgaactttgcaattttgatgtttggtccatggtacataaaggaaaactataggtcttttatgctaaagaaagaaagtacggggttagagaagaaaaaggataaatgttttacaaagttgggctcaatgtatttacgtaaatggcccacatgaaacagaaagttaagagattcgacccataaaaagcacgtgtggtttataaatggaaaatttcatcttcagggagacgaagacataatttcaattcttttctcatcaaagtttctaaaacaaaaatcttggcctaaagaggtgacgtcatctccaccctctcgtaatttttccaattttgcccttggaagctgcttcgccttttttttcaatttcatcaagggttctgagatttttttctctcagcttcttcgtaggtttttgatccgaggtaggtaggctttgggtttacaaaaatttcgcctcgattttttgttctcacgcgtcgttcttgttacaggaaatcgatttcatctctgatcatctttgtgacgaaggaaatggagctcgattttgacgctagtaacttggttgaagatgaagctgttgaagttgaacataatgttagtgtaaaattgtactttctgggctatttttcttttggttgaactaatcatgggtttacctttttcatttcgagcctggagctttaaaacttgtaatttccggtgaaaatggttgtttatgtagctttatagttagaatcatgaacataagttgctatgtcaaccatttcatttagtttgtgtcacgtttcctggaacatatgtggtttttaatctcaaggatgagattttaataaactgtgtttgtgcattattgcttctcagtgttgattttaatttctttgaacagggtatgactgaaattgaaggggaaagatgtggaatttgcatggatataattattgatagaggcgttcttgattgctgtcagcactggtaaaagcttgttttcgcttttcattgtctttaaatattgcaaagttgctatgggtgtttgttaaggagcagtctggtaatttgtgtctatgtctgttaaatttcaggttctgctttgaatgcattgataattggtctacgattatgaacctctgccctctatgtcagagagagtttcagttgattacatgtgtccctgtaagatgtctcatatttgttttttgttttgttttatctgaacatttgtcatgatttttgtaagtagaacttttgagtttaggaataatgagtttttgttttgattatgaaggtgtttgattcaggtgaaagcagcaaggtcgatgaggatttggtatcagggtactatttttttccttgtgtttgttgttgtgataaagtttgcttgcctgaactatctgagcggtctctttgtcctcaattatttgtggcctataatgataaatttatattaagtggcatagtataatcaagtgatttaaaatgtgatagatgtcatgtgtaccatatgtttctgtatttgctaaaaactgttgtgatctgctgacgttaaactaagcaatacatgcagagatgaagattgctgcattgaggaggagactgatgtcgtctcttctccgtcacactatattgacgatacacactatattgatgaaaatgtaagtatatcatatatgggttttcctagttactacaaagtacattaagctttcctaatcattttgtaggcagttgtctgtttagatggagatctttgcaagattcgtaacactttcagttacattgaaggggattcaaaccttgatacatcaattgcttgtgattcgtgtgatatgtggtaactattattacctgttgactttatctatggtttttttttttgtacattgtcgtgattgttgtttttacctcttttttctatcactaattcattgctggtgaacttctggagcttgccttgttgttacagtgccataatgtttgtgtctaccatgcttttagatggattttgtgtctaaagcttagttgtgctaccggtttctaaatgctatcactatcagtctatcacatgaaggaattttgtaatatgaaatgtaaatggcaaagatactagccttttcaatcttttatatgtacttgcttttgtgtacttcgtattgttttagattgttcatcattacagcattctttcaaattagcttctgactgttgctttcaactgtgctaacaggtatcatgctatttgtgtgggttttgacgtggaaaatgcatctgaggatacatgggtatgtccgaggtaggtttcgttggcgtattgactacctatgattgcttaatccatggtttgatcaacttcagcaccgttgtttcattatattgtttctttaattattagcctattaggcaaaaatatttttatattagagtttccataaaattattttaatctttatctagtaaagacactttgtaccaattctaagtgaaacctaatgcctatacatattattcttcctttctctatcttatttagccatcttgtcatagtttccctccttggttttgtgtccacagatgtctctctaatgaaaaaccacatgaacccgatacctcgccaatg

SEQ ID NO: 3757 - DNA, 3000 bp, Unknown
  misc_feature (1)..( 3000): cDNA_ID_1807522_gDNA_ID_1620662_Annot_ID_47992 3000 nt of promoter + ATG
atctcgataattcctccgccgtctctcttcaacgtgtgaagaaactcgcggctgaacacggagaacgcctctccttccaccaggttcggtgaaatttcgctttcttagggctaggaaacgtgtgattgaaggatttgtgtttgtgtagttgatgatttcaacgaatttgggattatgatttgacttgttaatcattgatttgactacgaggctcttttttttgtgtttatttatttatttaattttgggcataaattctcgtaataaaatatcagtttttctaaaagattgtttgattccaaaatcatgggtatctttctttggtattattgctttgattggtaactactacaatggtactgggtatttaccgttttaacaatcataaaaacgataccaaaagcgttatttaccgttattttgtaccattttaactattcgcattttcggcttaaaaacttgtatagcgttgtgtcaatgtaattttatatgttaatgttaattattacaatttctttttctctaagttttataacccaaaaataattatttatgtattaaatattagtttaggcctaatgagtaccatgtgaaagagtaattgttctactttctatttttgtatttcatataaagtttaatcttgttcttctgaattagtttgtattatgtttacttacggtcaaaagaatctgttagttactgtcaaaagttaaaacttgattgttctgtcttaatttgcaggtggatcttcgagacaggtctgctcttgagaagatattctcagaaacaaagtatgattgagaaaaaaacaaacattcttttagcttcttcactttatcactaacaatgagtgataatgcatattattgggtttattctttattgattgatgaacgtggaattattattattttacaggtttgatgcagtgatacattttgctggacttaaagcagttggtgagagtgtagagaagcctttgctttattataataataatcttgttggtactattactcttttggaagttatggctcaacatggctgcaaaaatgtatgtataatttgccactacacaacaagttcgaatccatttttactttgcttgatcaattctcatgattagctacttttactctgtttccagcttgtgttttcatcatcagcaactgtgtatggctctccaaaagaagttccttgtacagaggagtttccaatttctgctttgaacccatatggacgaacaaaggttgttttcttgacaaaacccacttgagtattgtggttaattatgaagtgtgaatctgacttattatggatgtttttgtagctattcattgaggaaatctgccgcgatgtatacggttctgacccggaatggaagattatattgcttaggtatttcaatcctgttggtgcacatcctagtggtgacattggtgaagaccctcgtggtattccaaacaatctcatgccctttgtacaacaagtggctgttggtaggagacctcatctcactgtctttggaaatgattacaatacaaaagatggaacaggggtatgtacttgtcttttatgttttcataaaacaagaagaggttttcaacattttgatctcatgttttgttttaggttcgagattacattcatgttattgatttagctgatggacacatagcggctctacgtaagctagaagattgcaagatcggtatattatgatttccattcgtttctcttatctactacaatcattctcaagtctcttaactttgtttgtgtgttgtttatattcaggttgtgaagtgtacaatctcggaacaggaaatggaacatcagttcttgaaatggttgatgcttttgaaaaagcatccggaaaggtaaaaagtgacactttctttcatctttagatacttggattctaagtcatgttttgttaaacctttgaactcttttgtggatcagaaaatccctctggtgatcgcgggacgtcgaccgggagatgctgaagttgtatacgcctcgacggaaagagcagaaagtgaattgaattggaagtaagttcatacatacataaagctataactttgaagatattacttgcacaaaattgtatgttagacactaaaaagttgggaatatgtaaatgagataagtctaaatttgggttggtaacaaatgcagggccaaatatgggattgaggagatgtgtagagatttgtggaactgggctagtaataatccttatggatatgattcctcttctgaagacaactctcattaacttttcttaatcgttttcttcttttgctaaaacatatttctccacactaaattattatagtatccgcaagaaaaaacaacaacaataaagagtcagattttagggaaatatagggacattatgtattattattacaatcaatacttagtctgtaattgatttggatatgttcttgtataatcaaaaaagatttgttatgaatagctacaacgcaaatgtttagctctatacggcaaaaagtaccttgaggttgacacgacgtcgttttcagctcggtgatagttgaaatgtatctttctgaagcttttaagttcaagagcccacacacttcttctcattctttataaacataacactggacagtaaccaaacttcagatctgaatcaacctcttaaggttcgtttatactcattctgtttttcactgatagtttatgcacaatccgaatctttcttctatgtgattgttttggatttgattataaatttgacattatcattaatttagaatgattttgtgtgtgttgggttgtttacaaaatcatttctttgaatgagtttgttttaattttgtgttagggttataacgcgattgggaatttagttgaatttagaactaaatttgtgctagcttgtgatttattgtctctaattttgaactactaatatttgattaccatatgtttagtggtacagaagaagagaaaggaatg

SEQ ID NO: 3758 - DNA, 3000 bp, Unknown
  misc_feature (1)..( 3000): cDNA_ID_1821810_gDNA_ID_1620662_Annot_ID_47996 3000 nt of promoter + ATG
aacttatgagaagcaaggagatacaaaagagataaagcaaaccctagtttttgaagattgatctgattcaagaatcgatcaaacaaaaccctcaattaaattgactcgtgtgaagaatggaggagaagctttaagagatgaaatcgtttaccgattttagaaagtcgattgtctcactgagacaaaaaaagagaggctttttatttttaatccgataacgagttaaaccaaagtgaactgagtcaaaacgtttccgatcatgtatacgtggcacattttcattggaagagatgattggttgttttgcatttttttttttcttgttctctcccttgaagttgaagagtttaacttcgctaagaggaacagagatggacttgagtttaatatgttctctgtttctaacaaatgtttttttttttgagttttcacatacaataaaaaatattaaaagttaattataatttataaatgcattattatttgtaatttacgatttaccattttctataaccttaattaatatagtatacaattatttttcttgaaatttataattcatcaataataactaataactattgcattggaaccaatttttttcctaaatatattatttaggaatagaggagtagttgtttttggcaaaatggtagattattataaatctaaagtggtagcagttaaatttgaaaaagatggatggcatagtaactaaaaattatttaccacaataccttaaaaaactatgaagaattgattaattaactaacagactaattaaaacccatatttgtcctttgaaattataattttaaataattttacgaaacctatttaagattacataatattttttttataaacaataacaccttttaaaattattaaaacttattcactatccagtttcctagtttttatatattttgaagcaataatgttgtgcttaaaatatatgacatcatagtgacaaaagagtttatttgtgaaatctcaatcactcattttgaaatgccattaatccgtttagtttccatattattaccaaagcctttcatgtaattggaaacttttgtgtttaagacttaatcttgtgttgcaggagccaaaagaaaaagaaaaaaacaaaaacaaagaaattgtaaagaagtgtaactagaaaaatcgatcactcatcttcaaatgtcattatccatcaagttgtcatattattgctagacagaagtggtcgtctagacttagttgacctgaaaaaagaatagtcaaagtcttttatatgtggacctgaaattagactttgtagtttgtacgtaagtttgtgttgctagagcctatatgagaaaaaaaaaacagtggatattggtgattggtttaatctggttaactccggttatctagatactggtttaatatcatttatcttgtgtatatataaactaaactttagtttattttgttgatgaacgttgtaacaaacacttaattctgttaataaagattcagtttaatctccgatcttttctcttcttttccgttttaccggaacttcgccggtgttaatatggtatcagagcatatcatttgagcttccgcatatcatcggagatgagtctttcattgaatcatctttctcttatgagagtttttcgattcctacaatcgtttgttgcaatttgcaatttcttcgtcagctatctaattttggttctgattcttcttctttccttcgattgaccttttgtggtgacgaatctcactttcttttcatttcgtctcactttctttgatttttctttaacaatttgttaagaatgggttctatgaacaatccgttgaattcttcaagtcttcgtccacctccagctagtgttcctgaacaatcgcgatatcaagctgatcaatatgagaatccgcatcatttgcatacgagtgaccacgcaggtttggttctagtctcagaacgccttaatacagcttcagatttccattcttggcgaagatctatttggatggcattgaatgttaggaataagcttggattcatagatggaacgattgtgaaaccaccattagatcatcgtgattatggtgcttggtctcgttgtaatgatactgtgtctacttggttgatgaactctgtgtcaaagaaaataggccagagtctccttttcattccaactgctgaaggaatttggaagaatatgttgtctaggtttaagcaggatgatgctcctagagtgtatgatatagaacagagacttagcaagattgagcaaggttctatggatattagtgcttactatactgaattgcagacactttgggaagaacataagaattatgtggatcttccagtgtgcacttgtggtcgttgtgagtgtgatgctgcagttaaatgggaaagattacagcagcgaagtcatgttactaagttcttgatgggtttgaatgagagttatgaacaaactcgtaggcatattttgatgctaaaaccgatacgtacaattgaagaagctttcaatattgttactcaagatgagagacagaaagccatacgtcctactcctaaagttgataatgtggcgtttcagactgtttcttataacagtggtgatccttatatggagaatatggaaaatggattcattgcggcttataatacagcaagaccagctcaaattacctctgtgtactaactgtggaaaggttggtcatactgtgcagaagtgttacaaaatcattggctatcctcctggctataaggcagctacatcatacaggcaacctcaaatacaaactcagcctagaatgcagatgccacaacaatctcaaccaaggatgcaacaacctgtagcagcacaaatgcagacaaacatgccaaatacaggaccaatgcagatgatcccttatgcaaatcaaatgcagatggttccatactcgaattcaatgcagatggcgaatgctgcttatgctgaataaggttcttttgttccaatg

SEQ ID NO: 3759 - DNA, 3000 bp, Unknown
  misc_feature (1)..( 3000): cDNA_ID_1821927_gDNA_ID_1620664_Annot_ID_48012 3000 nt of promoter + ATG
gaaagaaatttgcctattacaaatagagtagaaaataaatgatatgacgatttatttaagcttttttaaagattaatattaacgaccaaaataatatatataccacgattatgatttttattaaccttttattttgtaaaaaaaatacactgttaaaattttaacttattcaagtttttgtggaagtctactattgactgccgagggatcaatatagcccagtgctatcggttagaccgatcaatcttggcactcatgtatatgagaatgtttcctttattagttaaaatattgttattttaactatgaaattctggttgttactttggttttggaagccaataccctatactacagcggtaaaaacttgaaagtgtcagaatgtaatcgaaatttacatgaattcaactccaaaaaaccggtggaagaactactacaagcaaattaaccaacaacaaatctaacatgtaccttgaataatcattacacaacaacattgccttgcctgaattaaccttaatcctggagaaatcaaaatcccagaggaactacgccaagaaaaagctcctgaatcagagtaaagccagcctaccagttatggaatcaaccaactcctttggtcctgcacaagaaaagtaatgaacatgttgaggaacaacatcttagctaaaaccgaatttcaaaaaattattgtctctaccaggtccaactgcaagaactgttcttgatccagccgcaacctgttaaaggaagagttttagtttccagagaaacttgttagcgtactactaccacagaaaattcacaaataattttcattcaagagcagtcttttcgtgtttcaataggtcggatggtgtttatgtcttctatagttctaactatttgattagtagaaacttttagattttcttttgaataggaggagctctgattatactttcagcctcaataattgatcaagcacgacaaacctcagttcttccagcatcagctacaacaaaagtcgggaggccaacgctctcagcagcctctgtgatcttattcctgtgagcagaaaagataaatgtagctttcaaatttattgaagacaacttattaacatttgtagtaaagtaataatatgtcttgaagtgcgttttgtttgtatcccccaagattttcacctgcttacatttcttgctgtttttgcaagtgacgactatctttggctgcccattttcctcccatcgccgcagaaggtatcggtcactgaaagaattaagatgaaaacaaaaaaaaacataaaccccggactgatgcatcatacaaagcaaacaactcatttcagacgaaattacctctgcatcaactctgcatacatgccggtggcagcatctgcgaatattaaaaagaaagtcattttacttccagtgttcaaatttcaaacacatttcataagacacttacgtgcacactgtgacgcaattttgcccgttctcatcttcaagtcttgcctaactaccagtacctgtgatcagaacaagctcaaattagttacacaaatgttctgattttaacttgtaatctaaaaatctgacatcattgaaaactcatcaccatccttgtatagattatgcaagtctcttttatgaagctaaaatttcaatcatttgatgggtttggaacataaatcagcttgcattatcactaggttttgttataaggatttaagttataatattttactccaaaccaataaaatctaggggcagagacaagagactatcgttacactagatgatagacaaaccattttaagctcttggtccttgccattgcctggtacagaactctgcttctggaccttgctggataaaagtctgctccttttcactggggaggtcacttgctgtgataaatccaatatcatacctatgatgaatcctatcacaacccctggtatgagattctctgctctaaaactcacagatatcgacttcttttcttgtctctgatcatattcaccggaaaaaaaaaaacaatgatacatttttaactgtccaacaagaatgctggtttagtaagctacaagaaaatttcagaacatgaccgaaacaaccgagtaaataagctcgtttgttgcagtctcagtaagattttagagacaaaaacatgataaattctcgtttgggtggtgagaactgagaggcaaacattcaaatttacaccacaaatctctcaattttatttgccaaatcaaccatagacatacatataagaaacttgtgcactataaagccaaacacttacacttaaagcaaagtacactattaagaaagaatcagactttgactctttgagcttaactgatcttacatcaataaccaaaagaagaaagagctcagaatttgtaatttgtttagtttcaagttttccaattcactagccaactgatgccattcggaagttttgatcaaactagactcaattcctcagcccgagataaattttgacaaaaaagaagcaacaaaactaagaacaaattatcaacagaaaagacggaaaataagtcgaaatcaataccatagcttgaggctgcgaagagtttcgagacgaaggccacatgatacgcttctggagattctccaaggcgacagaggaacaaagctaagcctttaaaatcgaatgcccatgagtatgatgaagaagggagataagagcagccttagtaaccgtaaacgtcagggtgttcatatctctgattacaaaacgacgcgttgtttggggcttaatgtacattctggaaaaatacatggtccaattagaaaagttttaacagtatatagctactaatgtaattactatagaatatctctcgaacacacggtgcgttttactgtcgtcgctcctttttgttggtctgtttccacttcagttcttctccctccggaaaagctacaaccccaatctaaaaccctaacggccatttctaccatcggagctccgaaaatgccgggt

SEQ ID NO: 3760 - DNA, 3000 bp, Unknown
  misc_feature (1)..( 3000): cDNA_ID_1821923_gDNA_ID_1620664_Annot_ID_48013 3000 nt of promoter + ATG
cgaaaagggagggtaacgggtaaccttgaagaggtaagggaagttggaatcgtcgcagccaccggaaggctggagattagtgagattctcgagatcagcggtgattttgagcacatagttcaccattttttttctcctttgctctatgaagcactaaagctttgcagacgcgattcttcttcttcttattatttatcagaatggccccccaaaaaactcatatttcgttataaaccaaatatttggtctcagcccgtttaatttttttgacctatgagtcttttagtccaaaagcacacatatgaaaaagcccaatttgaaagcaattgagcccaagttatttacatctagttgttttatgtcctgtaagttttctatttggtatcatttgatatttcttaggttttttaataatcttaaggattttgagtggttaaaataaaacaccttaggatttaaacttaatttctcaaagcaaaatcatagcactagactcaacatttttttttaaaaaaaacaccattagcaaactacaagcctagtaagtcacaatcaagaattcaaaccatgattaaccaatatttgctcttaagtccaactaccaagataggcaaaaaaatgcaaaaaccaacggaaaaagatcaacttctttaacgatagaagaaaacacatgttaaagaaaactattatttatagaaaaaggtttctccaatgctacgctttgttcgctattgttgacacaaaatggcacaaaaccaaaaaaagaacataaagaaaaaatgtaaaagctcgtgtgggtgtagtgggaacgcaccaacacgcaacctctggattagaggaatcctcatcaacagccaaacacgttgtacaaaagtcaatctagtgtcttgccatttggcttcatgtcggtttcgcgacactgagagaaagccacacgtacatctacgtagcttcatccccaatcaatccccaatttatttcttttgaattccgtcatttcttctgcattattgtcgccattatccttttttgttttgtaatcagtattttatcattaaacgtgacaagtactgtcttcattctccaacacataaaatagtcagaactcaataaataatcataaaattgagtactctttggcccctgtatgattagccgttaaactatcactttcgcaaaaaacttcatgtgattactttgatatttatatgtactaaaatagttttttttcttcgtcttatgttcgcatataacttaaaagataaataactcctacgaagtatatgatacgtgactccaatcaaaatctttgacttgtgagttgtgaatatgaatttaagtgaaactgtcgcccagtattttttacggtcaacagcatgtggatacttttaaatatttttgtttaacaaattaaagtgaagaattttcgttgtctcgtgaaggttttagtggtatatatatcagatttccaaattttgcaagatttattttgatacatatatgaagttacaaaacatacaattacattccaacgttaacattgttttactgtgataactgataatgtaatcctgcatgattttgggtgaacttaaaaacgaaactactgaaagttgcatgtcgttttgcaatcataatgtgggcaacacgaaaacgagctcgaacgttggaaatattggagaaactcttaaagtccgtgagaggtttacatttgggagatgtgatgattggaaactgaatgtgggacaaaggtttaggatcttcaaaatcgcgattgagttaattggggacgtgaagctcgtataagtattcttgataaactcatctttaacagaaaaataataatgaaaaactcttctgttttggatctgtctcacatattggagagatgctcacgttagcaaaaaatcacatgtcgagaagattaatctcaaattagtttcaccacaatgaagttgaggagatgctataaaaatatatcgaaaccgttaagtgaatatggatttatggaaaatggccagatacatcaagatcaaaccatccttctctaagagaccacttaggacctctaaagaaaacaaaattgataaggaaaggacaaaaaaaaaaaatccataaaagacaatctagatgataagtaactataaaaacaaaagttaatgtctctgtaaattaccaaaaacttaaactcataaacaaaaaccaatttagaattgaaacatgttaaccaagattgaactaaaaaaaaaaatcataataaaatagaatttcataagataagtcctacatttccaaaacctgatctcttcctctagttccaaaaccctaaatatcctttttgaatccctaaattaatttgtcaaaatgagttaattaaaatatagctaatttttaattaaagaaagagttgtgatgacagttcttacaaaaatagagattcatttggtaaaaattggatagaagatattttattagcatttccccttttgtttttcgttcaagtgaaggtttcaacaaaattaaagagaagatctcttaatcacaacaattaaagtaaagtttaaagactaaaaacaaagcctaaataaatatcagtttggtggtattaaactagcacgtgtcaaaaactaattggtagacaaaaaaaaaaagtctcacgtgtaacgcgaaagcctttctaaaaaaatttcttcagcatttaccaaactaaagcgcgcctctcgcttccttccttcaacctcttctttgctcatctctctctctctacaagaccaaacttatctttttttttctcttctctctgtctttttacacacagagctctgttttcaaagctctgttctgtttcttcgtgtaatctctgtttcttcaatctgttttttttcttctaattttgaattctcgtacagacgcaacggttatattgttgtttagcctctttgttcttcgaatccaatgtcttcgttgttttgtgtaaccatggattctcatctctagatg

SEQ ID NO: 3761 - DNA, 3000 bp, Unknown
  misc_feature (1)..( 3000): cDNA_ID_1821921_gDNA_ID_1620664_Annot_ID_48014 3000 nt of promoter + ATG
aggtgacagtggttcgaatctaatcgcagtctcatcccacgaattgattaatttcggatttgcagatacgaggatgacgaacgcgaaacagagacagaatctcaccattggaatcgaaatcgaaatcatctagagatgagaatccatggttacacaaaacaacgaagacattggattcgaagaacaaagaggctaaacaacaatataaccgttgcgtctgtacgagaattcaaaattagaagaaaaaaaacagattgaagaaacagagattacacgaagaaacagaacagagctttgaaaacagagctctgtgtgtaaaaagacagagagaagagaaaaaaaaagataagtttggtcttgtagagagagagagatgagcaaagaagaggttgaaggaaggaagcgagaggcgcgctttagtttggtaaatgctgaagaaatttttttagaaaggctttcgcgttacacgtgagactttttttttttgtctaccaattagtttttgacacgtgctagtttaataccaccaaactgatatttatttaggctttgtttttagtctttaaactttactttaattgttgtgattaagagatcttctctttaattttgttgaaaccttcacttgaacgaaaaacaaaaggggaaatgctaataaaatatcttctatccaatttttaccaaatgaatctctatttttgtaagaactgtcatcacaactctttctttaattaaaaattagctatattttaattaactcattttgacaaattaatttagggattcaaaaaggatatttagggttttggaactagaggaagagatcaggttttggaaatgtaggacttatcttatgaaattctattttattatgatttttttttttagttcaatcttggttaacatgtttcaattctaaattggtttttgtttatgagtttaagtttttggtaatttacagagacattaacttttgtttttatagttacttatcatctagattgtcttttatggattttttttttttgtcctttccttatcaattttgttttctttagaggtcctaagtggtctcttagagaaggatggtttgatcttgatgtatctggccattttccataaatccatattcacttaacggtttcgatatatttttatagcatctcctcaacttcattgtggtgaaactaatttgagattaatcttctcgacatgtgattttttgctaacgtgagcatctctccaatatgtgagacagatccaaaacagaagagtttttcattattatttttctgttaaagatgagtttatcaagaatacttatacgagcttcacgtccccaattaactcaatcgcgattttgaagatcctaaacctttgtcccacattcagtttccaatcatcacatctcccaaatgtaaacctctcacggactttaagagtttctccaatatttccaacgttcgagctcgttttcgtgttgcccacattatgattgcaaaacgacatgcaactttcagtagtttcgtttttaagttcacccaaaatcatgcaggattacattatcagttatcacagtaaaacaatgttaacgttggaatgtaattgtatgttttgtaacttcatatatgtatcaaaataaatcttgcaaaatttggaaatctgatatatataccactaaaaccttcacgagacaacgaaaattcttcactttaatttgttaaacaaaaatatttaaaagtatccacatgctgttgaccgtaaaaaatactgggcgacagtttcacttaaattcatattcacaactcacaagtcaaagattttgattggagtcacgtatcatatacttcgtaggagttatttatcttttaagttatatgcgaacataagacgaagaaaaaaaactattttagtacatataaatatcaaagtaatcacatgaagttttttgcgaaagtgatagtttaacggctaatcatacaggggccaaagagtactcaattttatgattatttattgagttctgactattttatgtgttggagaatgaagacagtacttgtcacgtttaatgataaaatactgattacaaaacaaaaaaggataatggcgacaataatgcagaagaaatgacggaattcaaaagaaataaattggggattgattggggatgaagctacgtagatgtacgtgtggctttctctcagtgtcgcgaaaccgacatgaagccaaatggcaagacactagattgacttttgtacaacgtgtttggctgttgatgaggattcctctaatccagaggttgcgtgttggtgcgttcccactacacccacacgagcttttacattttttctttatgttctttttttggttttgtgccattttgtgtcaacaatagcgaacaaagcgtagcattggagaaacctttttctataaataatagttttctttaacatgtgttttcttctatcgttaaagaagttgatctttttccgttggtttttgcatttttttgcctatcttggtagttggacttaagagcaaatattggttaatcatggtttgaattcttgattgtgacttactaggcttgtagtttgctaatggtgttttttttaaaaaaaaatgttgagtctagtgctatgattttgctttgagaaattaagtttaaatcctaaggtgttttattttaaccactcaaaatccttaagattattaaaaaacctaagaaatatcaaatgataccaaatagaaaacttacaggacataaaacaactagatgtaaataacttgggctcaattgctttcaaattgggctttttcatatgtgtgcttttggactaaaagactcataggtcaaaaaaattaaacgggctgagaccaaatatttggtttataacgaaatatgagttttttggggggccattctgataaataataagaagaagaagaatcgcgtctgcaaagctttagtgcttcatagagcaaaggagaaaaaaa

SEQ ID NO: 3762 - DNA, 3000 bp, Unknown
  misc_feature (1)..( 3000): cDNA_ID_1821917_gDNA_ID_1620664_Annot_ID_48015 3000 nt of promoter + ATG
aagggctatataactggtatatgcaataagtaaagtcgtgtatcaaactttttcatttgttgtatcatctccctcttacatatacagaaaacagcaaaccaaaaaaaaaaaaaaaaaaaggcaaaacacaaaagaagaaaagaaaattatgggattttgtttttgtttatcctcaggaggatcaacagataaaagtcagatttatgagataactgattatggacaagaaaatgcagttttatactctgaccaccatgttgttcctcaaaacttgggctctgtctcttctttagccggaggcaagggcttgaaccaagatgctgccattctccacctggtactttatacttttgaaaatatatatatgtttgtcttcaaaacaattaatttgtttttaacggaatgaaatgataaatttgtagggatatggaacagaagaaggagcgttatgtggagtgtttgatgggcatggaccgagaggtgcgtttgtgagcaagaacgtaaggaaccaattgccatctatactcttaggccacatgaataatcattcagtgactcgagactggaaactcatatgcgaaacatcgtgtttggagatggacaaaaggattcttaaagttaaaaagattcatgattgctctgcttctggaactactgctgttctcgccgttaaacatgtaagttattcatatctttaatgttttataccgctttatatattaggggatctattatttttcattgcaaaaatattgttcattttacgaaattgtgtattattaacaacaatattaatttgaacagggaaatcaagtgatggtggcaaatcttggggattcaagggctgtcatgattggaacaagtgaggatggagaaaccaaggtggctcagttgaccaatgacctgaagccaagtgtcccaagtaagtttttgaagttaattggataaagtgatgttgtaaacaatgatacgtaccggtttcattatggttaagcatttttgggttaattaattttgtaggcgaagcggagagaataaggaaaagaaacggaagggtgttagctttggagtcggaacctcacattctgagagtttggcttccaaccgaaaaccgaccaggcctagccatgtcgcgggcttttggtgatttcctccttaaaagctacggtgtcattgcgactccgcaagtctctacgcatcaaatcacttccagcgaccaatttctactccttgcttcagacggggtacgtaaatctaaacctattaagtataaactaaaaacctgccacaccacactttaattttatatgagagactatgtttttgtattttggttactattgatttaaaaccgaaccaaaatccatgttcaattgtggcccacccatttaaggctttttattaatcaacctgggcccaaataatacgaccaaatccaaagtaaagcccacatttaaaataattcgttttagttgaatgacccacttaaataatgattttcttttgtttcttgtataaaggtgtgggatgtacttagtaacgaggaagtggcaacggtggtgatgaagtcagcaagtgaggcaggagcggccaacgaggtggcagaggcggcgactaatgcgtggatccagaaatttccaacggttaagattgacgatatctctgtcgtgtgtctctctctcaacaagaagcataatccacagccacaaatatgaacaaaacccacttgctctaatcaaagaatcatgacacgacagctcacacaagacttttgtgttttgcctataagtgattgtgactgtatatatataatctatatataccgttgtatcttaattcttaagtcgtgtgattatttagaaagaaaaaaaaagaaaaagaagaacaatagattataattaggaatggtgtgtgtcgttgaataaaagcaacaatgaattatgacattttggacacacgtcgtgtggactggtttggactagttcaaattgattatgtaattgctatagaaatttgataataacattttttttttgttaaacaatagtaacatataacgaaataatatcgattttgatcaatatgtttttttgttgttgttaaaagatataattttgatcaatagtttataaccaaattatttaatgacgcatctatttgagtttgattgcttatcagagttaagatggtggaagaaaacaagaggcagaaaaagaaacaaaaatagatatttgccgaaatatccaaaacaaataattatttttgtaagtttgctatagagtgaaagaaaaagattctatattgttgcccccacaaattttggcattccatctctgactaagagagtatattcagttttcggatttatctaaaatttggaataaattaggctcctatattttttatttttagtagtgaatttagtccgaaaacaaattgatcccatctaaaccaaacagaaatagtcaatccaaaaacttcattatagattaatttagtttcaaaactaaatcatctttttattgttcaaagttcaaacttaaacacacttgacatgatcacaagaaatagtgcttatttttctcctttggcatgattctctcatgttctttcttttttttcttttcaaagactcgtcttttttactcatgggatttgtgaaacaaatgaaagaattcaataatgtgtccatttttttgacaaattcctttataatactccataactcacgaaccaatgtttaagaaggaagcaacatcacgcaactgaattttcaaaatatgtccttttcggtttcttttgtccaaatttccaaagaaatgtctaaatgtgcaaatatatccatttataaaactaaacaagtaaatatccaattctagcttttgcgtgttcattatataaacaacgtgtctgttctctccaatcagataaaaagattcaattttatttgatagcccggcgattaaaaagattcctatcatcatcactcgccggctaatg

SEQ ID NO: 3763 - DNA, 3000 bp, Unknown
  misc_feature (1)..( 3000): cDNA_ID_1821913_gDNA_ID_1620664_Annot_ID_48016 3000 nt of promoter + ATG
agtagaacatgtttcagagtatgaaggttacatatttgagagcggtcaagggcttgcacggtctgttttcaagccaatgtcaatgctgttaactcatcctcaacaaagatgtgctcaagatgatcttgacatccccatgtctcttgcaaagaaagtgcctgtgactgaggcggcaagtgctgtagatcctcacaatgggaacaatattcagatcataaactaatgaaacacttttttttttttcttgtatcttttggtcatgacatggttgtgagtttcgcatgtgaaaaaaatactcaaaacctgtagtgacaacttgttctagatccatcaagtaagaaactcaaatgtccagatgaatataaatgattttcttattttaagagaaaatacctcatcaagtcctcaagggctctctaataaaaggtatttgcaatattgtttcagctattaatgatgaattaaatgtctaatatgagctaaataaattgaattatgtaactagtcttatcttttatcccgataaccatatcagcaaacttttcatatgaatgaatacatagataatgcacaaattaaagtacgtcattgtgtacatggatatcttagtttatggaaatgtgtggctttgagaacgagaagctaagaaatattacaaattgctttgaatgttgcaaagtcaatacatcgatcaagttgatattcaatgttttaatatattgggtagatattcatattggcgagatcgtgattgcatgatcttcaatgtttctttgggaagaaattcatcaaaaatccattggcttatccaaaagaaaaatcttcacgatttcatgaaaatatatgcatgtaatttagtttcgctttcccttaagtttatccttatagctaaagcaacagtctagttcgtaaattatgcctctcggataggtaatagctaatggacgatgtcaccacgactttaggaaaacctaaaatatatctcaaaacaaaataaaaataacaaaatgttgccatgcatttgggtttaggagatgacgatgccagcaacatgtacggcatccgttctctatatatatattagatcccattcgtacggcctaacttctctcttttctctttttctttttattattattacggcctaactttgatagaagaatatgaaaaacgaatttaataacgtttgactaaattattaaattatgaatccatagattggaatcctacaagatgacacatcatgtgcctttctaatttagtagcggggtagtctataagaataaaactaattttaaaattaatgtcgaattgctatgtgtattgacattttacgtacataaaatttttagtcaactagtttaatttttggagccgatattgattaatcttagaatcttaccaatgattagtagtcttaactaaaaaattccaaaactacataataaagagtaggtaaattaattcacacctaatctaagaaaactaaaactaaaatatgtcttttcaaaataacgtatagtacaataaatgtataatatagttctgtacttctgaataaaagaccaactagatcatcaatattttaaaagaagtacagaaaactattgataaaaaggatgtgatgtgagagttgaccctgttgtatcgtttgatatgtccaaaaggtcaggaaaagctggcttaattagtaattagtaattacaaagtacttacgtcacatttgtttattattactcttttcttttcgtttacaaaaatttagaaaaaataatatttatttaataattgtaaaagtatactcctcttgcattaatatgcaacataacaataactgttacatagcattttgcaacataagaataagtgttacataaacatttttggtaaaactatattaatgcaagaggagtattttctgtaaattttatgtaagtgttagttaacatagaaaaaaaaaggttattggaggaaattaactatggttttgtgctatgtatgtaccttggtgtcccaacataatctattgtcagattaaaaaccgaatcaaacgttattagattgatcaaaaataaactctattaacgataaaaccactacacgaaatcaaaaataaaagaagtttttttttattttttggtttaaggtactcaaactttcaagatcaaacgcataccctgactactagtctgctagattaatctccatttcatcagttctctttctttttctattttaaaattacatacttagttagcaagcggatggatgaatttttctttaaataattaaatatttggtgagtctaaacttgttggcaatgacaaagaacaagaatcccgttggtaaaatctattgataacttccaaattctcatttatattttggaataaatcaattagtagtttaagcaagatactaatcacaccacgtcatgtgccctttcaaatgaatattgggatgggatggtccagatcatatttttaactaattaactgtaaattgttatacgttgtcactgccaccaggagccacataattgccttacattacagcataagctatattaatttcttaatttactggagtatgtcaaataattcggtttctcactagtcgacacattttacatattctttatttctaatataattggcggaaacgactcatttataatcaagtattctaattatcaaaaggattcaattttttaaaaaaatgttatgaaaaacaaaaatattgatcgaccgcctcggaattaaaaatcattctttttaaatgcctaaagatacaagtcatcgagatgaaaataaaagtatgtattaatatattcctaaataagattcacaaagggctatataactggtatatgcaataagtaaagtcgtgtatcaaactttttcatttgttgtatcatctccctcttacatatacagaaaacagcaaaccaaaaaaaaaaaaaaaaaaaggcaaaacacaaaagaagaaaagaaaattatg

SEQ ID NO: 3764 - DNA, 3000 bp, Unknown
  misc_feature (1)..( 3000): cDNA_ID_3071828_gDNA_ID_1620664_Annot_ID_163877 3000 nt of promoter + ATG
acatcatctctttcataatctctccttatgtgtaatattggtctgcactttatgtggtcatggacttagtcttgacgccaatcttcttccaggaaacactaggcatgatttgtttcgtgtccacacgatctttaaactgaacagcaaagttgagcaacgaatcaagaagtgagtcagatagatagtgaggctcaagtccaagttccatcagcttagtgtgctttgcgttgtagtaatgttcttctgcctccactctcgggttaggcaccgtcatctttttcacgtctagcccaagctttgaacccgctttagtgacgagtgaagccagttcattgactgaaaactgttctgtaaattggttgaagacccggaactcaccagcttttgccgggtttgctatagcgatctcaacacattgaaccgtgtctcttatatcgaggtagcctctcgtctgcaaagggaaaaacttcaatcaaaacctcaaatttttcgattgaaatttcatgtgaaaacagatcaagaaagtcatttacctgaccacctttaccataaactgtaagtgggtgaccaacagcagcttgcacacagaaccggttaagtgctgtaccaaacacagcatcgtaatccagtcggttacggagttcctcatgcatctctgtctcatcagtcttcactccataaacaactccttggttgagatcagtggctctaataccccaagccttgcaagtaaaagcaatgttgtgcgaatcatgaactttgctaagatgataaaaggagctagcttgcttggggtatggcaaagtgtcagttctaccgttgtgggttatggttatataaccttcctcgatgtcaatatttggagttccatactcacccatcgtcccaagttttacaagatgacactcctctccaaactcttttatagcaaagagaacgttgagagtcccaatcacattgttgtgctgtgtataaactgctctggaccggtcaatcatcgagtaaggagcggatctctgttccccaaagtggacaactgaatccggctcaaaagacttgaaagactcagctaagaattcgaaatcacagatatcaccaacgtacaactcaattgatttccctgtcaaagccttccatcggctgattcggtcatgaatggaggcaataggagtcaatgactcaagtccaagctggtggtcgaaaagacgtcttacaaggttgtcaacaatgcaaacttcgtaattcttcttggacaagtggagagcagtagcccaaccgcaataaccatctccaccaatgaccataacacgctttggtttagaggatgagttattggtagatgtttcgggtggtgcttgttgggttataggtacagcagttgctctgaaaacgcagctttttctcggtttcttctcttggaagagaagtcctttgagagaagatcttgaaagaagctgagcattgaagaaggtctgccctgaaacaaacggcttaactgaattcttgctgctgctgctgctaagtgagataactgaagggcatgaagctgaaagtagatgcgccattttaaaggtttgttcttgattctatcaaacaaattcacctgcaaaaacaaaagcagctaagatttcaagacataatttggttcagcagaacaagacatatcaagtagatgtttcataccatataacaagtaaggattcagctgattttctctagtttaacttcaaattcaaatcaaaatccaaaaagacatgaatagaaatcgaaactttatcttcacacccccccccctaaatcagctacgtccataacaagagaagaatcaaaacacacgaaatttgaagtcttttatcgaatctgaaaatcagctattgtcaaagactggatatttatttgatcaactaaagtaaatgtaagaaagaagtacattgatgaaattcagagaaaacccaactgaatgaaaactctgtgaattttgatttcctatcatattcagagtttcttcaaaacgaaatcactcaacttacaaaaccggagaaatgaaattcattagaagaaacgattgcttacctttgaaaatttggaatcttgtttagagagagttggagaagatccttcgagactttgaactttgaagtgagggatgggtctctcttctcttctcccggaacgatgagagatgagatgagacagatataaatcatcagatatgcccaaagcatattcttacttattcccttcccaacaaattatggcccaaagtgtcgcttttttaagaacgttggtttattagttttaaagttttccggttgtgaatgatacaggtccggcctttgtgggccagtttctcagtcgctcatttaggcaacttaaggaacattcttcccttactgggccggttggcccaaatatatactttttgaatatgtttgtggctattttctaaattttaacttttaattattaaaacagagaatcatgagataggagaaaaacaaaatcaactgtaaaatgcaaacctaacttacataatcttttgaatgaaattttattaagacgcaaaacattactagtatttcgcattgtaatagtcatttttctgcaagttgaccaaacaagagtcatacttctgatgcaagatacgaacaaagacttcaattataacaaaacattctcatacatctcatctctaattctatatttgttttctcgtagttattatcttccaaactttaatattcttgtcaatgagggtactagatgaaaatgacgacattctatggtcatttgattcccgtgaacctcatgtgaccttgttaacgtacgtgcacgcacacacaaaccctcgcactgattgacattctcccaatctttctttataaaacacacagacaactccataatattaataacccatatatacttagcttgctggtttccttggcaataatttatataattctacaagtttaatcgcctaatcggatttagtaaatg

SEQ ID NO: 3765 - DNA, 3000 bp, Unknown
  misc_feature (1)..( 3000): cDNA_ID_1821891_gDNA_ID_1620664_Annot_ID_163875 3000 nt of promoter + ATG
tcacatagcccatgcaccatacgtcctctccttctcgctctttccttccaccaattcttcgaaggttttgccctcggtggctgcgtcgcagaggccagactaaccccgcgtggatctgccatgatggctttcttcttcgccatcactactccgatcggtgtagcggtgggaacggccattgcctcatcttacaactcttatagcgttgcagcattggtggctgaaggagtgctcgattctctctctgcggggatacttgtgtacatggcgcttgtggatttgatcgctgcggatttcttgagcaagaagatgagtgttgatttcagagttcaagttgtttcttattgctttttgtttcttggagctgggatgatgtctgctcttgcaatttgggcttgatcacttttcattattactatttgtttatgaaagtaataaatttaggcatgcctttttcttttttcttttggacagaattattataggtatgcctatcactctatttgtttcaaaataatgtttgtaatcaattctattagatattcactctttatcaatcatgttatatatttttgtagctggtaaacaaataattaatttttgaacaaaaaacaaaaacaaatacaattagtttttacaagcaagtatgcaactgaaatccaaagattttcttgacgccttttcgagcatattctaatccttcattttgatttagctcaagaaacgccataatagaaccatatatatgaactaagtgtttttaaaaagagtaggtcatgactcatgagtaatcttttccacgatctttaagatatattattcttggaaggtcgaaaactataatatttcattttctgtcgaatatatatatatatggatgacgatggttcccatgcatgatgaagaaaaagacgaaccctatatttatctgtttaattaaaattttctttgtggagataaactctctgtgaaacgcattccgccacctaatttatcatatattttcatgtgaaccaaaataattaaaatttgtttgccatatatatatttatttgttgttatctttctgagtgataaaggtgacaaacatttttgtccactgatacccaatctcttccacttcagttcccttcctttcaaattttatctcgtgcttttacagcatatcccacaattcctgtaaattatctcaaggatttggtgcataaattctattttttcgtacttttttgttggatatgtaaatcagaaccaaaaaaacttaacattgattaaactttacaatttacgtatgtcccattagaggggaactacagtttttgtaggaaaataagaaatttgcgaactaaagacactaaataatcctacttttaaaatcacaatagttagtactcaataaaaaatattgtatattgttgtgaaaaaatgtaaatagtttggagaaactgctactaataaacaaataattaagagatgtcggagatccaatttaatcataaaaataaaatgattagcacaatattgcactactgatttagatgcgatacacgtggaatctgcaacttttcaccaaccacatccgagcctacaccacgaaatttgaggatttttatttatttcccaaaaatttctctgtatttataaactaactatttcttgggacgtgaatatacacattttatattcaacggtccgtgagtgtatattgtatatactctctctcagattccctccttgtagctagcttctacctcctcctttcattcatggcgaaaaactaaaaaagacatccatctttctcaaaacatctctcttactctcttcgttttctgactgcaaccttttttcccaatggagcgcgcaaggagacttgcttacagaggaatcgtcaaacgtctcgttaacgacacaaaacgacaccgtaacgctgaaacacctcaccttgttcctcacgctccggcgaggtatgtctcttccctttcccctttcatctccacccctcgatctgtcaaccacacggcggctttcgggaggcaccagcagacgcgttccatctccgtcgatgctgttaaacccagcgatactttccctcgtcgtcacaactctgcaacaccagacgaacaaacccacatggctaaattctgtggctttgaccatatcgattcactcatcgatgctacggtgcccaaatcgattcgattagattccatgaagttctccaaattcgacgctggtttaaccgagagccaaatgattcaacacatggttgatttagcttccaagaacaaggttttcaaatccttcatcgggatgggttactacaacactcatgtccctactgtcattctccgtaacatcatggagaatccagcttggtacactcaatacactccttatcaagctgagatctctcaaggtcgtctcgaatcgctcctcaatttccagaccgtgatcacagatctcacgggtcttcctatgtccaatgcgtcgcttctggatgaaggcactgctgctgcggaggcaatggccatgtgtaacaacattcttaagggtaaaaagaagacctttgtcattgctagtaactgtcaccctcagactattgatgtttgtaagactagagctgatgggtttgatttgaaagttgtcacctctgatcttaaggatatagattacagctctggtgatgtttgtggggttcttgttcagtatcctggtactgaaggtgaagtcttggattatgctgagtttgttaagaatgctcatgctaatggtgttaaggttgtgatggctacggatttgctggctttgactgtgttgaaacctcctggagaatttggggcggatattgttgttggctctgctcaaaggtttggtgttccgatgggttatggtggtcctcatgctgcgttcttggctacttcacaagagtataagagaatgatgcctgggaggattattggtattagtgttgattcttcaggaaagcaagctctgcgtatg

SEQ ID NO: 3766 - DNA, 3000 bp, Unknown
  misc_feature (1)..( 3000): cDNA_ID_3071835_gDNA_ID_1620664_Annot_ID_163874 3000 nt of promoter + ATG
acctttgggaagatttcagacaacacaacgttccaaagagaatttttacatcaaaatttccaaaatgtgtgttaaaaactgaagaagaagataatgcttatttatcttctttctccgtgaaagaacagtgtactttcattccgcagcttctctatgttcctaaagagaaccaaaaagcagaaatcaacaataaagttagtattcataaattaaagagaacaaaataatgcaacaaaactgaaaaagagaaaagtgggtctgattaatctcttttgcatgaacgcaaacacttacaaaaaaaattacttactttttcttacaataatttcatgaagaaattcataatcttcatcatctgcctcactaaaagattcagagcactagatcaacaaatagcaacattttataactaaataaacaaaccaaaagttgtattatcgaggggaaaaatacaactttaatattcaagaaagaagaagttgaaaagaaggagggccaaatcacgtacggagctgcctctgtttatgacacgaatccattttcatatctttaagatcttccgaccaaaaaaaaagataaatcagaatcaagaaaatcttatatataatcactttcttaaaatgtcatttatttaaaatgttgttcatagagaaagagatgaatctagtaaaattatctaaagaaaatatatggttgaaacagaatcgaaatccaaaaaagaaatccaaagacatgaagaagaccgatgtgttactgtttactacagagaagtgcactcatttctgttgcaggctttaaattagggaagagaccctacattttactatttacatgtctctatatatatatatatgtatgtgtctctatttataaaattttataaagttataagaaaatggtgttgtcttcttgtgctggtttcaattatcacaaatcagaaagagggaaaaaagtaaagaagggtgagatcttttttagccatttaaggagaattgatgagatgtgtgatccatttgggttcttgctttttcttctttcttttctcaccactcgtgtctttgtattgtgccatcaaatcttatatccatttacgtatttttttcatataagttttttacgtaagctttacaaaaatatcaatcaatttgcttggccttttctttgattgttcctttcttatcatttttatttatttatttatttattttaagttcaatgtgtcgttatgtgttacgtctttattatcatggctaatgatgatggaattgaactctattactcgtagactatatagattgcaacatctgaaattatgctcttctttattacaaccaaaagaagaagaaaatctaatggtacttgatttgatctgtattagcgtgacttgatctgtattttaaataatgttaatggtacttgcctaaacaatgactttctaagctggtatgagacaaagaaaagggtcaaggacaagtatcttgcatggccactccaagcaaaattggatattgatttggtgaaacagttattgttgttcgtataggacaaaattattttcaatagaaatcgataattattgatatcatatccttattattgtttgcttacaagtctatattatttaatagtttgaaattttgatttagtaaagcagaatagtatcaataacactaggaactatagtaccgactattaactgaagctggaatgcatctttaatcatgcctacgatcttaatcaataacacttattaatgttagactattagacccgtgctcataacttttgggtcctaggcgaattataaaagttacttttttttgttgtctgatagtccaaacaagaacttgtaatgctttttctaaaatgaaacaaaatgtacgttggctatggagcctatcgactccagcaccagcagatgcttaatctactccatagactagagcgctttttatctgaagtcgtataatttcccaagtcatttggcttaattattgtgtatcaacttatactatatgctactgatgtcttgcttagaatattatacaagttcattgacttagaattatatataggcagactaagcaaaatgggaataaatgatcacagagggcattaactagttcactgaggttcaacaatctacttgatcttaactcctttcgaattaatatagaagtcgagcacttgaggatcagaaaacacacattcattctcagtgtctgaagcacttgagggtcagaaaacacacattcattctcagagcggcgtataattttaagatgtcaatcgctcttacgtaaagatcgatagccatccacctaaacatatgcaatactccttctgtgaacaagaaatttattgataaaaccaagtgtgttagcaagttaatctttacatagaaatcaaggactcactcttaatgaccagcaaagtgtgttagcaagttgagtgaccagcaaaattctaaccctaaaaaagtaatgtagaaagcaagccctcattatcacctttaccgtgacatttggatttccatctctatcaccacccatccaggaaccaaactttagtggattcattgatgcaatgcagatagaagaagaatagaagatgatgcaatgcaagaaagacatcccttgagagagcccaaaccattcaccttattccaatacattaaaaggtgtggtttttcccaaaaaaaaattaaagtaaatttttacttttagaaaattggaaagaaaatttacaaatcagataaatgagaatttacagctcaatatttccatatcttccaaatattttccatagattttattttattggaaaaagtatcttcttaaaataccttgagaggttgtttagactttctaaaatttattggaaattaatcttaaccatatgctttaacttttgttatttacctcgacgggccgatattatatatatagcaaaatttgattttcgtggaacttataggcttctctgctgatccagaaggag

SEQ ID NO: 3767 - DNA, 3000 bp, Unknown
  misc_feature (1)..( 3000): cDNA_ID_2994851_gDNA_ID_1620664_Annot_ID_163872 3000 nt of promoter + ATG
acattttggaaattttgatgtaaaaattctctttggaacgttgtgttgtctgaaatcttcccaaaggttctatcagaagaagaaggataaaggcaagtttcaacatttttaatgttctatggacatttgtagtaatctaaagctttcttttttacttattagttcactgtttatcacagatagctttgagatattattggtctgtgtatcattgagcctagttacggcttcattaactcatgtttcggttctttatatattttaatgaaatatttaatgacatagtgagcgatgttctctgtctcttgcagcattttacatttagtactattctccaaagatttggtttcttagattttctgaaatcttttgtctaagtcttaaatacttgtcttctttggtaatgcagtttcatagaaacccaatggacaacaacaacaacaacaacacttttagttctctggataatgtcatgactaaccaaaatcctcttctcatggattttataccttcaagagaagattcaacttcattctcaacaatgcttccatggaataccatcagatcagatcctctacaaatgggtggctttgatattttcaattctatgctgactaacaaatacttatcatcttctccacggtctatcgatgttcaagataaccgcaatgttgagttcatggctcctcctcctcatcctcctccacttcatcctttggatcatttaagacactatgatgattcctcaaacaacatgtggggttttgaagcaaatagtgagtttcaggcattttcaggtgtagttggtccaagtgaaccaatgatgtctacattcggtgaagaagatttcccgtttctaatttcgaataaaagaaacaatgagctttcattgagtcttgcatcagatgtttctgatgaatgctcggagataagtctttgtgcagctacaagattagcctcagagcaagcttcttgcagcagcaaagacatttctaataacgttgttactcaaggtttctctcaacttatatttggctcaaaataccttcactctgttcaagaaatactatctcatttcgccgcatactcgctcgattattcatctcgaggaaccgagtcaggagctgctagttcagcctttacttcacgttttgagaatataactgagtttcttgatggtgattctaataactcggaggcgggtttcggatctacatttcaaaggagagcattagaagcaaagaaaacccatctcttggatcttcttcaaatggtatgtaatatattcattcactttttttgcataagttaaaaaaatggtttgatatatatgatgaagttttatgagttgatatttctcttcaggtggatgatcgatatagtcattgcgtagatgagattcatacggttatatcagcgttccatgctgcaaccgagttagatccacagttacacacccggtttgccctccaaaccgtttccttcttatacaagaacctgagagagagaatctgcaagaagataatctctatgggatctgtattggagagaggcaaagacaagactcaagaaacctctatgttccaccagcattgccttcttcagcagctgaaacgaaagaaccatcagatttggagacctcaacgaggtttgcctgagaaatctgtttcggttctacggaattggatgttccaaaacttccttcacccgtaacaatccttactcttcttaactatctactttatgatgatgacattgttaactcgattttataagcaaagttatgttttatttaatgcagttacccgaaagattcggagaaacatcttctagctatacgaagtggcttgacaagaagtcaggtaatgtctcatgtttgttttcttatgcaatgactcattgataacaagctttgttttcttatgcaatgactcattgataagatctttgttttcttatgcaatgacttattgataacatctttgctcacaatgatagcaaatatggtattcaaatgagtaatatatatcttgacatactagtcatgtctgaaaaaccggtattggttattttaagatgagattagggctaggaaaaaatcaagcttttctcttgaactacaaatgagactagattatgtattcttgaattcacaataatgttactcaagtcctaggattgtagtcgcacatatgttttgttactgaagtaagttaaagcgggcaaatgatatagagtgtgtctctttgttgtgtgtgattaaaggtatcaaactggtttataaatgcgcgggttaggctatggaagccgatgatagaagagatgtatgcggaaatgaacaagaggaagctcaataacagtcacattcaacccaacggaccaactcttcgaatgccaaaatctgttatgatgagccaagcaatgcataaataagacaacaattgtgtttaccaactttgtgataattaggcaattgctactctatgattgcccaaaacctaaaccatgtacgactatcattacgtatgttataattgtatatacaactcctttatctttgactatttcattttattatcctgtattcttatatcataattatcatcatcctcattaaacttcatgatcaccatttttacgtaaaaataaaattaagttcatgaaaatatataaaaagtatgtaaccactgaagatttattttcatatttattcaaacaaactacaaaatacaaacctaaagttttatttcaccgtttgcatttaactttttttctcttacaagtgagttttattattccaaaaactgaaatgaataatgacgaaaatctcctagcaagcgacgtcgtattttggtttgacttgagaatcttcggtcaactaataaaaacgcagcgttttcatctggtacggacacaattagaaatagaaagtaggaaaaggaagacactttgctaaaactgaggaagaaagtgtaaagacggagccttttacggcgaatg

SEQ ID NO: 3768 - DNA, 3000 bp, Unknown
  misc_feature (1)..( 3000): cDNA_ID_1821909_gDNA_ID_1620664_Annot_ID_163871 3000 nt of promoter + ATG
aagagaatacacagcctaggcaaagagaaagtatgtttttgttcttttcacgtttaataactgttgctcatatcaaagactctgggaagaaccttaccaattgcgaattgtagtaataactattcatggtttcagcttcttattctcttcatgttggagatattattttcttgaacatccattgttttatcttttgtatatactagtttcatttgctaagaacaatgtaaaataaaaagaaaaatttgtatactcatgctgaatcaattccttgacagacatctgatttcaaaaagtatgatgaaaagatagttgggtcgagggttaaaatctggtggccgttggatcgcgcgtaagcattttgtagtttgtgctttaatatactacttcaatttatttattctttctgtgctatgtattttcctttaatagctgaatctggactagcacctcggatggttgctggttgcatttctgtcgaccatgcctgtaaatgagtattggatttttaccacaggtattatgaagctgtggtcatttcatattgttctgctaaagagagacatcgggtaaagctaaatatatcagtcttctacatagctattttcgttggtttttggtgaatcattagtctattctcctaagtgatacatatttttaatttgatccaggtcattgataatatgctatatttgtttatgctgctgctgctatgtcgttttcaggttcgctatattgatggagatgaagaaatcttgaatatgagaaaggaaaagtggtctttttctgaatgaatcaaagtcatcaaaggtggggaattatatctctcatctctggttttttgttttgtttcatcccccggattttgtttcatgcttccacattttctgttagcaggataaagaagctaatcaaacgggatgtgatgaagaagcctccacaatgtaagcattacttctccagttctggtgtttttgtggtgctggaatagctcgatgtgaatttttgtttatgagatcaactcgatgtcttgggatgagactggaatagctactgtttcttcatgcaggccccagaagaagaaagctaagacacgcaaggaacagtcaactaataagcaatcaaagatgctttcaccatttccacctaatgttaaaaaggatgatgaggtcatatatagagaggttcttaccattttgttttcagcaaccaatctcttttgttaaattctttccatttattttcctcaggttccccaaatatcaaggaggcaggcagaacaagttctcagtaactgtgctagccagattaaaaagtatctgacagaagcagggaaattgtcgagcgtctccttagctaatcccagtgatgtagtggattcaatatgtggaagggcatttgatgctttaaagcaggaagatgttgttgctaatgaaaaagaagtaagctctctcacatatactagtgcactgtatcaaactacctttattgtttgtagataatatacttgcatcatgtgtctcatacagatgaaggtggtttttgagtaccaatggttatgcaagtcgtctagtttcatttgttctcttacggttctaaaaatttgtgtattctgcaggaccgtcaaggcccaagagaagcggcagtaaaggcatgcttctttcttcctgaaaccagcattgaaacactgaaatctttcatttgtaaaaagaagatgaatgtcatcctcgcttatgttggaagtagatagttaattgcaatcttattttccaatcagcaggaacaacagagagcagcagaagtttctacccctgagctaacttgtgtacctgagaggggactgaacctggagcagtcactaagtgtttgtcctcatgattcatctgtcaaatcagctatttcttctatgaatgagaatggacacaaaatccttgagatggttcaacaaccagtggctgaagaagaggatcttgcagaaactaagactaagacatacaagcgagctcgagtcgaaagctccagcgttcataaagctgatggcgagatggagaaggaagctgcagaaggagaaccctcttgccggtcccacaaatcgagtgctgagcccggagacttgcagcctaagaacctccctgaaccttgctctgtcacacaacagctggctaaggtcaaacagagcattttagacactgtagccagtgtaagacagtttcgctgtgagctggaaagaaaggaacagagcattgcagacactttaagcattgtacgacagttccgatctgagatcgaggaaaaggaagatatgctagaagcttcactcctggaaatcgatgtgttaggtatgtgatatgaatgctgatgaacacttaagagtctatttttctttttggttataggtctctctgataatgtgatgtttggaacaaacaggggagaagatatcgggaatcaacaaaatcctcaactgaagatcatcaagtggattgcaaactcaactggtatcctgaaactagttggacgattgagtaacgtagttgacaaccagagagaagtcatttttttgtatagcgttatcactcgctcaagtctaaagacagttgattttcttaatgtcaagtcaaaaaccaatagtggttcttataggcaccacttttttgatgatttaacaaagttcgaagttaccgcaattgctaatactgatcgattcaatcaaaagaaagcaccaagaaactgcatagcctcaataacagaagtaaaagaatctctcttgtgtcctagtggaactactcaatgaaacgatttttgctcattcccattcgtcaaaaaagtcaaaagaatcaaaacgctgaaactttttctctgtacaaagaaaaaaaaagaaaacattaaacgacgacgtcgtgttttagtttcaccaaaacgcatcgttttatttatatcggacgaaccagtagaattgtagaaagtagaagagagaattcactacatcggcggcgaatg

SEQ ID NO: 3769 - DNA, 3000 bp, Unknown; identical to SEQ ID NO: 3762
  misc_feature (1)..( 3000): cDNA_ID_1821917_gDNA_ID_1620664_Annot_ID_163869 3000 nt of promoter + ATG

SEQ ID NO: 3770 - DNA, 3000 bp, Unknown; identical to SEQ ID NO: 3761
  misc_feature (1)..( 3000): cDNA_ID_2144907_gDNA_ID_1620664_Annot_ID_163868 3000 nt of promoter + ATG

SEQ ID NO: 3771 - DNA, 3000 bp, Unknown
  misc_feature (1)..( 3000): cDNA_ID_2144903_gDNA_ID_1620664_Annot_ID_163867 3000 nt of promoter + ATG
aaccttgaagaggtaagggaagttggaatcgtcgcagccaccggaaggctggagattagtgagattctcgagatcagcggtgattttgagcacatagttcaccattttttttctcctttgctctatgaagcactaaagctttgcagacgcgattcttcttcttcttattatttatcagaatggccccccaaaaaactcatatttcgttataaaccaaatatttggtctcagcccgtttaatttttttgacctatgagtcttttagtccaaaagcacacatatgaaaaagcccaatttgaaagcaattgagcccaagttatttacatctagttgttttatgtcctgtaagttttctatttggtatcatttgatatttcttaggttttttaataatcttaaggattttgagtggttaaaataaaacaccttaggatttaaacttaatttctcaaagcaaaatcatagcactagactcaacatttttttttaaaaaaaacaccattagcaaactacaagcctagtaagtcacaatcaagaattcaaaccatgattaaccaatatttgctcttaagtccaactaccaagataggcaaaaaaatgcaaaaaccaacggaaaaagatcaacttctttaacgatagaagaaaacacatgttaaagaaaactattatttatagaaaaaggtttctccaatgctacgctttgttcgctattgttgacacaaaatggcacaaaaccaaaaaaagaacataaagaaaaaatgtaaaagctcgtgtgggtgtagtgggaacgcaccaacacgcaacctctggattagaggaatcctcatcaacagccaaacacgttgtacaaaagtcaatctagtgtcttgccatttggcttcatgtcggtttcgcgacactgagagaaagccacacgtacatctacgtagcttcatccccaatcaatccccaatttatttcttttgaattccgtcatttcttctgcattattgtcgccattatccttttttgttttgtaatcagtattttatcattaaacgtgacaagtactgtcttcattctccaacacataaaatagtcagaactcaataaataatcataaaattgagtactctttggcccctgtatgattagccgttaaactatcactttcgcaaaaaacttcatgtgattactttgatatttatatgtactaaaatagttttttttcttcgtcttatgttcgcatataacttaaaagataaataactcctacgaagtatatgatacgtgactccaatcaaaatctttgacttgtgagttgtgaatatgaatttaagtgaaactgtcgcccagtattttttacggtcaacagcatgtggatacttttaaatatttttgtttaacaaattaaagtgaagaattttcgttgtctcgtgaaggttttagtggtatatatatcagatttccaaattttgcaagatttattttgatacatatatgaagttacaaaacatacaattacattccaacgttaacattgttttactgtgataactgataatgtaatcctgcatgattttgggtgaacttaaaaacgaaactactgaaagttgcatgtcgttttgcaatcataatgtgggcaacacgaaaacgagctcgaacgttggaaatattggagaaactcttaaagtccgtgagaggtttacatttgggagatgtgatgattggaaactgaatgtgggacaaaggtttaggatcttcaaaatcgcgattgagttaattggggacgtgaagctcgtataagtattcttgataaactcatctttaacagaaaaataataatgaaaaactcttctgttttggatctgtctcacatattggagagatgctcacgttagcaaaaaatcacatgtcgagaagattaatctcaaattagtttcaccacaatgaagttgaggagatgctataaaaatatatcgaaaccgttaagtgaatatggatttatggaaaatggccagatacatcaagatcaaaccatccttctctaagagaccacttaggacctctaaagaaaacaaaattgataaggaaaggacaaaaaaaaaaaatccataaaagacaatctagatgataagtaactataaaaacaaaagttaatgtctctgtaaattaccaaaaacttaaactcataaacaaaaaccaatttagaattgaaacatgttaaccaagattgaactaaaaaaaaaaatcataataaaatagaatttcataagataagtcctacatttccaaaacctgatctcttcctctagttccaaaaccctaaatatcctttttgaatccctaaattaatttgtcaaaatgagttaattaaaatatagctaatttttaattaaagaaagagttgtgatgacagttcttacaaaaatagagattcatttggtaaaaattggatagaagatattttattagcatttccccttttgtttttcgttcaagtgaaggtttcaacaaaattaaagagaagatctcttaatcacaacaattaaagtaaagtttaaagactaaaaacaaagcctaaataaatatcagtttggtggtattaaactagcacgtgtcaaaaactaattggtagacaaaaaaaaaaagtctcacgtgtaacgcgaaagcctttctaaaaaaatttcttcagcatttaccaaactaaagcgcgcctctcgcttccttccttcaacctcttctttgctcatctctctctctctacaagaccaaacttatctttttttttctcttctctctgtctttttacacacagagctctgttttcaaagctctgttctgtttcttcgtgtaatctctgtttcttcaatctgttttttttcttctaattttgaattctcgtacagacgcaacggttatattgttgtttagcctctttgttcttcgaatccaatgtcttcgttgttttgtgtaaccatggattctcatctctagatgatttcgatttcgattccaatg

SEQ ID NO: 3772 - DNA, 3000 bp, Unknown
  misc_feature (1)..( 3000): cDNA_ID_1821876_gDNA_ID_1620664_Annot_ID_163883 3000 nt of promoter + ATG
gtttattagcaaagagccattgacgacaccagcggtgaagtatgaaacatcaattttaatagcaaggcatgccatccttttctatcacatattttatcataaaaaatcgtgggaattgaaccgttacatatagacatagatttgacagcccaatcacatatcacagacacgaatacatataactagctaggttccctcaactattcatttgacttctgaaaaatggtcatctctcgagttctagttaatacaagcctatgatcataattagggcatatggactataatccatcagttgtattctgtctatggtagtcaaattgtaaggcctgatctttgggttttgcaaactatttactagaattgtctagcattttttcctatgatgtaggataaatcacccttataaagggattaaaacgtttcagaaacgtttggaaactaaactacaaagggattcagtaatttattcaatgcttatttcgaacaatgatgatagcattaagatcttacagccgattaaatttgcccaaacaatgatgatagcattaagtttttaatcgatatgtcttcgatttacattgtctattgtatacttacaaacttttatgccatatgaactgttttcttatattaaagattgaaaatgttttatggggaagaagattacatgattggataggaatcttgaatatctctacaaaaacggccttgtttctaatcaatctatgccaaagtcaatccgttttttataacccaaattagctataaaacctactgctatataaactggatgcaacgggacaaccaaatgcattatgtagttttccacttatcgaagaaatgaaattgataatgtgagacttctgtagcagaaagctcatcatgatcaagccttataaaacatttcaaaatctaattcataatgaaaatttgcctagccatttaactagctagggccattaggcccaatgtccaaatagcctgaacgctgggaaaaagtggggctttcggaacagaacaaataaaatttgacgcactttattgtgttgcaagctacttcttgaagtatatattttgattctcgaaacgtcttcagttctgtacaaatttaaatattctattgaaaaagaaatcttggtcgtcgtcgtcgaatcggatacgttaacgttacgacatacgagtcaccattagggccgtagacgaaatactaggagacgcatgaaggtcacgtgtatcaccgttgcagcacataagttttcacctctcagtattgaacatgcgccgtatttcaatttcaagcttataagaatattattttctgttttgtctcgtcacgtagaagaacactcaacacaacgggtcatataaaaacaatcaattgaccaattgaaacacttaccattagctttactaaaacaaaaagtgctacagctcaattatttcgacgtactttttttttttttttttttggtcttttgtggcctatttcgacgttctttaaaaccacgatcatagtggtttgggatatagtaattaatttcatgtgtttaaccaaaaggtaggaaaagtaattaattattagttgttgagaaatcaagttgcaaaggagattaccggcgactccgttggtttatgaaacaaacaatgagacggtttagaatgacggtggccccaatattttaggtctgctcatattattttgaatgatttaattttttttatttaaataaggtacccttatatacataaatgatttaatttagtaaaagcttttgtttatattgcttttatacaagtttttgggtatgactattttaacctcaatcctcaaaactataaaatctattattgcacgcttggattttatatatatatattcaatctataagaactaaaaaataaaagtgatcatagtcaaataatttttgcataaatacttaatattgctacccaaaaaaaagaaaattgcataaatttatgtataattacattatgaaaaattattgatatgttgatatacagttttctaggaaatatcaatatgaaaagaaaaaaagaaaaaaaaacattgtaagctatttcccttgaattacactatatgtatgtgtgacagtatatatgtgtgagcttaatcatataattaccgtaacatcactattgatcttgaaagttacgacgacaaaaacaagattccatcatagatctacgtgtatcttttgtgtgattagtatataaccaaagcgattaagtgaatttaaaatttgtagatatttcttacttaactgattatactataagaagcaaaccccaaaaccatctgcatctcaacgacgataatcgtccgaatatgtttttctaatagagtttgctgaccaaatgcaaatggcatcacgtctcttgccgtttgacgctagcaattacacttcttcattgaaactttaaaagtgaacccaaagaattaactcaataataactgatgagtatacaaattattgtttccggctaaaaacctgaaattaactcaaatttggaatggggatattataactttgttcccacgtataacaaattagttcataattaagaggagaatcacaaaaataactgatgtattgatgttcaattttggaaaattaagatatttccaatggtaataatctgttacagccttactgggagtagtatgatactaaaacagtaaatgcattttagaccgacataaacaataattaagaagaagaatgtttgggtcaaatctcaaagttagatattatttttttgctttttgcacaagaaaacagaaaccaaaaaccactagtcaaaaaaccacccatgtattcctcctagtctctaatccaacaactatataaaaacctctcccattctcattttgttactcatcccaaaaataaaaagagtatatctctcacacacatacacaaacttgacagttttttaatttctctgttagtgaactcaaaccttcccatttccatg

SEQ ID NO: 3773 - DNA, 3000 bp, Unknown
  misc_feature (1)..( 3000): cDNA_ID_2105056_gDNA_ID_1620664_Annot_ID_163882 3000 nt of promoter + ATG
aattagtatagtcgagtcgaatcagataaaaaatcacaccggtcctaagtatctgatgcattgtttttgcagaacacttctagggtgtttctcaagatttacatctttgccgtctcctatatccaacctttagtttcaaatcagtgaaaacagagttttagaacacattcaaagacaggaagatcttaagatggattctggatttaagtccttaccagtaaaagaatggttgtgtgctcttgctcgctgaccagacatcataatagaagtgcaagttgtggccgtaacgatgacgtgggtcaatctgtaatttcaagagatggatcattagagtatattcaatgatagctttggatgtcaagtagggtacttgtctttgatatgaagttacaaagatatttaggttatggggacttacagcttcaagccaatgctgaagagctaatttctgagccttttcatctttagataagcctttcccaacctaagaaagtgagacccacgttggtttttcatatgaaagagagatattgagttctactaataacaccttgacttataagtaaacagagataaattgatgtcagaccttagcagctcgttttctagctcgtgcccatttcgaaacagcggtctcatgtttttcttctccaaagaaagacacagagctcaaatccaaagctgcaccttccaaagtcctccacctacaacatttcaagcaatacaaagggttagtgtaaacatctttaaaagacattaaaaaaaaagacgaagatgaatcaagtaactcaccagagctcctcaacaacgaccgcacaatctgctaagttccttctggtcctgtaactcttgtacaccttttgtaacgtagttgcagctgcatcaagctcggtgacaggtctaggagagaagaacacaaatggctctggtggagtaactgtaggtttcttgatttggattctctcacagtttcttccattcaaagtgttaggcgttgacttctttgtctccaagacctcaaaatctgaatcagtcttggtctctttaggaacctcccagctgttgaaactcaacgaccgctccatagtactcttaggagaattctggtgcctattagtatcgtctctcttgaaactgttggttcttgatgtcaagcctccgtctttaagtttgaagcataaggacccaacttcaagacccatgaccactaatataacgaaaggataattccaaagtatatttaatatagaaaatcccctgcacacattaattaaacaaacagtagtcgcattaaaattagctataccaaaccaattatttgtctcattcaaacattttaacaaataaaagtaccttgtgtgggtatcaaacacaaaacaaacgttccttggtgtttgtttagacaagaaacagagaagcttgaaagaataaagaataaaagaatgatttttgttctttggagataaaactgaactagggatatgaatataatgatgactaagagatcttaacataaatataagtaagggtaggcagttgaagactattgagagagtaagaagtcttcgtttttgcaaaattgttgaatatggaaaaaatattacggaatattcaaagttggcgtgtttgaattgttgaatattaccaaaagagacaaaatagtgagaggaggctaactaggagacagagtatgtggggagccataagagatggaggctaacgaaggtaagttcatggaagttattgagataaggacaattcacataatctttttccaacattaattttgtcgttcttatttaattatataaataactacatatttagtacacaataattttaaagggtttacgtattaattatctaacggtgaagtttaggtcacacaatggttcatgtagaattattacacacgatgacacgaatgtcaaaatttgcgaggagcataaacgttttacatttgaaaactttgtatgcacttgtgttgacaaattaaatcttcggcatgtagacatgtatggttgctataaaattatctgctatttcagagttactcaacgggtttacttttacatttgaaaacaaaattctctcaaatccttacacaaggtctatatccaagaagaggattatgaaagaattgaactagggtttaattcatcaaaaagtcaaacggttcaaagaaatacgtcaagttgtcaatttgcgaattgtccaatataaacatgtattttctatcttagaaatactaaaaatcaaatcgtgttatttcttttgtcaaaaacctgtctatcattaacgttcagacgcagttttatttgttccaaagtatagtttatgagactattgaatacattatcctacaaatggtcaaacataacatatacatttaaaattgtaaaagaatttctatttctactgaaattttatatctttaaagtttcaattgataattcaagtcatacaagttcacacgatagacaaaattttattttgttaaggagtgataagggttacttttgggttttatatgtcttcatcgatatgaacatgttcaactcgttttatttacatggaatatgtcgtacgtacgtccaaaatttatagaattgtagaaaataaacttccaaaattttaccattgactttcctcgaagctatagtagttctgaaattggagactttgaaagataaaagtacaaagattggagtaccactcaactctagctcgaagactttctttaatttctgatcttccacgtagtgatagagatgcatgggatgtttccaggaaatacttctacggttctattctaccaaatctggaaaaaaataaaatgaaaaacaaatcatcggaaatacttacagattttaagttaatgggctgggcttagattgttgaattgggcctcgtgctttatctataattaggctatttacgaaacccagccaatgaacctgagctgagactgagagacatctcggtgaagaagtagcagag

SEQ ID NO: 3774 - DNA, 3000 bp, Unknown
  misc_feature (1)..( 3000): cDNA_ID_1821880_gDNA_ID_1620664_Annot_ID_163881 3000 nt of promoter + ATG
tctttatctgaagcttctgccttcaaaagtcgaggatcattcaatacgtcatgactgctcttaatcttttgctttacaacagccagttccttttcctcttcttcagcttcttctccgaatgacagtaaattcaatttcctaattatcacaaagacaacaacaaaaaagtctcaaaagaacagccaaagcaaaattatagctaaagctatcaatcgaccatggataacatcttacttcacgggctttgttgggggttccttgatttcagcagcagattcttctgatgtctttgctaacactctaggaacaatatcttcaaaagggttccacaaaacctgtcacagaaatatacagagtatcaaaaaatatcaagtaaatcacaagaatgacacaccaaagaatcagtatcaatcagagaatgtcctcaatatgaagacatggaacactataatagatcaagcattaacaatccttcacctcgacagataatattttcggagcaggatccagaggtcgatcatccttactcgtgtcaacctctcctagtcttaaaagattgtagattgaatcgcccgttacctaaaagaattaaaaacaagttgcagctaaatatgatcaagaactagaaaagaataattgcacgaagcagaaaaacaaaacaaaagaagtaattttgctttaccttgccaaagatagtgtgcttcttatcaagccaatcacacttatccaaagtgaaaaagaactgacttccattagaattaggtgagctcgcattagccatggcaacaatcccacggtggctaaatctcagccttgaatggaactcatcggcaaagacacctccatatatactatctccacctgttacatatatcacacataaaactcaattgacctaatccagcgagcaatcagaagaaaatttgatacaaatgagaggtcttaaaccctaagaataatcagaaagcgtagaagttaccggttccggagccggtgggatcgccgccttgaacgagaaaaccgggaatgacacgatggaagatggtgttgtcaaagtaaccctcgaggcatagttgaacgaagttccgtacggatttgggcgcttccttaggccaaagctcgacgtcgattggaccatgagtagtatttacaatgacctttccctttgtcggcggctctagcacgtacaccgtcgacatctctgctacttcttcaccgagatgtctctcagtctcagctcaggttcattggctgggtttcgtaaatagcctaattatagataaagcacgaggcccaattcaacaatctaagcccagcccattaacttaaaatctgtaagtatttccgatgatttgtttttcattttatttttttccagatttggtagaatagaaccgtagaagtatttcctggaaacatcccatgcatctctatcactacgtggaagatcagaaattaaagaaagtcttcgagctagagttgagtggtactccaatctttgtacttttatctttcaaagtctccaatttcagaactactatagcttcgaggaaagtcaatggtaaaattttggaagtttattttctacaattctataaattttggacgtacgtacgacatattccatgtaaataaaacgagttgaacatgttcatatcgatgaagacatataaaacccaaaagtaacccttatcactccttaacaaaataaaattttgtctatcgtgtgaacttgtatgacttgaattatcaattgaaactttaaagatataaaatttcagtagaaatagaaattcttttacaattttaaatgtatatgttatgtttgaccatttgtaggataatgtattcaatagtctcataaactatactttggaacaaataaaactgcgtctgaacgttaatgatagacaggtttttgacaaaagaaataacacgatttgatttttagtatttctaagatagaaaatacatgtttatattggacaattcgcaaattgacaacttgacgtatttctttgaaccgtttgactttttgatgaattaaaccctagttcaattctttcataatcctcttcttggatatagaccttgtgtaaggatttgagagaattttgttttcaaatgtaaaagtaaacccgttgagtaactctgaaatagcagataattttatagcaaccatacatgtctacatgccgaagatttaatttgtcaacacaagtgcatacaaagttttcaaatgtaaaacgtttatgctcctcgcaaattttgacattcgtgtcatcgtgtgtaataattctacatgaaccattgtgtgacctaaacttcaccgttagataattaatacgtaaaccctttaaaattattgtgtactaaatatgtagttatttatataattaaataagaacgacaaaattaatgttggaaaaagattatgtgaattgtccttatctcaataacttccatgaacttaccttcgttagcctccatctcttatggctccccacatactctgtctcctagttagcctcctctcactattttgtctcttttggtaatattcaacaattcaaacacgccaactttgaatattccgtaatattttttccatattcaacaattttgcaaaaacgaagacttcttactctctcaatagtcttcaactgcctacccttacttatatttatgttaagatctcttagtcatcattatattcatatccctagttcagttttatctccaaagaacaaaaatcattcttttattctttattctttcaagcttctctgtttcttgtctaaacaaacaccaaggaacgtttgttttgtgtttgatacccacacaaggtacttttatttgttaaaatgtttgaatgagacaaataattggtttggtatagctaattttaatgcgactactgtttgtttaattaatgtgtgcaggggattttctatattaaatatactttggaattatcctttcgttatattagtggtcatg

SEQ ID NO: 3775 - DNA, 3000 bp, Unknown
  misc_feature (1)..( 3000): cDNA_ID_1821883_gDNA_ID_1620664_Annot_ID_163878 3000 nt of promoter + ATG
tcaagtatctgaatacaaaaatataagggtatcatcaattgattttgtgcatcgacactatacaaggaaattatataaacggattggtttgactaagtcacataacgtcaaaatatattaacacacacacacacaccaaaaaaaaaaaatgtttccacaatgcgtttaagtcgtcatttgtatctttggaagaaaacttaaataatagtatgatattttagaattatcttattttttcgttttcatattaataatgttttggtagaatgaacatgaagtagtactatatataatagttacgaagataacattaaataattacttaaacaagcaataaaataaattttattatttttttcaataacaaaatctatatagtgattagcaactaactaaacttggcattgtaaaactttatagttgattactataacaactctaaaacagcttatgcaagtcatgtacagttattagaattcatccaattgacttggctacattgtatatgaatgaagtcaactgcatttgaaataaataaatcttattagcattaaagaactcaaaacttaaaagtcagagcttacgaaaaacaaagtcaaagtcaaaaaacatatgaagaaaagaaaaaggtcgtttacctgagaaacaacaacgtgcctcacaccactgtccaagcctacgtccccgtggccgtggctgtggccgtgtccatgaccggaaacaccacttctcttagagagagcctcaaaaccttcggcacccatggagaggctatgacggtgatgctccgcgtgagcccgcatccccacgatatgcaacgcccctccatcttcttgatctctcagaaaacccgattcaagacctgggtcagacataaccgaaacttgcgtaccaagcgactcgacggactggttcatcatcttctcctgtttcctctcgtagtatcccgtgatcatgaaatccgcgagcagagtaagaagcgccgcgaccatggcgaagaattctggaaaagggaacattttccatggaaactccggcagacatgggtcggacaaagctttggatccgcccgagagcatgtgaacgaaccctgttgcgaggataactcctgctgcgaacgctttggctcccctcattaagccaccgtttaacggaagtagggttccaactagaggaatcgagactccggcagctccggagataaggatcgacgccatagctgcgaacttgagggtaagagcagctgcgtcatctcggcacgggtctgagtcgcccgagtcacagctagttgtgaacgactctgttttgttacatgcaaaaataaattgagttaactttgctaagaaaatctcaaaatttgcatttaagtgtgtttaagagcgaaatgaagtaattgctttgagatttgaagtgacaatacctgtcaaaccagatgataatggtcgaagaaactgccaaaaatcctgaaaacattatgaggcaaaattatgtgaggaaacaggattgaagaagcaaaataacattaaatagatgaagtggaagaagtttcagacctgtaagagagacatttactaaatccgattaggcgattaaacttgtagaattatataaattattgccaaggaaaccagcaagctaagtatatatgggttattaatattatggagttgtctgtgtgttttataaagaaagattgggagaatgtcaatcagtgcgagggtttgtgtgtgcgtgcacgtacgttaacaaggtcacatgaggttcacgggaatcaaatgaccatagaatgtcgtcattttcatctagtaccctcattgacaagaatattaaagtttggaagataataactacgagaaaacaaatatagaattagagatgagatgtatgagaatgttttgttataattgaagtctttgttcgtatcttgcatcagaagtatgactcttgtttggtcaacttgcagaaaaatgactattacaatgcgaaatactagtaatgttttgcgtcttaataaaatttcattcaaaagattatgtaagttaggtttgcattttacagttgattttgtttttctcctatctcatgattctctgttttaataattaaaagttaaaatttagaaaatagccacaaacatattcaaaaagtatatatttgggccaaccggcccagtaagggaagaatgttccttaagttgcctaaatgagcgactgagaaactggcccacaaaggccggacctgtatcattcacaaccggaaaactttaaaactaataaaccaacgttcttaaaaaagcgacactttgggccataatttgttgggaagggaataagtaagaatatgctttgggcatatctgatgatttatatctgtctcatctcatctctcatcgttccgggagaagagaagagagacccatccctcacttcaaagttcaaagtctcgaaggatcttctccaactctctctaaacaagattccaaattttcaaaggtaagcaatcgtttcttctaatgaatttcatttctccggttttgtaagttgagtgatttcgttttgaagaaactctgaatatgataggaaatcaaaattcacagagttttcattcagttgggttttctctgaatttcatcaatgtacttctttcttacatttactttagttgatcaaataaatatccagtctttgacaatagctgattttcagattcgataaaagacttcaaatttcgtgtgttttgattcttctcttgttatggacgtagctgatttaggggggggggtgtgaagataaagtttcgatttctattcatgtctttttggattttgatttgaatttgaagttaaactagagaaaatcagctgaatccttacttgttatatggtatgaaacatctacttgatatgtcttgttctgctgaaccaaattatgtcttgaaatcttagctgcttttgtttttgcaggtgaatttgtttgatagaatcaagaacaaacctttaaa

SEQ ID NO: 3776 - DNA, 3000 bp, Unknown
  misc_feature (1)..( 3000): cDNA_ID_2144897_gDNA_ID_1620664_Annot_ID_163864 3000 nt of promoter + ATG
tctttgatcgaaagaaatttgcctattacaaatagagtagaaaataaatgatatgacgatttatttaagcttttttaaagattaatattaacgaccaaaataatatatataccacgattatgatttttattaaccttttattttgtaaaaaaaatacactgttaaaattttaacttattcaagtttttgtggaagtctactattgactgccgagggatcaatatagcccagtgctatcggttagaccgatcaatcttggcactcatgtatatgagaatgtttcctttattagttaaaatattgttattttaactatgaaattctggttgttactttggttttggaagccaataccctatactacagcggtaaaaacttgaaagtgtcagaatgtaatcgaaatttacatgaattcaactccaaaaaaccggtggaagaactactacaagcaaattaaccaacaacaaatctaacatgtaccttgaataatcattacacaacaacattgccttgcctgaattaaccttaatcctggagaaatcaaaatcccagaggaactacgccaagaaaaagctcctgaatcagagtaaagccagcctaccagttatggaatcaaccaactcctttggtcctgcacaagaaaagtaatgaacatgttgaggaacaacatcttagctaaaaccgaatttcaaaaaattattgtctctaccaggtccaactgcaagaactgttcttgatccagccgcaacctgttaaaggaagagttttagtttccagagaaacttgttagcgtactactaccacagaaaattcacaaataattttcattcaagagcagtcttttcgtgtttcaataggtcggatggtgtttatgtcttctatagttctaactatttgattagtagaaacttttagattttcttttgaataggaggagctctgattatactttcagcctcaataattgatcaagcacgacaaacctcagttcttccagcatcagctacaacaaaagtcgggaggccaacgctctcagcagcctctgtgatcttattcctgtgagcagaaaagataaatgtagctttcaaatttattgaagacaacttattaacatttgtagtaaagtaataatatgtcttgaagtgcgttttgtttgtatcccccaagattttcacctgcttacatttcttgctgtttttgcaagtgacgactatctttggctgcccattttcctcccatcgccgcagaaggtatcggtcactgaaagaattaagatgaaaacaaaaaaaaacataaaccccggactgatgcatcatacaaagcaaacaactcatttcagacgaaattacctctgcatcaactctgcatacatgccggtggcagcatctgcgaatattaaaaagaaagtcattttacttccagtgttcaaatttcaaacacatttcataagacacttacgtgcacactgtgacgcaattttgcccgttctcatcttcaagtcttgcctaactaccagtacctgtgatcagaacaagctcaaattagttacacaaatgttctgattttaacttgtaatctaaaaatctgacatcattgaaaactcatcaccatccttgtatagattatgcaagtctcttttatgaagctaaaatttcaatcatttgatgggtttggaacataaatcagcttgcattatcactaggttttgttataaggatttaagttataatattttactccaaaccaataaaatctaggggcagagacaagagactatcgttacactagatgatagacaaaccattttaagctcttggtccttgccattgcctggtacagaactctgcttctggaccttgctggataaaagtctgctccttttcactggggaggtcacttgctgtgataaatccaatatcatacctatgatgaatcctatcacaacccctggtatgagattctctgctctaaaactcacagatatcgacttcttttcttgtctctgatcatattcaccggaaaaaaaaaaacaatgatacatttttaactgtccaacaagaatgctggtttagtaagctacaagaaaatttcagaacatgaccgaaacaaccgagtaaataagctcgtttgttgcagtctcagtaagattttagagacaaaaacatgataaattctcgtttgggtggtgagaactgagaggcaaacattcaaatttacaccacaaatctctcaattttatttgccaaatcaaccatagacatacatataagaaacttgtgcactataaagccaaacacttacacttaaagcaaagtacactattaagaaagaatcagactttgactctttgagcttaactgatcttacatcaataaccaaaagaagaaagagctcagaatttgtaatttgtttagtttcaagttttccaattcactagccaactgatgccattcggaagttttgatcaaactagactcaattcctcagcccgagataaattttgacaaaaaagaagcaacaaaactaagaacaaattatcaacagaaaagacggaaaataagtcgaaatcaataccatagcttgaggctgcgaagagtttcgagacgaaggccacatgatacgcttctggagattctccaaggcgacagaggaacaaagctaagcctttaaaatcgaatgcccatgagtatgatgaagaagggagataagagcagccttagtaaccgtaaacgtcagggtgttcatatctctgattacaaaacgacgcgttgtttggggcttaatgtacattctggaaaaatacatggtccaattagaaaagttttaacagtatatagctactaatgtaattactatagaatatctctcgaacacacggtgcgttttactgtcgtcgctcctttttgttggtctgtttccacttcagttcttctccctccggaaaagctacaaccccaatctaaaaccctaacggccatttctaccatcggagctccgaaa

SEQ ID NO: 3777 - DNA, 3000 bp, Unknown; identical to SEQ ID NO: 3768
  misc_feature (1)..( 3000): cDNA_ID_1821909_gDNA_ID_1620664_Annot_ID_48017 3000 nt of promoter + ATG

SEQ ID NO: 3778 - DNA, 3000 bp, Unknown
  misc_feature (1)..( 3000): cDNA_ID_2686789_gDNA_ID_1620664_Annot_ID_48018 3000 nt of promoter + ATG
aaaaattctctttggaacgttgtgttgtctgaaatcttcccaaaggttctatcagaagaagaaggataaaggcaagtttcaacatttttaatgttctatggacatttgtagtaatctaaagctttcttttttacttattagttcactgtttatcacagatagctttgagatattattggtctgtgtatcattgagcctagttacggcttcattaactcatgtttcggttctttatatattttaatgaaatatttaatgacatagtgagcgatgttctctgtctcttgcagcattttacatttagtactattctccaaagatttggtttcttagattttctgaaatcttttgtctaagtcttaaatacttgtcttctttggtaatgcagtttcatagaaacccaatggacaacaacaacaacaacaacacttttagttctctggataatgtcatgactaaccaaaatcctcttctcatggattttataccttcaagagaagattcaacttcattctcaacaatgcttccatggaataccatcagatcagatcctctacaaatgggtggctttgatattttcaattctatgctgactaacaaatacttatcatcttctccacggtctatcgatgttcaagataaccgcaatgttgagttcatggctcctcctcctcatcctcctccacttcatcctttggatcatttaagacactatgatgattcctcaaacaacatgtggggttttgaagcaaatagtgagtttcaggcattttcaggtgtagttggtccaagtgaaccaatgatgtctacattcggtgaagaagatttcccgtttctaatttcgaataaaagaaacaatgagctttcattgagtcttgcatcagatgtttctgatgaatgctcggagataagtctttgtgcagctacaagattagcctcagagcaagcttcttgcagcagcaaagacatttctaataacgttgttactcaaggtttctctcaacttatatttggctcaaaataccttcactctgttcaagaaatactatctcatttcgccgcatactcgctcgattattcatctcgaggaaccgagtcaggagctgctagttcagcctttacttcacgttttgagaatataactgagtttcttgatggtgattctaataactcggaggcgggtttcggatctacatttcaaaggagagcattagaagcaaagaaaacccatctcttggatcttcttcaaatggtatgtaatatattcattcactttttttgcataagttaaaaaaatggtttgatatatatgatgaagttttatgagttgatatttctcttcaggtggatgatcgatatagtcattgcgtagatgagattcatacggttatatcagcgttccatgctgcaaccgagttagatccacagttacacacccggtttgccctccaaaccgtttccttcttatacaagaacctgagagagagaatctgcaagaagataatctctatgggatctgtattggagagaggcaaagacaagactcaagaaacctctatgttccaccagcattgccttcttcagcagctgaaacgaaagaaccatcagatttggagacctcaacgaggtttgcctgagaaatctgtttcggttctacggaattggatgttccaaaacttccttcacccgtaacaatccttactcttcttaactatctactttatgatgatgacattgttaactcgattttataagcaaagttatgttttatttaatgcagttacccgaaagattcggagaaacatcttctagctatacgaagtggcttgacaagaagtcaggtaatgtctcatgtttgttttcttatgcaatgactcattgataacaagctttgttttcttatgcaatgactcattgataagatctttgttttcttatgcaatgacttattgataacatctttgctcacaatgatagcaaatatggtattcaaatgagtaatatatatcttgacatactagtcatgtctgaaaaaccggtattggttattttaagatgagattagggctaggaaaaaatcaagcttttctcttgaactacaaatgagactagattatgtattcttgaattcacaataatgttactcaagtcctaggattgtagtcgcacatatgttttgttactgaagtaagttaaagcgggcaaatgatatagagtgtgtctctttgttgtgtgtgattaaaggtatcaaactggtttataaatgcgcgggttaggctatggaagccgatgatagaagagatgtatgcggaaatgaacaagaggaagctcaataacagtcacattcaacccaacggaccaactcttcgaatgccaaaatctgttatgatgagccaagcaatgcataaataagacaacaattgtgtttaccaactttgtgataattaggcaattgctactctatgattgcccaaaacctaaaccatgtacgactatcattacgtatgttataattgtatatacaactcctttatctttgactatttcattttattatcctgtattcttatatcataattatcatcatcctcattaaacttcatgatcaccatttttacgtaaaaataaaattaagttcatgaaaatatataaaaagtatgtaaccactgaagatttattttcatatttattcaaacaaactacaaaatacaaacctaaagttttatttcaccgtttgcatttaactttttttctcttacaagtgagttttattattccaaaaactgaaatgaataatgacgaaaatctcctagcaagcgacgtcgtattttggtttgacttgagaatcttcggtcaactaataaaaacgcagcgttttcatctggtacggacacaattagaaatagaaagtaggaaaaggaagacactttgctaaaactgaggaagaaagtgtaaagacggagccttttacggcgaatggaggaagacagagccaccatg

SEQ ID NO: 3779 - DNA, 3000 bp, Unknown
  misc_feature (1)..( 3000): cDNA_ID_1821891_gDNA_ID_1620664_Annot_ID_48022 3000 nt of promoter + ATG
gcaacagggttcgttcacatgctctcgggcggatccaaagctttgtccgacccatgtctgccggagtttccatggaaaatgttcccttttccagaattcttcgccatggtcgcggcgcttcttactctgctcgcggatttcatgatcacgggatactacgagaggaaacaggagaagatgatgaaccagtccgtcgagtcgcttggtacgcaagtttcggttatgtctgacccaggtcttgaatcgggttttctgagagatcaagaagatggaggggcgttgcatatcgtggggatgcgggctcacgcggagcatcaccgtcatagcctctccatgggtgccgaaggttttgaggctctctctaagagaagtggtgtttccggtcatggacacggccacagccacggccacggggacgtaggcttggacagtggtgtgaggcacgttgttgtttctcaggtaaacgacctttttcttttcttcatatgttttttgactttgactttgtttttcgtaagctctgacttttaagttttgagttctttaatgctaataagatttatttatttcaaatgcagttgacttcattcatatacaatgtagccaagtcaattggatgaattctaataactgtacatgacttgcataagctgttttagagttgttatagtaatcaactataaagttttacaatgccaagtttagttagttgctaatcactatatagattttgttattgaaaaaaataataaaatttattttattgcttgtttaagtaattatttaatgttatcttcgtaactattatatatagtactacttcatgttcattctaccaaaacattattaatatgaaaacgaaaaaataagataattctaaaatatcatactattatttaagttttcttccaaagatacaaatgacgacttaaacgcattgtggaaacattttttttttttggtgtgtgtgtgtgtgttaatatattttgacgttatgtgacttagtcaaaccaatccgtttatataatttccttgtatagtgtcgatgcacaaaatcaattgatgatacccttatatttttgtattcagatacttgaaatgggaatagtgtcacattcaataatcataggaatatcgcttggagtatcacatagcccatgcaccatacgtcctctccttctcgctctttccttccaccaattcttcgaaggttttgccctcggtggctgcgtcgcagaggccagactaaccccgcgtggatctgccatgatggctttcttcttcgccatcactactccgatcggtgtagcggtgggaacggccattgcctcatcttacaactcttatagcgttgcagcattggtggctgaaggagtgctcgattctctctctgcggggatacttgtgtacatggcgcttgtggatttgatcgctgcggatttcttgagcaagaagatgagtgttgatttcagagttcaagttgtttcttattgctttttgtttcttggagctgggatgatgtctgctcttgcaatttgggcttgatcacttttcattattactatttgtttatgaaagtaataaatttaggcatgcctttttcttttttcttttggacagaattattataggtatgcctatcactctatttgtttcaaaataatgtttgtaatcaattctattagatattcactctttatcaatcatgttatatatttttgtagctggtaaacaaataattaatttttgaacaaaaaacaaaaacaaatacaattagtttttacaagcaagtatgcaactgaaatccaaagattttcttgacgccttttcgagcatattctaatccttcattttgatttagctcaagaaacgccataatagaaccatatatatgaactaagtgtttttaaaaagagtaggtcatgactcatgagtaatcttttccacgatctttaagatatattattcttggaaggtcgaaaactataatatttcattttctgtcgaatatatatatatatggatgacgatggttcccatgcatgatgaagaaaaagacgaaccctatatttatctgtttaattaaaattttctttgtggagataaactctctgtgaaacgcattccgccacctaatttatcatatattttcatgtgaaccaaaataattaaaatttgtttgccatatatatatttatttgttgttatctttctgagtgataaaggtgacaaacatttttgtccactgatacccaatctcttccacttcagttcccttcctttcaaattttatctcgtgcttttacagcatatcccacaattcctgtaaattatctcaaggatttggtgcataaattctattttttcgtacttttttgttggatatgtaaatcagaaccaaaaaaacttaacattgattaaactttacaatttacgtatgtcccattagaggggaactacagtttttgtaggaaaataagaaatttgcgaactaaagacactaaataatcctacttttaaaatcacaatagttagtactcaataaaaaatattgtatattgttgtgaaaaaatgtaaatagtttggagaaactgctactaataaacaaataattaagagatgtcggagatccaatttaatcataaaaataaaatgattagcacaatattgcactactgatttagatgcgatacacgtggaatctgcaacttttcaccaaccacatccgagcctacaccacgaaatttgaggatttttatttatttcccaaaaatttctctgtatttataaactaactatttcttgggacgtgaatatacacattttatattcaacggtccgtgagtgtatattgtatatactctctctcagattccctccttgtagctagcttctacctcctcctttcattcatggcgaaaaactaaaaaagacatccatctttctcaaaacatctctcttactctcttcgttttctgactgcaaccttttttcccaatg

SEQ ID NO: 3780 - DNA, 3000 bp, Unknown
  misc_feature (1)..( 3000): cDNA_ID_3071828_gDNA_ID_1620664_Annot_ID_48023 3000 nt of promoter + ATG
taaattggttgaagacccggaactcaccagcttttgccgggtttgctatagcgatctcaacacattgaaccgtgtctcttatatcgaggtagcctctcgtctgcaaagggaaaaacttcaatcaaaacctcaaatttttcgattgaaatttcatgtgaaaacagatcaagaaagtcatttacctgaccacctttaccataaactgtaagtgggtgaccaacagcagcttgcacacagaaccggttaagtgctgtaccaaacacagcatcgtaatccagtcggttacggagttcctcatgcatctctgtctcatcagtcttcactccataaacaactccttggttgagatcagtggctctaataccccaagccttgcaagtaaaagcaatgttgtgcgaatcatgaactttgctaagatgataaaaggagctagcttgcttggggtatggcaaagtgtcagttctaccgttgtgggttatggttatataaccttcctcgatgtcaatatttggagttccatactcacccatcgtcccaagttttacaagatgacactcctctccaaactcttttatagcaaagagaacgttgagagtcccaatcacattgttgtgctgtgtataaactgctctggaccggtcaatcatcgagtaaggagcggatctctgttccccaaagtggacaactgaatccggctcaaaagacttgaaagactcagctaagaattcgaaatcacagatatcaccaacgtacaactcaattgatttccctgtcaaagccttccatcggctgattcggtcatgaatggaggcaataggagtcaatgactcaagtccaagctggtggtcgaaaagacgtcttacaaggttgtcaacaatgcaaacttcgtaattcttcttggacaagtggagagcagtagcccaaccgcaataaccatctccaccaatgaccataacacgctttggtttagaggatgagttattggtagatgtttcgggtggtgcttgttgggttataggtacagcagttgctctgaaaacgcagctttttctcggtttcttctcttggaagagaagtcctttgagagaagatcttgaaagaagctgagcattgaagaaggtctgccctgaaacaaacggcttaactgaattcttgctgctgctgctgctaagtgagataactgaagggcatgaagctgaaagtagatgcgccattttaaaggtttgttcttgattctatcaaacaaattcacctgcaaaaacaaaagcagctaagatttcaagacataatttggttcagcagaacaagacatatcaagtagatgtttcataccatataacaagtaaggattcagctgattttctctagtttaacttcaaattcaaatcaaaatccaaaaagacatgaatagaaatcgaaactttatcttcacacccccccccctaaatcagctacgtccataacaagagaagaatcaaaacacacgaaatttgaagtcttttatcgaatctgaaaatcagctattgtcaaagactggatatttatttgatcaactaaagtaaatgtaagaaagaagtacattgatgaaattcagagaaaacccaactgaatgaaaactctgtgaattttgatttcctatcatattcagagtttcttcaaaacgaaatcactcaacttacaaaaccggagaaatgaaattcattagaagaaacgattgcttacctttgaaaatttggaatcttgtttagagagagttggagaagatccttcgagactttgaactttgaagtgagggatgggtctctcttctcttctcccggaacgatgagagatgagatgagacagatataaatcatcagatatgcccaaagcatattcttacttattcccttcccaacaaattatggcccaaagtgtcgcttttttaagaacgttggtttattagttttaaagttttccggttgtgaatgatacaggtccggcctttgtgggccagtttctcagtcgctcatttaggcaacttaaggaacattcttcccttactgggccggttggcccaaatatatactttttgaatatgtttgtggctattttctaaattttaacttttaattattaaaacagagaatcatgagataggagaaaaacaaaatcaactgtaaaatgcaaacctaacttacataatcttttgaatgaaattttattaagacgcaaaacattactagtatttcgcattgtaatagtcatttttctgcaagttgaccaaacaagagtcatacttctgatgcaagatacgaacaaagacttcaattataacaaaacattctcatacatctcatctctaattctatatttgttttctcgtagttattatcttccaaactttaatattcttgtcaatgagggtactagatgaaaatgacgacattctatggtcatttgattcccgtgaacctcatgtgaccttgttaacgtacgtgcacgcacacacaaaccctcgcactgattgacattctcccaatctttctttataaaacacacagacaactccataatattaataacccatatatacttagcttgctggtttccttggcaataatttatataattctacaagtttaatcgcctaatcggatttagtaaatgtctctcttacaggtctgaaacttcttccacttcatctatttaatgttattttgcttcttcaatcctgtttcctcacataattttgcctcataatgttttcaggatttttggcagtttcttcgaccattatcatctggtttgacaggtattgtcacttcaaatctcaaagcaattacttcatttcgctcttaaacacacttaaatgcaaattttgagattttcttagcaaagttaactcaatttatttttgcatgtaacaaaacagagtcgttcacaactagctgtgactcgggcgactcagacccgtgccgagatgacgcagctgctcttaccctcaagttcgcagctatg

SEQ ID NO: 3781 - DNA, 3000 bp, Unknown; identical to SEQ ID NO: 3775
  misc_feature (1)..( 3000): cDNA_ID_1821883_gDNA_ID_1620664_Annot_ID_48024 3000 nt of promoter + ATG

SEQ ID NO: 3782 - DNA, 3000 bp, Unknown; identical to SEQ ID NO: 3774
  misc_feature (1)..( 3000): cDNA_ID_1821880_gDNA_ID_1620664_Annot_ID_48026 3000 nt of promoter + ATG

SEQ ID NO: 3783 - DNA, 3000 bp, Unknown; identical to SEQ ID NO: 3772
  misc_feature (1)..( 3000): cDNA_ID_1821876_gDNA_ID_1620664_Annot_ID_48028 3000 nt of promoter + ATG

SEQ ID NO: 3784 - DNA, 774 bp, Unknown
  misc_feature (1)..( 774): cDNA_ID_1821991_gDNA_ID_1620665_Annot_ID_48030 3000 nt of promoter + ATG
gaattcataattggatttgctcatagtttagtgagttcttctatatagattacacaataatgattgtattatccgtgtttaccaatataattttagtgaaaaatgcaatgtaaagttttactgagaaatgagaagaattgagtcaccaagctgatggtacatactacataagatagactactaagaattttacattgaccagtagaaatcttcaaatctctataaagtggcccaaaataaaaacgatttaaaattgcataaacgatgttgttgtttaagccttcaacattggcaaatgatggcaatctcagaaaaaggagtcatggcaatctcagaaaaaggagtcatggcaacgaaaattgacaaaaacggcgtcgtattgagggttaaaagttgaagtccctaaaccgtcatcgtattggaactacgctgagggggaaataagctttcgcgaagcttcgagagttaaggcgacatttcactgagttttctctacgcgacgtagatctgtgtctccggtaactttctcttcattttttctttctctgttggattattttacttttttttttggctttgttacggaacctgctcatgatttgacctagtgaactcttagtaacgttttagggttttaactttttttcttggatgaatgatgctgggtccttctttatgttagagttgttctttgtttaaagaagttatcaacgtcagtttgctttagtttataaagcttctcgttcgacgatttttcctctgcaactagaaatg

SEQ ID NO: 3785 - DNA, 3000 bp, Unknown
  misc_feature (1)..( 3000): cDNA_ID_1821987_gDNA_ID_1620665_Annot_ID_48032 3000 nt of promoter + ATG
gacggtgggcttgtttgcagaaacggacggaggtgaagcttcaggatctgccgtacgtgcttggagcttgttgtgtgttgcataacatttgtgagatgaggaaggaggagatgttgccggagttgaagtttgaggtttttgatgatgtggcggtgccggagaataatatccgatctgctagtgcggttaatacgagggatcatatctctcacaatctcttgcatcgtggacttgccgggacaagaactctataggctctgtttttcaccttttcttattttgaaactgattttttattgcaaattctttttccaaattaggaataaaaacattttagggattggttggatacagaaagaatagttgaattgagagtagaagtggctgatgatattgtttgtgttacttattagcattgtgtaatctttagttcatgtattttctatacaaattgaatctgaaacctcttaagtataagcttcttctctttcgatttttcacaaaattggtcgactagaaaaagaagaagcaattccacttttattacaagctcaggctcagacagaagtacaagtgtacaaccatgaataaatggaagttgtacttaatctgtttcgtttgcaggatcttccttatctattgatgtgttgagctctttgagaaggaatgcaaatttggaagcatgttttcctttgtcattcattatttgtgggctaaatgatacaaagaggaaagccatatgaacatgttatttactgtcacatggcgcacacagaggaaaagccatatgaaatacaacatttgaatatgaaacttgttggaacttttttgacaaaacttttccggtgactttccggccaaattccggccaaacggctgaacggaattgtagggtcattagtgcattggaaagttagtaaagagtactacaaaatggtatacacatacgtcaaaaatgaagttgtattgaatgagaaataaaggtgtaaagtgggacacttgggccaaaccggaccgaaccgaaccaggctgcgggttgtcgggacgtcccgtcgtcggctcaagggctttcagacttgcgaaccgtcatacttgtgagttattgagtttgctgagttgaatcttatggaaatattctcaggatggtctcaaaatattctcaagatagtttcaaaatatgtcatgtttatcctgagaatgttctgcaaaatcttatctacttctactatataaagagattcaacctctcattatttctaaaactctcaaacacaaaacagtctaaattctaaaatctctcctctctcttgctttttaaaagtaatttcttagtttactttcacataaacatagtcatgattccattgatttaaaacttaaaagtttctaatcatgtttttttttacaaacgtgaatgtggattaaatgagatttcaatggaaagaaaacaaagaattggagatgcaaatttccttaaaagccattaagcttactttgtgattgtgattatccaagtatataatttaattcataaacagtaacaataatcttcattcatcaatcgtcgcagcttatttccttaaaaagccaatataagctacttttcaagccggcttgactcatacatattaccagattaccccaacagtcaccatgaggggacgaatctcctctggggttaaccaatgggtactatcgtaatttcacaatcaccaataccattgccgatcaaaaacagcaagcaacgaacgcgcggttcgtctcgatcccgtcctctcatggctgttgtcgttgcagagacgtcgttgattttcgatttcgatttcaagcttttcacgtactcattggaacgatccaatctcaaaagtctctgattttgggagagagcttcgttaaactcagcgcgaattgtaatttcccttttgccgcgattttggattacaaggtacgaggtttttgatttctcatcttcaatgattgaagtttgatctgggttctagaattctaattctgtgtgttgccctttgttttattcggcttattgaagatgcttgacttcgttttatgaagttcgtatcttttttgattcagttctcttctagggttttcttgtgttagagctctgaattttggtaatttttttggtaatgaagtttgattatggtggaaacacgaattttcaggagaagggttagttcaattttatacttttgcttggaaaagtaatatgtttgaagttggacatttagtttcataattagtcggcaatgcagataagctgtgaagaagacatttaaaggaattatctttcgttcttttcgaattgaatatggtgttggggttggtttaggtattttgtttggattggtgattcttcaacacatttcacctggatcttagttagagaaagaaaggacagttccatgttagacttgtttgtgtagttcagttgccacttgactagaacttctccttttttttgtacattagctaaatgggtagattcattttgtttccttatttgttgaagctcttttattgggttggttagttgcttcgttttagatgaaaattatatgcggtgttatatggctctgagcatgtttccggaagttgctggcttaatgaagcaaatacatgcgaagattatgtgaagaacctaaagtactctgaaaccaaatttatacttatattctagtgtttctatttatgtatagattttaaaatttttatgtttttttttggttttaagacttggttagtgcaaatggaatggttcattatcttggttgtttttatgtatactcttgtttctattgcaatgtcattctcgtggtcaatgtttgttgctaaggttttgattccatttgtcacttttgcaggtgaaataatttgacagctgaggatttaagcatttatgtgctgcaactctgcaagcttgtcatgtaccactgtttgtatattgtttataaataaaacagtggacttaaagttaaggga

SEQ ID NO: 3786 - DNA, 3000 bp, Unknown
  misc_feature (1)..( 3000): cDNA_ID_1821983_gDNA_ID_1620665_Annot_ID_48033 3000 nt of promoter + ATG
aaagaacgaagaatcactgaattaaccggtttgtttccggttaaaatgtggattaaaacttttcggtcaaagaaaaccgggaaaaagaagtagtaaatgggaaagtctctaagtcgttggtcaacgtcgtgaacatgtgcttgactaatattaattaatggctgttttatttccaaattccaatttctggctgaaaagtacatgaattatgcttaaaactgtgttttacttaatatataatgacgaggaaacaacaaaaaggaagaagcgaagaacgaagtagacgaagacgatgaagaaaggtggattcagcaataatctcaagctcgcaattcctgttgctggcgagcaatccatcaccaaattcctgtatgtttctcgatctctctttctccatggatctgtggatagatagatgtatttgtgtgtggaaatgtctctggttttgtttttgaaggaggaaaggttttggttctctctgtaggactcaaagcggtacgtttaaggatggagatctacgtgttaacaaggatggagttcgaatcatttctcaattggagcctgaagtcgtaagtctttcctcttcctcgttcggtgctgattttactgaatttcgcgagtgttaggtttgattgtttatttgtactgcatatgaagattttgttgagtttgaatgcattaactgtaatgtggttggtggatctgatcataattagaaccttcttaagatcatttctgtagttctggatagagaaactcagggattaagctcatatcttctagattactgtttgtaatctgtttcgtttgcgactgtgtttcagctgtctccaattaagccagctgatgatcagctgagcttgtcggatttggatatggttaaagtcattggcaaaggaagtagtggtgttgttcagctggttcaacacaaatggactggccaatttttcgccttgaaggtactcattggttaaccttcagattcttttatgtatatgatgagctaaattcctcatcttttctctgtgtttgaagatttacaaatctttttcttccttgccttgtcactcactgtgcataactctgatgctatatgattaggtcattcaactaaatattgatgaagcaattcgcaaggcaattgcacaagagctcaaaataaatcaatcgtcacagtgtccaaatcttgttacctcgtaccagtcattttatgacaatggcgcaatctcactaatcttggagtacatggacggaggatctctagcagactttctcaagtcagttaaagccatccctgactcctatctttctgccatctttagacaagtaagaaacacaggatacacaggaaactatacgcttcactgttaattggttgattgatgtgatttattggttctgttattgcaggtgcttcaaggattaatctatcttcatcacgataggcatatcatccatcgtgacttgaaaccatccaatctgttgatcaaccacagaggagaagtcaaaataactgactttggtgtgagtaccgttatgacaaacaccgcaggtttagcaaacacatttgtggggacttacaattatatgtctgtaagtatcttatttgtctcttgagcattgactagtttgaaacccctttcgagtgttataaaaattgagaatcttaatttttcctttttacagccagagagaatcgttggaaacaagtacggaaataaaagtgatatatggagcttgggtttagtagtactcgaatgtgcaacaggaaagttcccttatgcacctccgaatcaagaggaaacatggaccagtgttttcgagttgatggaagccattgttgaccaaccgccacccgctcttccttcaggaaatttctcccctgagttatcttcattcatctccacatggtaatctctcaaaaaattcctgctccctcttttactgagattactttactaagttaacatattccactctacactctcatccagtttgcagaaggatccaaacagtcgaagctctgcaaaggaactgatggtttgttttatataatcccttttgcatgtttttcatccattgaaatgttgaatcatactctgtgtcaaacaatttcaggaacatcctttcttgaacaaatacgactactcggggatcaatctcgcgtcctacttcacagatgcaggatcgccacttgcaacacttgggaacctgtctggtacgttctccgtgtaaactacaagggagacataatatcaccatctggttcctgttatcatctgaagatttcttgttttaccttccagtgataaaatgatctttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgattatg

SEQ ID NO: 3787 - DNA, 3000 bp, Unknown
  misc_feature (1)..( 3000): cDNA_ID_1807640_gDNA_ID_1620665_Annot_ID_48034 3000 nt of promoter + ATG
aacgatactcagcaattccatatagtacccaagcattgttatatagatcaggagaagcattactcgcaactaagaagtgaaattcaatgaagcaatcgaattctttcaccacaaaacaacccaaaatccttcaaaaccctaaaattggaggcaatctcattgagtcaattaccttaggttcaaattgcattccccaaacctcagaaggaggagcttccaaaacagcaatcgtagcattagtatcaacatcaaacacacggacaaagctatcaatcgaagaagatgctgcaataatcccagaaggatgcgcagccaaagctgctactcccaaagagtgtccagtattagtccgcacaagatccagctcgtccggtcgccataacttcaccgtctcgtcaagagatccagtcagaagcaacgccggtcgatcttccgtcgccggaacccacgtcgctgcccaaacggaatcttcgtgagcgttctcgatcgatttcagacctgcgagtttcattctctttttaggtttttactgtgtttcctcaagtgagcaagaagaagcaaaagacccaaatttgaaacagagactttgattctcgttttttagttataaaatagaaactcgcgtcgtttttagtagttggaaacaatagagtgtttaacatcgttccgtattcttgtttactactaaaggcccattaatatcgtaacaggcccattaatatcttcttcctcactctcccgccgtcgtcagctaattgcggagaagtactctctggagccgccacgtctcagtgatccgactacgacacctttcttcactcttcttcttgcgtcttctctgctctcgtggtctctctgttatttaattttaatcgattgagatcgcttttagctctcgtctttgaattttacgggcagaaaatgggtgaagaagctcgagcgttagatatggaggagatcagtgacaacacgacgagacgaaacgatgtcgttcatgacttgatggttgatttatacccgcttagcagctactacttcggttcaaaagaagctcttcgcgtcaaggacgagattatctctgatcgagtcatcagattgaaatccaagtaaatcgagttttgatgtgatttagatcatctggtttttttcttattgttttaatctatagctaaagtttcttttttgtttcttttgaagttatgctgctcatggattgagaacttgcgttgaagctgttcttctggtaattttatagttggtagccaaattagggattttgaaaagttttacagggaaaattggtttgaaaggattgattaaaatctaatgttgggacacatcaggttgagttgttcaagcatcctcatgttttgcttcttcaatatagaaactccattttcaagcttcctggtggtcgtttgagacctggagaatcaggtttagtatgctgtttccttgcatctttatgcataaatatcgctgtctcaattctaaacgctaaagtcatgtttctccttaatcttctagatattgaaggtctaaaacggaaactagcatcaaagctatcggttaacgaaaatgtgggtgtttcgggttatgaggtaggaactatggcttcttgttaaagtgcttttgtatctgattgtttctggcttaagaatggtctctctaattacaacattgttgtaggtaggagaatgtattgggatgtggtggagacccaactttgagacattgatgtatcctttcttgccacctaatattaaacacccaaaggttggttagttagtttcactttcattgtaagaaaaagttgagacttttgaagatttgcgcttatactaaaagctctgctctatcctcatcttttgtgtaggaatgcacaaagctttttcttgtgagattaccggtacatcaacagtttgttgtgcctaagaacttcaaactcctcgctgttccattgtgtcaactccatgaaaatgaaaaggtatgtactatcttacttgcattgcccttaactcatcgtgaacttttaatcgatgttcctggtaaaactaacagggtcagtcaatcaagctgtatttaattatgtgttgtgatgtttcatttatgcgttgcagacttatgggccgatcatgtcgcaaattcctaagcttctttcgaaattctccttcaacatgatggagatatgaacgaacctcatgatcattgcctctagtagctcttgccccccgcaatttgtgataggattatgtttggggaaatcgtttgtggagcctctctgagtctgtgactatataatgtatatagggcttataatatatagacaatgttgaagaatagcatgttcttgttggttatagagactagacatgaagtatactgatagatagattaatcaattcgaaacaatttttctttgtgtgataatttcgatgtgtaattgaatgtatacatgagtaaaacaaatataggggtgtatgcttatttgtatattccttgttgaagaaaaccttgttatcttcaaacatgaaaccgagaaacataagtaaagattttactgtttgttatatgtgtttattgtatttgatcaaacaatatttgaaatattgaaaactttctataaatatcaaacgttagtttggcattctgcgttagcgttttgttgtagtggtgattttgggagtgtttaaaaaccaaaagctaaagaacgaagaatcactgaattaaccggtttgtttccggttaaaatgtggattaaaacttttcggtcaaagaaaaccgggaaaaagaagtagtaaatgggaaagtctctaagtcgttggtcaacgtcgtgaacatgtgcttgactaatattaattaatggctgttttatttccaaattccaatttctggctgaaaagtacatgaattatgcttaaaactgtgttttacttaatatataatgacgaggaaacaacaaaaaggaagaagcgaagaacgaagtagacgaagacgatg

SEQ ID NO: 3788 - DNA, 3000 bp, Unknown
  misc_feature (1)..( 3000): cDNA_ID_3092376_gDNA_ID_1620665_Annot_ID_48036 3000 nt of promoter + ATG
cgaaacagattacaaacagtaatctagaagatatgagcttaatccctgagtttctctatccagaactacagaaatgatcttaagaaggttctaattatgatcagatccaccaaccacattacagttaatgcattcaaactcaacaaaatcttcatatgcagtacaaataaacaatcaaacctaacactcgcgaaattcagtaaaatcagcaccgaacgaggaagaggaaagacttacgacttcaggctccaattgagaaatgattcgaactccatccttgttaacacgtagatctccatccttaaacgtaccgctttgagtcctacagagagaaccaaaacctttcctccttcaaaaacaaaaccagagacatttccacacacaaatacatctatctatccacagatccatggagaaagagagatcgagaaacatacaggaatttggtgatggattgctcgccagcaacaggaattgcgagcttgagattattgctgaatccacctttcttcatcgtcttcgtctacttcgttcttcgcttcttcctttttgttgtttcctcgtcattatatattaagtaaaacacagttttaagcataattcatgtacttttcagccagaaattggaatttggaaataaaacagccattaattaatattagtcaagcacatgttcacgacgttgaccaacgacttagagactttcccatttactacttctttttcccggttttctttgaccgaaaagttttaatccacattttaaccggaaacaaaccggttaattcagtgattcttcgttctttagcttttggtttttaaacactcccaaaatcaccactacaacaaaacgctaacgcagaatgccaaactaacgtttgatatttatagaaagttttcaatatttcaaatattgtttgatcaaatacaataaacacatataacaaacagtaaaatctttacttatgtttctcggtttcatgtttgaagataacaaggttttcttcaacaaggaatatacaaataagcatacacccctatatttgttttactcatgtatacattcaattacacatcgaaattatcacacaaagaaaaattgtttcgaattgattaatctatctatcagtatacttcatgtctagtctctataaccaacaagaacatgctattcttcaacattgtctatatattataagccctatatacattatatagtcacagactcagagaggctccacaaacgatttccccaaacataatcctatcacaaattgcggggggcaagagctactagaggcaatgatcatgaggttcgttcatatctccatcatgttgaaggagaatttcgaaagaagcttaggaatttgcgacatgatcggcccataagtctgcaacgcataaatgaaacatcacaacacataattaaatacagcttgattgactgaccctgttagttttaccaggaacatcgattaaaagttcacgatgagttaagggcaatgcaagtaagatagtacataccttttcattttcatggagttgacacaatggaacagcgaggagtttgaagttcttaggcacaacaaactgttgatgtaccggtaatctcacaagaaaaagctttgtgcattcctacacaaaagatgaggatagagcagagcttttagtataagcgcaaatcttcaaaagtctcaactttttcttacaatgaaagtgaaactaactaaccaacctttgggtgtttaatattaggtggcaagaaaggatacatcaatgtctcaaagttgggtctccaccacatcccaatacattctcctacctacaacaatgttgtaattagagagaccattcttaagccagaaacaatcagatacaaaagcactttaacaagaagccatagttcctacctcataacccgaaacacccacattttcgttaaccgatagctttgatgctagtttccgttttagaccttcaatatctagaagattaaggagaaacatgactttagcgtttagaattgagacagcgatatttatgcataaagatgcaaggaaacagcatactaaacctgattctccaggtctcaaacgaccaccaggaagcttgaaaatggagtttctatattgaagaagcaaaacatgaggatgcttgaacaactcaacctgatgtgtcccaacattagattttaatcaatcctttcaaaccaattttccctgtaaaacttttcaaaatccctaatttggctaccaactataaaattaccagaagaacagcttcaacgcaagttctcaatccatgagcagcataacttcaaaagaaacaaaaaagaaactttagctatagattaaaacaataagaaaaaaaccagatgatctaaatcacatcaaaactcgatttacttggatttcaatctgatgactcgatcagagataatctcgtccttgacgcgaagagcttcttttgaaccgaagtagtagctgctaagcgggtataaatcaaccatcaagtcatgaacgacatcgtttcgtctcgtcgtgttgtcactgatctcctccatatctaacgctcgagcttcttcacccattttctgcccgtaaaattcaaagacgagagctaaaagcgatctcaatcgattaaaattaaataacagagagaccacgagagcagagaagacgcaagaagaagagtgaagaaaggtgtcgtagtcggatcactgagacgtggcggctccagagagtacttctccgcaattagctgacgacggcgggagagtgaggaagaagatattaatgggcctgttacgatattaatgggcctttagtagtaaacaagaatacggaacgatgttaaacactctattgtttccaactactaaaaacgacgcgagtttctattttataactaaaaaacgagaatcaaagtctctgtttcaaatttgggtcttttgcttcttcttgctcacttgaggaaacacagtaaaaacctaaaaagaga

SEQ ID NO: 3789 - DNA, 3000 bp, Unknown
  misc_feature (1)..( 3000): cDNA_ID_1821963_gDNA_ID_1620665_Annot_ID_48042 3000 nt of promoter + ATG
taacttttttctaaaacggcacaatgtgcaaatgtattcatatagcggataacaatatccaagtttccaaacaaaccaactctgaaactgtttcactcacataataagagaacgaagagctaattgctgaagaatccgacgaaaatggctccgagatcagattcacaaaccctagccaccggctccgacgaaaatgaatcctcaatcgatccgatcttccacattctccgtatcatccctttctccttcctccgaccaccacgtcttcgtctcaagctcccttccttcactctcccatctccaatgactgtcttctcactgattctcctcacttacttcctcgtcgtctccggtttcgtctacgacgtgattgtcgagcctccaggtatcggatcgacacaggatccaatcaccgggtcagtaagacccgtcgtgtttatgtcgggtcgggtcaatggtcaatacatcattgaaggtctttcttccggattcatgttcgtactcggtgggattggaatcataatgttggatctggcattggataagaatcgagctaagagtgttaaagcatcttatgcaacagctggagtctcctccattgtgattgcttatgttatgagtatgctcttcattcgcattaagatccctggttatctccgttagagggttagatcacttttggcttcaattctgtaattggatctttagtataagatcgatcattagaaaaaatgtgactttttgttttgtttgtttgctaaagcttatgtgtttcttgtttgataatgagaatttagctttgaatgttagtatctgcacttgcattattgttgaattttgcgttgaagaagataatgggaaattttctgtaacagttatatgacaacacaaacaataaagtagagatttttgaagtttggtttgttggatcgctttgttgcttcaggtgttgttgactaaggcttggaagttgaggtctgcaataatattgcagatgcagatttctaatttcacaaagaagttccaacacagaaatgctatatgtaaaagaaatatcggtcaaaattgttatttatgattttaattacatgatttacaataagaagtaatgaaatctgaatgctgtgtatttacatactttatacatttagtgatgaatttaagtaaatgattgatagattcaaaattgtgtttgctgtgtgcattgttcttatctgctgaaataggttcttggggagaagagacgtcgaggtgagcacgtcacaggaaacttggtggaagttaggatatcaatgggacggtactcaggcatgatgagcccttctcgctcttccctggtccaaacccttgatctgccattgaatgtcccgtacttgactagtttacggaaaccccatgtcttcttctttgctgcggtgttcaccagtttaccattcatcttttggctcagatactctcgcaccgcatgcaagctctgttccacaacctcaatgggtggggagacgagtgggtttccttccgcgctcagttttcgtaggcgcctcatgcatccaatagactcaggcaacactgttatcttgttgtagctaatatccagttcgaggaggttcaggagaagaccgatagaagatggaagagcagaaagatactggaagttctgactgacattgaggatttcgaggttgatgaggttctcgaggtcctcagggaggatcataaggcaattgagacgagcatcgaggacacgcagggaagtgaggcaggtgatggtggctggtaggctaatgagcttgtttgagttgacacagagctttttcagattggttagttctaagcctatgttgtctggtaatctaatcagctcgttgaagttggcgtttagttcttcgagtgacctggaaaatccaaaacaaaagaaaacagaggaatttatcagcattatcatcatatatgattggtttggtccagatttggttgaggtgtgaaacctgcaattttgaatagtttgggggagggaaacgagaaagttgccggagacattaaggatcttgagcttagaaagacaaccaatggagtttggaagagctttgatctggtttgagtgaatatccaatgctatcaagttgagtaatcttgctgttagagattctggtattttctgttacaattcatagacaaacccccaaaaagaacattagaaacgtatattctgactgtgtatgagtgtatgcatagagatatgaaccttgatatgattgttggagagatcaagcttgcaaatatttgccaaattgagggaaggatttgggagagattgtaatgccatgccactcaaattcacaacctctagtctctcttcctcgttgttattgtatgatggtgactttggcgataaggatggtgaaagtggtgatgatggtggtgatgtactcaagtccatcatcatcattgtcatcatgtgatccttttgtccatgtaattgctgatactgatatgcatcttcgcatatcatcgttttatgtgtgtttgtatggaggaaaaagatgataatggtgaaatgatgtggaatgagtgattcttgatctgcttataatggcaacacagagagattaaggaggttatgtatggacgatcaaactttagtgggaaattgaaggaaatgaatactcttcggaaattaatgatttgtaattaaggaaattataaaaggtgattagctgatgaaggagagatactcatgcgtcgccaagtttttctaaacacctgatcgaaaaatgttagagctacccgcaaatcactcataagtaaaaaaataaaataaaaaagttcccataaatttcatttcaactttgagactaattttataatcagagtctgaaatgtaacaaatcaaaatttgtggggttaaaacagaaataattaaaaatatgccacttgtaataattccaaagcaagctctggtgacacgatcatcggaacaaaatagagtacccggtgacg

SEQ ID NO: 3790 - DNA, 3000 bp, Unknown
  misc_feature (1)..( 3000): cDNA_ID_1821959_gDNA_ID_1620665_Annot_ID_48043 3000 nt of promoter + ATG
aatctttgctttgtagctattttctcgatatatttcaacataaaatcataaaaggaaaaatgacggcgtttggaatcaccgtcctcgccgttttattgaaaatgtaagcgtgcatggtgcctaatcgcaccgacgatgccgacggtatttgattttgactcattcagcgttggccctttcttaaaactttattagtagttaattaatttgcagattcttttgaccttttagctctattttatttctatgaggaatatggtctctcatggaaaattggaaattgtaaatattccttgttgttgctgatcatcaacagttgatgtaaggtgaatctagaagtataatagtatgaaccaatgtaagaatcgtatactgtataattaactttaaaatactcacatggatactggatagggtctgttctacgttgctccacatgaaataatacactattattgtgaaaaatagatatccaaacaaaagttttgttgaatagatgactacgttaaaatttacagtttgttgttccactattaacaaatgaaaaatatatatgctttgttgctcaaagttcaatatatatcaaattttattactagataatactataatccgcgaataacagttcaaactttagactatagacgtctagacctaacaattgtcgtacactcgtattatttagttgaagaaataaaaaacgtattacttttaaacgaattaaaaaaatcatgattaagtcataaactattgaacataatatagtctccattaatctatattatctaatactcccgtgatcggtcaatgatgtatgcagaattcagaacattagtacgtcacaaagtataaaatgacggtctttaatttacttgttcaagcttttcctccattgtttattttcaacatgattacatgaaagtgttgtttacttctcttaataaccaacttattcaaactgcattttaatctataaatatgactatatgagtgtgttaaaacacctcagaatatcagcaaaacgcttatcagctgaccttgatttattagttttttttttatgtttcacgaaatattagttaatcataattccaagaatgcttgaatgtctatataacctaacctaccattatgttcttaccatgatttaaattatcttctcaagttccattttcgtgaagaatatatgaaagtcaaatattatttgctgaaccttttttttttccttgtagcgtgcaggatagggattttggaaactatggtctaaagctagagtctacaatgtcaaggtaaaatattataaatttaacattccatcatgtcatactaaaaaggaaaaacaaaaaagtccagtatgtgtcattttagccacacaaacaacagcaagtgcgtcgaataaccatcaaataaatgatctacacataagaaaagatagaacaaaataaataacggagaatgaaaactgaatattttttgatattttattttcataactgaaagtatttatcttgaaatttttaaaacgactttacaaaagctcaagcaacaataatccgaacagaatttttgtttgtaaaatgctataatcatgcttttctttctattcaactttttatcagttaaaaggcagtagaccaatatattcaagtcttaaataattttagaaacagcgtgtttcatacatttgtatttttggtactttttagctaacatattgacttttatacaaatcttttttatactgaagatatttatttgaatattttatttagttacttattttagagagcgtattgactactgactatttagacaattttgacgttcgcatacggaacatttttgaaacgtaaatagctatcctcaatgtcacttgaagatgtgatagtggttaatttagccgatattaatgtagcatcacataattttgagttgcaagagtctggtgaaccaaatttttgtaaagagattactgtttgaagacatgttaacttacctaaaatttatattctttctacttttaaccctgaaaccgaaatcggacaataaacttcataatttcatagttctggaaaattatttaatagtaagcatttagtttgattgatgtagtaatttgtcattttttaaagtactaaatcttttatttgttttgaaaaagtttttaaattttaaatagtatcacgaggaagcccccgagtgacgactgacgagtcaaagctccttcgaggaagtttcctatagagctctctctctatctcctctcgttcctcctctattttctcgagaaagtgacggaaaataattcagcagccagagagtatcaaagggaaagagctgagaaaatcctctgttccgccgataattgaggtagatgattatattatatttcttttttttcgattcaacagtaactatagaaaatttgttgtttctggaatcgccagagattttttttttctctttttttttcctctttgtttacctttttgcttctgctactttgtgtttgtttattcgaatctctcctgcgctttcgcacgatttacgatgttaccctacacgattgttgttggaccacttcctacacctaaaactaatatttcactgagctagattcttcttcttcttcttcttcttcttcttcgttttgaattttgaaatttccgggaaatttttcggtatctattcgtttcagtgtatctatcggaaaacggattttcgaaggttgtttggttttaggtggcataatttggcgaggagtggtaattactgcttcgtaacagtgaaatgtgagacttgttcataagagatttgtctcgaatcgtatttggatttatttggtagtgacttttgaattggactgagattggttttagagaggaagaagagaatgctcaaggctatgtactgtttctgattgggatgcgttttttgttctcttttgtatgtgtttagcttaaagaagagcgtgttgctatctctcctgcgacagtcatg

SEQ ID NO: 3791 - DNA, 3000 bp, Unknown
  misc_feature (1)..( 3000): cDNA_ID_1821951_gDNA_ID_1620665_Annot_ID_48045 3000 nt of promoter + ATG
tacaacgaatatgcaactatatgtcgagaaccactcatgtgtttatataatctcatgtacacaggtattaccgtattgtattgtgtattgaaaattcaaaatactttaaaacatgattagataatttggtacgtgaggtacagccttttgcatgggagatggagcagacataatgattatgagatacgtagacatgttgtgttaaaatgaattgattactgatataaaaaaagttggcaataattcgagtaccatgaatgatcaaaagtctgtggaaacttaactgcgtcacacaataaagcttaaaattctacataacatgcaatgttttttttcatcctgacactaatcgcgcgccagtgaggaccaccaatcttttctattagcattagatattggattattgtatgccttaaataatatttacgataaaatagcatatatatttgttaaaaaagtctcttccaaatccaaaattagatgaatcattagggttttaaatctgtgaactcaatgtatggaaccgagaataacattacttagggttccaattttagggtattatcagtaattcgacacaatgattttgcaattttataggttttcaatcacggattcacagaatcgcaatgtccaactcaatcaacctccgacgtcgtgaataaaattgtaaaagtacaagtcccatatttccgataaaagtacacttcttgattcacgagctataactttgagtctttgaccgagaaaatcttaagcgaaaattctcaaagtggccatactcaaacgtttcaactatataaaaccaaactgaatgttgtaagattctattatggatgaatatttgtttgtatttttgtattcttttccgtcaattatgtattattttataagatctaaatataatcacaccaaaagaaaaaaaaagataagaatatattaaaactcttgttactaaaatgcaataacttcgttaattattatttttatttttttgaaaagaggacgggcgttctaaatattttgttaaatgtacagtttcctccaatttgtaattgatgataatttttgctcaactcatatatataccacatatgtatcttacgtgtctagggcgagagagataatagtgctttgaaaattgaaagacgggagacaggttgttgcttttttagaagacttgaagaatgaaattctgtctctcttcaaaaatcagtctcaaagacagtgacaccacctcaatttttatataatttctgttattatatatattgtaaatataatttcacgtttctttattagtaacttttgctttcctttgtggttacgctctttgagttctgtagttctaggaagatcgagatttgagagagactaaacaaaaagattaaatatgactctttcctttatatgatactattccctacataaaagaaaatttcgtataattaagagataatgtcgttggatagctcatttaatttggttgagcataatattagtggaaaattttgatagttctctttctcaaatttaactttgtgatgactccttatattactaaactttaattaaaatattaaaaagaataaagacggattcaactgccgaatctcctcattatgagaaagcactatttccgttcctaatatttcatgtggtcacatagattgattgaacacatacaattatcaaatatatatatagatggtgtaaatcggcccgcatgtttttagtacacctaaatatctctactcatacatatatctattagtggtagatttgaaagttgtattttaggagcggaaatacagtgctttctcataatgaggaagatctggcaattgaatctttggtccatattttttattttattttatttttttgtattttaaactaaaacatctctaacacaaatatatcaagttaatgatatggacatgtttgattgatctacaacacatatatatgactacagatgtataggaccagtcatgtcctagatcaattaaacatgccctcatttgtattcaattggttaaccgcaagtttatctgttgcatcacaagaccttcgtatttaaacatgccctcattccaatctatgtgtagagtgagattgacaagagctgagtttgaagcagacgcaaagatgctaatggttattatttacacactggtttaatgccttcatatacattataatcctatgatcactacacatgatcaaactaataactgatggaaaaaatttaagagatatgagtcaccaacttcctcaagaaagcaaatatagatgtgtggatattgttgaagtttacctttccatgtaatgctaagtatcttactgttttatggtaaagccaaaaataaatttattttcaattaacggaggcaaaaaactttgccctaaattctatcatattttagtgtagtgtctatggtatttgtataaataaaaaagcataaccaaacattagaaaagaattcactgggcctcagctattattaagccggacctcaaaatttcatatgtatatgtataaagatgaaatataatatagttcgagacatttttaacttgaacctgtggagggaaacgaagcttgaaggaagtgggaaattcaaaaaagcttcagaaagctgccttactattcaaaagacgaaagcaaaaggagaatataatttattaaaaaacaaaaaccataaagaaattgatgtttaattaataaaagaaaaaacaacatcgaaagtatgaaaccaacccaacaatataaattcataacttgctctgtcctcatctcttcgatacttctctcagactaaacatatctttataaacactaagtttacttccaccattactttttcttcctttaagcttcaagaacttcaaagtcttacttaaaccttttgtttgtgggtagagaggaaatagcaaaaagagatcgatagattcttgcgaggggtttagggatttaaggtgggtggttttgtgatg

SEQ ID NO: 3792 - DNA, 3000 bp, Unknown
  misc_feature (1)..( 3000): cDNA_ID_1822736_gDNA_ID_1620665_Annot_ID_163919 3000 nt of promoter + ATG
catctatctctatctctctctactttctatttcccaagatggctcctttgctgtcacaaaccttaatacacaccggcagattccttctccgtcgcttcttagaaccacctccggcagtaatctctgctgtggctgcgagtcgcgtctgcttccatcgatactattcgtcgaagtctctttctctcgtgtctccacttggcttgcactgttcctctttattcagtcctccaggtatctgcaattgacaaattcagcttcctcttcacttcattgtacatgacttgatttagaaataaaagtctcagctagttcttgaatgtggaagcttgtgaacgattcaattctttgagagttgctagatgatttgattccactgcagatttgattttgccaattagaaaagttcttaaaggtgtgtgatttgtgacttgttgttgcagcattatgtaactcagctttctcatcttcggcaacaagtacaactatcgaagtacaatctacagagcatgaagttgtgattgctttaggaagtaacattggaaaccggatgaataatttcagagaggctttgcgattgatgaagcgtggtggcatttgtgtaaccaggcacagttgtttgtacgaaacggctccggttcatgtgactgaccaacccaggtttctcaatgctgcagtgagaggtgtcactaagcttggacctcatgagctattaagtgttctcaagactattgagagagacatgggacgtaaggatggtattaggtatggaccaagaccgcttgacttggacatattgttctatgggaagatgagaattagttctgataagctgatcataccacatgagagactctgggaaaggtcatttgtgttagcacctttggttgatttgcttggatcagctgttgataatgatacagttgctcattggcattcgctcgcgatacatcctggtggaattttccaagcgtgggagagactgggtggcgagtcactgattggacaagatggtatacaaagggttttaccaataggagataagctgtgggatttttctaacaaaactcatgtgatgggtatacttaatcttacacctgacagctttagtgatggagggaaatttcaatcaatagattctgcagtttctcgggttcgctcaatgatctctgagggtgcagatataattgatattggagcacagtccacacgcccaatggcctcaagaatttctagtcaagaagagttagatagactactaccagttttagaggctgttcgtggtatgccagagatggaggaaaagctcatatctgtggacactttcaactctgaggttgcttcagaagcaataagcaatggagctgacattctaaatgatgtatctgcgggaaccttagacccgaatatgcataaggttgttgcagaatctggggttccttatatggccatgcacatgagaggagatccatgtacaatgcagaacaaagagaatttgcagtatgatgatgtctgcaaggatgttgcttctgaactctacttgagagtaagagatgcagaactctctgggattccagcttggagggttatgatcgatccagggattgggttttccaagagcgtagatcataatctagatattattatggatcttccaaaaatccgagaagagatggctaagagaagtatagcagtttctcatgcgcctatactcgtaggaccttcaaggaaaagatttctgggagatatttgtgggcgacctgaggccactgacagagatgctgcaactgttgcttctgtcactgcaggcattctaggaggtgccaatatcatcagagttcataatgttagacataacgccgacgcagcaaaagtatgcgacgcaatgctgagaagaagaaggtcaaaaggatgattggcggatacaatcataagcctaactttaaggatctacttcagatcgatacagcagtttcgctatgtaagaacaacatgccgagggaggcaacgtttctgctttgatcttgtgtggctggtgtagaatatagcaagttcttggttatgatgggtgattgatgaaacaagctagcaaaatcgcatacacgcatgggctccaatgtattatctcttttcaaaacacagacaactgtagatgagcaatagcaatttttctttctttctcttttataaattttcctgggttaataatgttgtaaacaaaagtttttgtctttggtgatatatttttgtcatttgtttctgaatgatagatgattccacatctacaaaagagttagaagttaacatggaggtcgacatcatgcagaacaggaacgacactggaagtcaacctaaatctccttagacttatggtggcaaagaagatttattttagtattcggacaggtaaaaactctctttctatcagaaagaaatgacatttttaatattacatgcctatacagttacaagaatacggttcatcctatagattgtcatgtaatctgcttatgaatgtttcatggtgaaatcattgggaaacctgcaggcgatctgatggacacatttcgttttggatgatcatagtttctgagataggagaccaatacaggcctgattatggcaaattcctttagaaacgattttatattcgttttctgtagcggctgccccttgcaactattaaaggttttttttgcaaaattataaacaaaaggtttcctgtagaaaagaagattgtatttcttttgtttactagtcgtcaactttgcaagtataattttcaagggaccaaaccaaatcaaggattttatttgacttttgtttatatatgtattgtaactgtaattgtaattgtatatcaacccaacatgctaatactataacttagatggagttgaagcgggtacgtgtagtagctgtccttttgatcttgcctcgtctatatattgcatgagagaacattttccataagaaagtaatcaaacacatttggtgataatg

SEQ ID NO: 3793 - DNA, 3000 bp, Unknown
  misc_feature (1)..( 3000): cDNA_ID_1821939_gDNA_ID_1620665_Annot_ID_163915 3000 nt of promoter + ATG
gtcttctaatgaaataatttttcaaagctataatgatttcgattattatgttttaagactatgtgttacttacagatgttgtgacatgttcgatgggctagtttgatctaattctaccacgattagttttagttttacatgaatcggttttaaagaattttgattttgtttgccttgtcgaaaacatagcctcgttgttcactcacagatgagtttattgtgaatgacggatcaaagctattgtgattatacaaaattgtaagctttttcttatggtcatttttatatgttatatatggtgcatatacttatatacataacatagacgtattagttaattaatatgtgattggtaatggattaagtttgtaattgcttccaattagctacaaccaaaacttagattataaacaaacatgagtattgagtacacgaggagataagggatttgtggtttcataagttgcttactcctaaatgtcggatattgttatataataacttagtgtattaattccagctgtcatatataaatttgtaataaaataagtcatatgattgcgattgtaagttgtaactatagtttttcttttcttttctcgacaggtatagagttataaatattaaaatgtattttgaaatcatttaccttatcttaaacttaaaactttggactaattccttttgaaaaattaaaaaaaacttgaaaataaaaggttttaggggttttggatttgatctataatctagagtaacattttattggaggtgaaagactgaaagtgatttgtattatactgttctttttgtctatcgggaaaatggaggtgatgtagagggatccacgtgtaagatttcatgtggcgtagaagattaggatcgacgttgaaaaaaataaaatatcatacttatacgataatatagaataccaaactagtataattttcaaatgggaaaatcaatttgaggaccgactcttaccaacaactattttggctttttttagatgcatctaatttaccaatcattcacgcattgcctcaaagataatatgacttttcgtgtccacgaaaatatataattcctctaaaagaaaattatagtaagtattaatttggtcgtggtcgtcgtcttttatcgtttttacaagtaaacgtagtatattgataaagactactatttaaaggtccacacatagattcagtaattgggtcgagttttgtagactcgtgtaggatcgagtttaatagttctaaaaccagattaaggtaaactgcgattcatatggaactaatccagagaatgataagccatgttagattcatgaaacatgaattgttttgttcgtagcagttacatgcaaattgatccgcataagtcataaccacctacgacaaaaaaaaaaaaaaaaaagtcataaccacctaaaactcttaaaactcattgtctaatattaaaatagttcttatcgaataaatttttcattttagaactaaacaattaatgtaaactagactcgtcgttctgtcattactctcatcatcagtttctttttttttttgattcatattctcaatcattattgatagcaaaaaaaaaaatatataacaagaagtacgtacaatccattgttgtataattaggtcacataaaatttacaaaaagtttgtttgtctttctgtacactacacataatctcggaacgcataattctatctatattgacacgtcatgaagacgtgtcgtaaagacttacttggatatgacttctttgtaagttgcaatgaaactcgtggttaatgccgccaaatctgaaattcttggaaaattcttcgaatatacctttttaatactcatacatatatacattttctcacataacttaatccatatttgaggtttccaccgaatcgaaatgttacaaaattaacgtatccatgcaaatcaatcttttttttccctctccgtcgtcaatggaaatcaatccatcaaagaaactttaaagcatgcgacttttctctgcatgtatagattagtaaaaaaaaaattactttatgggaacgtaaaattgtcatggtcttttgaccaaaattgttttagattctatagttgcctagttggtataatatcttgagccacaaattagaaaatttactaggtagattttaagaataaaatcacaactgcttaggtaacgtaaaatcacaactgatttgtttactgatatatcaactatggttcttataaaaaaaaaactatcaactatggtaacaatgctattcttaccttggactaactaaagttattgaccaacataaaaagtgattaacgaactgatcattgagcatagtcaatatcaaatacaaacagaatgaatatgttccaaataaatatttaaagagtcgttaattaacgataattgacaaagcttgttccatggtaaatcaaacggtaataatatatagtcttcaacagtcatttttattgtataatgaaaatagtaattttattattattattaagatgtaaaaaaagaataaaaaaaagagagtatttgagctggtgatgcttcatcatcatcgtcgtcttcacactttgctccgacaggtcaccacttaagttttgcttttctcacgaaacaaacaaacttgctattttcttctctttttccagaccatgagaaagcaaaataattgagctcattctctgcaaaaaaaaccatctttaatctcttccatttggattcggagagagaataaaaacgaatagacaatttgattctctgtttctctctcacctatttttattgtgttccgatctgatcggatttaattatcaggttcattttcgatttaaatttcgattcttttttttgctggtctcaacggagaaattttccggtgacagcttaaagttttgatttttaattcttttttcacgaagaagaatttcaattttgtgaaaccgttagaagaagaagaagaaaaagattataagctt

SEQ ID NO: 3794 - DNA, 3000 bp, Unknown
  misc_feature (1)..( 3000): cDNA_ID_1821943_gDNA_ID_1620665_Annot_ID_163912 3000 nt of promoter + ATG
aactcgatcctacacgagtctacaaaactcgacccaattactgaatctatgtgtggacctttaaatagtagtctttatcaatatactacgtttacttgtaaaaacgataaaagacgacgaccacgaccaaattaatacttactataattttcttttagaggaattatatattttcgtggacacgaaaagtcatattatctttgaggcaatgcgtgaatgattggtaaattagatgcatctaaaaaaagccaaaatagttgttggtaagagtcggtcctcaaattgattttcccatttgaaaattatactagtttggtattctatattatcgtataagtatgatattttatttttttcaacgtcgatcctaatcttctacgccacatgaaatcttacacgtggatccctctacatcacctccattttcccgatagacaaaaagaacagtataatacaaatcactttcagtctttcacctccaataaaatgttactctagattatagatcaaatccaaaacccctaaaaccttttattttcaagttttttttaatttttcaaaaggaattagtccaaagttttaagtttaagataaggtaaatgatttcaaaatacattttaatatttataactctatacctgtcgagaaaagaaaagaaaaactatagttacaacttacaatcgcaatcatatgacttattttattacaaatttatatatgacagctggaattaatacactaagttattatataacaatatccgacatttaggagtaagcaacttatgaaaccacaaatcccttatctcctcgtgtactcaatactcatgtttgtttataatctaagttttggttgtagctaattggaagcaattacaaacttaatccattaccaatcacatattaattaactaatacgtctatgttatgtatataagtatatgcaccatatataacatataaaaatgaccataagaaaaagcttacaattttgtataatcacaatagctttgatccgtcattcacaataaactcatctgtgagtgaacaacgaggctatgttttcgacaaggcaaacaaaatcaaaattctttaaaaccgattcatgtaaaactaaaactaatcgtggtagaattagatcaaactagcccatcgaacatgtcacaacatctgtaagtaacacatagtcttaaaacataataatcgaaatcattatagctttgaaaaattatttcattagaagacaatcttttggcggtttgtctctatatcccatcattttgattttaagatataaaatagataacaataattttacaaagctacatgactttcatatattcttaggaccctcccatgtcaatatatttggacccttttatttttgatatggccatatcaaaaatagaataatgaacttaaccccacatgtcaatatataagatggcatttccgagtaatgcatcccattatatatatagacataaattataattttgttttcttgcaatcaacaagttcgacaccacagaatttatagtcggtgattatttcaaatttaatgtgaataacatgtgaaaaatatttatgggctagcttttgttcttatctcacttcacccatgtggtgcatgattcattgccatatcttgatctcttccttaatcatgtgaaagctattaaacattcctattttatgaatagtgacaaacaaaattagataggcaagtcgcatacaaaaaaaaaaaatgtaagaacaaaaacaattttcaactttaggttatagaatatatttaccgaccatttttacttgacgagttcggcaatcccggccgacgacagactcatttacatatggaccaaaccgacctaaatcgattctttaacaagttaaaatatccaagaaacctactcactaatcactatagctttttgccgaccacaaatactcgacccacctcttaaatttcattcatctctctggacccaacttaaatcacttttcttcaaattttatttttaataatgggcttaagttggttattcggcccaataactatattaactgggctgagtaaacaatatatacaagaagtctaattatatttcaaaaagactcgtctctattcataaagattagattcatgaatttcaattcgcgatcgaaatggaaacttatttttggctaagaatgtaaaaggaaaacttagatacaatatggaaaaatatgtctaaatacagggacttaaaatgaaaataagtaagagttgctggagcattaccattgccaaagtaaagtacctaaaacgatgaacggagagtgacgtaaacccgaccgttgaaagcactctttcaagtcgccgccggtaactctaaacccgccgtaccaatatttcagtaccctccattaaccctcatcggaaagatcttcactttgccttcatctttctcaattcctcaatccttactctcttccaggttttgctttattctgttaaaaacttaagctttctcaatttcctgttgttggcttcttccgttgaatcaaaattacgattcttgtgctcagattagttacataatctaccttaccattaatttgtttatgttttgggtcacggagcatgattgagatgtgaagagattagtgttgtgtttgtttagtgtaatgttcgatctgtttccttgttttgtctgatagtgtcgtcttcaatcacaaatctgtaatcttttgaattaaaagtcaaaacatgtctgaatttggcagtgcctttaatgtgtgtgttgtttcttaaattgtgcaagactagactcagtccttttctccgtgggatatcatttaatggggaattaagaatcattagttccagtttgttggtttggttgtgtaaatgtgaggaaactgatttaggggagggttcttgaatatttcagggtaagatcttatatgaaatgatttgctaagaggactataagtctcggtgatcggggaattcgatatg

SEQ ID NO: 3795 - DNA, 3000 bp, Unknown
  misc_feature (1)..( 3000): cDNA_ID_2050088_gDNA_ID_1620665_Annot_ID_163911 3000 nt of promoter + ATG
cacttttatatttgtcttttgttgggtactgttgaacgaatgtttctttacttccatcacaagacaaataaataactcaatacgtcgcaagtgattctttatattcctaactgtcgactagaaagaaaataaatatcatagttctttgacaaaaaaaaaagaaaatatcatagttactttactccaaaattatagcctatgactagacttgattggccatagaaaatacttacatattatgttatgatggaatttcttcagtagctattcaattcttgttaggatacgacgctatattatgatggagtttcttcattatttacatgttatattatgatagatagaacaagaaacaaaaataaaaagcttctatgtaattaattatggaaactttctttggtaatttttgtttggacgttgtaaattactttgctgttttttattttatttttttttgtatatgttgcgttttcgtttattgttgatttatatattcatctaaacgtgcttccagttttaaataaatttattttgtatttgtaaacttaaaaggccacatggaaaattttcaaaactttacataaatgactgaaattacaatttacaccatttttcttcacacacttaagaagagtcaagactaaattttggaacattcaaacgggctaaaccattaagcatctttgtctgggccgaactcaaaatatatctctgttcaatccgtgccttcagcccaacatgtgttttttcagcccaataagtttcttgcatgttttgaaataaataatgaattttagtcgaattactttctctcatatcggcatattttgttcattttgtttgatgaatgggtttaagtcgtcgaagttggttaaccgatatcgtaacgtaagattgaaccggagtttcaatactcgttacattttttcgtattctagctaacgtgaacggatgttgtttatacagctttctactacaaaagtagatttcaaaattgaactgcgattttcttcttactcttctagaaacacttcctcatatttaataagaaacgaaagaattagactccgacaatattgggaatgtttagttgtcatttggacccaatataatcaattccatacatttgcaattgcaaggtgggtgagtcatcaaaatttatgaatcttccaaagattatagatagaacagcttttaattagcctaataaacaaaaggaaatacgattatgcatacaaaataaattaaatattaagacttttaatgaattcttaaccaaaaccatatcaagtcatatcatacactatcctccatacacgtggtagcatacataagtacgttaaataattttatttagcaaataattttattataatcatctttgatcaccaagatcatgttgggccatccaagccacgactttagtaatgtgaaaacaatatcataaggaacgaaacactgttcatttcatacaattaaaatacaactttttcctacacattttctcaagagtttagtaagtgagagacgaatgatttgagaaaacagtttttacttttttcgatttgtttctcaaactcagtattttcggatttctaatccagattaaaagttctgaataaaatcacggggtatggagcaaagccgatataagtaaaaacctttccatattgatagacactagatttttttttagttcataagatagatactagatttagtttgagtataatggattaatgtggaactagttgtattgtttagtatgtgtatgttgtatgatttagtgaccgtcttcagttttcttgatgtctttccacgttttacaaattcttgaaagaactgagaactcaaatgtatgatacataaccattgaaaaaaatatttccaccatcataaatagagttttacgaatcgtttcacaacttttaattcagttgacaccattaaataatcaatatttctttagttacaattcagtagaataaaattgcatatgctatattatctaattctatgaatattttctgtctatgatatttgatttttatatactttagattttggatcacccccacattatttcgcttttcagtcacattttgtgtttaatattgctagataagtccgtggttatagcttactttgttaaaatcatatatctcaacttatttcataacagtatctaaagaagatggaattttataaatatatagacactcaaaaatcagaagaaaatatatatccacaaataatagaagaaaacatagatttactgcattcaaatcaagggacatgaaagaatatcctggacccaagtgggttatattttcaataaaatttagcaaaaaaagttgacaatcaactaatcatcaccattattggccataatcattacgtacgcatacacatagccacgatgtctacctatgtttaaatctttgaattctgaaactacgtatcttttatttttgtttaaaaaaaacctagtacgtatcttctttccttacttagacatcatcttctaactttaaggatcgaaattagaagaaaaacaaatgattaatatctacaagaacagaattttgcatttatactcagatactcttctagtacctcacaaaaataaaatgaaattggaattgaacacgccctaaattcaagtactatacggtctatacccatttgagtatatgaataatgcatattgtgagtgaaagagatagatacgatacactcttttctttgtttttcaattggacaaaaggaaacagattttgatctctgaattgaacggtcaagatcgtatataattatttcaggagattaagatcccacgtgcttaaaaactctctgtcagactctttatgtataaaatcctcggcccactcttgttttgatagtacactcaatagaaagacacaaagaaagaaagaaaggacaaacagaaataacaaaaccttccatttcaagaaagcatcatctttgtgtgtccgaaaa

SEQ ID NO: 3796 - DNA, 3000 bp, Unknown; identical to SEQ ID NO: 3790
  misc_feature (1)..( 3000): cDNA_ID_3071879_gDNA_ID_1620665_Annot_ID_163904 3000 nt of promoter + ATG

SEQ ID NO: 3797 - DNA, 3000 bp, Unknown; identical to SEQ ID NO: 3789
  misc_feature (1)..( 3000): cDNA_ID_1821963_gDNA_ID_1620665_Annot_ID_163903 3000 nt of promoter + ATG

SEQ ID NO: 3798 - DNA, 3000 bp, Unknown; identical to SEQ ID NO: 3788
  misc_feature (1)..( 3000): cDNA_ID_3092376_gDNA_ID_1620665_Annot_ID_163897 3000 nt of promoter + ATG

SEQ ID NO: 3799 - DNA, 3000 bp, Unknown
  misc_feature (1)..( 3000): cDNA_ID_1026502_gDNA_ID_1620665_Annot_ID_163896 3000 nt of promoter + ATG
atacttctgctgctctatctgcttactgcgcctccgctggaatcccatcgattgtgtttttaccggcgaacaagatctctatggctcagctggttcagccgatagctaatggtgcgtttgttttgagtattgacactgattttgatgggtgtatgaagctgattagagagataactgcggaattgccgatttatttggcgaattcgttgaatagtttgaggttagaagggcagaaaactgcagctattgagattttgcagcagtttgattggcaagttcctgattgggtgattgttcctggaggtaacctaggaaacatctatgccttttacaaagggtttaagatgtgtcaagaactgggacttgtcgataggatcccgaggatggtctgtgcacaagcagctaatgctaatcctctttacttgcactacaagtctggttggaaggacttcaagcccatgactgcaagtaccactttcgcctctgcgattcagatcggtgaccctgtctccatcgatagagctgtgtacgctctcaagaagtgcaatggtattgtagaagaagccacagaggaggagctgatggatgcgatggctcaagcggattcgacaggaatgtttatctgtcctcatacaggtgttgctctaactgctctgttcaagctgaggaatcaaggagtgattgcaccgactgatcgaactgtggtagtgagtactgctcatgggttgaagtttactcagtctaagatagattatcactccaatgccatccctgacatggcttgcagattctccaatcctcctgttgatgtgaaagcagatttcggagctgtcatggatgttctcaagagttacttaggaagtaatacacttacgtcataagagacaagaccataatctttagctgttttgttttttgaaaacttttagacgtttgtttgcgttactcttcaactcatctctctgtgatctttatctgtttctcagttttccaataaagttctatcgcaaagtttgaatcattttatcttctttgttttttgtgtaagcgataaatctaaagactccggtcaaaatcaacctgttgcagattatattgttacaactagatgcgtcttggagaatgcataaaagaaaaaagtcaaaaaaccgaattgttcatgagtaatcatagagcgatacactcttgtcatcagagacactagcaagtcgaccagcccggacaccggttccacctggtggtctaaaggccacagaccaaacctggtcattgtggttgctcattgtctgaatcgcagctctcattttaagatcccatagcctcacagttctatcgcttgagccggttgctatggctccaccgtctgggctagcatcaacgctcagcacccaactcgtgtgccctgacatggaccccaacagcgttttcccttctgcatcgtgcatgttcacatgcccatcatctgatccagagaagaggactctcgggtctacaggggagaacacaagggaccttacaggcatattgtgaccttctagctggtgaagtagctttgagcggtcaacatcaaaaacacagatcgtaccatccattgaaccacaagcaagtcgtttcccattaggagaccaagccaccgagagaacgaatttcttgctgctggttttatcggaaggttttggtgcatctgggcgtgggattgatagagttgagattaatctccagcttgcagtgtcccaaagcttgactgaggcactacttccacctgcaacagcaaggatcgtacccttggaacatgtaaaatactatgttagcagagcaccattctaaagagtaatgttgaaattataagctcagaagcaaataaaaactccactgcaaactaaaagagagatcattgcactgatacttgatagtcaccaggtcaaaattctatcataccaaatcaagatttatcatcaaagcaccaataaattgttcttaatctactatataagactcaatgaaaaatcagaagatgatctagatctattttccgagcagagtagatgaccctatctgatcagagctacagattcaaacgatactcagcaattccatatagtacccaagcattgttatatagatcaggagaagcattactcgcaactaagaagtgaaattcaatgaagcaatcgaattctttcaccacaaaacaacccaaaatccttcaaaaccctaaaattggaggcaatctcattgagtcaattaccttaggttcaaattgcattccccaaacctcagaaggaggagcttccaaaacagcaatcgtagcattagtatcaacatcaaacacacggacaaagctatcaatcgaagaagatgctgcaataatcccagaaggatgcgcagccaaagctgctactcccaaagagtgtccagtattagtccgcacaagatccagctcgtccggtcgccataacttcaccgtctcgtcaagagatccagtcagaagcaacgccggtcgatcttccgtcgccggaacccacgtcgctgcccaaacggaatcttcgtgagcgttctcgatcgatttcagacctgcgagtttcattctctttttaggtttttactgtgtttcctcaagtgagcaagaagaagcaaaagacccaaatttgaaacagagactttgattctcgttttttagttataaaatagaaactcgcgtcgtttttagtagttggaaacaatagagtgtttaacatcgttccgtattcttgtttactactaaaggcccattaatatcgtaacaggcccattaatatcttcttcctcactctcccgccgtcgtcagctaattgcggagaagtactctctggagccgccacgtctcagtgatccgactacgacacctttcttcactcttcttcttgcgtcttctctgctctcgtggtctctctgttatttaattttaatcgattgagatcgcttttagctctcgtctttgaattttacgggcagaaaatg

SEQ ID NO: 3800 - DNA, 3000 bp, Unknown; identical to SEQ ID NO: 3787
  misc_feature (1)..( 3000): cDNA_ID_1807640_gDNA_ID_1620665_Annot_ID_163895 3000 nt of promoter + ATG

SEQ ID NO: 3801 - DNA, 3000 bp, Unknown; identical to SEQ ID NO: 3786
  misc_feature (1)..( 3000): cDNA_ID_1821983_gDNA_ID_1620665_Annot_ID_163894 3000 nt of promoter + ATG

SEQ ID NO: 3802 - DNA, 3000 bp, Unknown; identical to SEQ ID NO: 3785
  misc_feature (1)..( 3000): cDNA_ID_1821987_gDNA_ID_1620665_Annot_ID_163893 3000 nt of promoter + ATG

SEQ ID NO: 3803 - DNA, 3000 bp, Unknown; identical to SEQ ID NO: 3795
  misc_feature (1)..( 3000): cDNA_ID_1821947_gDNA_ID_1620665_Annot_ID_48046 3000 nt of promoter + ATG

SEQ ID NO: 3804 - DNA, 3000 bp, Unknown; identical to SEQ ID NO: 3794
  misc_feature (1)..( 3000): cDNA_ID_1821943_gDNA_ID_1620665_Annot_ID_48047 3000 nt of promoter + ATG

SEQ ID NO: 3805 - DNA, 3000 bp, Unknown; identical to SEQ ID NO: 3793
  misc_feature (1)..( 3000): cDNA_ID_1821939_gDNA_ID_1620665_Annot_ID_48048 3000 nt of promoter + ATG

SEQ ID NO: 3806 - DNA, 3000 bp, Unknown
  misc_feature (1)..( 3000): cDNA_ID_1822019_gDNA_ID_1620666_Annot_ID_48053 3000 nt of promoter + ATG
taggagattatggttcgagtcttcccatcacaatttcaatcattaattgttggttaactagtaagaatattcagtttttccacacattttggagattataagttaggattctataatttgatccgagtactcatgttatcaaaaaagaattgttttataaaaaaaggtgcaatcaaatatagttgcattttacatatagaacgaagaagtctactttgaggggaatatggttgcattcagtaacattttttagtgaaagtttaatcgtcagtgcttagaccttttccactgaacgaaaaggccttaacctgcattttctccactctcatatgagattcaatttgtatggaaactaaaaatgtaggtactttactcttacaattattaaagtttaattggattaaaacatattatgtagtaatctcctttcaagttaaggattaagtttcaaaaaaagaaagtccaagcgaatcctctggatgagacagagagttatgaaattacatctttaaagaccgttagctgagtcaacttccggtggttgcaacccccacacataaaataagaaaattggtccaaatattgtattgtcactctcgtctacagttcaacgtacccctcacaaaaagctttagccataactagtctcaagtatcgagtttattatcgaagacattagtgagattgcaaaggaaaagaagtggaagatatgatagctgaaacgggaatggtgatggtaggtgttttgggattatgggcacgctttgtccgaaaaccgctccttcaattcaccggagaaatgatgcaagtaatctccgaagtcgtgtcgaggatgtgtcaaccagatacaacatcttatgctactctttcttcaactgctaattaataaccctcctcccaatatcgtcggaaggtgataacatatttaaatttagagttacatataactttttttaaccttgttatttgtaggttctcgattctataatatatacgtttttcgttttcttttgaatgttaaaattatggatcaacaaaagaaaagttatatacctggttttgtgttcctctctcgacatatgatatatatgtttacatgaaagcttaaccgcaatagagtactagtgaggcatcatagaggcttagtagatctattttaggcgaagctgcacgacatcagtaaattgattgataatcaaaggtttagaaatcgcaaaaaccatatgtgattagaataacgacatcggaagaagatgtgttctcgggttcatgaagctgatccacataaattagagcacgtgtataaatgagtctcgttataataacgacatatatatgatttattcggtttgtttgattcgggtacactaaaattaggttcggttcagatttggttttgattttctattttggtgttaccgtttctgctaagatcgttgattgtctgcttcatttgcttttacttcgtccacaaagttttacgagaaaggttggcacgggacttacgggtccccattgacctggttcatatgtggttcctagttcaagtcgtttgatcttaatttcggctactttttataattaattatttgggtttgggctgggccatgtaagcccaatataaaaacaaaaaaacacacagtttcactaacgacgtagaaccatggaaaattttactcatgggcctatttgcttcaatcatctttcttttttgtcacttcttgatgccttgtctcttatttggaccacaaaatatctgttgcagcaacaaaggaaaaaaagttgtaaacgtttaatttgttttctgtttataatgtaaatgtaacaaaatctcaagaaaagtaataatgaaacattcgtttctcaatatcctttgacaagaagtataagaagaaaagtagctacaattgatcaatcacgtgacccacattagtattaatcacaatacttaataattgcttataattattacaaacacaacttcactgtgactattcttgagttggttcttcctacaagtggttatatatcttttgacgataatcttgtgatatgaattaatgaagcatatgttctaactaacaatggaaaactttctggtgactacccactttaccatcattaatgattataatttccaaccttacactatataacgtatcaaacagatagcaaatttacattttgcaattattaagaacttcaagcacttatcttgtgcaataaggtcgtcgccccattctcaacctcacatggttagttatgaaatcatttgtgtatttcgattgtctcccctccaagctaagataaatcataattactaaacatcataaaacctcacactgctatctttgcagtatattctactattatctttatcttgagtaactgttactatcatttgtctctcttcgtacccaagttttgacatgtgacatgtcaactaacactttcacttccaacaaaacacttgtttattcaaattcatactatacacttctcatataatttacgaacattttctgttgtcgtataaaatatttctatacaatttatgctgttttcttattctcagtttctcaccatacaatactaacagtaatagaatatgtgtctatcggtgaagtgggtgtgtcggcgtacataacgaagggaccaaattgatcatttattaaatatttaatcaaaagaagaaaaacaaaaagaatcaaaaacctccatgaaataaaataaaatcctctctcttcttcttcatgtgaatgtctgagtttcaatgcatgtgctcgctcttggatctcaatcgttcttctacagctttttcttcactctcttctctatcccttagctgtcacgaaacattctctttcactcttcccttctctctccccaaaataaatcagaaacctatcaacattcttcaacagccacaagtaaaatttatagacatttctgtctgaagaagaaaaagattgaatttttttgcttgttgtgggttcttta

SEQ ID NO: 3807 - DNA, 3000 bp, Unknown
  misc_feature (1)..( 3000): cDNA_ID_2999634_gDNA_ID_1620666_Annot_ID_48054 3000 nt of promoter + ATG
cgaggaagaaatggaacagtgaagagacgtctcccaaggcaacggctaaagtcttcaggaagcttcttatgttcggaaggaaaaagtaaaaccgacgttggaattcttcttctccggcatcatcgaacctttgttttgagacgacgtcatgttgagttcagttaaaaagcctctcttattctttaaatttttccttgtgtgatattaaatactgtttttcattttattgttgttatcagtttgatttgtctgtttatattacatttgttgatgtgttgtttatagcattgaaagtgggcatttgagtgtgtataaaaaattggtttggtgagttgaataatgtaagaatcttttgtatttttctaattaaactgtttatgatcattaggagaacaatatatggggatgtgttggaatcatgaatcgtaggttaaatcctacaagaggaaaagcttcaggagacagagaagatgaagagaagagaagaaaggaagaagaagaagaagtcgtgacaaagaaagtcagctaatagacatatctccgctatttaaagtcgagtctaagcctttatacacttaaaggttgagggttcgaacccttgttatgtctttttgccctaaaagaaaaaaactttctcatgaaattccgtgagatgattcttccattctaagcatttggttctgttagattgataaagaagtctcctacagtaccaaggcaatgtgccatccatctacaatttgtataactatatcttttggtaacatgttcccatcaagtgggaatctaattcccctgttattcttttcacgttctaagcatttttcaagctgtttaccattttgaaacttagtaacgatcaaaaagaataagggatttcgtcacgtaaattaaatagaatctgtatacaggtcatttaaaaaaatattttagtaagatacacaggcacagctcaacgtctgatcttggtttgtcataaacagcagagaattctaccacaaggaagctctggtactatctttctcattaagcatccgcgactacaatattccccaatttattaaataaacttttccatgatgcaaaagtaccttttattaaacactacgaataaataaataaaggtgaaacacccatttcaaagaaatggtaacgtgtctttttcattaggcgagactagccaatctaagcaaacagagtcgtctttatatctaaacgaacattttgtgaaagaaagagagactaaggtgaatccatggcgtccaagattgtctcagccatagtatttgtgtttaacctcattgcctttggtttagccgttgctgctgaacaaagaagaagcactgtgagtcacatctccacagcgatatctaatttgaacaagatgataattatgtgatctatcttaatattttggagttaaatattttttggtggggcaggcaagggttgtgcaggacactgaggtgcaatataactactgtgtgtatgactcggacagagctacagggtatggagttggagcctttttgttctcagtggctagtcaaatccttatcatgctcgttagccgttgcttctgttgtggaaagcctctcaagcctggcggttcacgcgctcttgccctcattctcttcattgttagctggtttgttattataactcaattagtacatcacatatatatccctagcttaagctagcttagacatatctggcgtttttatttcgttcaaagatgattcaaaactcacaatcaaacatttacaatagatcttagtttatagaactagaattatcattaatctatcatggtatcaaaatcgcagtaaatcttattatcagcttacacattttcattctcttttcaatgcacagttaataattcaaatctaacatgcgtctcttaatccgttatgaagctaaacgtgcttattaaacaaccgacattgtgctaatatttttacaacttgaatgttgttttgttggcgaaaaaaaggatgttcttcttgatagcggagatatgtctattagctggatcggtagagaatgcataccacacaaagtacaggacaatgttcatggacaatcctcctgattgtcaaactctacgtaaaggcgtctttgcagcaggcgcctcattcgtcttcttcaacgccattgtctctcagttctactatttcttctatttctctgctgctgaggcctctctttcaccttactagaggttcttaaccaacaaataagttttattttttttctctctaaatgtgctatttgatatgctaatatcatattttgaggtgggttttctatgtacaactatgatgaaatgttacaactatgacaaaattatttgaaagtgatggtacacatgagatttgtagatttatttgtatggttattagatcgagttgaaatgttgttttaaaaagagtggatgtaatttgacgattttgtgacatatgacataatgctcttattcattgaataaggtttgagctattctcgtgaatgcgtaaattcaaattcgtataatgcatacttttgacagagtaacaattgtttattactggagaaacttatccaaacatgagaacgtccataacaactagtagcaagcaactagctctatctatctccttctcccatgccaaagggtatggaatcccatcaacaccaatcagcaatcaccatccctttattgcaactgttccatttgttaacccaaaaaaatagtttaaagacattaaaataaaatatctaaggagaaggaaatctaattctcaaattctcattggatattaaacgacgacgtggcagatacttagttcaagataatgctatccacacatcttcggtgacctctgtggggaccaatcttcctttgtccgaatatctcatttgctagtacataaacgcacatactctctttcgcaaaatatccactacgatagttttcttcagcaatcacactctctctttgttcgagtaccaaca

SEQ ID NO: 3808 - DNA, 3000 bp, Unknown
  misc_feature (1)..( 3000): cDNA_ID_1822015_gDNA_ID_1620666_Annot_ID_48055 3000 nt of promoter + ATG
tgttttatctttaaacttttaaaattccacagtggacaacaggacaagatatgcgatttacaataatatatagaggatatgaaccaagccactgatttttaagtggttttaaattggaactcatatcacttaacattaagaaaaggaagtaaagtaaaacgattagtcatcatatgcaaatgaaactaattggtcactataataaaacctaacagaagtataggggaagtacaccaattagcttaatctatgaaacgttggataatctagttaaaaatttatgttcacatgcccattaagtacgtaattcagtaaacaagctacaaattgacaggtccagcccaaaaggaacatagatgaaggtggtacatcaacaaatctgaccagtgtgactttgcacagtgacgtcactggtagatcgagtatattttaagtaaaggataataatctaagacactgatcagaaccgtacgaatataataattaatattcactgataattgtacgttttcactaaataacaaattgtcgatcaatgttatttataaaacctcagtgaccttgcatgttggctttatgtttccaagcctttgtttttttttctatgatgctttcattaagttattcggaccaactaatcattgcgtttaccagttaaacagtataattaattttaggaaaacggatactatttttagtctttacatttgcatgtgtagtatgtgcatatatataactactaatctaccatcagtttggttataaggatggtggaaacaaacaattaaacaaatgaagcatcatcatatatataacatagtctacaatactaaccactttgttaacttagattttatttatgaatttgaatttgaaaatgaaaacagtatatatgatataaaagtgaacatggcatctaaatgaaatgatatatgaatcggcgttggcgtgaacaatattagattcaacgaaagtaggcgatacgaacgtgacgggcctccagcattttgtacagtcgctgacgtaagcaacgtgatctgtggttgtccttatatggaacgtgcagtacagataagcagaccttgattttcatttacaaaaataatattgcatacaataattaacccaaaaaaggcgaaaaagaaccttcaaatagagtctttaacgtatattttaattaaggctagtagttcaggaactttaaaagagatgagacatgaaaacacaaatagggctgagagtgagacgtgtgtttgcttatctttcgtaactatttaattggttactagttgtaaatttgcattagatgatattggacgtgacttatcttgaattattatatggtaatttggattcaaaatcctcgtccatgcatctacggtgatgtgtccaacgtaaaacaagttatatgcaatgtaacttttggatgcatactagaaacacaaaagaagtcatgcaatgtaacttttgaaatttggttatgtcaaagattgatttccactgattacacttagtacattgtttagatagtcgaaaatttatttgactgcagtatgtgaaaaactcttaactttgacttcacgagatctattaaacaatttgaagcaggcttatttttgttgttgttatgttagtaagtcaaatgctgaaaacataaaccattttgtataataaaaagtttatgaaaaaataaaaaaagtttatgaaactactattaggaggtctcattaccccgagattagtcaaccatttcaagaatctctggtgctagttttgtttgttctgttttttgcaaaactgaaagtcgcaataatttgacgtctatctatgcagtagtaatttagtactatcctagagcaaagcaggatggaatcaatttactaaataagattataggaccattaggcccaaaagtgaaatatggatataattattgggccgatcatggtgctgtcatggaaaattcaagataagcttttttaacaaatgtgccagtgacaatgatgaggatgaagcaacaatataatgcaacactgtttagtcatgggaacccatcaaagtatcgggaatcacatcacacataaaagtcatttatctctataaaacttaaaaaacagaaaaaggaattattagttctactaaaggttctcatatgaaaagtaagtaaatttcatatagagtttaagtggctatatgacaatgtaaattttttaattaggccgctaagacaaaactttaattgttcaagaagtaaaagatgatcatggcataaaaaaaaagttaccaaggaaaatcaattatgatgaaatggataaggggtttatccggaaaaaaatgcagaaaaacaaaagtgggaagataagaacacatgaaagtacgagaatgcttatcccgtgacactgacatctctctttcacggccccaccaattcccattcttcccccgctaaataatacgccagagattcgatatccaaaaacctattaaaataccaacatttttgttaatctaaaacattagttcgaatcgaggaaaaaaaaaaacattaaattgaaataaattttatttaaaaaattccatactttttatgatactattctgttggtttttaaaatttaaaagttacgttccgacaaaaaaaagaaaaaaatatatttaaaagttacatttatagctttattatgtcatatcatctttatccaaatttagaattcagatgatgaataagataatagacaaattggaataatatgtccattaataaatactaaagaagaaatagtctcatgatcgcatccaaaacgtttttccttcccacaggaaaagaagaaaaacagacagcggaggactaaaacaactagccacaacacaacgcttcaaatatatattactctgccactttcttcaatcttccttcaaagattcttattacagcgacacacaactcttttccatttagatttttgattttttttggttctctaaaggaggagagaaatg

SEQ ID NO: 3809 - DNA, 3000 bp, Unknown
  misc_feature (1)..( 3000): cDNA_ID_1822011_gDNA_ID_1620666_Annot_ID_48056 3000 nt of promoter + ATG
ctaatctcggggtaatgagacctcctaatagtagtttcataaactttttttattttttcataaactttttattatacaaaatggtttatgttttcagcatttgacttactaacataacaacaacaaaaataagcctgcttcaaattgtttaatagatctcgtgaagtcaaagttaagagtttttcacatactgcagtcaaataaattttcgactatctaaacaatgtactaagtgtaatcagtggaaatcaatctttgacataaccaaatttcaaaagttacattgcatgacttcttttgtgtttctagtatgcatccaaaagttacattgcatataacttgttttacgttggacacatcaccgtagatgcatggacgaggattttgaatccaaattaccatataataattcaagataagtcacgtccaatatcatctaatgcaaatttacaactagtaaccaattaaatagttacgaaagataagcaaacacacgtctcactctcagccctatttgtgttttcatgtctcatctcttttaaagttcctgaactactagccttaattaaaatatacgttaaagactctatttgaaggttctttttcgccttttttgggttaattattgtatgcaatattatttttgtaaatgaaaatcaaggtctgcttatctgtactgcacgttccatataaggacaaccacagatcacgttgcttacgtcagcgactgtacaaaatgctggaggcccgtcacgttcgtatcgcctactttcgttgaatctaatattgttcacgccaacgccgattcatatatcatttcatttagatgccatgttcacttttatatcatatatactgttttcattttcaaattcaaattcataaataaaatctaagttaacaaagtggttagtattgtagactatgttatatatatgatgatgcttcatttgtttaattgtttgtttccaccatccttataaccaaactgatggtagattagtagttatatatatgcacatactacacatgcaaatgtaaagactaaaaatagtatccgttttcctaaaattaattatactgtttaactggtaaacgcaatgattagttggtccgaataacttaatgaaagcatcatagaaaaaaaaacaaaggcttggaaacataaagccaacatgcaaggtcactgaggttttataaataacattgatcgacaatttgttatttagtgaaaacgtacaattatcagtgaatattaattattatattcgtacggttctgatcagtgtcttagattattatcctttacttaaaatatactcgatctaccagtgacgtcactgtgcaaagtcacactggtcagatttgttgatgtaccaccttcatctatgttccttttgggctggacctgtcaatttgtagcttgtttactgaattacgtacttaatgggcatgtgaacataaatttttaactagattatccaacgtttcatagattaagctaattggtgtacttcccctatacttctgttaggttttattatagtgaccaattagtttcatttgcatatgatgactaatcgttttactttacttccttttcttaatgttaagtgatatgagttccaatttaaaaccacttaaaaatcagtggcttggttcatatcctctatatattattgtaaatcgcatatcttgtcctgttgtccactgtggaattttaaaagtttaaagataaaacaattatgtcagttcgtgacatatagagagctattcagataatcacattcagcatatatatactgaaattccgagtaaaaaatgctgtaggcaaatgaggttcacatgatcacttacgtacatagaatcgaataatttacagagaaaacacaacacattgcgaaaacaagaaggtcgagaaaacatattttgtattaaagtaagtacttggaaaacacttggccaggaaaaaaaaaaaacaacagtcaaacacttggccaagttgttacattgcgtgcaagtacgatttgtttatatgtaagaattggaaagcgtattttaatggggcgtttagttagggtcgaaatatgaaaacaccatctatgaccaaaacaaatcagggtcaagctagttttaaatctgcattttttttataagaaattgtttgtaagaaatcaatagtatataaggaaaatagacttggtgtaacagaaaaagttatttaatcaacagaggtgagaaaaagtgtttgatagaagatatgatgcagaccaggtgccattgccagcatgttgcattgttggacttgaagtaaccgagtaagtagataattgaaacgtgtcttataattgtcattaagggtcacaccacaaaaaggtttttgtgattattaaggtcataattcccctcacaaaagttggaaatataaaaattgaaaaactttggtcatatctaatctaatctttatctttggtttggttttatacgatcatcccgaagaaacatcatataaacctctcccatatcatacctacaaagaacatgcatgattttaacttattttcagttgtttcttctagtgggtttgagaactcatcatcaattgtcgtcatctgtttgctttgtgctcttgcatgcttacttgaatgagttataacaatagagaactttttagttttattttagcaacaacacttgaaagtataacttgttctactcgatttcataataagtgtgtgtgagatcttttgattactactagagactagagttgcttttaaaagtgtaatttttatttttattttgactcgatatacttttcaacaaaaaccaacttatatttttcttatcttttaataaaaaaagaggtatgatatgcattatcaaaggatctcctaaacttgtctataaaagatctcacgaggcggtctctgatcaaaacatcgtacaacccatctctttttttttttttaacttgtcttctctctttccttaactttg

SEQ ID NO: 3810 - DNA, 3000 bp, Unknown; identical to SEQ ID NO: 3808
  misc_feature (1)..( 3000): cDNA_ID_3092039_gDNA_ID_1620666_Annot_ID_163947 3000 nt of promoter + ATG

SEQ ID NO: 3811 - DNA, 3000 bp, Unknown; identical to SEQ ID NO: 3807
  misc_feature (1)..( 3000): cDNA_ID_2999634_gDNA_ID_1620666_Annot_ID_163946 3000 nt of promoter + ATG

SEQ ID NO: 3812 - DNA, 3000 bp, Unknown
  misc_feature (1)..( 3000): cDNA_ID_2106516_gDNA_ID_1620666_Annot_ID_163945 3000 nt of promoter + ATG
gaaagacaatgattcagagccagaagaattactacgtatatcatcaactgcgttaaatatggcgtctgaagttgtgagaaagagagaaccgccttctgatgattcattcttggttgcaattggaaatgaggattggggaagagaaaccagcattgagaaattcaatgcaggtgagaatgttcggataataaggaaagggaacaactatgacgaggagatgttgaatccgggtagaagcgatgaatcaagaagctattcgcaggcagagatgtcggttcatgatgggaagctcagaaccagaaatgaggcggaagaagactggttcatacgtaaccaagctggtccagaaacagatccaagtcttgtcaaaacatttgtaggagaccatttccacttaaataagagcagtgagagagatgtcctgaccgatgactctttcatgatccattctcgtgttgagaaccaagtagaagattctcggttaaggacagaaatcatggacttagacgtttacggaaccacccaacaagaaaacagtgccccggagaacactccgcatgaaccagatgacctatacatggttcttggacgggaacaagatgttaaacctacattgttaccatggacccctgaaattgactttgagactaacactttggctcaaagaacaagcagaatcgatttgataactgccacaaaggcctctgcaggtgaacaaaccttagatggtaaagaaaagaagagtcgtggtatctccaaggggaaggatgcaaagtcaagagcatcaagtagacctgacccggcgtcaaaagccaagagacctgcttggggaagtagagctgctgtctccaagtccaaatccgagatggtaagttccgtaaccgcttttcgtctttcttgattagtttccttctctcatctggatttggttttttgataggaggaagagagaaagaagagaatggaggaacttttaattcagaggcaaaagagaattgcggagaagagttccggtggtagtgtatcaagttctttagcgtccaagaaaactcctactgtgaccaagtcagtgaagagctcgataaagaatgagaagactcctgaagccgcgcagtcaaaggctaagccagtactgagaagttccaccattgagcgccttgctgttgctcggaccgctccaaaggagccacagcaaaaaccagtaatcaaaagaacatcaaaaccttcaggatacaagacagagaaagctcaggaaaagaaatcgagtaaaataggtcaatcagatgcgaaaagtgtggaactttctcgtgacccgagtctcgaaatcaaggaaacggtggtggaagattcacattcttacttgtcagagaagcaagttgatgcacttcctgctgttgcttctgttgatgatttcaaagacattaaagaattgcatagcttgccatcagaagaaacggccagagtaaagaacagaccgaatgaaatcatagcagagaaagtacaagatcagacgaagatcgatgatcaggaaacagtgaagaatacatctgtttctgaagataagcaaatcaccacgaagcattactcagaggatgttggagaagtccaggcttcacaggaaaaaccggtgtctccaaagaagtcggtgactttttcagagacaaacatggaggagaagtattatttctcaccagcggtctcagagattgacatctcaacgccacctgctactgaagcagatcattcgaggaagaaatggaacagtgaagagacgtctcccaaggcaacggctaaagtcttcaggaagcttcttatgttcggaaggaaaaagtaaaaccgacgttggaattcttcttctccggcatcatcgaacctttgttttgagacgacgtcatgttgagttcagttaaaaagcctctcttattctttaaatttttccttgtgtgatattaaatactgtttttcattttattgttgttatcagtttgatttgtctgtttatattacatttgttgatgtgttgtttatagcattgaaagtgggcatttgagtgtgtataaaaaattggtttggtgagttgaataatgtaagaatcttttgtatttttctaattaaactgtttatgatcattaggagaacaatatatggggatgtgttggaatcatgaatcgtaggttaaatcctacaagaggaaaagcttcaggagacagagaagatgaagagaagagaagaaaggaagaagaagaagaagtcgtgacaaagaaagtcagctaatagacatatctccgctatttaaagtcgagtctaagcctttatacacttaaaggttgagggttcgaacccttgttatgtctttttgccctaaaagaaaaaaactttctcatgaaattccgtgagatgattcttccattctaagcatttggttctgttagattgataaagaagtctcctacagtaccaaggcaatgtgccatccatctacaatttgtataactatatcttttggtaacatgttcccatcaagtgggaatctaattcccctgttattcttttcacgttctaagcatttttcaagctgtttaccattttgaaacttagtaacgatcaaaaagaataagggatttcgtcacgtaaattaaatagaatctgtatacaggtcatttaaaaaaatattttagtaagatacacaggcacagctcaacgtctgatcttggtttgtcataaacagcagagaattctaccacaaggaagctctggtactatctttctcattaagcatccgcgactacaatattccccaatttattaaataaacttttccatgatgcaaaagtaccttttattaaacactacgaataaataaataaaggtgaaacacccatttcaaagaaatggtaacgtgtctttttcattaggcgagactagccaatctaagcaaacagagtcgtctttatatctaaacgaacattttgtgaaagaaagagagactaaggtgaatcc

SEQ ID NO: 3813 - DNA, 3000 bp, Unknown
  misc_feature (1)..( 3000): cDNA_ID_2050942_gDNA_ID_1620666_Annot_ID_163940 3000 nt of promoter + ATG
agaccggctttagctttgtaatattgatttctcgttagccattcgattagtagttttggccagttatggactcatggttctcacgggaaaatttgtcaactagctaggtttacattatttaagtctcaggttcgttagaaatttccattgggaattgctctgttctggtcctttgaggttggacctggagtcatgtagtttgctactgtcataacacttagaaaacatatgcaagctggtgcatgagagaatcttggataagttttgcttgtaaactagtttatcgttttgttacgttcctcaagtggaatgtaccaagacatgatgattatattggatagttttagaacatatgtataccattttgttcggagaacaagctgcattctggcttatctttatgttttctttggacctctttaccctttgctgtcctctaatcgtgatgatatttcttgatttctataggacaaacatgaagagaacaaagaatgcaaggaagatgaaagccgtggctaaagctatagcgttgagcgagaagtatgaagcgaaagctacaaaggacaaaaccaaaaccctcagaactctttcggccaagaaattgtacgagtgattttggttaaaaggctacaaaagaaggaaaacagttataaatttttgatagttcgatttgtctattttggtcttgttaacgtttatgttttcttctagaaagagcttttgcaattttgtaatctccttaagttatcgacctatagaagttacgagtgcttatggattttgaccagatggtaaaatatattctttagcaagactggttttcttaacaaatttccaatcttcataaagtcatatctcaagtaacaaagaaacaggcgtacatgcgagactactacttttaacattaaacaatcattcaaagatcaaagtgtgataacaatgtcaaagacatatacatatgggcgtgtattctatactacttttatatccaacaatgagctctttacacaagatttgttgtctctaccaaatcaccttggctcggtctactgaaatatatgcgctatttcgcattgtcagtctgcatctgttacttctgcttctatgtctacgactgctgttgaggaaccctttcctgcacattcaaacacttaatctcaccatttgatatacaagagatatggttacttgatttgcgcagaagtaaaacaaaaatttgggtaagtaacctttcttaggtttagaagaaaacccatttaagtcttgtccaaaagcagtagtttggttggagaatttcactggttccttaacaaacttatcatccacgactgcattttccacgataagaaaacacaatgctaaatgctttgaaaagagatatacttagataaattggaaaaaatggaagaatcatcttattacctgagaatggttgagtacagaaagggcaaagctgaacttcatcatccatcgctgacctgcagacattttgatattcaatcaagctcgatttggcgaaacaacaaaaacaactgagagggatttgattcttgttatatccttacttgaatatctgaaactcatttccacaattaggacactgcacaagcgtaaacagagagatgaaaaaccgcaaaaactagctaagtggaacatactcttgacggatttactcaaaacacaagtgctagctagctaacttatagtcacgaaactgaaattcttgaaatgcttttttaagctaaagagacaagtagacttacattgctctggacaatatctcgttgtgcccaccaaaaaaaggctcccaaacccaaaattggaacaatcaccacaatcagctgcaaaattgtaagaacttcagttcaccagcacaattagataaccagagacattaaatgattaagactttagagagatagagagagtaatacccagacagagacaatagcatccaaaatccaaccaagctgaccagtcatagagagataagtcaagccaatggccaaagcaaggtttccgagaatcctcccatttccgttgttatctccaccattaaacttcaaacccctaaccctaaccacccgtcttttacggttaagagatttctcactagctagcatcccaatatctcccagacccatcactcgctgtctctgtctatgctcaatcaagcaagctctcaaccccaacttggtttggagcatagaaggagccaagctccgtcttttagcgtgtaatctgttactgggttccttgttgaaaccgtcgtgtatggagaagttacaaaggataatctgcggaatcgaagccatcgtctgaattttgatttcccaaacacaaagctcgagttgagaaggatccacttcaacgacaaatgatatttcacgacaatgctgtgttttaaggttatattgaacattaacagaaactagagcatcgcggggatagctcagttgggagagcgtcagactgaagatctgaaggtcgcgtgttcgatccacgctcaccgcatttttgttatttgtccctactttaattgaaacgcgtcgtttaggaacaacaagtcttattttattttatttttaattcacttacttgaaacgcatcgtttttgacgcgtaatgaattaaactgtttacctttgacttgagagatgtagtagaaaaactttaagatcttcgagaacagacttaaattcatgttgcattagagtttgatgaaaaccgattgattttattttattttatatacatgtattaagatcgagtgtaatagtatatttgtcccatgttcattttttggatgtatatacgacttttagaaatttatgcgttctcaacaaaaagaaaccatcaaaggtagccctcttccgaagaaaaatatttgacttttatcaaccttataaactaacaatcgaaaactcatcccaacacaatcttctaccttcttctctaatccatatagattccacacttcagccaaaaaaaaaaaacgagg

SEQ ID NO: 3814 - DNA, 3000 bp, Unknown
  misc_feature (1)..( 3000): cDNA_ID_2170409_gDNA_ID_1620666_Annot_ID_163939 3000 nt of promoter + ATG
cggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccacaaaggaaaaaggctcgactggggactagtttgatccaacttgacggcccacaaatgtgtaatgtttctcaacggagagaaaaataaatggttaccaatatttttacaccggttatgtgttgataccatttgcacaaaacggtttaagttctgaattgaataacttaacacccaaaatttggtaaaaagcttaatacaaaaagttcaaaggcattttcgcttactgcgacactcggagttgcagagtactctacgtaacagactctgttcatagagtttgcggcaccggtggtgggacattcttgcggacacagtatgtacttttggaagcatcgttcctaagggttgctgcagtaaactccttgtgacttggctcgcaagaaacataacatggccgcaagaaaaaacagcattaacgaagaggtgtttgagatcttcatgtctagtttattcttcctgttttattatgtgtcgactggtgtcaaaagaaacgtgttgattgtgaatttgtagacgccactctgtaaatttatttaaaataaactattttacttcacgttgagatcgggagttgccgggtttgtgtgccttatctgggcatcacccacacatgcattaagttgaaatgtatatgactttaaaaacttgaaacttcaaaaataaagaaaaagtctttagaagttacgtccacacgagcgtgatccacacttatcggtccttatattaggagcattgtaacttgctgcaataagctgctcattttattaatttgacttttggaaatcttaaaacaacaaaagtacattgtatatattaatagccggatccaagagtgtgatgcttaacatcttttgatgtcttaattaagttgggttttgaagtcagtgttcaaatagaagataacctttttatcaatttacgctaggctctaaatgattactgcgtatttggagcacaacaaaaatataatggttttcttaaggattagataatctggtacatgtaaataactgagttacaattactttctttagaatttggttcttaattaccttattcctctgttttattttgacaaacatataaattttatacgtacacaaaacataacaatatacttttaatatctgtaattcttagcaaactgagtttgtattggtaactactttctgcagacgagtccatagccggaagacgcaccacggctgcaatctaacaatgcgtatgtacttttgggcttgacagagccactcgcaacggcgggatcttcagagaacaaacaagttttgcaaacatgagagagcagagaagatgtcctaaagctatcttcacctcccaccactggcattacgactcctggtttagccggattcttaaaatcgggtctataagtgcgtcccaagattccatcgacttttggggacagattaataaacttgaactggacctcaaaatgggcaaaacagtcatctacaggtaatttgtagttgtggattctatcatcttctttggtcactggaaccacgttgaccatgatctcagctttgtctttgatagtcacgatcacactgttcttctctgtcaacctttcaatcttgatgtctttgtcggatgagtacctgataatatgcattaaaataatgagtgtttacatgaaaatctaaacgaatagacaaagatgacgtttaaaagttgaaacaatcgcaacctacaaaaatgatagggtaaaatttgagtttctatgattaccaagtggataaagtttcttgagggataattaaatcttggccgtcgatagtgaacttgaggtgatcaaggttgctgtcccaagtggcgactttggtggtctcaagggagaatttgtgggagttaaagaggaagccgagagcttggatccatgtaaagtctctagtgcggccagcaggtctatgaccagtgaacctagcattgatctgaaagtcagggtccgagacaatgctaaaatgttcattgctctttccatggaagtagaacacaattccatcaccacctatgaacctcggatctagacaaattgatccataggattcgcagttgggttttaccgctacaaaagatcatatccaaatcttaaaacatattttcaaaatctaaaattaatcaaaatgatgaaattctattaattctaattttaaactgcattggtatatcatcaattacaaaaagaaattggtggttaaataattaccccgacacacggcctcgcaaaggggtttaaagcaatcaacccaacaaattttgttctgagagttggggaacatttcggtagggcactcttcaggacagtcgatgtaccggagctggcatcggggagtcgcattgccaccacaataagtctgaccatgccaagccttgacatgcaagaaacatgaagctaccacaaaaattatcattagcaatgaggattttgggacctccatcctcgttttttttttttggctgaagtgtggaatctatatggattagagaagaaggtagaagattgtgttgggatgagttttcgattgttagtttataaggttgataaaagtcaaatatttttcttcggaagagggctacctttgatggtttctttttgttgagaacgcataaatttctaaaagtcgtatatacatccaaaaaatgaacatgggacaaatatactattacactcgatcttaatacatgtatataaaataaaataaaatcaatcggttttcatcaaactctaatgcaacatg

SEQ ID NO: 3815 - DNA, 3000 bp, Unknown
  misc_feature (1)..( 3000): cDNA_ID_1013540_gDNA_ID_1620666_Annot_ID_163938 3000 nt of promoter + ATG
tgtacgttcttggtattcttgaggaatttgaacaatgttgaaagcttcctataacaacagggaaatcttttataaaatatgaaattaaaaaactctagcatatgttccacggaaaacagagggaggcactggaaatacaaaaaagtaccatcagtttgtgaaatttctgagcatcatcagtgcgatcaatggttaagcaattgctctggttcaaataattgtattcacttgctgctttaatcttcaatctctctgcaaacaaaattatataataaatggtctagcactagcagcttctagctactcttagccttgagcaagtaagctaatcagtaaattatatatgtctacactttgcttcagcagggatacttccaaagaatctcatatgtagctgaaagattgaattcctgcattagttcatagatatttcggtttaaaatgttacctttaagaattggtgaagctcctgcacacaattgataaaagatatggtagcatctctcgccattgcacagctgagccactcttgactggtccaaagagactactaattagcccatgaatagctagcaagtggaactggctataaagcttctcaacagaaaatttaccttttctaggagaactatggtcgttcagcacaagtagtcacacaaacatggtgagaaaataataaaagacgtgagctccatagtcaagaaaatatgacaaacaatcatacaaatgttcaagtcttacaagtttcaagtttagctccgcatatctttccctttgcactaaaatgaatctccatcagtttaccctgcaccaattcagatttactattgaatccaaaccacttctcaatttacggctgacaccaaactttcaaatttatacaaacgattttagtattcctatgaaaggaaaactttcagtcatgcaaaaatttgaagaaaaaaaggatgtacaaattactcacgaatcggctagagttatcatttcttgatgttttagcattcccaaaagcttcaagtatacaatttgtctttaggatttcattttccaccccaaagctacctccaccaagagcttccaagtactgcattgcatattttgctgtctcagttttcccagctccactttctccactaagaaataatattttattcatttgattgatgatatgaatatcagaagtcaccttcacatatgcatagtcaaattatcagtgcacaaaaagcattcagaatagaaagcatcgtaccttatgataatagattggttcttctcctctgcgtaaagaaaaattcaaaaatgtaaatgcatacaataactatctcaacaccaaaaagggagaaagtgtatgctttcactcacctctcatcatatcatcataagctgcatctgccactgcataaacatgaggagcatccaaagcattcttctgataagctgatagaaactcttctccatagatctggacattcttaaaaggatttactgcgatcaaaactggccctgctttactctaaaacagaaaacattaaaattatgttatatacctctgctacactgaaatataaacgaacaaaccagaatgtttttaacttacataaatcaagtcttgtgagtatctgacccggaggttgtagagaagagatggctcattcaaataactaagctgagtaaggtcttcaactccttctaaaatctctgggttagcagggaaaatctcctccattgctactttcacaaccttagataacacaaaactacagcataaggccttttccatatcctaagaaatttcaacaatctcaaagaacttcttacatcgtcgttagcggacagcataacacacacatcatcactagaagaagtagaatgtatcttccccaagtgccactgcccattagcagcaactcgacaccaaacacaaagtttctggcataaaatagatgcaatgtaaaaactgtattcttcttgtcattggagaaactagaaaccgcatactttagtttaaaacaataatgaatcactaaaagttcaaacctttcagtttctcctcaatgatgaatatagaaatacaacataaaagataacacaaagaagcaatcatttacctccctgacgaaatactcagcgctattgatccattcaggatcatgcgagttcttcgctcgactcatctgagcagtactaatcttcacaacttcatttccagttttctccttctctgcagattgtgtgatctgctcagtgctccaatccttgtcttctttctctatggttttgctttccagcgaaattgcattacgaaacttcgccggaagagattgacgaatcaacggcattggagccctgaaagtagacggagagggaagcgacgaagacctctcgcttgaatcaagcaggcgaagagactccaaaatttccttcactgaacttttcatcattgtagtcggaggagacgccgataaacctcaaaatccacccaccaacaaaaattcaaactttttcgtttttgtcttgaatcaatacccattttcgcgtaatgtgagttccttaaaagccagcagaagaatctcgaaaccagaaaatctgaaaattttattgaataataatctctctcaacattgtaacatgtaactagaaattcaagaagggctaaaaataataacactaaaaacagcaacaaacctcaaataaagaaactgaatttcgccaaggagaagccattccaacggaatacataacataagagagagaatttgaaaatacagagacaatgaaactctaattaggtagatgatgatcatcatcgggctgttatttatttattatccattagtggataaatgggcctttaccaaaactatgggcccaataagtagacacgaattagtaaattgacccgacacagagcattaggtgaaattctaaaattcgattgatttccgtctctctactctcgttgctttgcttcgtgccgtcgtgcgtctgacctaatcagca

SEQ ID NO: 3816 - DNA, 3000 bp, Unknown
  misc_feature (1)..( 3000): cDNA_ID_2170393_gDNA_ID_1620666_Annot_ID_163934 3000 nt of promoter + ATG
ttatttacaatgtcatgtatgactagttgaagctcttaacatgtatttttttttacatctttactaaatgtctcttaagctaatcttttctttccatattaattcccactagcaaagttgttttttctttttaatctcaaatttgttaaactaacaaatgtatatatatattccttttttaattgttttctttttgtcaaagtgttttctcaattaaaaaatatacaaagaagcaatataacatttttttttaattgttgaggttggcaagtaaatctttctttcttttttgccaggacgagaaagatttgtttttttaattctctctttaaacgaaaacaaaaataaactcgttggccagctcaaacaaaactattcgcctgtctttcccgacgtgtcaccgacccgtataacaaggataataaaagctccaatttaattttttatttctacagctttttccaccaatacgataattttccatttttataaaaaaaaactttatttgagaattttccttattaaaaaaagaagtacagtataaaggtaaagacactttgccgcgtttctctcggtgccgctcgacgtgttaatcttcttcctcctgaagatctctctctgaaagacattctcaaattttctcgggaaaacacctttttctgattcgtttttctccagatcattccttctttcttatatccgatttcttcgggaggaggcgaagagacggtcaacaattttatccaatgtcgcgccgtcttttcgcctgtttcggcctcaagaaatcttcaactaaacctatctctggtggtaacaattccgccgccgtagccgcagaaattcccgccggagatggtcccgttctcgtccagctattctcgtctcagggatgtaaaacatcgcccgcggcggagatgttgatgtcccggctaggtcgaggtgatttcgacgctcagatccgtggcgaagatggtggatctggatctccgacgatggttttggtgtttcatgtggattattgggattacaaggggtggaaagatccgtatggatcgagccaatggacggtgaggcagaaggcgtatatagaggcgttgaatctggatacgatgtttactccgcagcttgtgatccaaggtcgttctcaattgatcggaaacgaagaggagacgctgctcaaatctatctccgaagcgcctaggtttccttctccagccttccgggtgagttttcgtaacattgtaaactattcgattgttgtggtgattgtgatgatcttgatgtgaaggaattagatttaatggtagatttcagctcttgtttatgtgatttcaatgtaagtgtcttgttttgtttgagtgtcttctggtgctaaatatataggagaatattataggattccaagtgaagcttgtatctgattcttgcgccttgcctgcagattcaagagcatgttcttgtatctgactctgtgttaggaaaatgtgtcctatggtttgcagtgtcgcttgtccttgagtcttgtgaatgtttaatatagtaaatcaaagagttctctttaggtacagggctgtatccaggtcgctgatgctctttctctgtatcaaaatgatcattagacatttaggagtaatattgcttttagagggattttgtctctgctaaaaaagtggtcaatgtggttgctttctagatagttataggtatatatgacagggaatgtagttttatgaatgcagcaagcttctattgcattagaattagctacttttggtgaattgactaaacaacatctgtgataaatttttgttcgacgacatgttcttgttgattgtgtcataggattagctacctaactaaactttacttcaaccatgaattttctctgctcttgaactcaatgagttcttgactaaacagaacaatgtggctcactcttcttcattggctttgtcactctccacataagtggtgttttttgtcgaaattttcacatgtaatattaatcatttgtttctctctttaccaggcgactttccagagaccaacctcagagacactgcaagtatcactcaccggagctttgagaatgaaagtagacggagacggaatggacataatggtggcaatatacgaaaccgggcttgtgaacgactgtgcaagaggagagaacgaaggaagaatgttgtcgaatgattacgttgtaagaaagatggaaaagatgtgcactgtgaaagatgtagcaccgaagaagccagtctcggggactgctcattttacgctctgggatggattcaacagcagcaaatgtggagtcgccgtctttcttcagaactcttctcttcagatttttggtacacagagttttaaattacctgatgagatttgagttaatttccctaatatctgaaaaataaagaaaagaaaaccgatctttgtatcgtccatattttgcttgtgataatcattcgggttccactctgcttttgtacagttataaatgtgtgactacttataacttaatagggtttaaggtttcttctaatttgtttttatttcaactcatattatcctaacctttctcttctcatgctacttcatttgatttctttttaagttaaacccttttttagttaatcagtatgtcaaagttccattccacgaatcttggtcctgataaatgttgggatgcatgaaacagtctagttgtttataaaaccctaaaccctttttattgttttttttgtaaacagtctagttgggatgtcaatgtgacatcgttttgacgcttagttattgaaacgacgtcgtttaaaattttaggataatttatttttgaaaataaatctgaaagcagagtgatatgttcgttcttattgccgatgaaatctctaatatgctccctgagtaatacctttgatgcacaaacgcgggaaatgaccttcattgtcccaacaccaaaacccaaatccatcaggaagctgagtgaatcagaaaatg

SEQ ID NO: 3817 - DNA, 3000 bp, Unknown
  misc_feature (1)..( 3000): cDNA_ID_1823625_gDNA_ID_1620666_Annot_ID_163933 3000 nt of promoter + ATG
ttgtctacatttattttacttcacagtgtgcatatactatcaatttgtattagagagatctcaaagagaaatcaaaatggagtgataggttgtattatgaggattcgcagagcttttaaaatggcagccaacaacattctatgaactaagttaaacagtgttatgaaacataaataatttcatttgcaataaccaaagagaataatatttatttattttctttggctctatcatctaataggaggagaagtaaaaaaaacagaagagaaagatccaatcattctagaaaggaacacaatatgcttcacggatcccaagaatctttctatgcctgcctaaacccagcaatataaatcaaaccttcacacgcttcggttcttctttacacgtgccggaaaaaaaaccctagtagtagccgcccaatgaccatctaaagtggtccccgtgatgacacgtgtcagttggaccactatccgtaacttaacatgaaagcacatgtggggtcccctctttcgtcctttgccctaccagttccttgtcctagcccacaatacaatctacgcggtatctatatcaaagtttatctagctattttccgaaatagaaagcatatacttccatttatttttgaacaaattaaacttggtagaaataaaatctttcgatattgatttatttcgatttagtgtaattctattatcatctcgcgtgtcattctaggcttatagcaacagtgtaggtatgttgcaatgttgggttggtcatgccgtttggatttatttccagtgattaattcagattttatttttcttcttaattatctacgtataacaaaatctcgctaaccgcagagtgaatttgcatgtcactcatgaatgttttgagtataagaagtgagtaatttgttttataaatatatgaacttatgaagatacatattgaagttgttttgtttgggggtaaaaaaggttatttgagtgttatatgataactttactcagaaaacgtacttagcaaaggtaattcgaagtacctttggaatcgagtaaatactgataactagaaaaaataagatacataatggagaaataattaaatatatttgtatttcttttttgtttaacaacgtacgttttattattagctagtatacatttacaacggttacgtagatcatataatagccatttaagatgtacaacatctcatctggttacttcatttatataaaaaaaaaacgaaatctcaacacatagtaatgtataattacttcagtggggcttctcttaagacttgtattgagaatatccatataaaacaaactttgtattaagataattaaaattttctaatagtaggtattgggctgaagccaagattaacatggaggcagctttaaaatgtttccttatatgatgcagccatcatttctactctactccgtagctccaaacccttctcgtaattcacgtctctcatgctattctttttgctttcgtcctcctctcatgtgaagcaataactatctctcgattttttttttcaaataccgaaagctaactttttcaaataaatgtcaaatatattaattttcgttttgtatttagtattttatttgtcagctaagtatagtgagtttttaagcttactcgtcgtatttatcatatattcatatacatatcacattagtcaaagtaaataaaaatttgtttttgaagaaaaaaaaaatacatataactgcgagtctgcgactgtaactggacttgcttattttagttgatatgagctgagtaaaatcacgttgtcccagaccttgctcgctacaatcggcgaatggtctaacgtcccgacacctgtcctcgatccgcgggtactatattctttgcaatgtgatgcacgcgctgttactattggacagtgtttctcacctcacgactgagcctatgcgagtagcgacaatctccgatttgctgtctccatggtagggattatcacaatctctgattttttttatcaggaacaagtaaataaatagctttgagtttttgttttttttctacattcttcgcccaaaagatgtaagaaaataaaggatttgaaaccttgttctgttgttactcctttaaattcttaaaaactataaatcattatatctttgatctgtttcacaaactaatcatattcgttgcaaagtgagaattcgtcccactttactctttacaccgatactagtattatagatgtacagcatagtattccatatctagttatttagtcaaaactctatatattaagaggtaggttaattaattaaggagtaattgaagattatagaaagaataaaaaataccatttaatggacagaaccaaagataactaactatcatactataatgttgaatttcttccacgatccaatgcatggataacaacatcaatcaaatcatacattcatgctatataacatagttttcagttacaaactctcttttttatttatttcagttgttccttttcatgaccatattaacatcaaataatgcatttttttcaacgtctcttgacttacacccactaatattgacaaattgaacatctatacgactatacacacataagttaaaaatgcatgcaagtgctaagggaatttataacatctaaggttaataagactaagaaagtataaaataagaatacgtattatgaatttatgatatactttactaatctttttgaaaaatactttaatttaatctactatagggggtaaaaagtaaaaaagaaataaagatacgtttatccgcatatagtacctggaaataacagaaaataaaaacacaggtaagtactttgcctgagctagtatatgaacactaaagagatacacacacacaaaaagagagcagaaacaaaacacacacacttaaagctttcgtctttacctcttcccttctctctctctatctaaaaagagttccgagaagaagatcatcatcaatg

SEQ ID NO: 3818 - DNA, 3000 bp, Unknown
  misc_feature (1)..( 3000): cDNA_ID_1825089_gDNA_ID_1620666_Annot_ID_163957 3000 nt of promoter + ATG
cttcttcattacacatagattacaacaacagttctcgatctgttgttgatggagtcattactatcactaactctcgttacttcgcatcccacgtacgtttttgaaatttgttgaagatagattaattatgcatacaaaaatcgttgagctgttttcacttaatattttcacatattctgcaggggaacaacggagagaagtcagaggaagaggcgatggggacaactacagatggtaaagctccgaatgtgacattgggtcatgcggcggatacagccaaagaaggattgaaacgagccaccgatgcagccatcaagaagagtggagatgtgggcaagccgaagagtgtagagaatgatgaaggagatgatcaggaggatgtagcagtgggtgatgatggaactgtcaaaggccaaaatcagtcagcaggatgagaatatatatagagacttcgttaaaagattatcagctcctaatgaaatggatgctggtttaaaccgtgtagtatgtttttttatttatgtagaaaaccatctgttaccatttataaactcatccttttatttcttacaatgtgtggtttcttttttgttttgtttttagatgatgttgtctaacattcacactttcttaatctaccatctaactgctattgttgtctgcctctctctgagtttgagttaccaaacactacatttcttgatttccaaaactgctgatgaatctctcattcaaaatccaaaactcgtgtggatgcggtttatcttcctcgagttggtttcttggatggcgtgagctttctgaacccagcatgcaatatcataactacaacatagacacagaagtattagaggtcatgaaaggccatacaaagttatatcagacttgacaattgcttagtaagttacctgaataactgatcgcaagagcagagaaaagagccatttggacattcaaaaacgttagaagaaccgctgttgctgcaagtagaagaagcaaggaaacgatttaaggtccatcctactatataatccattgacaaatgtcagtttcttgctaataccatgtataatcaatcccataagaactttcaaaacattgtagcccggaacaaattgatccaaaacattacagaaactcaaaagtctctcttattgaatgcatatcaaaacgttttgcagcattctgtgactataaacaagttgcagaactacaaataccaccacggtcccatcttcaattagcaaaagacaggaacaaaatgatcgaaaaactcaccgcattgtccaataccaatcgagagtttcctcatggaagggtgacgatcaaatttccacttatcactgcagtatttgaatagctcccaaagagctaagcttcctaacaatcccaccaatgcaagtggcatctgatatctacaaacaccaaaaatcaacacttcaattccaacacaatttcaagattcacactttagtctaaagctttagcctttatctaattaaagagtaatgggtcctcacagtgcacaagcaaagaagacgatgaacaacgtagcgtaattcctagcgaatcgtttgatattctcatgaactctcattctcgcttgctgagaagacgacgggaacgaataagagtcacaattgccaatgaaaccggtggtccacggtgtcgtatctccggaaaaatcatcggcggagagcttagagaaagggttaatagtaagaagagaagagacagtgacgagtcgagataagagagaagcgaagaaaccaccggtaatggatgaaacgacatcgtcagatgccgcagaagttgcggcagctgaggatgaaacggaggcggaggaggaagcggcagctgcagcggcggaggtgcggtgatcgaggagctcgaggtaaccggaatctcgaagccaagattcgaaagcaggatcggggacgcttagagagagaggattaggagagaaagccattgttgttgtcgccgtgattatcccatagtaggtctctcgtctcctcggtcttcccaaaatcaatttacaagaaattgcaactcgtgatccaaaatatcttcataattgctaatatagggctcttatattatcttttgttaatttaactcctataatgtagtttaatggttcttgttaatcaattggcttactaaataccttttatattagatgaaacatgcatgcacgaaactaaatatcatattaattattaaaaaaatcattctatgaattaagatagctagtagtttaaaaaataaaataataacagaaattatttattaaatcccattttttaaaaataaaagattctggtatgtacatgttttttaaaatggaactaaatatattgatacagtatctattaattttaatttttgaatatcaaatgatgataaatagttatcctaagaagaactatacaatgtataaaaccaggttattggatacaggtattaattaactagtgattttaaaatatgagtgtggacaaatatatgaaagacacatgtctaaaaatgtgagaaccacttgattataaaatcgtctactaatatatagtataagataataaagtttcttattttgtgtaaacaaacgttcacaaagaaataaattcaaaaggtaatattgaattgaaaactctgtctttagccaagtgttttaacgagtttgagattttatcctcactttatctaatatattaatgggatctgatacacgacagaaataaagaaagaaaaaaacagaagcatgtacgtatatattttcaggactattctaggaaaaaaatcagcaaaagtgaaaataatctaaagctaactagagaaagtttttcacctcaccaaaaggaaagactagctaaattcttaattattatcccgcaccctgccaaaagtcgagcgttaagtttcttataaattagaagaaagacgagaccattcttctcatagcttttttagaaggaatactgatagagagaaagaaaa

SEQ ID NO: 3819 - DNA, 3000 bp, Unknown
  misc_feature (1)..( 3000): cDNA_ID_1380010_gDNA_ID_1620666_Annot_ID_163956 3000 nt of promoter + ATG
atattacctgtgatggcataaagtgcgcataattgattaaagtcaatagaacaatcctgacatagaaggatgaaatctttatcagaaactactataagaccatcacaaatagtataactcgtgacaacatcataaaaccgagaaaataacaaaccaggtgaattattggaacagaagagatggaaccaaaacgaccattaattcgtccaacatggtaatgacattggtctttgatcttttgatctgtaataggacacaaacacaatcctatgaatatgatgcacatattagcttataaaagaggaagaagagatagaaaaaacttacattcaccaataccgttccttgttggcactgcaatctgaagtaacatgactttaccacgccactctgcattttcctctaagaacttctcaaatgcctgatatttttgtggaatccctttgatcgtatcgagacgatcaacacctaatatcaactgtcaacaaaaatcattatgttaattaaacagtttcttcttctaagcttcaaatatataagtaaatatatatacctttctcccaccaaaatcgtttttgaacttcttcatgtattgaacaacttcagagagttcacttgtgtttataaacctctcaggttctatcccaatgggaaactaacatccaaataagacaaaatgtttcattaaattaaacaaatcatagcatataatcaatataaagagattttaagataggtcattacaacagctactcgagtgactttgccctgatccacaattccttcagatgttgcttcgactccaagaatacacatgcatgcattcaaaaaatgtcttgcgaagtcataggtatggaaactatacaaacaacaacaaaaaaaaaaaacagagaaaagggagtatatatgagatcatgggttgattactacactgttaaaaagtaaaagatatttacatacccaactaaatcagcagtaagaacagaacgaagcagatcggatcgcgagggcaatgttttgtacatctcggaagaaggaaatggtgtatggagaaaccatccaactttcatcttactgttgtattccttaagatattgaggaagaagcataacatgataatcatggcaccaaaccacatctccttcttcatagtgctctttgacaacatcaaagaaaatttgatttgctttcttgtatgcttcatactgtgactggtatgttatggttgcatcgttacgatattctggtggcgttcccaagtagtgaaaaatcggccacagaatattgttgcagtagccattatagtattgatcacacacttcttccaaaaacactgggatacatccctacaaaaccaaaaccaagaatgaaatcatcatattattaacaaaaaaaaagttaccacaatctttagcattttaaccaaaaaaaatgttttaatatgataattaatgacataatctaggtggtcgtgttttattagtcaagatcaattaatgatcattgtctcctttactctctttaaccatgcaatacttacataacggttacacaatccgtattaaagttcatgttttcagactctaatttcgagttacaaaacaaaattaaacatgactgtatacgatagaagatttacgaatgtgtacgtaccttttcagctagggtaatggagagtgtctttttgccaatcgcatcatgaacatctactccaggccatccaatccatttggtctcaaattctttcaaacctttaagagatcatgacgaaaattaaaacaggtttctttgtgtttaaagcaataattaattattaattacgatattaccaaagttggtacattctcttacctagaagagcactaactagaccaccaggactcatcgtgaaagaccaagactcttctccagtcctctttgcagtgaccggaagcgacatcgacactacaagcagtcgtggccttgccatttttctttctctctatcagtattccttctaaaaaagctatgagaagaatggtctcgtctttcttctaatttataagaaacttaacgctcgacttttggcagggtgcgggataataattaagaatttagctagtctttccttttggtgaggtgaaaaactttctctagttagctttagattattttcacttttgctgatttttttcctagaatagtcctgaaaatatatacgtacatgcttctgtttttttctttctttatttctgtcgtgtatcagatcccattaatatattagataaagtgaggataaaatctcaaactcgttaaaacacttggctaaagacagagttttcaattcaatattaccttttgaatttatttctttgtgaacgtttgtttacacaaaataagaaactttattatcttatactatatattagtagacgattttataatcaagtggttctcacatttttagacatgtgtctttcatatatttgtccacactcatattttaaaatcactagttaattaatacctgtatccaataacctggttttatacattgtatagttcttcttaggataactatttatcatcatttgatattcaaaaattaaaattaatagatactgtatcaatatatttagttccattttaaaaaacatgtacataccagaatcttttatttttaaaaaatgggatttaataaataatttctgttattattttattttttaaactactagctatcttaattcatagaatgatttttttaataattaatatgatatttagtttcgtgcatgcatgtttcatctaatataaaaggtatttagtaagccaattgattaacaagaaccattaaactacattataggagttaaattaacaaaagataatataagagccctatattagcaattatgaagatattttggatcacgagttgcaatttcttgtaaattgattttgggaagaccgaggagacgagagacctactatgggataatcacggcgacaacaacaatg

SEQ ID NO: 3820 - DNA, 3000 bp, Unknown
  misc_feature (1)..( 3000): cDNA_ID_2107732_gDNA_ID_1620666_Annot_ID_163954 3000 nt of promoter + ATG
attataggagttaaattaacaaaagataatataagagccctatattagcaattatgaagatattttggatcacgagttgcaatttcttgtaaattgattttgggaagaccgaggagacgagagacctactatgggataatcacggcgacaacaacaatggctttctctcctaatcctctctctctaagcgtccccgatcctgctttcgaatcttggcttcgagattccggttacctcgagctcctcgatcaccgcacctccgccgctgcagctgccgcttcctcctccgcctccgtttcatcctcagctgccgcaacttctgcggcatctgacgatgtcgtttcatccattaccggtggtttcttcgcttctctcttatctcgactcgtcactgtctcttctcttcttactattaaccctttctctaagctctccgccgatgatttttccggagatacgacaccgtggaccaccggtttcattggcaattgtgactcttattcgttcccgtcgtcttctcagcaagcgagaatgagagttcatgagaatatcaaacgattcgctaggaattacgctacgttgttcatcgtcttctttgcttgtgcactgtgaggacccattactctttaattagataaaggctaaagctttagactaaagtgtgaatcttgaaattgtgttggaattgaagtgttgatttttggtgtttgtagatatcagatgccacttgcattggtgggattgttaggaagcttagctctttgggagctattcaaatactgcagtgataagtggaaatttgatcgtcacccttccatgaggaaactctcgattggtattggacaatgcggtgagtttttcgatcattttgttcctgtcttttgctaattgaagatgggaccgtggtggtatttgtagttctgcaacttgtttatagtcacagaatgctgcaaaacgttttgatatgcattcaataagagagacttttgagtttctgtaatgttttggatcaatttgttccgggctacaatgttttgaaagttcttatgggattgattatacatggtattagcaagaaactgacatttgtcaatggattatatagtaggatggaccttaaatcgtttccttgcttcttctacttgcagcaacagcggttcttctaacgtttttgaatgtccaaatggctcttttctctgctcttgcgatcagttattcaggtaacttactaagcaattgtcaagtctgatataactttgtatggcctttcatgacctctaatacttctgtgtctatgttgtagttatgatattgcatgctgggttcagaaagctcacgccatccaagaaaccaactcgaggaagataaaccgcatccacacgagttttggattttgaatgagagattcatcagcagttttggaaatcaagaaatgtagtgtttggtaactcaaactcagagagaggcagacaacaatagcagttagatggtagattaagaaagtgtgaatgttagacaacatcatctaaaaacaaaacaaaaaagaaaccacacattgtaagaaataaaaggatgagtttataaatggtaacagatggttttctacataaataaaaaaacatactacacggtttaaaccagcatccatttcattaggagctgataatcttttaacgaagtctctatatatattctcatcctgctgactgattttggcctttgacagttccatcatcacccactgctacatcctcctgatcatctccttcatcattctctacactcttcggcttgcccacatctccactcttcttgatggctgcatcggtggctcgtttcaatccttctttggctgtatccgccgcatgacccaatgtcacattcggagctttaccatctgtagttgtccccatcgcctcttcctctgacttctctccgttgttcccctgcagaatatgtgaaaatattaagtgaaaacagctcaacgatttttgtatgcataattaatctatcttcaacaaatttcaaaaacgtacgtgggatgcgaagtaacgagagttagtgatagtaatgactccatcaacaacagatcgagaactgttgttgtaatctatgtgtaatgaagaagctctatgtatgtttatggctcctctctttgctaaaaacatagccgccattttctacacttttcaattcattatctagctctcgctctcatctatatacacaccgatggaagtactttgaggatcgagttagtgtcgggagaagaacacgtggctaatcactgtgcttctcacgtgtccccagagcaacagaagcaaaggctgattcagagattcttgtgctaaaaaaaagtgactctagtcttcttatcatcatcaactctaagaaagaaaataaagggcccgaaccttataagcccagcccatatgttcaaaatgttgcaagtgttgtatctactatagactacggactaccacctgtaccgctcttccgagttcgcaagtttctttcgtcgaaaatacgtaggagagaccatcagaccaatatgtactaatgtcgatatggttgaagctttttggtattctcatatcaaatggaaaatgaatttgcaattaagacctgatgcaagatttcagacttttcggtattctcatatataatggaagcatatgattcgttgaatccgattctttccacaaaaccaactgttctctaatgcgtttttcccggggataaattcatataacttcaaatcccaaaaagaattaaattaaacacgtcggcagatacgaagaagcaatatcttcttttaatgtgaggaaaacgagtagatacagagattcaatttcgaacacgtattacccataaaaacgacctctctctatcattaagacaaaaaagcttcacactttccttagcccattataaacgcttcatttctatataaacatctcttatcttgttgaaaatctctcgcagcttttgaaaaacatg

SEQ ID NO: 3821 - DNA, 3000 bp, Unknown
  misc_feature (1)..( 3000): cDNA_ID_2995167_gDNA_ID_1620666_Annot_ID_163952 3000 nt of promoter + ATG
catcaatgcttcacaaagcattggaaggtgtaataatgatggagacgtttccaaaaacaaccgttgatgtttttgcattggttcttgaatctggaggaagtaagtcttaacaataactcgactgctatcaaaattattttaccagaatgtgattgcttattggttcgcttggacattcgtggagttgattatggaagcaacttattggattgttgtttggcattttctgattttctccaatggtattgtattgcaggtgacctctctgttttgatatcatgtgctagtcttgctttagctgatgccggaattatgatgtatgaccttatcacagctgtttcagtggtatgtgtatgttacaatagttgcattgattcctctgcgttatctcttatgtttattagcattaagtgaagaagaaagtaacacatacattgacatatacaagtgcaccatagtctgagacatgtaaaacgtatagatatctgttaattctttattttgatacactgaaattatgcctgcaattttcgaagtcttgcataggcaaaagccttatgatagacccggttacagaggaggaaggatgtgaagatggcagctttatgatgacgtgcatgccatctcgttatgaaatcactcagctaaccatcactggtgaatggacaacacctaatatcaacgaggtatgcctttcaataatatctcttgtccttaatttgccgatgacggttagagacaaaaggtctttcttttcttagtgttgaatattgatgttattcaactgctttgtttgtctaaatcacatggatattggttaattagactgttcttcattttctttttaagctgttcataccatagggtctatgttgttaacatataattgtgacataggagctgtgcagacatgttaccaaacatttgtatttcaaatattgcaggcaatgcagctttgcttggatgctagttcaaaacttggagagatcatgcgtgattgtctgaaacagtctgcctcagcttccgatgaatgagcataaataactatgattttggattgtagctcagacttggtatgaaaccggttttagctgttataggtaaacggatttagtctaaacctgtgtgtagtttaaaccgatgtatgttttcacataagatttgatggaactagatctttagctatgaaatggatcccaattgcgagtggtatcaaagacatacagaatttaaagtagggaatttcaacaaatcaatcacattgttctttacaatttcaaaaaacttgtggatgatattaatatcagattttctaaatttatacgaaaatggaatgatattaagaatagtatacagaaaaatgaagaaaagagtaactgatttttgcatcttaaaaaagaaaaagtcttctctggttcacacatcacacaagttgggggcggtgatgaaggagggtgtttaggtaatatcagctaacgtcggaacttcaactgatcatgtagtacgtacgatacgaagaagaagaatctaatccgcatgacatgtgattattttggtcagagagagaagagaagacgtgtgtcgcagcaaagtggacagttgtgcccttatagccaaagaagacttcacacgttttcaacaccacctaacaactgtttctttctatctcccacctcttccccatttttgtctttttatttcttcttctagtttctcccaattttctctttgatttttttttgttttttcttgtcttcttgttaagattgatacatgaactaatagagtaactagtaaattctaagacctttcagcattcttgaaatgacaattacaaacacacgataatttgcgggaacatgaatgatagaagacattagaaaaaaaaaactccaatgtataaaaagtttatgaaaaatataataacattttttacgaattattcagttttctgtaaatttttatttatttcgtaaatgcttgtatctaacatttcagctagattgttctactgattaatttctatctaacattttatgaactttatcatttcagtaaccgcaatgcccgtgaccactctgcatataaaagtgtatgtcttcttcacattcaatcacacgtactttcaaaattctactaaaaattaaatgttttttttttatataactaatcaaagatatctaaagtttttgagtcaaagttatgcgttactcaaatagaaaaaaacatttagaaacctaaaataatatctgctcctcctaaaacatttaataacattcaaaaacaagtcaataaaaaaaaaaaaatttacgaataaagcccttaattagtcaaaaatgaacgaacaaaacaaaggtaggagaaagtatgaatggcccaatcggggagattgcagtagattcatacaaatctgtaaatacaattttaccgggtttggtaaaaatcacaatagatcattttttattaataagaaagagaaaaagaatgcaaattcgtggggtttccaagaaatgcaagtgatatatttagagattgagatctgaccccattttttgcttaacacacaaaaaatccttgggcagaggaaaaagtttatagcgactcttttcctctaaaagggtctgtctcttccttcttctctcttcagatctccatttcacggtatccttctctcttccccttgtctctattgacttttatttgctttgatttttatcgatcgtctctgatcttttgctaatttaacttgtttccgtttgttttgaatttactctctcctgatctttggcatgtattttgaatctgctgttcttagttttttatttgatcttgttctcgtctgtcttaatattgaataattgactagttttatttacagatctttgcattatagatcccttcaagtgcgattttaatcgtagattagttttggatccgttatattggactgatgtttttgatgtattttttggtattaggatcaatcctgtgtttgaaaca

SEQ ID NO: 3822 - DNA, 3000 bp, Unknown; identical to SEQ ID NO: 3821
  misc_feature (1)..( 3000): cDNA_ID_3100721_gDNA_ID_1620666_Annot_ID_48060 3000 nt of promoter + ATG

SEQ ID NO: 3823 - DNA, 3000 bp, Unknown
  misc_feature (1)..( 3000): cDNA_ID_1822168_gDNA_ID_1620667_Annot_ID_48062 3000 nt of promoter + ATG
ttagttaattacgctataataactaaatatcatgtaactcagtataaaaatattacagacatatataatgatttctttacaacaaaaactaatatttaaaatcaatcgttataaaaccagagttatttttatttagttttattttgattttactattattttagataatgtgaatgctctgttaattttatagacaaacaaatatttatatatttgaatagaagaagatctattcaatgagattttatcctattttcatatatttggttatatattatgtttgtattttgttaatgctatgttcacacgttactttctatgactttttttgtcatcatccaagaaaattaatatatcaacgttcacaaaacaatcaaatatcgactttgtaataatatatactacaaattagtacgcgttattattatatagagcaaaaagagagaatatatttcaatggatgggacccgtgagaaggtgctttcgttccttttataaattttattccaaatgatcaaaatttgttattttatttggtttgttaattatcttttttggtcactgatgtggctagctatttactttacacactgttatgatatactcttcttttaaaattccttaagaaaatattagtttaagctatccattgtacgactagcaaccaaatcaatcattataagttttaataatggtttattaattaatttctccaacttgcttaatttagtggctattgttgaattatggagcctattacatctataactttatacataagaaatagataatgaaataattataataattacaacaataacgttgatgaatgatgacgacattgaccgtcatcatcctactcgtagcaatacctactaagtttgtttctcctctttattttcgaaaatccaacggtattccaatttgtgatgatttctataaaagtgctttttcatatacgtgaaatgaaaaaatagtaacaccatattcatatattagttgatactttgtagttgtatatacgtggaatattaactataataacatatctttgacgatacaatgagtgattgcttaagcataaatgtgtctgaaagtggacgacgcataatatatagatttccattatcttacccatgaatgttaaaagggacaaaacaatcctcggtcttttcttttgataatgctttacaatttttaaggtacaattcaatgactattacgtgtatatgtgttcaagttattgaaattaattttcaaatcaatacgtgtcgatgactgacatatacacaacttcaaaatagaaatgtagccaatctattaatgtgttgttaagaaaaaggcaaccctactagaatgtgtacttattgtgtataactattgttttctcacggacaagaagtactagttcaaggaataagttcaaagacagaaatacataaaaagcatgaaaatagtgaaataaaagagaagacataataattaaagacgcgcatatatattatttgatacacacatttagtaccctttgtcgggaataaaaatactgcagacggtgaaatcaagattccggtgaccggagaacaggaatccgacgagaaaaaccctaagtaaaaagcaagattttgtaagagaagatcttgtgtggggctatatatctttcgatatacttttgtcacaacatcaatagaaatccactcaataccaaaacaaaagataagtataaaaaggtaataaataaaaattcacgtgggacttgggtccatctgttttttcacctgggaacatatgattcatatatatctattgtatttgtatttttttttgcccttagcaagaatgccttttcttttgttaagaaagttacaagactgtctatattgcatttttttcctttagttatgatacgaaatgatggcgtaagtcgtgactagtaatcaatcatcttttaagttaatggaaagaaaaaccgttggaatgaatatgccattgcagtgtgttaccagtaataaaccatgtaaaatcttctataatgtgctctaaagctactttgaaacaagtttctctgtattttttttctttctttctaatatcaaccagaagacaaaaaaagataatatatatgaatgttggttttgttgtattcataaaagacatagagaaatcatatctcaaattttccaacttttttagtgataaaaatactcgacactctacagtttctgaagattggtatgcagggccggcccaagtctttttgttgcttaaagcaaaaatgtgtttgacccattaataatgaggtattgaggaaaaaaaatcaaattctgacaaaagttagactcaaactagacacatagaagaaggttattcaaagcgttgaccactataccaccaacaattttacaatttgatgcctcaaattttgttactaaaatgtgatgcctaaagccctagcttcaccatctttagctctgggccgggcctgttggtatgttatatagcccacaatcctttggttacataaaaagtataaaaataataattcatcagctaattttatattggtatgataatattttgtttgtgaacaaattctatgagtcatatttttttcagttttttttccttctttgtaaagtaagagcccagcaatagtatgataaaataagctattgagcctaataacgataagcccaattaaggcccgtatacatgttattatctcaggcccatacataattacaaaaaaagttagggacgtaagaacaaataaaaatgagaaattatctggaaaagctgaatcaaatgtacagacacatgagactgagaatctaactttaggcttctctaattatgattcatcagagactttaattaattaggtttcaaatttctaataaagaagaagagtcaaagtgattaaattaaatggtcacagcttttatttattaagctctgtttcatttctgctgcgggagagagaaagagagagagacaatg

SEQ ID NO: 3824 - DNA, 3000 bp, Unknown
  misc_feature (1)..( 3000): cDNA_ID_1822077_gDNA_ID_1620667_Annot_ID_48069 3000 nt of promoter + ATG
caaatccgccacatcgtcttgaaaattcgcagatgtcttcgtaatcttgtcttctttctttattacctccaaatgcaagtcattgagttttccaagctgtgtcgcggtaagatcactcatgaaaccaccatggtttatatcgaagtcgtcatcgatcttaagaagatattgagaaagctgagtttcggcctgggatccacaaagtgcgtatataagtctaatgaaagaagaaggacgacatcctcccatccatagcatactgttctctataggagtgttccacgacggtgcaaagtagtgagcgcagcatcggtacgagagctctgatcgttttcccgcatatgtgtggtagtcattgacgattttaccaacgaggtcttcgagtttgtcatcgttgtttcgttgacacatgagtgcttctttgagatcatctatgtgtttagtttgtaaactcatccactcatggtaacatcttttttgaagtttttcaaccccataactcgaagatctttccatatctctcttattgtttttagctggttagttattaaaatgtaattcccgtatggtcttatatacattggatcggtgcatatatgtgtatcttttttttaatgtggtttagatacatgtaaatgtaaatgcatgcatacggtacgtgtaatctaatcactacgcggtgggtttttgtgaaatcgtgctttaacctttattaaattggatgttatcgctcttggtttgtagatatttgagtttatatgtaaacggacaaaacgcagatgaataatactagtgcctgacaaaattattttggacatacttcactttgaaaaatgaaataatatcttcttttctgaatcatacaagtacatctaaaattttacagaaaaacaatcaaaataaaacaaaacaaattatgttggcaagaaaaacccataaatttaagttggtaaaaaataatatctaagtcgtgcaaaaaaaaaaacccataaatttcatatgaaacgtataaactagtagtattttagtaactcgacagtgaaaaaaataactcaaataaacaaaaacaaatcatggtataagaaaaaaacttgtctgtattcatagacaaagagtaagcgtcgctagacttgttggagcttttgttattccttatgtgtataagacgacaacagcaaaagcttaggcatgcatcatgtcggtagtggtactctactactacgtctcactctcgtatacacattaagacacctaacatgatctcttctctacttagacaatattacaaaaagattatctactatacgtacctcaaactcacgtactcacatcaacaagtggttaagtttgacttcccggctccgcctcttgcggcggttgcatcctccccacgtgcacacccacgcctttctctaactcttccccactcttgcaacgacaagtttaatctttactcggcgagcaaatactatgccgcttgaaccggcgtaacaacacccacgatcttcctaagtgtctcaaacctcagcttatcagcttactagtatccaatctataaatgtaaacactttaacttgttatgatttatcgtaaatcatttatgaatcaagaaaaccaaatttatatgcgtctacaactctacatgaactggaacatctgattgataacacattatagttcatattttcatatttgcaagcaaaggtataagaagaggatggaacaaaatataaaaaatgaattgaatcactcgccataaaataatatacttggcacattatttatgttttttgccaaacatttggcacaatttataaatttataaattacaaagactgaagcaaaccattattccatatatacaaaaaaaacttagcatttaaatttatattatagacaatcgcaataacatcaagggtaaatataaacattatttcatattctgtcgatccaatatatatagagaaatataaaggtatattattactgtgggtcatgtcgttttaagacaattccgacataagaacagttaactgttgaactttatttatgttttggactagtgagtagtgacacctcaaaagaaaaaaatgaatacacgtgagttacgagtttcaactaattcatttaacttactgtttgacatgatagctgtaaaatacaaagcacagcaacattttcattttatgggctttaacaacattgataatccatgtcaagcgagagataacgataattgagttcatttagattcaaatttcttttaaatgagaacttttaacaatggagctctttttttttggcttcggttagatattctgattcaaattgtacacaagcatcattatggatatgcttatattaaaaaccgtgtgatggcctattagtaacaagtagtatttaccaaactttgatcaaaaaattattagtagatataaatgttttccaatgcaactaatcgttgtattggaatagttcatgatgcaaacaaaattattaacaagtctttaccaaaatttaatccaaatgtatggctaatcacaaaaggtttccaatatcagcaagtaataattaatagttgaaatgatgctaaacaaaattaactacctaatgcctagagcaatgtaaattgtctctaatcaaaactttagtgttgaccaaaatcattaaacaattataatttgtaacgtatataatcaatcatgtgattagttcaaaaaagaaaccaaaaagtcgatcatacatttatataattgttaggtaattcatggacacacatcaattaattaacattacacttttgacagtgtaaaacagacagtgttataataagtgaagagtatatgaatagggctgagctgtgcaaagacctgtctctctctcacttataattccctcttcacacattacttcttcacttatagagattctcacttacatttcccattttacccttcttcttccttcaaatccactgatgtcttgttatgtgaagtaatg

SEQ ID NO: 3825 - DNA, 3000 bp, Unknown
  misc_feature (1)..( 3000): cDNA_ID_1822069_gDNA_ID_1620667_Annot_ID_48071 3000 nt of promoter + ATG
tgcttgcaaatatgaaaatatgaactataatgtgttatcaatcagatgttccagttcatgtagagttgtagacgcatataaatttggttttcttgattcataaatgatttacgataaatcataacaagttaaagtgtttacatttatagattggatactagtaagctgataagctgaggtttgagacacttaggaagatcgtgggtgttgttacgccggttcaagcggcatagtatttgctcgccgagtaaagattaaacttgtcgttgcaagagtggggaagagttagagaaaggcgtgggtgtgcacgtggggaggatgcaaccgccgcaagaggcggagccgggaagtcaaacttaaccacttgttgatgtgagtacgtgagtttgaggtacgtatagtagataatctttttgtaatattgtctaagtagagaagagatcatgttaggtgtcttaatgtgtatacgagagtgagacgtagtagtagagtaccactaccgacatgatgcatgcctaagcttttgctgttgtcgtcttatacacataaggaataacaaaagctccaacaagtctagcgacgcttactctttgtctatgaatacagacaagtttttttcttataccatgatttgtttttgtttatttgagttatttttttcactgtcgagttactaaaatactactagtttatacgtttcatatgaaatttatgggtttttttttttgcacgacttagatattattttttaccaacttaaatttatgggtttttcttgccaacataatttgttttgttttattttgattgtttttctgtaaaattttagatgtacttgtatgattcagaaaagaagatattatttcatttttcaaagtgaagtatgtccaaaataattttgtcaggcactagtattattcatctgcgttttgtccgtttacatataaactcaaatatctacaaaccaagagcgataacatccaatttaataaaggttaaagcacgatttcacaaaaacccaccgcgtagtgattagattacacgtaccgtatgcatgcatttacatttacatgtatctaaaccacattaaaaaaaagatacacatatatgcaccgatccaatgtatataagaccatacgggaattacattttaataactaaccagctaaaaacaataagagagatatggaaagatcttcgagttatggggttgaaaaacttcaaaaaagatgttaccatgagtggatgagtttacaaactaaacacatagatgatctcaaagaagcactcatgtgtcaacgaaacaacgatgacaaactcgaagacctcgttggtaaaatcgtcaatgactaccacacatatgcgggaaaacgatcagagctctcgtaccgatgctgcgctcactactttgcaccgtcgtggaacactcctatagagaacagtatgctatggatgggaggatgtcgtccttcttctttcattagacttatatacgcactttgtggatcccaggccgaaactcagctttctcaatatcttcttaagatcgatgacgacttcgatataaaccatggtggtttcatgagtgatcttaccgcgacacagcttggaaaactcaatgacttgcatttggaggtaataaagaaagaagacaagattacgaagacatctgcgaattttcaagacgatgtggcggatttgccaatcgcggatgtggtgcatgctgatgtagcggtggaggatgctttggataagcatgaagagggaatggcggttttactggcggaggctgataaactgaggtttgagacgcttaggaagattgtggacgttgtcacaccgcttcaagcggtggagtttttgcttgccggaaaaagattacagctgtcgttgcacgaccggggaagagttagagcagatgtttgtggaggagtggggggcgccgctgtctgaagaggtgaggtggagcggggatgtcagacagagccacttgttaaagtgcgtgtcagtcagtagcgtataatatatgtgtaatatttgtctaattagagatgggtcatgtttagtgtgtgcttcatgtgtatgagatgttgcattattattttcacagtcgaattactaaattattatttaattatcttgttttgttttgattgattttctatgacattttactatgtaaagagtataatgttaactctagttgtaaattttcctggaaaataaacttactaaataatttggaacagtatatttaagttttatttatcataaaaaatacgtggaaaaagcttaaacaaaactagtggtaggtgttctttcaagacatccgataaatttggccaatggtaattggtaactgacaaactaatttggtgactggcagttgttggatctttatataatttgaatattcatttttgacatagattatcattgttgtgtaagcccataaaattaaatgttgaaattgtaagtcgcgtgtatccattttctttagtacctaaagaaaactttggttgttacgagaccacgagagagcaggcccgtctcaatataagatgaggttcaaagtgatattttgaaacattatattatagtagtttattttcgttaaccattatttacggaattcctacaaaaggaggtattttatattttttttgacgtcgggaagatattttgtatctttaatatactttctaagtgaaataggtccaaaaatagttttgtcaagcactttcatccgtgcccttttgtctgtttccggctaaagcaaagatccacaaaccaagagaaacttccatttaagaaacgtttaaaccacgatacgattacacgtaccgtcgtatatgcatgtagttgtaattacattttttacttaaaagtatatgacgacagataaaaaaactttaaattgtacatacatgcaccaatccaatgtataaaaggcaaaagaatagcgttaaaatgcattcacgaactaaccaacgaagaaag

SEQ ID NO: 3826 - DNA, 3000 bp, Unknown
  misc_feature (1)..( 3000): cDNA_ID_3012350_gDNA_ID_1620667_Annot_ID_48073 3000 nt of promoter + ATG
gaaaaataataaagacagagaggctaaaagagatgatgagttatataagaagtttgactaaataagtttgcagctttgactagcccaccttctcccaccgactgccaacccatccgtcaatatttctatcttcatttcctcacaaatatttattcaatctcttcattttcaaatatatagttttctagtactcgtagtatggtctaaagactttaaaactaaataaaatggtaggaagtaaatgcaaattacttgaatttgtaaactatattcatactttcgcaatgttagattagtctgaattcaaatgtgattaaatacgtttgtatatattacgttatcaaatataggttcaaattgtagggattgtccataactattgcgtatatatgttcaaaattatattatatgttgtatttgtataccatagacgttatgacatttgtaagttgtaatgtatcttaaattaatgttttgacaccggttttcaactattatggacgtctttaacgtaagaaaactgactttctgtgtgtttgaaaattagtctgctttacaaattaatctttgcttatataatttttaatgataataagattaaagaatttgataaaaaaaaaaatatatattaaaagtaatgtatattgtttttaccaaagataatctgaggttaaagttacaataataatcatatagaaacaagttcaatagcaaaattaacttagacatgcaatttaccgatttcttgacattagtcgaaaaacatttgaaactcggttatacaatgaggttatcgttcaggcctctggaaagaaaatcaattctataatacttcaataactttttagtaaaactaactggatcaactgatgaatcatatatcaaaaaaacaaaaaaaaaaactaacggaggtagacaatagtttagctggaatgcttgaagaaatggcaagaatatgcttcgagaagttatgatttatgaagaggttacctgcaaattttttcatttctttttgccgacggttggctgttagttaggaaaaagaatttttgttataggattttctcttccgtttcgtacaaacccaatcattattctcgtctttatacttaactttgcctctcattttcatgttatcaatcttttaaattaaatatatcgtcaatgactgttatgaataattagttcttcattctctgccttggttcgaacctcagtcacatggtgcacgttattgtgatttcccatacctcaagagttattcaagatcccttacagaaatatatttatataatcttttatctaatgtagttatttacaaacatgtattatctaccaaaataaaaagggctaaaagcttcttgagtgagaccgcttttggttcgattcattttcctacactccaatagtattacactattgtatataacaagaatcgtgggatttgtttaatccgtacaatgaaacaagaaagatatacaataacttaatatcatttttttttggggacaatcttaatatcatttctaatttctatagaaccaaaaacactcataacaacttaaactttgttttttgtgagaaaaataacaacttaattactagttactacattgacaatttaacatcttcagctaaaaccgaatgtatatgaacatttataatctagttgctattgtatatacgattggataatacgcatatcgacatttaaataattgagcctgaagataattcacaaatatgcaatgtaaatccgtccatacagccaaaagtatgtatgtcccatgcataattgaacaaaaagaaattatattaatattatttttgttgtcttctgcaaatgctaggactgctatcattatcatcattgattttaatattgatgtttccagaaaaataaataaacaaatataaagaaaaaaacaaacacaataagtaaagctacactattaggtaataattaaagctcatttttaagtctaaaattttaattataaaataaaaacattaaaaagttaagacccaaagaaacataaatgcttttttctttcatcaatgtcaaaaaagaagttttcccaccaaatggtcaaacttggatctttgacaatattgttccaatttcatcatgccctatcttttctatttatacacataccttagatataattattaaacccaaaatttgtgttaagaaaaaaaatagacccaaaatttgtgttaagaaaaaaaatagacccaaaatttggaatatatatataagtcaccgctggaaaaaaaattattgcaagtaatttcttatatgaaattggaatgataatattttgatcaagtatccattactaaaattttacaacgctagataacgagattgcttgaagtcgaacttgtgaacaaattataataatgtaaaactaacttgtattgactaatctttgattttttttacaataatgagtgatattacattcattttattaactaaatacaacgaatatgataaatattcagtcctcttataaactttatgatagtgaaaatttgagacattgacaattctagcattctaacattttatgagattacatgaaatgtcaatttagaccttaaaccaaacgaatacatgattcaaatttgaccgacaagtacatgatgccttccctttgatcacgaaatttccacaaagagtccgtgtctgcgtaattaaccagcaatttcaagggtgtttacgtaattgtagcttaacaaataaaaaacacgaaagaagatggcgaagaaaacggaaagtagtagatagataaagaaagagaaagagaagagctggattcacatggtcttgttctttctctctccttcttttctcatcttgcggcttccctttttctctctatcgccacaatgatcattaccaaccaaactgattgaaactcatttgttctctctctctcaaatccactctctctctttcttttctcttctcctctctgtgtctctatcgcc

SEQ ID NO: 3827 - DNA, 3000 bp, Unknown
  misc_feature (1)..( 3000): cDNA_ID_1842475_gDNA_ID_1620667_Annot_ID_48075 3000 nt of promoter + ATG
cacttcatgaatggatacatggttttgctttaagcataagtatatttgtattaaattttcactcaatttaattgcacgaatcattacaaaaataatatctcgctactcatataaataccctataaataaataagtgaattttttttatctctcatggaaatttgatttatgtatttatatgttttaagattcgaagaaatttttaaataatgaaaatttacaaatatataattcttaattcagaatttcagatattgaattacttattggatttttaaaacaaaaagaaaattacatgactttttttttcttttttttttttaaatatctgttagttcaagttaaaagaccatacattttctaaaggcgggacctatatcaggttaaattcatctccttttagaaaaaaaatatatttgggaaaggctttgatagcaagcaattaaagtatccgaaactaacaaaacctatctggtcttggactcttagtctttatataaacaacatcagatagatcgagagaccatacgcaacaatttactaatttctcttctccttcgttgcttttgaaaccctagttattatcgagagatcaaacacgtacgtacacaaaagaccgatcaaacagagaaggatgcagaagcgtgagttcatggagttgttcgaggcagcacttagagcggctaagtctgtgaaaggtgatgagaattctccagaggtatcgaggtttgtcgatgccatgaatcgtttgaaggaagcacccaagtcacttgtttgtgacgtggtctgcaaaacctccatggggcagggtttggaattcttcatcgatcacaaaaaccctaaaattcgatcggaaggaaggattcttcgggatctttggatgaagtttttttacgcttcaggtagagaaaagagccgtgataatagagaagctgcggtgaagatcccgacgcacgcaacgatgaagaagactggagattcaaagcgagacaaagtgcgtgagattctacaaacatctttggctaaagtcgcttctgaggttgttgacacggagatgaagacacgagtgactgcttgtgatccttgggttgtggctgtatctgtggaaactgcaatgtttgagaacttaggttgtttcatgggacctcaaaaagcaaagtaccggtctattctgttcaacatgggagatagtaacaatccagatttgaggaggaaagtgttacttggtgagattagtggggagagattagtgaagatggagaaggaagagatggggagtgagaagattcagaaggaggttcaaaggattaaagagagagcaagatttaaggaagagagtcgcgtgaagatgctttcatcagcagatatgatcatcatttagttagctgcagagatttagtcatgagtttcattattgtatagaatcagtattcgtgtcaattttctatcacaaactcgagatattagtagattgtaatttcaatacgatgatcgttttcaagttgcttcattgaatggtgtttctaaatctgcgtttaaagaatctagtcaaagtgtttcgtttcataagagggagctctgcagtttatgcagtttaaggggtctttggttttttcttttgaatgtttgtcttctattcgcattaggactcattgttcttatgcagccattaattcccggagaaaatgctgtacaatggttccttgcaaattacattctttggctacaaaatcctcattgtatgaagttgttgtacataggttcttggtacaccaattcgagaagaaatccgttgtatgaatccacgcattacacagatttcaggtttccgcagataaaggcacatctgtggcacaaggttcgtgtcttttctctttttacatacattcttgagagaaccaaacgctcatttacttaatggaaggcctttcccacctctcttcaacttcaaacaagaagtagctggagcatcacctgaactagtcaacaagttgatccagaccatatcaaaacacaattaggtctaagtttcttgattcaatctggaacataaagaatctgcacaaagacaataactctttaaatgtaatgtaccattacacgagccacaaggtcatagttgaaggaaaaagtggaggacacacttcgaagtttttcctcctcgaacaagtttgatggtcaaagccagctgcaagcaaaccaacttccccaaatctgcaaaaacaaaaactctcaagttgtatctgcttatttctcttctcttttcaagtttggtgaaaacaatctcatcttttcttgtttcttttacgcatatgtaaatgagtttagtcagaagttttatatagtatttgagcagaaggtgaagaatctagtcaaagtgatcaccaaagtgtttcataagagtttgtgcagttaagggtctttggtttttctttttttcatacagtacttttgaatttttgtcttctattattaccaaattttatgaaatggtttgtttatgactcattttcttacaaaggcaaaatcttaaatacttttttcctgtatttctgcgtaaagattctctcattattcattcattgtccttggtccttaccatattcatcaaaggtagctgagagaagtcagagaatgatgattcttaacatgttgttttaattaaatgtaatagcatgagagggcaacaatccgttgtagtctagctggtcaggatactcggctctcacccaagagacccgggttcgagtcccggcaacggagttttttttataattgttaaccgtaagtcaggggtactttcgtcattaccttatttgaagaaaccctagtgtctttcatataattatcacacactacgcagccgacgcaattcgtgtgccactctatttgctcatctccttcgatttcgaacccctaatcttgagatggtaaagtttcatccttttgatctatggttatcttcgttcctcgttttggggatttaacttactatttacg

SEQ ID NO: 3828 - DNA, 3000 bp, Unknown
  misc_feature (1)..( 3000): cDNA_ID_1822038_gDNA_ID_1620667_Annot_ID_48081 3000 nt of promoter + ATG
aaagaagctttagaacagagcactgttgcagtttaaaccaggttttatctacttttgtaactgtgtgttgtctcatcttcgttaaaaatctttccaaaagtaaaaacaacaacaaaagagtcgtgtagaaacatgtttgtatactccatatatcgtacattgtagataagatttacaaaagcttattgacgacaacaataaagattgtaccttttgatccgtggaggttcttcaacaagattctgaaatttctctgccatttctctgtctgtgagaattttgccttgtggtgtaagaaaagcagtccgttgaaacggtggagaccagataccgcttgtctggtaatcaaactgaaactcagacacgtcaatgtacttctgaagaagtttgtctgaaactggttttgtaacattctgagttaaaacagaggaagaagatgaagatgtaggtggagtttcagacattttttaaagaaaagaaaaagtaaagaatctaaattttgataggagggtttcatgaggaaaagggttgatggagacttttatggtaatgacaaaataatggattttttggctaataatggaggatgagtggagaggagcacagaacatttgtctatgttcctttttcactcttttttttgtttcttttcttaatgtacagatgcgtttttggattacatattacataatacacaaatcattgaactcttttcacatggcagcagatatgtgagtttttgctaacctcaaagaatttagacaatacacacaactactatgtgattagcccatatgggcttccattttagtgtgtgttgaaacccattgggtatatacagaatccactaactagaagatagagctagaaatgtttcatttttgttagatcatcattgagagtgactgaaatatcgccgtttaccaatgtaacatgaccaccaccactactttttgaccttttcaagaaaatgaaagcatgtaacatatacatacaaaagtttaacgaaatgtcggatctacccctgatcttagggagtgaatccggggtagtttagtacatgtatacaaaatatttcacccagaatctatcggtgatcatggtccagctagaaagacaccagtcttaccctaacttttttcaaagtctgtgtctttctgtagaaatctgaggaataaatatttgaatctaaagagaataaagaagaaagtaaaaaagcaaaatcgaagttttgttcaattttctgggatcatagagcaattttcgtttctttattcgttgaaagtgtgaagcttttttgattcagtgagaagtgttaatggcgggttacagagcagatgatgattacgattacctattcaaggtggttctgatcggtgattcaggtgttggaaagtccaatttgctttctcgattcaccaggaacgagtttagtctcgagtctaaatcaacgatcggggtcgagttcgcgactcgtagcttgaatgttaatgaaaaagtcatcaaagcccagatttgggacactgctggtcaagaaaggtttaagctccgtctctttgattttgtcttcatttgttcatttctcgatctgtgttttaggtattggccctctgatgcattgtggagtcaatacaatttcattagatctgtcttagttaatggaatcagtttatcgtagagaaagcttgagaaatcaacctaacctgtgatcgtgtatataattactggaggtgaagtgtacattgtatttgtgtataatgagagaactcaacaattatgcttaaagttaccagctttgtagaaattctgttgttttgctgattagtttgatcaaccagtggttgatgataatcttcggtatcgtatatgttcatggtgtttctatatgttcgttaattctgatgacgatatcgatttctttaatgatcgttttctaccattgaagctgaagagcttattgctttgaagtctttcttgtcatttcggttcttattatgttcctatctttctaatttaacagagtttcaatgactaagtcgttaacgggtttttgtttctcctcttttcgctatttttagataccgagcaatcactagtgcttactatcgaggagctgttggggcgcttcttgtttacgacgtaacccgacactcaacattcgaaaacgttgagagatggctaagggaactccgtgaccacactgacccaaacatagttgtgatgcttgtgggaaacaaatccgatcttcgccatcttgtagcagtccaaaccgaagatgcaaaatcttttgcagagaatgaatcactctacttcatggaaacctcagctcttgaatctaccaatgttgagaacgcgttttctgaagtactcactcagatttaccatgttgtgagcaagaaagcaatggaggctggtgaagattccggtaatgttccttcgaaaggagagaagatcgatgttgatgtttccgcagtgaagaaaactggttgctgctccaactaaatggtcttatgtcctaaagctgaaatcggtttttaaattttacattcaaattttgtttttgaagatgtttgcttttttttaggaaaacaaactatgttatggcttttgatttgcttgtttgaaaattgcttagctttggtctgattctgtaccggttaagggattttgtaatttaaccggttctggtctatggtttgtttttaattcaatccgcaaatatctctaaaccaatatttattgtgctaatccttgaacacaactaatttttgttataccaatttagaaaattttcgtcaaaaaaatagagatcacaattcagtttctaataatagaaacttttaataacagttcatttttagaatttgcttttgttttctcatttgactattcttgactttaattttaattttatcaaaataatccatgtaatcttttaaaattttcttaaaacaaatcacgtcgtcagtaacgccgaaagaatattccgttactaagatg

SEQ ID NO: 3829 - DNA, 3000 bp, Unknown
  misc_feature (1)..( 3000): cDNA_ID_1822030_gDNA_ID_1620667_Annot_ID_48084 3000 nt of promoter + ATG
ggaacttttatacgtttttttctctcaaaatatttaacatttactttcttctttatacaacgtttccttctacatagaagatcaaaagaagttttgtatagtagatcaaatactatcatcacttaaccaaattggcttgatatactgtcaaatcatgaacataaacggtcgctgtacttagagttgttcaatacaacaatcttgttcacgagccgtgcctattcccgactttttccaaagtagttgatcaatttaaagcatccacactagcgccacacatacaataaatattatcaatgtatacaaccaaaaaataatgtgaacaacgttataacaaactatagagaagattccaataatgatgatatgacttatatacatgtctcgactttcttttgtatagctgcgataaaacataactttttgttattctgggaccattaattataatgtttcacttaaaaagtgattttggtcccaaaatgttacaggtactaattaccaagttctacaactaggttaaaagtgaaaacacacactcacaatatagttcgactatttatctatatattaaatcagtatggttctgattctactgagtaccgagatttatatatataacttccatgctctaggatttgtgtccggaaagtgttattttgatctgttgccaattttgtgtccggaaagagtcatctcgaactttatcgacgttgtctaatttctgttttcagttctagtaaaacttttattcatttactaggaaaaaaaaggatccgagtactcaacatacataaaaagaattcaggtgcctaaaacttagattcgatcatatatataaaaatacaacacataccatacatgtatcgttgttttttttgtgtgtgtgtgtgtagccatgttgccattttgtagtacaaaaatgtctcatgagtcttgtaaaagacacgtgataacggcttccttcgaccaaccaaattactaatttccaaaatatagaaatcggtggaccatgcgtactccatacctcccatttattagttttatccgaatcctatgccaattcttcacttgtgttgtacgtatattaattaggaacaagtaaatttctttaaagtgttgaagctatatatgatctacactgaattgtgaactaattctgtgatctataggcatacgttatatttacagttaagattagttatatcatatagcaagtttagattttgaaattacatcttcctcgtttttgttttcacaaaaataacaaaagtaacttgaaaaattagtgatcatctcggcctcaatgtgtgcacgtgatctgacgttgaccgtaatattatagtccggagttttttttttgtcgtatcctattctttgggtgcttgtataattgcagttttgggagtaattaaaacacaccaagtccatatttttcataatggaaatttggaattttatttgagacagtaaacatttcgatagtttattttataacaacctaggattttcttttgttccgccatatttagaaacaaatcttagtccatcacttacagtcttacactgttaaacactattcatctcgatcatttttaatgatttttatagtaatcatctttacaattgatgagacaaatcaattttgagtggttgcaaaatagaaaccttaacttaatcaaaagaggcctgatattaattaagagcttccacaaatttagaatctttcttttcatcatgattaaaagggaaaatatatgataattattttggattattactattttgatgagtagaaagatttgactagcttgagtggacattgttctccttttaccatatttattgagaaaataaaaaagaattcgttatttaaccaacattatttcaaatgtagtaattttcgaaagtaaattttaatggatatttccaagcattcaaatagtcaaatggaccaatgatattactaagaaacatcagaaaaaaaagaaaaacacaagaataagaaaataaaatgccaacgactagttttaaaatctgtacttttttttcctagaaaatttgtacaaaaaataacaaaaacccaaggcgtatattcaaaggtcgaaactttatggtaatgtactaatgtctcagtgaaaaaattcagaaactttttaataccctaaattttttttttttttttttaataccctaaaactttttaataccctaaatctttttaatttaggaaaagaaagaaaaaagaacatactaatttctattgcatgcttctctcctacaaacggacacttctttattggttttgttcctatcataagcctctgtgttcgtgtctgcaacagatctgtctcctctttcatttttctttttctctttagaagaaaccggaaaacaacaaaaccctctacccgaaagggaggtttttaaagcactgtgccaaaaagccatcgttttctccagaaacccatcagtttcctctgaatcctgcatgtgaaagtttggtgaagaaagaggagagagatctgtgatttcctttaaaacgctgccgtttctctccttttttttgtttctctttctcttgatctctgttgttctgtggctgatgatgtcactaacaacgatgcccacttgcctccatcaatttttcaatctctctcatcttctttaatgtgatacaagttctcatcttcagtgtataagaatcataaattttgatcctttagcttctctgtttcttcttcttcttcttcttcccttgtaacagagagctcgaaagttttcatttttctttctttccccatctgggttttcaatttcactaatttactactcctgatttgggttttttgagattttgtggacttaaagctattgccatagtttgtcacacaaaatcacttcaaatttggaaactttttgcaaaaatgagatacaattcgatttggtacttatgcaagattccgaggaggaaagagatgatatttttctgctgaatta

SEQ ID NO: 3830 - DNA, 3000 bp, Unknown
  misc_feature (1)..( 3000): cDNA_ID_3071923_gDNA_ID_1620667_Annot_ID_163989 3000 nt of promoter + ATG
ttgtcatttactgttgaaatttacttttgcttcaggttaaaggtgaagccaacatttcttacatctgctcacgattctaccgtgcacccgagctcatatttggtgccactgagtacacaacttctattgatatctggtctgctggttgtgttcttgctgagcttcttcttggtcaggtaaacaattctttcagtaaccagcttattcaatctccatgtgtatatttgcattaggactcattgtgactatatcatgttcttatgcagccattatttcccggagaaaatgctgtggatcagctcgttgaaattataaaagtaagaatctttaaacgatgattccttgcaaattacattctttggctacaaaatcctcactgtatagttgttgtacacaggttcttggtacaccaactcgagaagaaatccgttgtatgaatccacattacacagatttcaggtttccacagataaaggcacatccctggcacaaggttagtgtcttttctctttttgcatgtgttcttgtttcagtttctttcttcacacatcaactgatcataattacgttttggtttagatcttccacaaaaggatgcccccagaagcgattgattttgcatcaaggctgcttcaatactctccaagtctaagatgcacagcggtaagcattggtcttgaggtttcttcagtctctaagaatccaactgaatccttactatatattttgtttcctcgtatttcagctcgaagcttgtgcacatccgttctttgatgaactcagagaaccaaacgctcgtttaccaaatggacggcctttcccgcctctcttcaacttcaaacaagaagtagctggatcatcacctgaactggtcaacaagttgattccagaccatatcaagagacaattgggtctaagcttcttgaatcaatctggaacttaaaagggatcctgcaaaagacaactacttttttatatataatgtaccattacacgagccacaaggtcgtagttgaaggcaaacgtggaggacacaattcaaagtttttcctcctcaaactcgttcagacaaagccagctgctagcaaaaccaactcccccaaatctgcgaaaacaaaaactctccagtgttgtatctgcttatttctcttctcttttcaagtttggtgaaaaacacagtctcctctttgcttcatttcttctttctttcccccttatgtaaatgagtttagtcagaagtttttttatatagtaaagtttgggcagaaggtgaagaatgtaatcaaagtgatactctttcaacgaggagcttctttcaaacactttttttttttttcaaacacttcatgaatggatacatggttttgctttaagcataagtatatttgtattaaattttcactcaatttaattgcacgaatcattacaaaaataatatctcgctactcatataaataccctataaataaataagtgaattttttttatctctcatggaaatttgatttatgtatttatatgttttaagattcgaagaaatttttaaataatgaaaatttacaaatatataattcttaattcagaatttcagatattgaattacttattggatttttaaaacaaaaagaaaattacatgactttttttttcttttttttttttaaatatctgttagttcaagttaaaagaccatacattttctaaaggcgggacctatatcaggttaaattcatctccttttagaaaaaaaatatatttgggaaaggctttgatagcaagcaattaaagtatccgaaactaacaaaacctatctggtcttggactcttagtctttatataaacaacatcagatagatcgagagaccatacgcaacaatttactaatttctcttctccttcgttgcttttgaaaccctagttattatcgagagatcaaacacgtacgtacacaaaagaccgatcaaacagagaaggatgcagaagcgtgagttcatggagttgttcgaggcagcacttagagcggctaagtctgtgaaaggtgatgagaattctccagaggtatcgaggtttgtcgatgccatgaatcgtttgaaggaagcacccaagtcacttgtttgtgacgtggtctgcaaaacctccatggggcagggtttggaattcttcatcgatcacaaaaaccctaaaattcgatcggaaggaaggattcttcgggatctttggatgaagtttttttacgcttcaggtagagaaaagagccgtgataatagagaagctgcggtgaagatcccgacgcacgcaacgatgaagaagactggagattcaaagcgagacaaagtgcgtgagattctacaaacatctttggctaaagtcgcttctgaggttgttgacacggagatgaagacacgagtgactgcttgtgatccttgggttgtggctgtatctgtggaaactgcaatgtttgagaacttaggttgtttcatgggacctcaaaaagcaaagtaccggtctattctgttcaacatgggagatagtaacaatccagatttgaggaggaaagtgttacttggtgagattagtggggagagattagtgaagatggagaaggaagagatggggagtgagaagattcagaaggaggttcaaaggattaaagagagagcaagatttaaggaagagagtcgcgtgaagatgctttcatcagcagatatgatcatcatttagttagctgcagagatttagtcatgagtttcattattgtatagaatcagtattcgtgtcaattttctatcacaaactcgagatattagtagattgtaatttcaatacgatgatcgttttcaagttgcttcattgaatggtgtttctaaatctgcgtttaaagaatctagtcaaagtgtttcgtttcataagagggagctctgcagtttatgcagtttaaggggtctttggttttttcttttgaatgtttgtcttctattcgcattaggactcattgttctt

SEQ ID NO: 3831 - DNA, 3000 bp, Unknown; identical to SEQ ID NO: 3826
  misc_feature (1)..( 3000): cDNA_ID_3012350_gDNA_ID_1620667_Annot_ID_163987 3000 nt of promoter + ATG

SEQ ID NO: 3832 - DNA, 3000 bp, Unknown; identical to SEQ ID NO: 3824
  misc_feature (1)..( 3000): cDNA_ID_1822077_gDNA_ID_1620667_Annot_ID_163981 3000 nt of promoter + ATG

SEQ ID NO: 3833 - DNA, 3000 bp, Unknown
  misc_feature (1)..( 3000): cDNA_ID_1822229_gDNA_ID_1620669_Annot_ID_48115 3000 nt of promoter + ATG
ctagtctatgaactaaacttggttaatttatctctcgtcaatcatcgaaggaccacaacatacatacatatatttgttgcaacatctaaataatatagataaatatatatgttatagcatattatataaattatagcatagtcaaagtgagttcaacgtcatgtttccatcaagccccaaaactatgattaaagcagacgaaataaaatgtgttaccaccaaggaacttacaaaatttatatgtaaaattaattttccaaaataataatttggacaatattatatactttagttaaggcccagtgtatacttcacggcccatgttaagtttcggtttataactttggtttgtttggtttaaatgttcagactagtttcctttatatgtggtttaaaagtggaaagtctccaaaaaattgaaggcctttccgatagttcaggctaaatagaaggaatcaccggtcgtctaaaacaagggaagatatttaaactcatcagactctcccaccatttaaagactactacgaatatggagacaaggtttccaaatgttgcaaaaatcaccctacatctttatctccgacgacaatgatcagaataatctccagtacacgagcttgaaagacgtgatctcaagttccgatggatttggttcgttgttttgtcacccacaatacagtgttccttcacaagatggttttctcttgtcagagatggattcttctaacatcgccattagcaacgagctcgtgaaaagagcagcctcgatgtatgttcaatcttctatgattgtcattgctcctgacacgaattggttccagagattctgtttgaaggctaagcatcaggcggttgctgcgattgattgtcttagaccggtttgccggattttcgctcggtctagttaagagatgtctttagaaagggtgattctaattcttcttagtaattgtgtaaatattgtatataattttagattatcaaataaaatttctcaatcattcaacagttttttttttacttcacctgaagcataagaactcatttatgaacatcatacctacgtagattaagcatcacgcccaagtcttttccttttaacgtttcttcttagctcgtttggaagaagacctcaacgtctcttttctcagatcttccgtagcttttgtgtccaggaacggctgcaaaataagagcaaaatctcaaacaagttaacacatgaaaagccgggttcatcaactttcactgtttaggttccaagtctaacaatttcaatcccaacatcaaagaaccctttggattttatgcccttggtagttctttgcgtttaagctacttcttggtccgacctcgtagtccattataagagtctgatccttagattaattcattggtttcatgctttgatttgtatatctatagagtcgataagcaactaatatgatatataaatcaagactctattaagatagataacaatgggttcattctacatctaaatattgctacaagttcaaacaaacaatgaagtagataggaaatggatttctaacctcgtcctttctcttttggagctccagaagctctcggcaaagagcaagacactcaacgtggtaagcagcagctaaatccttaatcaaagctttccttttgatgatcccaatcactttcaaaagaaccaattcaaagcatttggttagagaaatcacactgcagagatattgaaagaagtaaaaatagcaagctggtgaatcatgatcagagcaaaaacataagtatgatcttaaacatcaatgtttcatcttaaagataatccttcatagctatctatacagttgctttaagaatgcagattgagaatcactaaacttccatgaatcttcttcatttgatttttttatgaaactaagaaacagaatcaatgttcacaatcagttttaactataatctctcactcagcaaagtaaagagaagctctttctctacacttagtcaaattagtgattatgcaggaccaaggattttcgattagaactacaaaaaatgcgagctttgggtacgattaaaaagatcattctaattgaagggagataatagaaaaacccagaaagcaaaaccctagaaatcaatttgatgttgcagaagaaaaggggaaagtaagatattacttcgactaggatcgaatgtagccggaggagtagacgtttccggtgggggatgttcgggttgggatgaagattccggcggagaaggaagaggaggttccggtgaagttcgcttctcttcttccgccattgaagaagtttcaagaaatttttttcccacagagatttttattttattaaagtcagctgaagtaaatacaaaatctccttattgctattttccactgtgatttatttatttccgttttgttaaaaaagttttaaaagctctttataatgtcattttatcaaatagtgatactattatattttaatttctttcatataatttatcattgtttatttcgctgagggaaaaaaaactataaagtcgtttaaaaaaaaacaaatccaactatattttgtaaaaccacctataaatagtacaattaatcgataaacggtctatttccccatgggaactatcgcatctggctagatgaagcccgatctttgacctcttgctatttacccatgaaatgaaagttaaacgtctatttccccaccaaataaaagttgaagagcttaatgtccccgaaataaaacttcgagagcttaatgtccatagaactggattaagtcggtttactgtatgcgaaaccgatgacttaaccaactaaacctatttagaaccagaataaacctaatttaaaccaaaattatgacccgtaacccgactctcgaacctaaaaaaaaaaatccccaaattctctcccgacgaaccctaatttcactcccgacgaatcctcaaatccagtttttccaaaccctagaactttgatcgatcgatgtcggg

SEQ ID NO: 3834 - DNA, 3000 bp, Unknown
  misc_feature (1)..( 3000): cDNA_ID_1822225_gDNA_ID_1620669_Annot_ID_48117 3000 nt of promoter + ATG
actgaagttccaagctttagcaaagaagctcagagtttcttgcaaggcataatcgatggatttagcatagacgatgcattggaaattaagaagattgagagagtaacaaatcatgatgtgaaagcagtggagtatttcttgaaacaaaagtgtgaatcacaaccagagattgctaaggtttaggttcttttctctcacttataagttcttagggtttggatgctttgatgccctgtaactaaaattttggatgtctttttactgagttaggttcttgagtttttccatttcgcttgcacgtctgaggacatcaacaatctttcccatgctttgatgcttcaagaagcacttagttcggttatacttcctaccatggatgagctgatcaagtcaatctctctgatagctaagaactttgcttatgtccccatgctttcacgaactcatgggcaggtaatgtccaaagagaagaccttcaccattttacctttccctatttatctgtatctatctctttactaatgattttgtttactatgaattgtaatgcagccagctacgccaacaactttggggaaagaaatggcgaattttgctgtgaggttaagcgaagaaaggagatatctttcagaaactaagattaaggggaaatttgcaggtgctgttgggaactacaacgcccatatttccgcatattcgaatattgactggcctcatgtttccgaggagtttgttacttctcttggattaacattcaacccatacgtgactcaggtaatatagtttatattgatcaaacaatcctattcaaattcataaagatcatcgctgattgattgttctgtgtgtattttttttgcagattgaacctcatgactatatggctagactttttaataatatcagccagttcaacactattttaattgattttgacagagatatatggagctacatatctctagggtactttaagcaggcaagtgttaatataagaaaggaaaaaaaaagatgtcaaatcatttgaatctgaatgggaaaatcgtctcattgtttgagattttgcagacaactaaagcgggtgaaattggatcgtcgacaatgcctcacaaagtgaatcctattgactttgagaacagcgaagggaatctagggaaagcaaacgcagagcttacttttctcagcatgaagcttcccatttcacgcatgcaggttttaacatttctccatattctatgtatctcagctagagtgatggaagtaaactaagcctgaaaaatgtacaatctgcagcgtgatttaactgattcaactgtcttgagaaacatgggtggagctttaggacactctcttctcgcttacaagagtgcgatacagggaatcgggaagcttcaggtattattaccgtagccctaagaaatgtttccacttgtcacaaactaagaatgttcttgatataggttaatgaagctcggttaaaagaagatttggatgataattgggaagtccttgctgaaccaatacaaactgtaaatttctcgagtttctaatcttctatatcaatcaagatatttgatgtatctctaatccacagaagtattatggtatcaaataaaggtgatgaggagatacggtgtccctgagccgtatgagaagctgaaggagctaacaagaggaaaagctgtgaatgaagaaaccataagaacgtttatcaaaggtttggaattgccttcagaagcaaaagaccaacttctggagctaactccacacacatatgttggtgctgctgctgcattggcactggccgtggatgaagctctgcacttgggacattgatgatgatcaaagtggtgatagattgtcctcttttattatggtattcttttcgaaattggtggaaaacagagacaatttataggtcggtgacttgcaagtcgtcgtttaaaatgttaagaaaaatcttgtaccattgttgtgttatgtttcctctttgagtgtctgtgttttatctaagtcttgagctataagctgtggtcaatgattctcgaaccaatacaaattattgtaataaaataggtcatatacacattggtgtcaaataataaagagttctcaagttgaaattcaatttgagtggtttttgtttttctttataaccaagtgttatgtaggtatcaaaatctagcaaatatatatgcatatagtagtcaaataaattgtccacagaaacaaaactgagaaataataatgttaaaatgttgtttgtcaattaagagctttaagtaattcttctatttattgctaacatttacatgaacacaaatgttttagccttttaggtctaaaataaataatataagatctatctcaaaaacaaacttactagtttcctttagacttgatctattactaaaagtctagtacatgtgtccaacaataatctcaactctacactatatttagtgtcatataaaaaaaatccttagaagttaaaaatagaaatggaaaatttcatgacaatataccataaaaaatcttttacctagatatcttcctacacattgctataattttatttatgaacaaatttccctgtgattttatttgagaaaagctataaattgaattattgaattgaagacataataatattgttttttcctgcaagtgtatattgttctgcgtttaccaagttcatggcggccataaacccgaagatttcgtcaaacatgtttgttctctaatctttccaacgactttcaaaacatatacatatgctaagtcatgcatataataataacaaatgattgaatcctaatattattcttatttttataacactaccaaaaccaataagccctttcgtcgttacccactacccataatttcatttcattacaaaacacaacaacacatcattcatttcattagatcatattgcaacatctctctgaattcttctttacgattttgtaacttctatcaaataccttaataatg

SEQ ID NO: 3835 - DNA, 3000 bp, Unknown
  misc_feature (1)..( 3000): cDNA_ID_1822221_gDNA_ID_1620669_Annot_ID_48118 3000 nt of promoter + ATG
tctttatcgatgtatgaaaagctaaatcagtattaaggttcatcaatctaacagtagaaacaagtcatttagaagctatatttctttttataaccaaaaaaatagttaaaaagttttttaaaatgcgacgagcgtggaacgaaacattaaaacaataaacttatgtttgatttaataatcacaattctccaaaacggatttgtgcctctggtgggaacacgtcatagattctcatgaagcgttaaactgaagattaatatgtttattatacaaaagtgaattaatactctgcatctagtccttttcaagagtacacaatctgcacttttttaatgaaaatagtacacaatctttatacttcaaactgaggtaacattattaaattaatttattgaagttgacttaagatgatctattcacataatggtacgtgtgtgtgtgtatacacagaaaacccctgattttatgtggaacctaaaaccctccatgaaatgcggtcagtaccttagaacacaagtttcaccaactgtacttcccaattatcctgccgcagatttcccattcaacgtacacacaaaacccccaaagcaacaatctctttaaaatgccctaaatctcaccaacacatactcctctctgattcaacaatggcttttggcaatatccaagaactagacggcgagatcctaaagaacgtttgggcgaattacatcggaacaccacaaaccgatacaagatcaattcaagttccagaagtttctagaacttgggaagcgttgcctacccttgatgacataccagaaggttctagagaaatgcttcaaagcctagatatgtcgacggaggaccaggaatggacagagattctcgatgctattgcttctttcccaaacaaaaccaatcatgatccattaaccaaccctaccattgattcatgttctttgtcttctcgggtttcttgcaaaacaagaaaatacaggggagtacggaagcgtccgtgggggaaatttgcagccgaaatcagggattcgacgagaaacggtgttagggtttggctcggaacgttccaaactgcagaggaagcagctatggcttacgataaagccgcggttagaattagaggtactcaaaaagctcacacaaattttcagctcgaaacagttataaaagctatggaaatggattgcaacccaaactactaccggatgaacaactcaaatacgtccgatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagagacagtatgtgatgtgtttggtttgtttgagtttgaggatttgggaagtgattatttggagacgttattatcttctttttgacagaaatacattgaaaactaccgttgctaatttgataggtatacatatatagacatgtatatattgtataattatatgtcaagattatttatttattttacatttttcacaaaaaaaaacgttaatctatttttctgtcacaagtgtgtttttattcatactacatactacaacgccaatttaacatgccaaatataaaacatacatgggcaaaggcccaacagccagtttaaagaactttgtctgaagagaaagttgttgtatatatcacaagggatatgtggtaattgggaaacatgttgggttgacacgtgggaaattgaaggagatggagtttccgtcactggtagaatcttctaacactagagagcttcaattcaggttgaaatcgtcagaaaactaatgcagacggtagatctcaatcttcgcccaaaaaaactatttagcttgatgagaataatttcacttaatttaaatttgtaattttttttcattttctttttcaatagacaacttttcaattttcaagttgcagttcatcaaaccggaacaaaagttagcctataatcgccaaagagataaacggcgatacaattagaaataaagccagccatcgacgctatagagttttgggatcaaggttaagctactttatccaccttgatctcattcaatctctaaaagctaaatgagtttcgatttaggaattttgtctattttcaatcgataaaacgacatcgtagtgtacagtaaactaatatcgtttagacataacagagaaaactaacaaaaaattaacaccgtaatttttttttgtgaatctacttatcatcatatctaaatagtaaaatgtttacatttagtcatttaacgccaccattgagaccgccgcttgttaacccatttctaatcttatacatgacatataattgtactaactaacctcaaatggtattaataaacagtttttggttcatttcagttatatcagtatatgacaaactcttagtgagatataaatctacacataaaacacatgagtattgttttgtcattgtccaaacatttttgattcacaatacgacgatttataaattattaaagtttccctccaaattattttgaaggcatttttaatccatatatttgaaactattaataaacgtgttcaaaataaaggataaggtgataagtaacaaataatcctcctccaataagcgtaataagtagggacatcaagggtaaatatggaagaaagaaaaaaaatgcacatgtgtttttttttaatcggaatctcctaaaaccctatatatcggcggtacagttacgcaaagcttccagtgactcactcacatcgtgctttgattctggaatctaggtttaaagtttagacctttgagatcacactatatcaaaaatggagctcaatttctcttcaatg

SEQ ID NO: 3836 - DNA, 3000 bp, Unknown
  misc_feature (1)..( 3000): cDNA_ID_1822213_gDNA_ID_1620669_Annot_ID_48120 3000 nt of promoter + ATG
atatacaacaactttctcttcagacaaagttctttaaactggctgttgggcctttgcccatgtatgttttatatttggcatgttaaattggcgttgtagtatgtagtatgaataaaaacacacttgtgacagaaaaatagattaacgtttttttttgtgaaaaatgtaaaataaataaataatcttgacatataattatacaatatatacatgtctatatatgtatacctatcaaattagcaacggtagttttcaatgtatttctgtcaaaaagaagataataacgtctccaaataatcacttcccaaatcctcaaactcaaacaaaccaaacacatcacatactgtctcttctccagtaaccgtcttctgcatttcaacttcttgacacatagaatcttcattactccttcgtctctttcttaaatcgaaccaagtttcttcactcccacgcaaaccacgagtctccgagtgctccttagttgaacaatagctaagggcacaatggttttcaaccatcccatcaacgacttcatcataagccttaaccgcctcttttcctgttctcaatccgattttgcggctgcttcttaatggatcggacgtatttgagttgttcatccggtagtagtttgggttgcaatccatttccatagcttttataactgtttcgagctgaaaatttgtgtgagctttttgagtacctctaattctaaccgcggctttatcgtaagccatagctgcttcctctgcagtttggaacgttccgagccaaaccctaacaccgtttctcgtcgaatccctgatttcggctgcaaatttcccccacggacgcttccgtactcccctgtattttcttgttttgcaagaaacccgagaagacaaagaacatgaatcaatggtagggttggttaatggatcatgattggttttgtttgggaaagaagcaatagcatcgagaatctctgtccattcctggtcctccgtcgacatatctaggctttgaagcatttctctagaaccttctggtatgtcatcaagggtaggcaacgcttcccaagttctagaaacttctggaacttgaattgatcttgtatcggtttgtggtgttccgatgtaattcgcccaaacgttctttaggatctcgccgtctagttcttggatattgccaaaagccattgttgaatcagagaggagtatgtgttggtgagatttagggcattttaaagagattgttgctttgggggttttgtgtgtacgttgaatgggaaatctgcggcaggataattgggaagtacagttggtgaaacttgtgttctaaggtactgaccgcatttcatggagggttttaggttccacataaaatcaggggttttctgtgtatacacacacacacgtaccattatgtgaatagatcatcttaagtcaacttcaataaattaatttaataatgttacctcagtttgaagtataaagattgtgtactattttcattaaaaaagtgcagattgtgtactcttgaaaaggactagatgcagagtattaattcacttttgtataataaacatattaatcttcagtttaacgcttcatgagaatctatgacgtgttcccaccagaggcacaaatccgttttggagaattgtgattattaaatcaaacataagtttattgttttaatgtttcgttccacgctcgtcgcattttaaaaaactttttaactatttttttggttataaaaagaaatatagcttctaaatgacttgtttctactgttagattgatgaaccttaatactgatttagcttttcatacatcgataaagaattcttcggtgtttagttaagtttgttagaagttattattttaccatacgatcacagtttaacgcatattgcctagagaatataatataatgataactaaacgctatcaaaatgtgaaacgaaataagaaaaaacatgtaagggctaagtcatcactaactttttatccaagtattatttgtatgagatcattttccgtaagtccaaagatttgaaacaatgatgagaggtgaatagaatatataaattccacacgctttgaaacatagcttacaattgaaaaaaaatgaaaaagagattaatatctctattcaatgtattatagagaatgagctagagatactttatatggtaggttcaagtcacctcaagtacgtatcagctaatattaaaaaactatctgctaatttttatatcaatcgtttaagattcattcattcgttctccactacgagagtttcttgctttggcacatatatagttcaagaaagtctcgtgttggagagactccaagcgtgctagagcgtttcgattagaaaggtgttttgttcgagcattaaagattgttgcaatggttctatcttaaggtagtcatttgttaaattttggtattcaatctcgagagcttcataagtctagcgagcttcataaacacactacaagtcatgtgtataaaatttccaattctgtaatcacaagtctaaacttaatctgaatccaaatcacaaaaagcattttcaaaattgattaaaaaaaaaactacaatatagaaaagattttaattgatgcttggaacggaactaacattacctgttatgatttcgggcctgaaagtattctgagttttgattcagaaccactcggtattaaagaaaaagaagacttactacaaaaaaaaaattatatatatttttatgaattattataaccaactaatattgtctctattggttctaagttcaaacttctaaccttcgagggccgggttcaaattccagtaagtgatttattttttgctaacaattctcttatggcgggaaaattgacttctgtcgagaattagggtttctacaaatctttctccgttctaatttcggattaagatttcaatctctccttctcgttttcttctttggtgctgctgagaagaaattagtgaaattgtgaaagagaag

SEQ ID NO: 3837 - DNA, 3000 bp, Unknown
  misc_feature (1)..( 3000): cDNA_ID_2031704_gDNA_ID_1620669_Annot_ID_48122 3000 nt of promoter + ATG
acatgggattcaggtttttctggcttcttaaaaaatctggatctgataagtcctaaatctttgttttgcatggccctcaaattatcgagccctgccatgctgcactcagtttacagtatactgcagttagatatatatttcatcttcaaaaattactggcagaatgacaaagtactcataaagtttctaacctgtgggacggatccagtggtagcttttcactcaaatcttgtaccttggcagtttggcttgtacgagtgcctggtgatattttgcctgagagggttgttagagaatgtccagcatctgagttatacagtgctcctttagtgttatcctgtatttctgcctgagtgtctgtacccatttcttcctgttgatgttctatcttgtctgaacataaatgagatgagatgcttggtgaagtctgttctatcttctcataacttgattccatggtggtaatcattttcttgttggcattttctggatctataggacagtcttcttttgtaccagacctgcagagttcatggatatctggactggtttctctgtttactgcaatatgtgcaatctcagaagcatgtaatggcgagggtgctatggtctcatttgaaggacatggttcattcttttcttcaacctttgaacatgatgtcttcaatggtgaagtatctacggattgaggttgcacacacattgtatgagtttgtgaggctttttttcttgaaccctgaggtgattccaccgcctcaaaatctcccatgctctctaatgcagcttgattcgagtttttgctcttattaacaaccagagtatctgtagtcttgtaattttggctctctttttcagctgaagcttttgcctgaacatctgtgtttgccttggagggaacttgtctagttattggtaagtctagaccaaagtccaaatcgtctgacttatcactcttactacttgcacaaatttcttcacagtccatgctcttggtcgtagtcttgcttcccttcttcggggggcttgaaccaagatcaaagtcgtctaacctgcttgcagaaaaacataacatggcgttaagcaattttagatgacatagataattctaaaaggaaattgatttactgaaggattcatacgcatcaaagtcgtaagagaaggcaaatggattctttttctgttttgaatttccactaggtttatcatcagaggtctctttcgtttttgtggttttcttggctgggcttgagaaatcaaagtctggcatgtccattttaaatgatgatccaaaatctccatccagatcgaaacccatatccctgagaaagagacaaagaaacagaactatatgagacactaggccttgttgccaagcaacagaaacttatagtagtaatcatgataaaggaggaaaaatttcacgattgaactacatttatttaggtgcaaacatggtttaagaaacttatcatattggttacactcacaacttgaaggcattcttcttattttttgctggtgagccaaagccaaaatccattggatcatcatctgtcattgacttgaagttccatgtatccttttccatgtctttatctgcagctaaccatggaaattaaaagacaacgaacctttgaatcacccattttaacaatgggaactacatcttatggtttctatctacgcccaaaaaattaaaagctggccaaaattgagaaatagaacaataaggagataaagaagaataaaagatagtgtgcatgatctttttgcctatagcatcaagttattaaggcagtctacttggggattccttttcttcaatggaattttcgccgcaagcggcttaaagacattccactagcaatgccatgttagttatgaatcatatcacatgaacatttgaaccataccgagcattagatctttgtcctgagtatctgtagaacttcttttagcaggtgcagacatggcaatatctgttcagtatcactcttgaaaaccaactgcaaagaaaaaactaccatcataatcattctagcactcactcacgaaaacacttatctgttatgttatgataatcacaaggcaaccaacaaaaaaatcatcctactacgtcacaaactcaactagcatagacaaatcatcagttccattaacactcttctaaaactatttctaaggcgatatgacgcataacgtacgtaggtatgattatcggagagactgagaaacataacagatcaaacaatgtgattatccgagaaccaatctaaacgaagaagaacagtagcaggaatcaaattatgagattcaacaccaaattataaaaaataaccaggcggttcgtcgattttaagcaaggagacgccactcgagactaaatttcagggacaacgagcagcacgaaactaagtttaggagaaagtgcatcttagcattgatcgaacatttcttactcaaatctacgcataaacgtcacctctaacacagaaatgttcatcgattatgatcaaccgatcgtcaatcgtcgaaccttagcaaaccgaagctaaaacaacgcctgacagtgagattctactcaatcgacgagcaacgagggtaaattcttaccgattgaatcgctttgcagttgtatatgtagtaggcgctaacgataaacgttcaacggcaacaagacgacgacaccggagagaaaatcgccgacggaactcgaaggggggagattttgaaattagctgggctccgaatgatttgacttgggcctttatattcttatgtttggtatatatatatagaagctcgcctttttttttggtacggctattttattttctatatcatttttgatttataaataaaaaaaaggaggagatagaggaggaaatctatctccttatcctgaccacagaaacaaacataagccaatggaaacaaaaaaattctaaggtgaaaaaagccaatcagaagctgagtaaactctaagctcacacaaaaatg

SEQ ID NO: 3838 - DNA, 3000 bp, Unknown
  misc_feature (1)..( 3000): cDNA_ID_1822197_gDNA_ID_1620669_Annot_ID_48126 3000 nt of promoter + ATG
caagaaacatatagaaaacactagtagcacataccgttgatttcgagtctgtctcattccgcaaagcgcttgaagcggtttcaaccacaccgagcgttggaagaccataatgaattatgtactccgcatcaacaacaccgacatttttctttcggtcaccctatccgcaaccaagaacatgttagtaaaaaccgtacaatgaaggaagtaagggcttatcaaaacaagttagaagaagaaacaaacttgagcacaataaccaagctgcgtatccagaccccaagcatggatcaaatcattctgcaacgcaaacgaaagcattaaacccaatcctctcgactcggggaacaaaaaacgaatgctacacaaatgttacctgaatcatataccaagaacatctccatgcagctctagagaaaacaggtgccatcatttccacccacctacagatccaagttacatgttaactggagaatgaggtagaaagagagtttcaagaacatttcacggaatatgcgaaaagcgtttacccgatgcaaggaggattggtgctatggtcatcacatcgcccgctacctttgtatttatacattcttctatgaacttttgatttttttcgacgagcggttataggatgatgcacttctgattttgaagtgtcaagagcaggttgcgatatctcaagcccctcttctttgacaatagatagatatctaaagtaaaacgattggaatgagaaatgaaaaaagataaaaaagaacacaaattctatatttagtgtgttaccgttgaggattgaaatgaccaacaccaagatcttcgtcccaaagaaatatatactcgtactctgcaactatatcgggatgcaagaatcgcttggcgaaccaccttgtgacattaacaacattcaagtattagagagtatatgatggttgacgaaaacaataacaagaagttcaagaaaacggaccattttgtttgattcatcacggaaacatgaatcgcatgattattccatggatactgcttccagtcatcgacaacaccatcataatgaaaaagcatgaccgcgaaatctcgaggaggaaactgaagtcacagcaatttgtataactaatcgaaataaaagacgaaaatcttgctgatagaaacaatcaaatgagaaaacaaaaccttttggataactttgttaactagctccttttgcttgataccgaccgccatggctaacaaactcatcgaatggttaggccttctctgaaagaaatatacagcaaaagattaagctacacgaaaaaaaagcaatgaaactttccaaatctttgaggaatcatgtaactactaaataaccttttttgtgtcatcgtagttccatagatgttgtgtttccaggttcgatgttttctcgataattccttgcggtagtgcttcagtacccactggcttattgaaattctagtgaaagatatatatatttgtaagtttaatatcaaagaatctcataaaacaaacctcaaagaatatttcaaagacaaaccttgcatgtactggttgttgttgcattctgcatcttatcagtactgttatgcatcttatcagtgatttcccacttcagcaacttctgcagatttataatcttatacatcaaattcagaaatctaaacttattgttctaatgttgactataaaaccagaattattcaacaatgtcatgttatttacatgtcggaaaaaaacactactgattacacaaaaagacagctgaacaatttaaccaaaatgacagtatcatagaacacatatagatcttaagtgatgccaaatacaaagaagtttacctctttaaagtctttagcaagataagcattgcaaatgaagtaagcaccacaaatcagagcagtggtgattaagacactacagagacacgatctattcattgaaccctgcaatttagagaattgataataagactttgagacgaaaacatagatcagagcctagagacaagaggttttaaatcacacatcagaagaacactgagcaaggttataaactattaacaatatttgaatcatcagtaataaaaaatcttatttgattcaataggacaatgaggacaatttggaaaagacaataatttgacagatattttttttagattttcctctatgtttacacatgagaagaagatatagctaaaaaattcctaaactatgcacataattatctaactgaattcatcatcgtcaacaattaaacagccaatagacacaaaaattggatatatgaatgaaatcaataaaaaaagaagagaccaaggaagaagaaaatatgtattctcacctgtttcatgaattagatgatttgtttttctctgtttctgccttttgtgtttctctgaaaattgaagctttttttaccctctcaaaaaggtttcttttaagacagaataaacccttttcgaaagagaagaggaagagaccaaagtagacgaagaaacgaatatcctgaacttggtcgtttcaaattctcttctcgaatttggaagctttaaacaataaagattctgttttttatcttcttccgagtctaagaagaagctttttattagctcagttgcttcataaaacccagaaacggtaagtgataaagaagattgaagtcagtcaaagagacacgtttcagagatcgtgtagcaaaattcaagggttttcaggagagagagacaacaaatgcagagaggaaagtgggaagtgatgagacacgtgttttacgtttattggttttgatattaagtcgtgtgtgtactgtatatttgtctctcgcttaggaatttgaaaccgaccgagatattatttgttgtcgtcataattaccagatcagattataaacttttaattctctttaccaaaataaataaaaaagagaactttatctgattttttttccggcgggagatctctgtgtgaagcttcttctctttctccatcgccgacaatg

SEQ ID NO: 3839 - DNA, 3000 bp, Unknown
  misc_feature (1)..( 3000): cDNA_ID_2785806_gDNA_ID_1620669_Annot_ID_48127 3000 nt of promoter + ATG
gataaattaaattatttcaatgagttatctatcctaatttatttgtatataaatcttgagatttttttttttaaaattaacaccatatcaagtatataatatgatagtgttgacaccaatttgtttagctttagtttttaaacaaaaatcaaatatacatactactaagcataaagattagtaggcacctttatagtatatactttatagggtataaacttgtgtgtacaatcatactaaaaataaggcataacatataaaataaaatagtttacgcattttacatcattcaaaagacaaaatgttttctcactagaataaaacagtactatgaagaggcaggtagttgataatataaaattttcgtctattaaccagtatagatacgtatcgaaatagtcattaatcaacacaaattcaaagggtcttatccaggcacttaagattatctaagcattatataagatggaaagaataagctttaattacgatgagaatataaaaccatcaaaaggccataaacttggaagcagcaactcggttcattgtgccaaagtggggacctatagtgtgcattctgattcaagaaagagatgatcatgacctcaattgaaattgtaaatcatttttaaaaaaagtaaagggacttcatatagtctatatatagcatatttttatcattaaaaatgtttgtttaaagattcaacttagaaatttgattaaatactagtattacttaactagtgcgttcaaattattagtaaacaagatccaaccttacaaaaaaaaatcacactttattggcacctcaactgaatcttttattttagtcgtcaaagaaaaaaaatggattcattcaagctgtaaatggaaatgtgtcactaaggcccataaatctattttgaaaaagcccattaaaactaggttcttaagtcttaaattgaaatatatcaatctacttttttcttaatagatataattggtcatcattaaaattcttgcattggctaattgcaaagaagaaatattcgacatgaaatttgtacatttggtgctattgtggaacgcatcttttttttcataaactttatcatataagaaagaacttgaaaaaaaaagagattctaaagaagaaagatcaagatgtctccaagtaacaagttgcagaagattcaacagcttcatcgagctcaatatctccacaagtagagagaattgttgcaaatatataatcatcaacttcaaatccctctgcctccattctatacattagcttcaatgcttccctgcaaaacccattcctcgcataacccattatcatcgccttccatgaaaccaagttcttctcaggcatactgtcaaaaacccgaaaagcttccgagacaaatccacattttgcatacatgtgaatcaaagcacttcccacaaagacatttgatagagcatgattcttctttgcaatggaatggattgatctaccgataagaagagattctgaattcgcacaagcttttaaagccgaggagtatgtaaatgggtttggctctacaccttcttgaatcatctctttcaagaagtctagcgcttccgattcatgtcctaagctcgaacatccagagatcatagcggtccatgaaaccacatctctagatggcaattgctggagaacattgaaagcgtcacgagattctccgcatttacaatacagccacaccaaagtacttcctatatagacattcttttcgatcgaattcttgataatctgtgcatgaagttccttccccaacaataaagctccaacagatccacacgctctaagaatgcttactactgtcaaattgttagcaatcaaatgccgcctcttcattatccggaagaggctgatagcttcctcaccaaaaccttcccgagcatgagcagctataatcgaagtccatgtgaccgtgtttctattactcattccatcaaacacttttctgcaatcagaaatctccccacacttagcatacatgtccatcagcgaagttcccacaaaaacatctgtctttatcatcctcttaacaaccaagctgtgtacttgccttccgaatcttaacgctttctcctcactacaagccttcaaaatactgcacaccgtaaactcgttaggcaaaaaccagtgattcaacattccgataaacatgcctatagctttaattccatgcccttttctcgaacacgccgatataacagcagtccaagatatcacatctttctcctccatcatatcaaaagctcgtaacgcacttgtcaattcaccgcattgcgcataaaaataaacaagagaactctccacaatgagattccccactccaactttcaccatattaccatgaacttgtctccctaactcaaactctgctctcctactacacagattcaacaaacacacaaacatcctctcgttcgtaaaacgtattccatgcttcacataatcctcaaacagtgcaaaagcctcatcctcaagaccatacttcaaatacccatcaatcatagcagtccaagtaacagtatttttctcaggcatactgtcgaacactttacgtgcataaaccaaatcaccaagtctaacacaagaactaatcaaattgttcccaaaatagataacttgatcatcaaaacacttcaacgccatcgcatggatccttttaatgagtcgcatcccattagaagactgtagccactccgctaacagagcataatcaactctttcgctatcgaaagaagacgaatcatcctgattcacattctctcctttgaaaccactaaaacccgaatcgaaagatgctctctttccagaaactaatcgaaacccaggtaatctcacgtgtctctgttcctctcgcttagttcttgaatcgctactgtaacatatcgtcggagatttgtaggattgagtcaccggaatctctgaaatccggagacgcggttggattaacgataacgaaaacattgtcggcg

SEQ ID NO: 3840 - DNA, 3000 bp, Unknown
  misc_feature (1)..( 3000): cDNA_ID_2992760_gDNA_ID_1620669_Annot_ID_164035 3000 nt of promoter + ATG
tgctattgtggaacgcatcttttttttcataaactttatcatataagaaagaacttgaaaaaaaaagagattctaaagaagaaagatcaagatgtctccaagtaacaagttgcagaagattcaacagcttcatcgagctcaatatctccacaagtagagagaattgttgcaaatatataatcatcaacttcaaatccctctgcctccattctatacattagcttcaatgcttccctgcaaaacccattcctcgcataacccattatcatcgccttccatgaaaccaagttcttctcaggcatactgtcaaaaacccgaaaagcttccgagacaaatccacattttgcatacatgtgaatcaaagcacttcccacaaagacatttgatagagcatgattcttctttgcaatggaatggattgatctaccgataagaagagattctgaattcgcacaagcttttaaagccgaggagtatgtaaatgggtttggctctacaccttcttgaatcatctctttcaagaagtctagcgcttccgattcatgtcctaagctcgaacatccagagatcatagcggtccatgaaaccacatctctagatggcaattgctggagaacattgaaagcgtcacgagattctccgcatttacaatacagccacaccaaagtacttcctatatagacattcttttcgatcgaattcttgataatctgtgcatgaagttccttccccaacaataaagctccaacagatccacacgctctaagaatgcttactactgtcaaattgttagcaatcaaatgccgcctcttcattatccggaagaggctgatagcttcctcaccaaaaccttcccgagcatgagcagctataatcgaagtccatgtgaccgtgtttctattactcattccatcaaacacttttctgcaatcagaaatctccccacacttagcatacatgtccatcagcgaagttcccacaaaaacatctgtctttatcatcctcttaacaaccaagctgtgtacttgccttccgaatcttaacgctttctcctcactacaagccttcaaaatactgcacaccgtaaactcgttaggcaaaaaccagtgattcaacattccgataaacatgcctatagctttaattccatgcccttttctcgaacacgccgatataacagcagtccaagatatcacatctttctcctccatcatatcaaaagctcgtaacgcacttgtcaattcaccgcattgcgcataaaaataaacaagagaactctccacaatgagattccccactccaactttcaccatattaccatgaacttgtctccctaactcaaactctgctctcctactacacagattcaacaaacacacaaacatcctctcgttcgtaaaacgtattccatgcttcacataatcctcaaacagtgcaaaagcctcatcctcaagaccatacttcaaatacccatcaatcatagcagtccaagtaacagtatttttctcaggcatactgtcgaacactttacgtgcataaaccaaatcaccaagtctaacacaagaactaatcaaattgttcccaaaatagataacttgatcatcaaaacacttcaacgccatcgcatggatccttttaatgagtcgcatcccattagaagactgtagccactccgctaacagagcataatcaactctttcgctatcgaaagaagacgaatcatcctgattcacattctctcctttgaaaccactaaaacccgaatcgaaagatgctctctttccagaaactaatcgaaacccaggtaatctcacgtgtctctgttcctctcgcttagttcttgaatcgctactgtaacatatcgtcggagatttgtaggattgagtcaccggaatctctgaaatccggagacgcggttggattaacgataacgaaaacattgtcggcgatggagaaagagaagaagcttcacacagagatctcccgccggaaaaaaaatcagataaagttctcttttttatttattttggtaaagagaattaaaagtttataatctgatctggtaattatgacgacaacaaataatatctcggtcggtttcaaattcctaagcgagagacaaatatacagtacacacacgacttaatatcaaaaccaataaacgtaaaacacgtgtctcatcacttcccactttcctctctgcatttgttgtctctctctcctgaaaacccttgaattttgctacacgatctctgaaacgtgtctctttgactgacttcaatcttctttatcacttaccgtttctgggttttatgaagcaactgagctaataaaaagcttcttcttagactcggaagaagataaaaaacagaatctttattgtttaaagcttccaaattcgagaagagaatttgaaacgaccaagttcaggatattcgtttcttcgtctactttggtctcttcctcttctctttcgaaaagggtttattctgtcttaaaagaaacctttttgagagggtaaaaaaagcttcaattttcagagaaacacaaaaggcagaaacagagaaaaacaaatcatctaattcatgaaacaggtgagaatacatattttcttcttccttggtctcttctttttttattgatttcattcatatatccaatttttgtgtctattggctgtttaattgttgacgatgatgaattcagttagataattatgtgcatagtttaggaattttttagctatatcttcttctcatgtgtaaacatagaggaaaatctaaaaaaaatatctgtcaaattattgtcttttccaaattgtcctcattgtcctattgaatcaaataagattttttattactgatgattcaaatattgttaatagtttataaccttgctcagtgttcttctgatgtgtgatttaaaacctcttgtctctaggctctgatctatgttttcgtctcaaagtcttattatcaattctctaaattgcagggttca

SEQ ID NO: 3841 - DNA, 3000 bp, Unknown; identical to SEQ ID NO: 3838
  misc_feature (1)..( 3000): cDNA_ID_3071987_gDNA_ID_1620669_Annot_ID_164034 3000 nt of promoter + ATG

SEQ ID NO: 3842 - DNA, 3000 bp, Unknown; identical to SEQ ID NO: 3837
  misc_feature (1)..( 3000): cDNA_ID_2031704_gDNA_ID_1620669_Annot_ID_164030 3000 nt of promoter + ATG

SEQ ID NO: 3843 - DNA, 3000 bp, Unknown
  misc_feature (1)..( 3000): cDNA_ID_2050286_gDNA_ID_1620669_Annot_ID_164028 3000 nt of promoter + ATG
tgatattggagccaccacaagactttcgatatctgaaatctgtgagggtaagaaatgtaagttgctttagaaatgtccaacatattacaaaagatggaactaaaaatatataaacaaaagaaatggagatggacttactgggttatagaacttctgcttcgagaaaccactatcaatcacatagacaacgccctgaataaagaaacgacacagaaagttactctcaatgatgtatcagcaatatctgtatgagaaatacatctgttcgttccatgggattttgcaacaaaaagacagtaaagaagaatccttgcctctagagtcaatgaagtttctgcaatatttgttgatagtataacttttctctttcctctgggagttggagtaaagatcaattcctaatataaaaaaggagaaaacaacatttcgccgtttcagttattcaaatactctcaaaagtatggtttagattgtctagagccttgcaacaaaattaacctgttctgatcgagaaagtcctgaatataatggaagaggtagcagtcctgaaaaagatatgaattgcattatggtgcttaaaaactgaaggcaaatgctaaagttgatcgacatgatcttatttatgtgtatatattatacctgaagaattcttttgattgctatgagcttcttcttcaagaagtttaatagcagtttcaatatcctcttgaccagtaagaaatacaagaacatccccaggtggctcctgaacataagaagagacaatttaaatacaagaacatacctggaaaataatatactaagtttgaacacattgaatggttataagaacatcaacttaaagtacccgttcattaatcaacagtatcgttgaaacaactgatcggatataatctgatacaggctcctcgacatagtgaattttcacactgaagcctctgccctaagaaattttgaccaagaaaacaaaaatatttaaatatcacataggaaaataggttatcagagaatgatcttacgcaagagagtcacaatatacctcaacagataagattgcaggttccaactttggtccaggggtactaccttctggcgcatggcgttttttgctacataatttaacataatgtataagattatatcgtactagtgattccaagagccctaaacttcaggaaaaagaactataaccattcggtaagatcagaacctggaattgaagaaattggacatggtttttgcttcgattgtggctgaagatataatcaggcgtagctcaggacgacgacgttgtatctgaaaatcaataataaatagatgttgctgaaagtacactaacaattaagactgtgtttgactgagataccttttttaagagaccgagtaaaatgtcagttgaaatagatctctcatgagcttcatctatcataataacactgcacaatgacaaataagaaaaggttttaccaacacgatttactcataatctgaacagattatacagtgcaacaaaatcattacctatactttgtcaagaggggatcctccatcatctctcgaattagtaccccatctgtgagaaattttacactagtcacaccctgttgtaaccaagcaaaagatcttgtaagcatcatcagaatactccatacataagaaaaagtagaagagcgttaaggaaagagtctgacggaagttgtatgatcttcaaatcgaatagtgtagccaacttcctccccaagattcactcccatttcctcggccactctcgcagaaaccgcctaagcaaattacaaaacaaagcatatatgtgatcaaatataaaaacttgagctgagatatcactcttcaaagttcaaacttgagttgtaagattttgtttagggagagaaaacaaacctggacagctaaacgtcttggctgtgtgcaagcaataactcggcctccttcagcccacccagcttctttcaggtactacaaaatataataaacaaagctattgagctaaacaagaagaccttgctattgatcgaattgtagttttctccaattctccaacttccccaacagctattgagctaaatattgcatgattttgcaagattttgagtaacttttatgcctctctctagctacattgcaaatatatcagcaagttactatcacaatccaaattcgcaagtcgcaacctttgactcctatcaaaatttgcctactggtctaagaaccttgaaattagcaaagctaggtgctttccccaaaaatattaacgaagagcaaagaatgaagaagaaacctgaggaatctgagtagttttaccactacccgtctcgccaacgataatggtggtagcgtgattctccaccaaatacagaatctcagttctgtacttgtacactggcaatctctgtctttgcttctctatattcgcatacccatagctacaatttcgactaagttacaataacaatcatctgctgaacaagtaagatcaaagagaaagagaaattagcatacctagaagaagaagaggatgcgagattgttggacatgaacactatgcctccttctccatcctcttcgaaacgaggtttctcggtccctggtttccaaaacgccatcttttcttcgcccaagagctttgccttcttcagttatttcagtttatgagaaggctttttctctcttatgtgcttttcgttgttaacgccgatggcgacacggttgccggcgattaacaggttcgggtctaaattttaggcatttggtttaaatgatttcggttcaatttaaaaaaatcaatttggttcggtttgatatcggttatatgttcaccattccttgggattatttaataattaaaagaaaatgtatcgtcttgcttcttcttcccacactactccaccactccataacaagctctcaccttttctcctccgccgtaatctacgccaccaaagtcaacgacttcaccgtcggaattgtcagatcagagcaatg

SEQ ID NO: 3844 - DNA, 3000 bp, Unknown; identical to SEQ ID NO: 3835
  misc_feature (1)..( 3000): cDNA_ID_2050294_gDNA_ID_1620669_Annot_ID_164025 3000 nt of promoter + ATG

SEQ ID NO: 3845 - DNA, 3000 bp, Unknown; identical to SEQ ID NO: 3834
  misc_feature (1)..( 3000): cDNA_ID_2050298_gDNA_ID_1620669_Annot_ID_164024 3000 nt of promoter + ATG

SEQ ID NO: 3846 - DNA, 3000 bp, Unknown; identical to SEQ ID NO: 3833
  misc_feature (1)..( 3000): cDNA_ID_1822229_gDNA_ID_1620669_Annot_ID_164021 3000 nt of promoter + ATG

SEQ ID NO: 3847 - DNA, 3000 bp, Unknown
  misc_feature (1)..( 3000): cDNA_ID_3610175_gDNA_ID_1620669_Annot_ID_164012 3000 nt of promoter + ATG
attgtaagctcaaactcgtctcttagcatttgtagcatcttcctaactcccgcttctccatccgctgcaagcgagaacaagctcggcctcccgacctaacggaacaagtaattaatcacatgtcctttggatatttatatgatcagtgataatactcatatgcagcaacgggacacacatttgtttcattgtttggcttcatttcgacaaattaaaaacaacttaataaaacagaggatatatttgggtttgttttgaaaatttagaagtttggtgcaaaatgttaacaatttgtaaaaatcaagaagagataatcaaggttattgcaatgaaactgaaaatgaaaggagcgatttgaaaaccgtgagagaaaacaggggaaatgacaagagctaagtgtatatgatgaatgaacttacaaagacacctgaagcgccaagagccaatgccttaaagacatcggttccacggcgaaccccaccgtcaagaaaaaccggaatccgaccctccacggctttaaccacctgcgatttgtgtttgcttgattaatcaatgaagaaagctgaaactttttgttttaacagttttaaatcttgatccatttaaaagtttacctcttctaaggccactatagttgcaggaacataatctagctgacgagctccgtggttagagactattatccctgcagctccatattcaacagcaattcttgctgccaaaaatttgaatgatcatagaaattatcttaaaacataatgaaaacttcaagcaaaaggttgatgcatattctcattcttagtatatttgttttaccatcctcagctgtaataacacccttgacaagaattggcaagcttgtgatagattggagccattttatatcctgtaagaagaaaacaaacagcgaaaagaagcgagtttactatgtttctgaatcttggtatgcaaaaacaaagaattgatcatgttacattttctgaccttccagctaagtgattgatcaacttgaccagcaacatatgaagctagccctgagtcattcgtctgcaattatccaccaaaaaaggttagttaactattgagcttttaggtcaattgaagactttgttatatgtcttttgaccttgtctattttcccaagatccaacccttcgaagttcttcaacgttagacctcgaggaagcgcgaatctgcaagagaataactatcaagaaaaccaaaagatctaacaatctggtttatgtgatggtggagtagtttcatatcacctgtttttgatgtcagattctctgcgtccaagccttggagtatctacagtaagagcaatagctttgaatccagcttcttcagctcgtttcacaagctgtataaccacatttctatccttataaacctgaatcaagagagcaaatagtcaacacagagccaaaaaatcaataagaaacaagtaaatcttctgaaacatacataaagttggaaaaaacgaatccctggtccggttgaagcaacttcctcaacactacaagtagcccatgaagataaagtctgaaaacatcaaacaatacagataatgaaaacacaacaataagagaatatccaatcaagtaaaagagacagagagaatgaatcaaaaccatgattgttccagcagcagaagtagctctcgcggttgcaagctcgcctacaacaataacaaaaacattctccatagtgaaactaaagttttcttcttgacaagaaacctcaagattgtgttttggttacactgatcattacataacactaaagacttaccatcaggatgagccattttctgcattgcagtaggagcaatcataattggcatagaaatattaaaccctaaaaccgttgtgctcacatcaatcttgcttacatcgataagaatccgaggcctaaatctgtttccagctcataacacaagcacatcaataaaaagacagagaaaggataaaaacacattttgagtccttgttgtgaatagtttcacttacagaatcctagagaaagcgtttcgattctcttgaagagtccattgatcttcagcaccagatgcatagtaatcataaaccatctttggtaatttctcctttgcgatcttctcatattccatcacgtttgttatctccatttttatttactcaacactcaaaaaaattcctgtgacagataaatacacattttcatcatcaaaatcactttttaaaacccttgaattcaagaatgaagaatcaggaacaaaaaacgacactgacactaaaaaaagtcaattagcagactaataaaatctgccccggctcagattctataatcacaggatcgtcactcgttgagtttgatattgatgaaaatctaacaatcagataaacaagcatcgacgagaaaagtaacagagagcttcttacctagaggcctagagagacttggtcttctcgggaaggtggcgaagaataagaatataagaacaaaacaaaatgttgatcgagtactcttaatataatatagacactcataactaagtcacaaagaaacatacgtctctgtgactgtgtaaataattgtcagtgattgtcacgtgatggatcacgtgaaacacaagctcaccagacaccagggcttttcatttgttacaacaacatgcatagtttaagacccattattctcaaataagatggaccagattagtcatttgtgatttggctccaattttatgatttataaaagagttgggagtccacaaaatattggttatattgtgagtgggtaatggatgttgttcagaggatcaggtagttagtactctgctgttttaaaatccaatagactttggttaacaaattgtttaaatcacaaaaccatttacggttcgaccgaaagaaccgaattttattctctctgccttatcacctctgagtggaaaaaattgagtgagcgccattgtaggagagcttcgggaaagaagaagaagaagaagaagcc

SEQ ID NO: 3848 - DNA, 3000 bp, Unknown
  misc_feature (1)..( 3000): cDNA_ID_1822181_gDNA_ID_1620669_Annot_ID_164040 3000 nt of promoter + ATG
acgtgtaactgtagatgcacacagagattgtgtaataccttcaccgatagggtttgtcgaaatgactaatatataaaatatttaaaagctaaacgtttatctatagcaaacaacaacaaaaatagagttaaaaagtatagtccaaaacttgaaatgaagatttggctattagattaatagggttggtacattaatgactgatggcttatagatagatatggataccatttcattttatcgttctgcttagaacttagaagaataaacaaaacaaaagcatgtgggaagagaaagctccctttaacacctcaaatatggctaagagtccccaacacaaatcctattaataaattcacacatacaacaagtgttcatgacctaaccaacaaattcaatagagcccacttttttgagagacaaagatgcaatactcaaaataggaacaattctcttaatatgtctaattacatttttgttactagacaagtcagcatcaccaacttcaaaactaatgaaccttatttaatgtaccgaccaaaagtttaacaaaataaatagtaaatttgctagatttttatcttctgatccaatctaatccctattacgatggaatcaagttcaaaacaaaaacatgtcacaagggatcataatcggaaaagcaatctttatgtataagatatagttaggtatgtgtacacatgtgttaatgtgtataaatttgtgtatattttgtatgttacagcaaactatagaagagacaagatgttgattttttgtaaaaggaccaccttcaaaatattattattaagggttttattaattgaaacatatacatatatacacacatatgaatagatatattcacccccacaaggttatgtgacattcttttcaattctctgttctttccccttcttcgacgctgctcaacattaatttctcctttcactttcatagtaattagctaagtttttttcctcaataaatcaatctaagaaacctctaaatgactaaaccacgtatacgtttataccttctatttttttttttgtctaatacaaatttaacaataaaacattttatgttgacaaaaaaaaatacaatcaaaattttaataaagtgacccatattcgagtttcaatgatgactgcaatcaataagttgcattgtaattaaggttcattagattatcaatatctcacgtcattctacttcatcatcgatttgttttatagtttaattacaattactaaatgagagttgtagtgtcatttgtcaaacttttttatttttattatataaatagatgtgttaattaatttgtgtttgatcaaaacacaaatagaagtttaacacacctttttttcgtcaagaagtttaacacacatgaacacgcaaaagaagggggaaagcaatatgcatgatgagatgtgctgagaaagcaatgcgggaaaaagtcagcatcaaaacagctctttctctttccaattgttctatgagtttaaatactgatggtaaaacaacatatacaattacaaactgttaggctacatatcttagtccatatgtatatcacttgattaattaacattttatgtacgtatctaacaaactttaattttagatgtgcgagttttattacattattggcttaagtcttataacgggattaacatctttaaaagattgccatttttgaactaatttcgaagtaatttcggtgacactaaaaatatcataattttcacacgcacaaacaaaaattcatgatcttcaaatcatcgaatgatcatcttattagttacttatattcacaatttaaaatgcacctcataccgttactactttttataatgcagtggcttcgagtactacatctatgatattacctattagattgttcaaattgtagttgatgatgatacgtatatagaatgatggagaacatattattaggtttacgaatagtgtcattttgacatatgttacatattacatatatacaccctaattaataaaaataataattcaacatacaaataaacccctatctaacactatgattaatgaaatgataatgacttatattcaaagtttattaaatttgaataaagggaaaattataatttttgtttgaaaaataacattaaaatagaaaacgtcatttattttgtgaaacagaaagagtactaattaaaagttacaaatttaatgtgggatttaaatcagcttaactagcattgaaacaattttaatgtcactaatgctgttatttaccattcttaaaccttatcgtcaataactctatcacccagctatcataacagtttattaccatacattttttttggaaacgagttattacaaatttcttcgaatcgagttattgccatttttacgaaaaataaaacaaaaattataattgctcatgatttcatatttttctatatatgattctatggtctaaccattgtcagcatttccgaacacaactgaaattgtcaaagacaaaggtaatctaaagaaaagaaccaaagcactccaaagccttaaagtgttctttactttggttttaaaatttgaatctaaaatgaacagaagaacgttcctcgttatatgtgtacactctctcaacactgtacttaaaaataaaataaagcacagtgtagtttcaatttcatatgctaaatgtaggattatttttccaacggtcgaaaaaagcttaaagcatttttaaccaattctttatttattttttaaaacattacaaacttttcatatttttattactctctcaagtagtctcatcttcttcttaatccaaaggcccaaactttgaatcatcactatcactctctctctctctctctatctctcaagaactgcacggacaacgacatgcttttaatttccatgcaaatctctcctttcttctcaagtcatttttgaaaatcaatcaaaaaactgaaacttggtggagcttttatcattcactcatca

SEQ ID NO: 3849 - DNA, 3000 bp, Unknown; identical to SEQ ID NO: 3848
  misc_feature (1)..( 3000): cDNA_ID_1822181_gDNA_ID_1620669_Annot_ID_48130 3000 nt of promoter + ATG

SEQ ID NO: 3850 - DNA, 3000 bp, Unknown
  misc_feature (1)..( 3000): cDNA_ID_1822172_gDNA_ID_1620669_Annot_ID_48133 3000 nt of promoter + ATG
cttgcaagatttaaatattggttttgcttaatgtttttatgatgaatacttagttcccactttttggtgcaattattgcatattgattggatgaaaaaaatacattttggaatatagaaaacatagagggatagacaagaacaacaattctgatggtccccaattttatgataaaagtcaattgttgatggcaggacatttgtaaaattgttttttgatactgttcttcactctattattgtttttttgcttgtttacatggtaaaactattatgtactacatgacaaattcagatatatacaaatatttagcaaaagtaaacttgaatacattgtttactttaatgttttgtggggttttcctatgtgcacgcctgtgaattttcgagattttctctattgtatcttcttgtctgtttcttttgttgttgctttgggattataatagacaaatcaatagggaatggaatcagattctctgaagactttttatgccttcattgtcactctttgagtcttaatgtttagtgtagtgtgctcaaattggggtctgtgcaacttataagtcatgcaaatctcatattttttgaggaacttggaatttggtaaagtatgaatgttttgaattgttgtggaatgtgatttcagattaaactggcatccgtgaaactagcgatgaagtatatgaagagagtatccgcagagctagaggctattgaaggtggtggccctgaagaggaagagctaattgtccaaggtgttcgattcgcattccgtgttcatcaggtaaagttaaaagaccttgatcatcttctctttcgatttggttctgttctgttacaatattaaactcttaaaatctgttttgtttttgttcagtttgccggaggatttgatgcagaaacaatgaaggcatttgaagagctaagagataaagcaagatcatgtcatgttcagtgtcaaagccaaacacatcaacataaactttgttttcgatctaccccttgttaaagaagcaatcttagcttcatatataatccacctcttgttgtcattttctcgatttaatttgtttttttgttctttcgtcttaaaagacctataactcttgtgaatatacgttctcgatcgtcttgctgaaaaaggattaaaacagttgatattcaaaggaaacccatcttatcatatgtactgataaaagcttcacaataatgtcgcggctaagaatgaaatattcaaatatttcaaagagacagcagaaataaaactaaatccattgccctaaaaccccaaacttcaaaccctgcaaattttgattgcacctcctagttacacaacaaaccactcatcactgctgtatccagcatctttggctttagactcatcatcaccgactgcatcttttgagagttccatctgaaaaccaaagagacgtatttgttaggaaaatcaaaacagaagaaaggatatagtttcaagacatgctaaaagttatgcgaaactagaatacacaccatttgaatagctcctggtttctctgttttaacattgggcataatagcttcagctttgtctacgactacatattcgtcatctgaatgacctgatgatgcatacgtcagaagttaacaaagacattacagatcgattaaaaaacgaatggacaaagaacggatttagttacttgcactagtctcattcacaaagcaaaaacaattacctttatcaccttcaccactctcatcatcagaatcgttgtagaaatcaaacgtatcaacagggggaattttcctacgaggtcggatcagatatggtaaaggaactcctgaaaacgacacaaaatttcctgattaaaaactcaaaactcgaaacagaaggaacctaaaggataatatcaaatggtaaaaaacaaaaaaggtgaaaagtgagctcaccgttgcagcctcccctcttccgagaatgcagaacagaaacagcatgaactggtgccaatgttgccatgtcctgattcaaaaatggtacctgttagcaattgcaacaacttttatgagaaacagagagatcagcacaaatctaagaaaaccctaaaaacgatataagctaaccagacaaagaagagataacgaagaagaaacctaaagagattaagaaatttccacacaataagttaacatctttgtataccaaatcggcgaaaaccatcttaaaacaagaaattcagatcgttcgaaacagaaatttactccgcaagaaatataacgcaaaccctaattttccgtgtgatcatataaacagaatcaaaaccaaaagttccatagaaaaatagcagaaaaggagaattatttcaaagaagagatgaattctcaaataaacataggattaccttatcgaagattcagagaaaatcgtttatcagatcttgagaaatttgatcgtcgacgaattatcaaaactcagtaagagaagaacaagacatcagcggtggcgaaaactagagattagcgatgaacagtaatcttattagcgatataaatagggattatttactttttattttgtttcccttttctaaaccttttccaattaatttatgttggctgacgtgtctctgattaaaccaatctcgagcggttcagcttccaacaaaccggttcggtttaacactattaatttctcgacctcgctcctatcttctcctctcattcgtcaatccagagactagggttttcttcccgccgaaacctcaccggaaattctctccggcatctcctaattcgtcaatcgggtactgttaaatcacaaggctttagtaatttcttcttatacataggtctaaatctatctgcttgatttgaaatttggattttggtctaattagggactgacactaccaatttacttaatgatttgaggataattacttcgattttgacttagatgatatgaatttgatttagtttcagtgagaaagacgaatgaatgttttgatttttatagaga

SEQ ID NO: 3851 - DNA, 3000 bp, Unknown
  misc_feature (1)..( 3000): cDNA_ID_1822168_gDNA_ID_1620669_Annot_ID_48134 3000 nt of promoter + ATG
tagttaattacgctataataactaaatatcatgtaactcagtataaaaatattacagacatatataatgatttctttacaacaaaaactaatatttaaaatcaatcgttataaaaccagagttatttttatttagttttattttgattttactattattttagataatgtgaatgctctgttaattttatagacaaacaaatatttatatatttgaatagaagaagatctattcaatgagattttatcctattttcatatatttggttatatattatgtttgtattttgttaatgctatgttcacacgttactttctatgactttttttgtcatcatccaagaaaattaatatatcaacgttcacaaaacaatcaaatatcgactttgtaataatatatactacaaattagtacgcgttattattatatagagcaaaaagagagaatatatttcaatggatgggacccgtgagaaggtgctttcgttccttttataaattttattccaaatgatcaaaatttgttattttatttggtttgttaattatcttttttggtcactgatgtggctagctatttactttacacactgttatgatatactcttcttttaaaattccttaagaaaatattagtttaagctatccattgtacgactagcaaccaaatcaatcattataagttttaataatggtttattaattaatttctccaacttgcttaatttagtggctattgttgaattatggagcctattacatctataactttatacataagaaatagataatgaaataattataataattacaacaataacgttgatgaatgatgacgacattgaccgtcatcatcctactcgtagcaatacctactaagtttgtttctcctctttattttcgaaaatccaacggtattccaatttgtgatgatttctataaaagtgctttttcatatacgtgaaatgaaaaaatagtaacaccatattcatatattagttgatactttgtagttgtatatacgtggaatattaactataataacatatctttgacgatacaatgagtgattgcttaagcataaatgtgtctgaaagtggacgacgcataatatatagatttccattatcttacccatgaatgttaaaagggacaaaacaatcctcggtcttttcttttgataatgctttacaatttttaaggtacaattcaatgactattacgtgtatatgtgttcaagttattgaaattaattttcaaatcaatacgtgtcgatgactgacatatacacaacttcaaaatagaaatgtagccaatctattaatgtgttgttaagaaaaaggcaaccctactagaatgtgtacttattgtgtataactattgttttctcacggacaagaagtactagttcaaggaataagttcaaagacagaaatacataaaaagcatgaaaatagtgaaataaaagagaagacataataattaaagacgcgcatatatattatttgatacacacatttagtaccctttgtcgggaataaaaatactgcagacggtgaaatcaagattccggtgaccggagaacaggaatccgacgagaaaaaccctaagtaaaaagcaagattttgtaagagaagatcttgtgtggggctatatatctttcgatatacttttgtcacaacatcaatagaaatccactcaataccaaaacaaaagataagtataaaaaggtaataaataaaaattcacgtgggacttgggtccatctgttttttcacctgggaacatatgattcatatatatctattgtatttgtatttttttttgcccttagcaagaatgccttttcttttgttaagaaagttacaagactgtctatattgcatttttttcctttagttatgatacgaaatgatggcgtaagtcgtgactagtaatcaatcatcttttaagttaatggaaagaaaaaccgttggaatgaatatgccattgcagtgtgttaccagtaataaaccatgtaaaatcttctataatgtgctctaaagctactttgaaacaagtttctctgtattttttttctttctttctaatatcaaccagaagacaaaaaaagataatatatatgaatgttggttttgttgtattcataaaagacatagagaaatcatatctcaaattttccaacttttttagtgataaaaatactcgacactctacagtttctgaagattggtatgcagggccggcccaagtctttttgttgcttaaagcaaaaatgtgtttgacccattaataatgaggtattgaggaaaaaaaatcaaattctgacaaaagttagactcaaactagacacatagaagaaggttattcaaagcgttgaccactataccaccaacaattttacaatttgatgcctcaaattttgttactaaaatgtgatgcctaaagccctagcttcaccatctttagctctgggccgggcctgttggtatgttatatagcccacaatcctttggttacataaaaagtataaaaataataattcatcagctaattttatattggtatgataatattttgtttgtgaacaaattctatgagtcatatttttttcagtttttttttccttctttgtaaagtaagagcccagcaatagtatgataaaataagctattgagcctaataacgataagcccaattaaggcccgtatacatgttattatctcaggcccatacataattacaaaaaaagttagggacgtaagaacaaataaaaatgagaaattatctggaaaagctgaatcaaatgtacagacacatgagactgagaatctaactttaggcttctctaattatgattcatcagagactttaattaattaggtttcaaatttctaataaagaagaagagtcaaagtgattaaattaaatggtcacagcttttatttattaagctctgtttcatttctgctgcgggagagagaaagagagagagacaatg

SEQ ID NO: 3852 - DNA, 3000 bp, Unknown
  misc_feature (1)..( 3000): cDNA_ID_1822276_gDNA_ID_1620670_Annot_ID_48135 3000 nt of promoter + ATG
tcataccgtcatcgattacgcttgaactctctaatttcgtctccgatgtgattgaatcagttgattctgtatcagagccatgatgaagaagctcccaatcatccatgatgatcgaattcgaagatttcagattgggattgcaataatcagaaaccctaatggataaaaccccaaatattggaaaaggatcgcaacaaattagagcggttgatgatggaaaagaatggttcttatccactttgagaaagtaattacgtggaggtatctaattggttgcgtgtcaatctcagtcctcaactaaattttttggcattaaagtttagtagattcagagaactatagtatttattcattttgttctttcatttttattttattttttaaaacgatttaattaggattcggcaataaatcgtatggtgcggatcaaatgaattaaacaaatatgtatcggttaaaatagagtagacgatgtaagaaaaatatatataatcaagattcaaacggttgaggtgggttttgcaaataaatccatcggtagattgaaatattttcttatttattatttatagattagtatttataatagtactgaccaaaaatatagaaaaaaaaaatcggtaaaaactttagaccgattttatatagaaataaatttagtttataacggattattgtccgctccaaaattaaatggtttagtctctaatagtttagtttgtttcgaaaagaatggttcttatccactttgaggaagtagttatgtagaggtatctaattggtcacgtaacattctcagtactcaactagatcttttgacattaaaggttggtagattgagagaagtatggtatttattccttttgttctttcatttttttggtttttcacaatgatttaattagggttcacgacgaatcgtatggtgcagatcaaatgaattaatcaaatactagatgatttacccgaactatgtacagggagaaatagttatatgaaatatataaacaagtttttggaaacagattttatattatcacttgatatataagtgtgaatatttgaatatgatttagtaactgatatattttggagattttattagttaggaattaggatattctatatttggaataagattttaaattaaaatattgacccaaaagaaaatctgaaatatcattcctataattcagaaatatattcgaatattttttgtattttataagattttattttggaaacaattcaatataaaaactgaaaagagtatgaataattatgttttaaacgtaataaatttttgattatcttttattattcttcataattctatgtagttaggattgatttattgcatatcccttattttattaatcaatttatattgttacgataaggttttgggttgtaaataaattttaactaaaatgagtaaatgactaattaaattgaataaactgtgtaaaagttttaataaattgataaggtaaaaatttgaaaagaaataatattgaaagtaatcagtaagcggatacatttttaacatagattaatattgaaatattgttcatagtgaatgtgtaataaatgaaatgttactaactaatttatgtaaaactatgttccgaatatattcaagaatcatatgggctcacatatacatttagattttttgcaatttataacaaaaaaatagaatgtcatatatgttaaaattctaaatgttttctataaaacctaaaaaaataaagtacgaaacatataataaacatttatattatatgttgttcatcataatttatgatatatactttttacttgtttgctcaaatatatatggttttttgattaattttctttattaattgctactctcttaaatgtagaggaaaaatatgcataagtaccactaatggcattatatgtaattagtctagtaaatattggataactattaagtttgttgaaagtttttctggttacgacatgtcagcatgatagtcttgtaaatcacacgtgaatgtaaggttttttatttaaaatacttctcaattaatatataggggatgtatcagttaaaatagagtagacggtctaaaaccatctccaatgcacacctctatttttttctttcattttagagacaaatttattttagaggaaattagattttgctccaatgtattcttctaaaatagtttttttctccaaaatagagaaaataaatagattttactctttatatagattaaaacgtaagattcctttattttagagaaaaatctattttagagacatatattgaagcaaaatgtatctaacatagaatcacctctaaatggagaaaaaaaatagagatggacattggagatgtttagaagaatatagattcgagcggttgaggcgaataaatctttctgtagattgaaatgtttattatttattatgaataaattatcatataatagtgtaaaccaaaaattatagaaaaaaccccgctaaaactacatacccattttctagaaataaacttaggttacaacggattgttgtctaccccaaaatttggatggtgtaatctgctaatggtttagtccgcttcgagtaacatttaagcaaatcgttagtataaaatgggtaaaataagtgatactcaaatacatattaaataatgtcaactttaaaatattttaaatatttttcatgtttcaaataattttcttacaaaatatatcatttaaattcttaaagaataaacaaattttaacaagaaagtaaacgtgaaccatacttcaattcttagtccaaatgtagttcatacaaatatgacaataatttaacaaaaaataagaaaaagtattcttccgggttaaaaaaatagattcgatcaaacttaaggtcttttttgttaaagtcttcttttcgcaaaaacctaaaatctcctctcctttgtactctcaagcttcgttttttcttcttctccgtccaaatttctcc

SEQ ID NO: 3853 - DNA, 3000 bp, Unknown
  misc_feature (1)..( 3000): cDNA_ID_3072039_gDNA_ID_1620670_Annot_ID_164069 3000 nt of promoter + ATG
cacagtcttctattagtattacttttccatttagtggcgatggaatagctagctgctcatcgaaccctaaggctaaatcgaggagattcaaagaacgatccatggagaaatttggacggagaagaagaaaaaacgaagcttgagagtacaaaggagaggagattttaggtttttgcgaaaagaagactttaacaaaaaagaccttaagtttgatcgaatctatttttttaacccggaagaatactttttcttattttttgttaaattattgtcatatttgtatgaactacatttggactaagaattgaagtatggttcacgtttactttcttgttaaaatttgtttattctttaagaatttaaatgatatattttgtaagaaaattatttgaaacatgaaaaatatttaaaatattttaaagttgacattatttaatatgtatttgagtatcacttattttacccattttatactaacgatttgcttaaatgttactcgaagcggactaaaccattagcagattacaccatccaaattttggggtagacaacaatccgttgtaacctaagtttatttctagaaaatgggtatgtagttttagcggggttttttctataatttttggtttacactattatatgataatttattcataataaataataaacatttcaatctacagaaagatttattcgcctcaaccgctcgaatctatattcttctaaacatctccaatgtccatctctattttttttctccatttagaggtgattctatgttagatacattttgcttcaatatatgtctctaaaatagatttttctctaaaataaaggaatcttacgttttaatctatataaagagtaaaatctatttattttctctattttggagaaaaaaactattttagaagaatacattggagcaaaatctaatttcctctaaaataaatttgtctctaaaatgaaagaaaaaaatagaggtgtgcattggagatggttttagaccgtctactctattttaactgatacatcccctatatattaattgagaagtattttaaataaaaaaccttacattcacgtgtgatttacaagactatcatgctgacatgtcgtaaccagaaaaactttcaacaaacttaatagttatccaatatttactagactaattacatataatgccattagtggtacttatgcatatttttcctctacatttaagagagtagcaattaataaagaaaattaatcaaaaaaccatatatatttgagcaaacaagtaaaaagtatatatcataaattatgatgaacaacatataatataaatgtttattatatgtttcgtactttatttttttaggttttatagaaaacatttagaattttaacatatatgacattctatttttttgttataaattgcaaaaaatctaaatgtatatgtgagcccatatgattcttgaatatattcggaacatagttttacataaattagttagtaacatttcatttattacacattcactatgaacaatatttcaatattaatctatgttaaaaatgtatccgcttactgattactttcaatattatttcttttcaaatttttaccttatcaatttattaaaacttttacacagtttattcaatttaattagtcatttactcattttagttaaaatttatttacaacccaaaaccttatcgtaacaatataaattgattaataaaataagggatatgcaataaatcaatcctaactacatagaattatgaagaataataaaagataatcaaaaatttattacgtttaaaacataattattcatactcttttcagtttttatattgaattgtttccaaaataaaatcttataaaatacaaaaaatattcgaatatatttctgaattataggaatgatatttcagattttcttttgggtcaatattttaatttaaaatcttattccaaatatagaatatcctaattcctaactaataaaatctccaaaatatatcagttactaaatcatattcaaatattcacacttatatatcaagtgataatataaaatctgtttccaaaaacttgtttatatatttcatataactatttctccctgtacatagttcgggtaaatcatctagtatttgattaattcatttgatctgcaccatacgattcgtcgtgaaccctaattaaatcattgtgaaaaaccaaaaaaatgaaagaacaaaaggaataaataccatacttctctcaatctaccaacctttaatgtcaaaagatctagttgagtactgagaatgttacgtgaccaattagatacctctacataactacttcctcaaagtggataagaaccattcttttcgaaacaaactaaactattagagactaaaccatttaattttggagcggacaataatccgttataaactaaatttatttctatataaaatcggtctaaagtttttaccgattttttttttctatatttttggtcagtactattataaatactaatctataaataataaataagaaaatatttcaatctaccgatggatttatttgcaaaacccacctcaaccgtttgaatcttgattatatatatttttcttacatcgtctactctattttaaccgatacatatttgtttaattcatttgatccgcaccatacgatttattgccgaatcctaattaaatcgttttaaaaaataaaataaaaatgaaagaacaaaatgaataaatactatagttctctgaatctactaaactttaatgccaaaaaatttagttgaggactgagattgacacgcaaccaattagatacctccacgtaattactttctcaaagtggataagaaccattcttttccatcatcaaccgctctaatttgttgcgatccttttccaatatttggggttttatccattagggtttctgattattgcaatcccaatctgaaatcttcgaattcgatcatcatg

SEQ ID NO: 3854 - DNA, 3000 bp, Unknown
  misc_feature (1)..( 3000): cDNA_ID_3089354_gDNA_ID_1620670_Annot_ID_164074 3000 nt of promoter + ATG
cattttattaagaaaaatatgaatgaaacgaaaactaaactgtgatccctcttaattcatttcttttaatgtgtaataatttgtttataatagtatttttttataatatttgggaatttgatattgacataaattttagggtcattgttttctaagattataaccaaaacctaaaattccaaactaccagttatattataaaataagcaaattatagttataatcttgtgtctatattggactttgatataatatttaaaagataaaatgaaatgcattactacacaagccccataatgaatatgtcaaggaatatccaaaaacgggtaaggagctttgtgaccattcgactctttctacgattctagttcttaagtaaagctttcacacccattattcacagatttaggataacgtccacttgcccaccgaaagagactcttagacttattgtgacaacttcaaagtattcttcaatccagtagagatttttcagatatttattagagtaaatctgttaattatatagggctcattgtttgtcagtttattgatggatgatacactgaattttttttgcggtgaaacttatgtattggtgttttttttttctttctttctacatcaatctttttcttttaagagtgtaaagctcagcccaaattcccaacagtcaaaaagttaattgttgctttcattggtaatcatattaaagacagttaaagatataacccttatttagttactatttaccaatcatacaagcagataaaataggcaattgaaaataaaagttcaaatattaactaaccacatatttccgatgcagtcaaatatttttcttaaccacatactaatatactatcaatgaaaagaaaatctcattattttttccaaccacaactatttcttttttttttctacctttctcgatatctaaccgtatcatatcacatatgcaaacaacatttcttagagttgactcttttgagctctaaataaagatagattgacaaaaaacaattttttaatttttattgacgcattcaactttaattttctaaatatcaatcaattcttacaacacactaattttttttctagctggttgaccttctctggtatatctgctttctatttttagtttttgaataaaataaaaatctatttttagtatgtgttaagtatatttattaagaaaaaaacaacgttccaagtaagatacaaaacgtttttacaaatctgaatcatgaaaaatgctacttcacttataatttattgttttctcatgttcctccttatgaacaatgttaaaggtaatatcttagtctcgttaagatttaactaataccttattcacaagatcgaaaacattgattatatctataaaacaaatatgcattaaaaatagagctttcatttttttgtattatcaactaaattctatatattttatacttttttattgattgaaaatagggcagggaaaaaaaaaaccaccatgcccgcttggactgtcggcaaacggaaaatgtgggcatgacggacctaagttatgttttagtgaaatggaacgaaaatttaataaagatgtggttaaaactattacccactgcaagtgctgggatgatcgacgcaacaatgtggacaagcatcggtgcacatgttatttaaaacatggttttccttgcaccaatggctaagtttgaagttataagatagttttgtttatggcaaatgttactggaaaatcttcaaaaaacagctccatttatttttcatttgtatgtttactatccaatactttttggttagaaataaaaatacctcatttaattttttttggcctaaaaataaattatctttaaaaagttaattacaaaatagacatttgtcttaagaatttatttattttaaaacatttctgatatgtctttacgaaaacaagtatttctctcatgtgaaaaatcatctctaacctcatttcatttgagtcatcttctcaaatcgagaaagtttaattagtgttgtagtgttgtgtcgttgtgtctatgtatgcatcgcagactgtcgactaaacggtttgggtttacaagtccaattctagagtatagtgttttgtgaaaaacaaaaaattatgttgcgaaggaccttctctgtcgttgctttgagacaccaagaagcgctgcaccaccactgaagctgtttgccaccatccaccattgatgccattggcgaccctccaccatcaaacccgtgaaccaccatcaaagctttgtgctacagccgcttactgcagaaggttaaaatcgtccaaaattgaaaaataaacggccactgttgcattcaactgtgcaacatacttcttttgaaattactaaatctaaaatgcctatttttgatataaactcatctttaaattattggtagattcgaacacgcgacttaagagccgttaacggatattacatcatataatttattaaggtaagaaagatttttaaattttttcactgattcaaaattttaaaaacgaacatatattaatcaattgatgaaaaatgtgtggatttaacatcatacattggctaaaaagtttaaataataattcataatcatataataaataaaactaacaataataaaactaatgagatttttggcgggatgttacttaataacaattgtaaactatcagatatattttttctttataaatacatacaattttcaaatttttttatatactaaattttataaatcgttcagtgtagcgcgggtaaaaaatctagttaaagattttttgaatacttttaaaatatagaggttaatttagtcattttctcatttaaaacaacaatttttctcaaaatcttgtaaattacaattcggccctctcgaagtttcttcatcttctcttcaatttttaaaacttaagcttttgatttctcgattcatcttcttctcagctttagggtttcgattgttccgatcactatg

SEQ ID NO: 3855 - DNA, 3000 bp, Unknown
  misc_feature (1)..( 3000): cDNA_ID_1822266_gDNA_ID_1620670_Annot_ID_164080 3000 nt of promoter + ATG
cgcgtccgtgggagtgatcaaagctgatgtgttcatcatccatatctgaatattctgtatatttttgtttatagaatgaatcctattgacattaaaatatataactttggatgagtctacgtatggccttttttgagatgttgctgacattatcatatactaaaataataaagtgcaatgtggttcactcgcaatagccgcattttgtcaccatttaagggaatttactatttttgtggtgaaattatgtaaattaccacatgttaaaaaaagaaaaaatattagatctcacaacttcatttgaactagggaacggttgacattgttttttttttaaatagttaagaaaatttggaaataattttgaaaagtaactttgacataaagaaaatcttgagaattgatcttttatttgttttcagaaatgattaattttatgatgatttttcttgaatcatagaaaagtcatataggaattgctccatgaacaaagcgacaagtttctccgtcatttagaagatctgtagataacatttgccaagaaaggactcacaatcacttctcaaaatgatccagctgacgagccattgatcgaaccatcttatagctgacaagacatttaatgaaagtcgcgcttacgtcacttacactcaaaacacgttcttctttctaagaaatcgtcaaaaaaaaaaaaaaatagattgcacgaaaatgccgagaatacaacttggaatgttttaactagtcccattaattcgatattttacctaggtcaagtaacactcttataaataatccttgcactctcgaagaaaaagaaatagggagtaaggtaattcaccagttcccaccttaaaagtaaacctaacttgctatatctaaatacaacaaaatttcactcatgaggaggagaacagttcacggatcatccaacttgttctctctcattccttctttcttattctcaaatggacatcatcgtgtttcaaagattttcagcacttattacagagacaatctacatttctacatctcattcattttgtcatttgtaatcaagtcattcaagttaaataataaaaagtgtgttttttctttcaaaagtttgtaatcttttgaagctttgtcaattcaagtttattggtgtgattccatagtcttgtttgattgcgtttctagtgtgtttgtgagattcaaacattctagttcgtgtgttgttgtggattcaacgacaaaacttccattttccatctctaccatcgttccatcgaatcattcaaaccgtaggccgagaaaccgagaaacataaaccttaggtaaattccaaggtttgcatcagattgctttgaccaaggctcataagtcattacttgacaccactctatctttcacgaatttaagaatttagagagactttgtgaccttttggatatggttagatctctgttattatttggttttgagagtcattggtaattgattcaacatctttatcacttaatagtgatactttttctatgtgtttttttttgttggttctatttggcttaccctttaagaattctagtggtcttgtatcttcctatatatctaataacatatggttgtttctatttcatttattttttatatttaccgcgacacgcatcagaaaacgaacttggcaacttaacaaattagctattaatcaatggacatgacatgtacatgccaaattaaattgggcttaataaaacacgtgttcgttggaaaaaattaaatatgttttgtatttttatagttaatagtgtaacgatttatcatgatctgcgccgaaattcacgctcagagttatatttgagttctttaaattattatttataaaaagtaagtcagaatatgaaaaaaccggaaacatcgatcacattaacttaaaagtaataatttttcattttaggatatattttggataccgacagctttgtcactacatcgaacaattttatgtttttttagaatttgttaatatgatgataccatttgatatccaataagatacttatttactttatattattagattagaatcatctacaacataaaatctaattatttagatgagtattatagatttgttacctctcgagtttaagatcgataactcatgttgttgaaacaagaaacataaaagatagttctgaaatttaaaacataaaagagagtttgaaattgaaaattatatatattgtagaaagtttatgacaagaggagaaagtatgattcttttagtatttgtttctatataatattaagaggaaaaagtaaagttcttatagaatatattctttcaagcaatttagctacttccagctaaatcattaaactcctttgactagcaaattaaataaatttaaatcatataaaggtaaaaaaacacacataaaatattagttttaagaaagatgaaaacaagtaaaaaacataaacaaccgaacatgtgtcaattgttttcagcagtctaatactcgtgtgactggccaatttaatgactatgactcactttcaactacctaacggtttcaaaacatgttaaccttgttttttttctttaaacaaaatcccattagttgtcactttaaatctctattattatagtaattattacaatctttttttaagaaacacttagtgacccatattaagaaaaaaataactttatttttaaacccatatcttatattttgtatctatccaattccttcctattatgtaaatttaattctatattattatattttgttgtgacatcttctcataaaataaataaatagctatcacaatttgatagcacctgaatacttcacctgaaactttccccacctctctctctcatcttatctatcaccattgcttcatctccaaatcttgaaattctctgttttattttcaagaaaagacagaaagtgaaacaagtcttttttttttttttttttggtgtggaacattgatatttgagtgacg

SEQ ID NO: 3856 - DNA, 3000 bp, Unknown
  misc_feature (1)..( 3000): cDNA_ID_1822270_gDNA_ID_1620670_Annot_ID_164076 3000 nt of promoter + ATG
taaatggagctgttttttgaagattttccagtaacatttgccataaacaaaactatcttataacttcaaacttagccattggtgcaaggaaaaccatgttttaaataacatgtgcaccgatgcttgtccacattgttgcgtcgatcatcccagcacttgcagtgggtaatagttttaaccacatctttattaaattttcgttccatttcactaaaacataacttaggtccgtcatgcccacattttccgtttgccgacagtccaagcgggcatggtggttttttttttccctgccctattttcaatcaataaaaaagtataaaatatatagaatttagttgataatacaaaaaaatgaaagctctatttttaatgcatatttgttttatagatataatcaatgttttcgatcttgtgaataaggtattagttaaatcttaacgagactaagatattacctttaacattgttcataaggaggaacatgagaaaacaataaattataagtgaagtagcatttttcatgattcagatttgtaaaaacgttttgtatcttacttggaacgttgtttttttcttaataaatatacttaacacatactaaaaatagatttttattttattcaaaaactaaaaatagaaagcagatataccagagaaggtcaaccagctagaaaaaaaattagtgtgttgtaagaattgattgatatttagaaaattaaagttgaatgcgtcaataaaaattaaaaaattgttttttgtcaatctatctttatttagagctcaaaagagtcaactctaagaaatgttgtttgcatatgtgatatgatacggttagatatcgagaaaggtagaaaaaaaaaagaaatagttgtggttggaaaaaataatgagattttcttttcattgatagtatattagtatgtggttaagaaaaatatttgactgcatcggaaatatgtggttagttaatatttgaacttttattttcaattgcctattttatctgcttgtatgattggtaaatagtaactaaataagggttatatctttaactgtctttaatatgattaccaatgaaagcaacaattaactttttgactgttgggaatttgggctgagctttacactcttaaaagaaaaagattgatgtagaaagaaagaaaaaaaaaacaccaatacataagtttcaccgcaaaaaaaattcagtgtatcatccatcaataaactgacaaacaatgagccctatataattaacagatttactctaataaatatctgaaaaatctctactggattgaagaatactttgaagttgtcacaataagtctaagagtctctttcggtgggcaagtggacgttatcctaaatctgtgaataatgggtgtgaaagctttacttaagaactagaatcgtagaaagagtcgaatggtcacaaagctccttacccgtttttggatattccttgacatattcattatggggcttgtgtagtaatgcatttcattttatcttttaaatattatatcaaagtccaatatagacacaagattataactataatttgcttattttataatataactggtagtttggaattttaggttttggttataatcttagaaaacaatgaccctaaaatttatgtcaatatcaaattcccaaatattataaaaaaatactattataaacaaattattacacattaaaagaaatgaattaagagggatcacagtttagttttcgtttcattcatatttttcttaataaaatgaaaatgataaataattggctaaactataataaaagaaaaactacatattttgggtagatgaaaaaaaacaatatccatgaatttgtcatttgttgttcactcgaataataaatttcatatttattgctatattacaattttgagtttggatatttcccctatgaaagaaaagaacatataacatctttgttgtctctttttccatgtcactcgttccaatctcatgatcccatttacactcaagatatattattgtgcaaatgagcatcaacatgatttatatagactttaaagtccatactatttcagttaacctttaccatctcctactcagattcttcttcaactatagaaaccattcacattagttttcgggtttgaagtggcttaaaggtatccaatttgtgaaagcctggaatatgctctgttccattacctccacatgccaaaaacagagctaactacatacttatacgactttaaatcccttttcttcacgtctctacctgcaataatacacatcatcatattacactcatctttctcaacctcaatcatattcacagaaaacaaacttggtcaccgtgtcgaaaacagggtttaatcgagttagttatttagaggttttggtcccgaacaaagacgttgaagttcagtgagagattgagaaggcagactcgagaaaacatgaggctatagaaacaagtctaatgggaacaaatgaagaaaaaggccttgtgccactcattattctctatctccacaaaagaaaagaagagacaaacttgaaaaaggaaatgggtgattcttattcttttagagaatctgataatgcaaaaaaacttactaaaaaagaagattctctttgagattaggacagaatatttgtctttccagagtttaacggttataacatgacgttgtaatatgccatctgagagatgataatacaaataacaagaaccacaccaaagttaagcaaatatttgaaattaaatatcaagaaataaaagagtaaagagaaaaaggagggaccttttgtatgagattataaaatgcaaagctaagttgatatacaaaactaggcctctcttccaccctatagctgaaggagattcggtatgtaaaatgccgaaaaatcgaatttgttccttttatctattgctgtgtgtatagatgtttatgtaaattttgtcaaaggagttttcagtgcaacaatcagagag

SEQ ID NO: 3857 - DNA, 3000 bp, Unknown; identical to SEQ ID NO: 3852
  misc_feature (1)..( 3000): cDNA_ID_3089358_gDNA_ID_1620670_Annot_ID_164071 3000 nt of promoter + ATG

SEQ ID NO: 3858 - DNA, 3000 bp, Unknown
  misc_feature (1)..( 3000): cDNA_ID_2050395_gDNA_ID_1620670_Annot_ID_164068 3000 nt of promoter + ATG
tttagttgaggactgagattgacacgcaaccaattagatacctccacgtaattactttctcaaagtggataagaaccattcttttccatcatcaaccgctctaatttgttgcgatccttttccaatatttggggttttatccattagggtttctgattattgcaatcccaatctgaaatcttcgaattcgatcatcatggatgattgggagcttcttcatcatggctctgatacagaatcaactgattcaatcacatcggagacgaaattagagagttcaagcgtaatcgatgacggtatgattctttctgatcatttctctgctactgatcgggtgattgaatcgggttattttgattcttttcgggttgattacgggtcggagtgtctgaatccgggtgaggttagtgttgattctggtttggatcagttcagtgttagtcaatcgggtgatgattgtgtcagaaatgaatttggggtttatgattcagaaactggaattttgggtgatggtgaggttaggcttagtgattttgaagctgccaatgagaaatatgttgagagcgaagctgctactgaattaactggtggaaccgtatctcactatgaaacagagaatctcgaagaattcgttgatggaaggcacggtgagaacgaatcgggtgttgaagaacctattgaggattcgagcaagttgtgttctgatttagggggaaatgaattggtttctcgagattctggggttgtgaatggtgaaaaagaagttgtttctgatagtgtagttgcttctagtgaagtaattgagggaagtggaggagatactgtggaagttggaggcgtgagttctggtggtgagggtaaaagtagagagactgtgtggtggaagatgccatttgtgcttcttaagtactctgtgtttaggattggtccggtttggtctgtctctatggctgctgctgtgatgggtttggttctcttgggacgtagattgtataatatgaagaagaaagctcaaaggttccatcttaaagttacgattgacgataaggtacactatattatcattgacccttgtgttttcattttgcttgaagttggtaagctggtctagattgatacgttttaggagttagctacactctatgttgtgttgatgcaattggtctgacttgagccgtagaatttcaagtttagtttagttcttgtcttgtcctgccttatattaaggtgggggtattggacgcatgaatttgatagacttcaatagaatcttaaattctagtgttattcaattagacatttcacaaattcttttaaattcttgtgttatttaacttgctcatttcttaattctattagttgcaagtgttattcagttttcggtagttttgtttgacaacgttacttcacaagaatttaatagaaaaattggtctaaaatgtgaagaacaaattctgagtttttgagttgagatttggatagaatataacacatccatcctttttttctctttcatcgatttgcttcaaccatacaaaaaaaattctcaaatctgagggagagtgtttaacacatttattagaatctgtgatttcgatccggtttattcttcggatcatcattcgttcgattatatatgaggagagtgcgttaatctatagagagcagatgagcggaggttgtgatgacgtcgttgtcgttgttgtcaaaatatggatctcttccatttcatgtaaacgtcaacgtagattgtttctgggttaagaggtttgtgaaggaaaaagtacagtttttagagattgggcatggtggctgtcccgataaagagcattgtggaacaaaagatttcagtaatttatcttcttaattctagtagaattctattaaaaatactgcaaaatatttatttgaattgagaagaaagattcgaaattcttttattatacctgaaaatctagaatttatgtccaatacccccctctaagatatagattttgtagttaatatgttcttgtaatctgtctgaattaagtacaaaaatactgaggcatcatccgctgaaaatgctgtgatttgatattttcccttagcgcacatctctttgcttggttggtatttgtttggtgttggtttacttctatcattatcacgtcttgggttgtttatgatctgtgcagaaggcgtcgcgggtgatgagtcaggctgctcgactcaatgaagtgttcacagaggtaagaagggtccctgtgatccgccctgctctaccatcgcctggcgcatggccggttttgagccttagatgagaagccgttttctacaatacctagacacagtggagaatcaatcatacaatgtccatcactttatgtaccgtaagaatacaaatacatgtgtttatgtcgtacctatgcataagtagtagtttaccatcttatgaaatcgcgtatgtgagtcgtgtcccaaccgtgggatacactgcagagtgattaccgtagcgatttatgtatgttcagagactgaaaatcccagttggtaagcctttttctatgtttgatcttaagaatttcataagctatatgtgggttttgttatggatttcattggggtttcaagcttgtaaactattatagagaggaggacatagtccaaagtcgataaaaccactacaatggaaataaagaccctacaaatttctactatgttgtcgattctacaaaatttgagtagaagctatcgtctcaacaacatcccctcgacgatcaacaaagaaaacatcattatttttgataactttaaaaaaaaaactggtagcccatttttaggcccaataaaagcccgaacattataaatagacgttaaagccttaaacgttacttctccaccaccgttcagagtcgcaacccaaactcttttcactgccggagataattctcttcttccccaaaccctacagtactcagctttccctaaattcctcgccggacgattcgtttccagatg

SEQ ID NO: 3859 - DNA, 3000 bp, Unknown
  misc_feature (1)..( 3000): cDNA_ID_3089354_gDNA_ID_1620670_Annot_ID_48137 3000 nt of promoter + ATG
attataaccaaaacctaaaattccaaactaccagttatattataaaataagcaaattatagttataatcttgtgtctatattggactttgatataatatttaaaagataaaatgaaatgcattactacacaagccccataatgaatatgtcaaggaatatccaaaaacgggtaaggagctttgtgaccattcgactctttctacgattctagttcttaagtaaagctttcacacccattattcacagatttaggataacgtccacttgcccaccgaaagagactcttagacttattgtgacaacttcaaagtattcttcaatccagtagagatttttcagatatttattagagtaaatctgttaattatatagggctcattgtttgtcagtttattgatggatgatacactgaattttttttgcggtgaaacttatgtattggtgttttttttttctttctttctacatcaatctttttcttttaagagtgtaaagctcagcccaaattcccaacagtcaaaaagttaattgttgctttcattggtaatcatattaaagacagttaaagatataacccttatttagttactatttaccaatcatacaagcagataaaataggcaattgaaaataaaagttcaaatattaactaaccacatatttccgatgcagtcaaatatttttcttaaccacatactaatatactatcaatgaaaagaaaatctcattattttttccaaccacaactatttcttttttttttctacctttctcgatatctaaccgtatcatatcacatatgcaaacaacatttcttagagttgactcttttgagctctaaataaagatagattgacaaaaaacaattttttaatttttattgacgcattcaactttaattttctaaatatcaatcaattcttacaacacactaattttttttctagctggttgaccttctctggtatatctgctttctatttttagtttttgaataaaataaaaatctatttttagtatgtgttaagtatatttattaagaaaaaaacaacgttccaagtaagatacaaaacgtttttacaaatctgaatcatgaaaaatgctacttcacttataatttattgttttctcatgttcctccttatgaacaatgttaaaggtaatatcttagtctcgttaagatttaactaataccttattcacaagatcgaaaacattgattatatctataaaacaaatatgcattaaaaatagagctttcatttttttgtattatcaactaaattctatatattttatacttttttattgattgaaaatagggcagggaaaaaaaaaaccaccatgcccgcttggactgtcggcaaacggaaaatgtgggcatgacggacctaagttatgttttagtgaaatggaacgaaaatttaataaagatgtggttaaaactattacccactgcaagtgctgggatgatcgacgcaacaatgtggacaagcatcggtgcacatgttatttaaaacatggttttccttgcaccaatggctaagtttgaagttataagatagttttgtttatggcaaatgttactggaaaatcttcaaaaaacagctccatttatttttcatttgtatgtttactatccaatactttttggttagaaataaaaatacctcatttaattttttttggcctaaaaataaattatctttaaaaagttaattacaaaatagacatttgtcttaagaatttatttattttaaaacatttctgatatgtctttacgaaaacaagtatttctctcatgtgaaaaatcatctctaacctcatttcatttgagtcatcttctcaaatcgagaaagtttaattagtgttgtagtgttgtgtcgttgtgtctatgtatgcatcgcagactgtcgactaaacggtttgggtttacaagtccaattctagagtatagtgttttgtgaaaaacaaaaaattatgttgcgaaggaccttctctgtcgttgctttgagacaccaagaagcgctgcaccaccactgaagctgtttgccaccatccaccattgatgccattggcgaccctccaccatcaaacccgtgaaccaccatcaaagctttgtgctacagccgcttactgcagaaggttaaaatcgtccaaaattgaaaaataaacggccactgttgcattcaactgtgcaacatacttcttttgaaattactaaatctaaaatgcctatttttgatataaactcatctttaaattattggtagattcgaacacgcgacttaagagccgttaacggatattacatcatataatttattaaggtaagaaagatttttaaattttttcactgattcaaaattttaaaaacgaacatatattaatcaattgatgaaaaatgtgtggatttaacatcatacattggctaaaaagtttaaataataattcataatcatataataaataaaactaacaataataaaactaatgagatttttggcgggatgttacttaataacaattgtaaactatcagatatattttttctttataaatacatacaattttcaaatttttttatatactaaattttataaatcgttcagtgtagcgcgggtaaaaaatctagttaaagattttttgaatacttttaaaatatagaggttaatttagtcattttctcatttaaaacaacaatttttctcaaaatcttgtaaattacaattcggccctctcgaagtttcttcatcttctcttcaatttttaaaacttaagcttttgatttctcgattcatcttcttctcagctttagggtttcgattgttccgatcactatgtctgggacttccaattgcaccgtatacataggtaagtttctctttcaacatttccattgatcttgactgttaaaaacttctcgaaaaccaattgattttgaaaaatcagggaacgttgacgaaagagtaagcgatagggttttgtatgatatcatg

SEQ ID NO: 3860 - DNA, 3000 bp, Unknown; identical to SEQ ID NO: 3856
  misc_feature (1)..( 3000): cDNA_ID_1822270_gDNA_ID_1620670_Annot_ID_48138 3000 nt of promoter + ATG

SEQ ID NO: 3861 - DNA, 3000 bp, Unknown
  misc_feature (1)..( 3000): cDNA_ID_3089366_gDNA_ID_1620670_Annot_ID_164065 3000 nt of promoter + ATG
aagtggtagtatacaatttcgtacagtcaattcttctattttggatcaactttttaccacaatatagtataactagtgccataaatagcatggtaaattggtaatatttatcgtgatggtgcaacgttaccaatttcagctcattttattgtcattttcactaatgattttcatattaatttgatagattaataactatatcattagttaatatatatgtttactaatgcaaactccacttggtggataattttaatgtagtctcattagtttatatatagagttaatatattcaagacctctaattaccatccattttgttcgagagaccttattatatatcatcttccactttattcgaagtaggcagatacttaatatcttcattttgttttatctttctgtgataaaacattttttaaaacttattgcattattaagttagtattagaacgcatgatctgatgtttaaactcatatgaaccaccaagaggttaaactacacgaaaacaaattcaaagataacgtgaaatatagtaaaattgtaagtaaacaggtgttgacaaaggaaacaaataagatttttttttttttctttgaaataaaaatgacactgacatacttttcaagagtaaaaagctagcaagagttcacattcttcattactatttaggaaacgaatggtccaaaatacttttagacacgtaatttgattgtgacatgacgatgattttattttttttgaaagatttaactatttgatataaaaagacaaatgaattaccatttgagtttgaagttcactttccgtgtgaccattcttctccatctttaattacctataaggagattaagattctctggtcatggaaagagtttataacacatggaacaaaaaagatacataaactttaaatggaaacatgtattgcaaaaggattttttttttttactatgagaaagcttgataagtaccatgaaaagtggaaaacaaaatccaaaagataagctaaagtttgaaaattttgcatatgagattgagatttattaagaaaatgatgtcagcttttgagtggagaaacaactcctgcagagtaactactattaaaagctgagaattatggttatttgcggagagacagagagggaaataagaaaacgagaaaagcttgaaactgatgatgacacaaatatatgtatgaagaagatcatattaatatttaagcaaaagtgagagtagtattaccaaaggagtttgatttcagtgtgagaaagcaaagagaaggggtttgatatattgaagaatagcaagctttattttatcaagatctagatttcttttggtagcaaaacaattgaagaaataagatagggtatggtaggacccttggttgttgaggtttggcatattgtaaaatcggaaaaaaaaaaacagaaaaaaaaacagtggacattttcttcctacaaactatattttaaggcacataccataaacgtgaaattttgtacgttactaagttattgtcttactaaaaaacatttaaaagagaaaaacaaataaacaacaattagagcattcacatcaaattttgagtttttcgatctcataattttaaaacttttaacctcacattcacaattttagattgttaaatttatcattcaagtagtaaaccaccaccagctttatatgaggaaataatgtcccaagcaatctttgcctctcttccggcggtggtcatcgatctttcgaggcatcagagaagtttgaaatcttgagtacgccggatctaaggctctggtcacttttgtttgcgtccatcagcagaggtccgatctctttttccgattccggtcttctttaccgttttggcattttataactggatattgaattgtaaagcgaaagccaaggtccatttgtgtatattttaatataaattttttaaaaaattgtagtctttttatacatagtttatggtcatctatttaatagaatcactaatggaactgatgtaaattgttgttttaatacataagttatgtcatatattcaatctttgtaagtttgacttaaacttaataacataaactttgacggataattactataatcaaagcaactctctaacgaacaacacatagaccgtcaaacaaacaacgaccggcaaacgaacaaagccaacatctttcttctgttcatcctttaacaaaatctcttgatcgagttagtcctcacaatcttatttgcatcccagagagttctaaccctatttcggagaagttttacatttttttcctcaaatttctaatatcgacataaatataacatattggatccaaaatcacttctaagtcagactcgaaactaaacaaacactattcttttcccacgaaatcttatttacactccggagagttctaaccctatttcggaaaagttctacattttttttcctcaaatttctaatatcgacataaaaacaatatattggatccaaaatcacttctaagtcagactcggaactaaacaaacactacttttttcccacaaaatcttatttgcaccctggagattctaaccctatttcggaaaagttctatattttctttcttcaaatttcttataaatcatcataaaacaacattttggatccaaaatcacttctaacttctaagtcggacttggaactaaacaaacactactcttttcccacaattgacgaccctttttgttagtcatattgacccgttgaaagttgaaaactgcatggtgggtgagacaagtgatattaaatcatatgggcctaaaatggcccaacaagagataaaagcccatactattctacgtccatcgaggtgtcaccttcctattgaattttgactgaaaactgaaaaaagcaaattgtagaagaagaagaagaagaagagtgatactgagaagatctgtgagattattatattcgattttgatcagtttctaaaaagctttcaacaatg

SEQ ID NO: 3862 - DNA, 3000 bp, Unknown; identical to SEQ ID NO: 3855
  misc_feature (1)..( 3000): cDNA_ID_1822266_gDNA_ID_1620670_Annot_ID_48141 3000 nt of promoter + ATG

SEQ ID NO: 3863 - DNA, 3000 bp, Unknown
  misc_feature (1)..( 3000): cDNA_ID_1822346_gDNA_ID_1620671_Annot_ID_48148 3000 nt of promoter + ATG
aacagatcattccacttatgaatccccattactaattttccattcctattacagacgttttacgtagtagggaatctagtttattaatatacatatcacatagattaatcttgattgtttcgcaaattttaatggttttcggaaacaaaaagggggtacaaagtgagctttccgaaatagtgtagttcccagcatccaaatctctcaaaattccttccacaattagaacgattgttcgttcgttcgttttcacaatgtatctcgacctcttttagcaagagtttgctactaaactcgaaccaagtggaaacatgtgggttttgcaatctaaattgaatttgttttgtcaaaaaaggttcttatatttagtacactgtaaaaaatttcgtttctaataacataaatacctagtatagtgtaatggtgttcagagttagcatgcaaacttgtgttaggaaaggatatcaaaagtctcttgtttcaacaatttttattttatattcaaaaattattatgatttgatctttcaagttgattcaattcatgaagatcacataaagcttcttctctgaaatgaatgtcacatggaataattatgtattgaagagcaaaaaccgcatatagtaacctagcttaaaccgaatatacccgaagtcaagactttaatgagaatcagactaaatcctgaatttatttgaaaacaaatcatatgatttggtcttcggtccggtaaaaaaactcagataagtttgaaaacaagttttaatatttatactatatgattccgtcttaatcaaaattgtcaacttacatcaataaaatcaaaactcattttaactagattctaagaatctcatcgaacaatcgatctttgtaaatcttcatggaatagtggttagcatttgtatcattgagtttgaaagaaacggaataattaaagatgacactaaattcacaactttgaacaaacaaacaaaaaaaagtgacaagaaaaatagaggtcggtgtcggagccgcccaaggtggcaacttgttcacacctcataataaaagcttctcacaagttggaagtcgcggtcgagtccagtcaagattttgttgcccttttcccgtgtgggctcaccaccctctttgtcttcttctccccaaaaattttccacgttttttgtttcactctctcaatttatttatattttttttgtcggctcatatttaatttgtgttaattaacacttccttgattagaaagtttttttgtaccgacttaaatttatcatgcaatgtgattggtcgctttcccaaaacaatctctcaacgacaaaaaagtagtaattagtaattaaatacattatattttgttgttaaatagtactcattctatttcaaaatataaaatatttaagtaaatatcacacggttaatgaatttaaatatataactcaagtatagtactaaaaagaatactttaacaaacaaacagaaacctattgtacagtaaaatatcaatcagtgaattattaatcaaatagtaagggaaactaggatataatagaaaaagaattgccgacctacaaatcagagtcaatggtcaagcaagtcaagggaaagttcgtaattgttatggatctggagtctggacaaattaaaaaaaatttgttaaatagaagaggatataaagggaacacagatcctacatattgaaatttatgtatgacgtccaaatttttcttcagcatgggacactgccccgccgaaattattgatttttcggatctttcttctacttgcttcttttttgtttgcttttataagttttgcatagctaattcttaatttcttatcatttatttctagttggtagagacttataaattgaacgtttcaagtctttggacggtatttgagatttcttgtaatttcacttgtaattgtaccacctaacagtgactaaagcagaataaattacgattcgtatacaacaaagtattcaaatttctaaatgtggatatattattgattttattttgggaaacatgtttatgataatcacctatatctcctctatagtctactagaaacgatatttgtcaccttcatcgtacaagactataatgtataattctatccataatgaacgatctagtttttaacatgtactatagagatgaatgattacgacagtaaatttaacccatgcatacgaaaatacataccgatagatataacacaattcagaatgttttacacaatcccatatttttagccaatcagtgtgattttaatagacagctttctatgtcttgttgtgctttttcttcttctttttttcccaaagtctttaatgtcttctggactttatagaagacagctttttatatgttatcttcactttcgaacgactttccttcctaacatatcccaaaacctatctctttaatttattcctatcgtacttacagcttttattaaaaaaactttcttattttaatcactaaacaattaataaaacatttatttatgatttttcattttcgttaaagctcttttattaaaaacttaatcacaacaaatttattaatcttaaatttgaccttaggataaaatttatatattaatcttatatctgttatacattaaataaactttaatttctgcgcaacaaactaatttattatttatttcttgtctctgtctttgtagttttagtataaataaagccattttgctccgaggaacttctcattcagtcggaccaacttgtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccggtaagtccggatttcgtctgatccattttcccgaaatctaagttgatttttgtatcccttcaatttctatgaactgggattttgggaattaatcatg

SEQ ID NO: 3864 - DNA, 636 bp, Unknown
  misc_feature (1)..( 636): cDNA_ID_3092768_gDNA_ID_1620671_Annot_ID_164125 3000 nt of promoter + ATG
ttcttctcttcgcttcaaatcgacgtctgtgtgaggttaaatcgcgtcgcgttttcatctagcagttttttttggttcaaacgaacgagacacaccagctaaaggccatttgcgttagatctaaggagagagcgacgtatacgtggtttcaagcaaattctccacgggaaggagattaacgagcaaagtcgatttcagtctcctttgtggagttttctcttcaacgcatcgagggtatggtttagctcagtttcgtgatttctagcgtgttattcatcgagttcctgtgtgtaatttgatgatctccaattgtggttattggaaacgagtttggatttagcttctgatgggtttgtttttcaattgaatctggagattgattttcgtttagctgctgcacaatttgggtctgtttttttacaaaatttaaagccacacaagctttttatttgtcttgttcataattctaagccactatatttgtgtcggtatcatataagttttgtgaaatttagctcagttttctttgttgtgattggattctgcgtcaatcaggtggcacgaaccatggttatctaaacttggtggtgatccacgaagagtcattgtgggaacaagaacacagtgaatcgaatg

SEQ ID NO: 3865 - DNA, 3000 bp, Unknown
  misc_feature (1)..( 3000): cDNA_ID_3072070_gDNA_ID_1620671_Annot_ID_164100 3000 nt of promoter + ATG
aatatccaacttgaccaatatatctttattgttcgtcaactgtcatcgatctatatcactttacgtataggattaatgtggcgtaaaaagataaagaagtttggtccaaatttcaatatcaaacttctagtgatgagaaatttctatttggtctacatcggggaacagatcattccacttatgaatccccattactaattttccattcctattacagacgttttacgtagtagggaatctagtttattaatatacatatcacatagattaatcttgattgtttcgcaaattttaatggttttcggaaacaaaaagggggtacaaagtgagctttccgaaatagtgtagttcccagcatccaaatctctcaaaattccttccacaattagaacgattgttcgttcgttcgttttcacaatgtatctcgacctcttttagcaagagtttgctactaaactcgaaccaagtggaaacatgtgggttttgcaatctaaattgaatttgttttgtcaaaaaaggttcttatatttagtacactgtaaaaaatttcgtttctaataacataaatacctagtatagtgtaatggtgttcagagttagcatgcaaacttgtgttaggaaaggatatcaaaagtctcttgtttcaacaatttttattttatattcaaaaattattatgatttgatctttcaagttgattcaattcatgaagatcacataaagcttcttctctgaaatgaatgtcacatggaataattatgtattgaagagcaaaaaccgcatatagtaacctagcttaaaccgaatatacccgaagtcaagactttaatgagaatcagactaaatcctgaatttatttgaaaacaaatcatatgatttggtcttcggtccggtaaaaaaactcagataagtttgaaaacaagttttaatatttatactatatgattccgtcttaatcaaaattgtcaacttacatcaataaaatcaaaactcattttaactagattctaagaatctcatcgaacaatcgatctttgtaaatcttcatggaatagtggttagcatttgtatcattgagtttgaaagaaacggaataattaaagatgacactaaattcacaactttgaacaaacaaacaaaaaaaagtgacaagaaaaatagaggtcggtgtcggagccgcccaaggtggcaacttgttcacacctcataataaaagcttctcacaagttggaagtcgcggtcgagtccagtcaagattttgttgcccttttcccgtgtgggctcaccaccctctttgtcttcttctccccaaaaattttccacgttttttgtttcactctctcaatttatttatattttttttgtcggctcatatttaatttgtgttaattaacacttccttgattagaaagtttttttgtaccgacttaaatttatcatgcaatgtgattggtcgctttcccaaaacaatctctcaacgacaaaaaagtagtaattagtaattaaatacattatattttgttgttaaatagtactcattctatttcaaaatataaaatatttaagtaaatatcacacggttaatgaatttaaatatataactcaagtatagtactaaaaagaatactttaacaaacaaacagaaacctattgtacagtaaaatatcaatcagtgaattattaatcaaatagtaagggaaactaggatataatagaaaaagaattgccgacctacaaatcagagtcaatggtcaagcaagtcaagggaaagttcgtaattgttatggatctggagtctggacaaattaaaaaaaatttgttaaatagaagaggatataaagggaacacagatcctacatattgaaatttatgtatgacgtccaaatttttcttcagcatgggacactgccccgccgaaattattgatttttcggatctttcttctacttgcttcttttttgtttgcttttataagttttgcatagctaattcttaatttcttatcatttatttctagttggtagagacttataaattgaacgtttcaagtctttggacggtatttgagatttcttgtaatttcacttgtaattgtaccacctaacagtgactaaagcagaataaattacgattcgtatacaacaaagtattcaaatttctaaatgtggatatattattgattttattttgggaaacatgtttatgataatcacctatatctcctctatagtctactagaaacgatatttgtcaccttcatcgtacaagactataatgtataattctatccataatgaacgatctagtttttaacatgtactatagagatgaatgattacgacagtaaatttaacccatgcatacgaaaatacataccgatagatataacacaattcagaatgttttacacaatcccatatttttagccaatcagtgtgattttaatagacagctttctatgtcttgttgtgctttttcttcttctttttttcccaaagtctttaatgtcttctggactttatagaagacagctttttatatgttatcttcactttcgaacgactttccttcctaacatatcccaaaacctatctctttaatttattcctatcgtacttacagcttttattaaaaaaactttcttattttaatcactaaacaattaataaaacatttatttatgatttttcattttcgttaaagctcttttattaaaaacttaatcacaacaaatttattaatcttaaatttgaccttaggataaaatttatatattaatcttatatctgttatacattaaataaactttaatttctgcgcaacaaactaatttattatttatttcttgtctctgtctttgtagttttagtataaataaagccattttgctccgaggaacttctcattcagtcggaccaacttgtgaccgaagaaagcaaattgagactacgcaccaactagtcctttggtttgtatcttaagataaaggtttcttttatg

SEQ ID NO: 3866 - DNA, 3000 bp, Unknown
  misc_feature (1)..( 3000): cDNA_ID_2187191_gDNA_ID_1620671_Annot_ID_48150 3000 nt of promoter + ATG
gtaaaaactttttccctggaaggcatttatcgagggcaagaaattttgtcactgacccatcattcccgtgttgaacagcagcagcaaatttgcaatgtaaatgagctgaaaaccaatattgaggcttcagtttttctagcagtagagccgctggtttacttccaagagttttttcctcgatctgtaataaattttggtcaaatcaattgaaaacctctcaaaaccaaaatgaagaagtagaatcatgttcccacagatttacctcttgacgaaagtatggtttttgccgcataagtgattctgagtctccataatcagtgattccaacaggccaatcatgtgatagaaatatatcaagcggctcttcaagttgcatcaacttctggacatcatagtcacgaacatgatagaccgatctgatggtgctctcgttatatggtggccgctcaaagtgtcctactcacacaaatgactgattctcactttattgacaccaaacaaatcaaacgaattccctaatctatacatttccactatagacactaactcagaaatccaactttctcccatttcaaaagctgaaaaattggtactttgtcagagagatgaagaagaaacaaacctgaacggtaatgacgctcattgtatataccagaaaggccaccaattcgcacattaccaaacttgacaactccagcaaaacccaaaaagtaaatattggtggcagcccaacccccataatacctatagcacaacaaccagcaaccatcaagaacacattttttaagcctcggaatcctaaactcaaatactagataacttacaattcccataagtagttagaagcctcatgattcccaccaatgaaaattgtgggaatcggagcaacttcttggccggagtagtacttccagaaagatttcatctctctgtattttctaggtacgttaaggctatccatgtctttctcatttctaacagcctaatgttttccacaaagaacgaatcttttcagacttaggaagcagaatcgaatggatttttattttcaaggtaaaaaaaaacaaacgattacctgaaaatcgccgcagcagaggaggagatcgactttagtgttgtgaatctgttcgtaatgttgaattgttttatacacattgtctaggtctccatgcatacaaccttcaattgcaatcttcatctctctgctgaattctactattctcgggtttcactaattcgacgagctcaacttacaaatttgaattcgtgccgtgagacgaacaaacgattagtggacaaggaccaagaaagaggcagaagaattgagtaagaagagcagagaagaagcgtggatttagggttgtggattttgagaatcaaaactgaggaagaagaagaacaaaacgatgtcgtttcaataaacaccaaaaccacggtcgtttcgaagagaagagtcaaataaagaaaaaacgcgggacggcggcgcggaatgaagaagaacaaccaaaagcccaaaagctaaaattgaaaataaatttgggttaggcccaaaagcccactaaacattttccatgtgtactgcgagttttgattttagtccgttaaaatagggcctattataagaaatggtctgtctttctttttttgataatgggttaaaatcatagttgcaacagttgattatgagtttgatatataaataattttttgtctgttaatttttctcgaaactaaacgaatgtgagggatatcctaggttttgcacctatatttgttagatattagaataattaaattcatgttcgtcgtagtttccttgtaaaacacgttttgttttagaatctaaagcatgtgaaaggcatgcctcgccaacttttagttttcacaccatgcgtgcctttttcttgttctttggtcggtcgtagtcttcttactaataacgaattctattccatgacgagttccttccacttttctcctttctaatctaaaccttttataaattattgattatatctgagtgagtagctcaaatataactataaataacaaaagtacctcaaaattatagtattaaggtataggaacgagtggagaattggaagcatgaaacacatgtgcatcagaatgccaacgttgactcacgagttttgaaatcttaatgaattcgataaatcgtctgagtcggattatacttcgttttttcataactctttttcagatacaagaatcggttgtttaagaaaaaaagaaaaatcgctgtttaatgaatcattttaccaaagaacccatgtagactatctatatctatagtattataccatgtggcttggatcgggtccgaagtactataagcctaaggcggaaaatcttttggttgagagaattgagctaaaatatcaatccagtatataaaaaacatataccgtatctctattcattataagttggttaaaaccattcccaaactcatgataatcactctctcaccaaaaaacaaaaatcaaataaactgatatatatatatataagaaaaacttgaacatttcctcacattgttactctagattttaaaggtgatagtgatacaatggctgataaatgtgctaaaatttgaaattaatttgtccattatgccgacatccatttataagcttttaacatgatactagaatcaacaaataaatatttttattattttatttggaaactattaatgagtacacgatatttacatttacataaattggttgattggttacctgaattttggtagaaattgcccacagaatattcggataagtatttcggtttagccaaaagcagtgtcgtcttcttacacaaaaacaacaaaactccaatcgtcctccctcgtcctgaatccatccatcatccactctcctcttaaaaatcctatctttgtggtttgcaatctctcccacgacgcgcttcatcattcatggctatttgaatctctcttctctctctctatcaaatatg

SEQ ID NO: 3867 - DNA, 3000 bp, Unknown
  misc_feature (1)..( 3000): cDNA_ID_1822338_gDNA_ID_1620671_Annot_ID_48151 3000 nt of promoter + ATG
gaacagacaaatgaattatgaaggagtaaccaaactatagaccttaatcctcacctggcaataaaagtggaagttgcagcaaaattagattgatgaacaatgcgtggagatgtaccataataagtcattttccacagagttccatgtttcaccagaaaattatagctcctgggaagctggttgaacggccagggcgtatgatctgtccacaaatccgtaataaacacctgcgcaagcactcttagaacggaacaaaatcaacaatggctcacactacttaaagtaccaaagatctagactttcaaatgtatttggttaattattccaagaaccaaatttaatttaaagtcagtttcacactcttcagctggaacattcctaagccatcaagtgaatgtaacgcaatgctatccacttacatgaaccaaacatctaaatcctattttctctaattcaagaaactctaaacctgactacaattacaagtttataagtaaactgaatctgaagcttcgaagaactctaaaactaagaagacagaatagagattctccgaacatccaaacagatacttcaatttactaccaaaacttgtaaaagtcccaaactgaaatccatcaatgatcaatcaatcgtgattctacccaaaaagatggatggaaatatcaagacgaacctggtactcatctccaaactcctgattaaaagcagctctaatggcttccgcagaagctctgtgaccaccaccagtatcactcatcaaaatcaaaactttcttcggccgatcagcttcaacaccattcaacggcaatccctcctcacccaaaaccccaccagtcccattttccctaatcccattctcatcactcgataatccgactcctccgacggaggcaaagctctccggaaccactttatcgcagtgaaacctaataaagctattgaaatcgctgataaacctacggagactcgaaccagcactgctcttagtgttgaagctcaaggaagctagggtttttcccatccttcgggagggtaaagtccggaaaccattgaagtacaaggcattggacgatgagagagcatacccatctgaattcgaacacggggatcgatttctagaggttaaacctctgagccgtgggaagaaatcaaagaccggtgcggctgattcctgggttaccgttgaagggttttgcatatttgatagagagagagaagagagattcaaatagccatgaatgatgaagcgcgtcgtgggagagattgcaaaccacaaagataggatttttaagaggagagtggatgatggatggattcaggacgagggaggacgattggagttttgttgtttttgtgtaagaagacgacactgcttttggctaaaccgaaatacttatccgaatattctgtgggcaatttctaccaaaattcaggtaaccaatcaaccaatttatgtaaatgtaaatatcgtgtactcattaatagtttccaaataaaataataaaaatatttatttgttgattctagtatcatgttaaaagcttataaatggatgtcggcataatggacaaattaatttcaaattttagcacatttatcagccattgtatcactatcacctttaaaatctagagtaacaatgtgaggaaatgttcaagtttttcttatatatatatatatcagtttatttgatttttgttttttggtgagagagtgattatcatgagtttgggaatggttttaaccaacttataatgaatagagatacggtatatgttttttatatactggattgatattttagctcaattctctcaaccaaaagattttccgccttaggcttatagtacttcggacccgatccaagccacatggtataatactatagatatagatagtctacatgggttctttggtaaaatgattcattaaacagcgatttttctttttttcttaaacaaccgattcttgtatctgaaaaagagttatgaaaaaacgaagtataatccgactcagacgatttatcgaattcattaagatttcaaaactcgtgagtcaacgttggcattctgatgcacatgtgtttcatgcttccaattctccactcgttcctataccttaatactataattttgaggtacttttgttatttatagttatatttgagctactcactcagatataatcaataatttataaaaggtttagattagaaaggagaaaagtggaaggaactcgtcatggaatagaattcgttattagtaagaagactacgaccgaccaaagaacaagaaaaaggcacgcatggtgtgaaaactaaaagttggcgaggcatgcctttcacatgctttagattctaaaacaaaacgtgttttacaaggaaactacgacgaacatgaatttaattattctaatatctaacaaatataggtgcaaaacctaggatatccctcacattcgtttagtttcgagaaaaattaacagacaaaaaattatttatatatcaaactcataatcaactgttgcaactatgattttaacccattatcaaaaaaagaaagacagaccatttcttataataggccctattttaacggactaaaatcaaaactcgcagtacacatggaaaatgtttagtgggcttttgggcctaacccaaatttattttcaattttagcttttgggcttttggttgttcttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagag

SEQ ID NO: 3868 - DNA, 3000 bp, Unknown
  misc_feature (1)..( 3000): cDNA_ID_1822330_gDNA_ID_1620671_Annot_ID_48153 3000 nt of promoter + ATG
acactaacatcaaatgcaaattatgaagtgaacagttgcagtttattacaacaaccttcaagattcctctcattctcctttctattttcattgtcactttattcgagtcaaaacacagagacaataaaaatggcgtcctcttacagaataaactgttccactcttcttcatctccttatgtttctgtctagtcttctcacttcctccgccaacctctcctttaatttctatgctagttcttgttctgtagccgagtttctagtcagaaacaccgttagatcagctacctcctccgatccaacgatccccgggaaactccttcgtcttttcttccacgactgtttcgtccaggtaacacgcactaattacgaattactgaggaaagttcaaacaatttggcttaaactttgtttgttggttgaacttgcaagggttgtgatgcatcagtgttgatacaagggaatagcacagagaaaagcgatcccggaaacgcatctcttggaggattctcagtcatagacacagccaagaatgccatcgagaatttatgtccggccactgtttcttgcgctgacatagttgcacttgctgctagagacgccgtcgaagctgtaacatttacttcactcccacttcacttcaatctatattgctctaatccggtttaaccaatcccaactgaaccgaaagcatacacatgaaatcgaaaaaaagaaacaaaccaattctgtatcattttcgcatagactacacaatgaaccaaatataaccggagttgtagatacattaaaccggttatccttattaaggtttgaatgtttttcttctttggcgggacaggcaggaggaccggtggttgagattccgacagggaggagagacgggaaagaatcgatggctgcaaacgtgagaccgaacatcatcgacacagattttactctcgatcaaatgatcgatgccttctcttccaaaggcttgtccattcaagatctcgtcgtcctctcaggtatatatcaacgtttcttgaaacttctaatcaattttaccaacatgttttgctaaacgcaaacagagtatgaaacagagttttttttctttaactatggtaaagtcaattcttgtagcaaaatctgtttcatattctgttacactcagcttcttctttttttatttacattcaggagcacacacaattggagcatcacactgtaacgcattcaatggaaggtttcaacgagactcgaaaggaaacttcgaggtaattgatgcgtctctcgacaactcctacgcagagacactaatgaacaagtgttcgtcctcggaatcctcatcattgactgtgagcaacgatccagagacatctgccgtattcgataatcagtactataggaatcttgagacgcacaagggtttgtttcagacggattctgctttgatggaggataatcggacgaggacaatggtggaggaattagcgagtgatgaggaaagcttttttcaaagatggagtgagtcgtttgtgaaactgagtatggttggtgtgagagttggtgaagatggtgagataagacgttcttgttcttccgtcaattaaaaacattgtccgcttcttaattaatttgtcccattttggatagtctgtaatgttatctcttaaattttgtatttgtgacgagttttggtacttgaaaatcgtcttctagttgtcgagacagatcctctttctaaagttgcgtctaatatgggaaacacattttcgatttggaaacaaacaagaaaacgagtagcaagtaaagtgaaattatttactactactagttagtacagaggaggacgtgagataaatcaagcgtagaacaatcagctgcatgtgacagccacgtgtcgaaatctagtgagaaggacggttgattcattctaacttgggttcaccgtaaagttgacaaacccaaaaaaaaaagaaaaaaggaaggaataataatcatctttttaggcccacgagattgctctttgcttatagagataacatcaaatatatttatttctcaaattaccaactacttatccgtaattaaatcattattattaattgctaataatgaaaacatataattgtatccataattaattgggtatcatatttcaaaaagttagctggttcttcgtcataaatttctccagttttgtcaaaaacgaagaccacagcgagccctaaatcttgtcgggcgttgaatcttacaaatttgcaagtgattctcgtcatacctgtatcttcttcttcttcttcgttcttcttctggtacgcccaaattactctcaaatctcccccaaattactcttatttttcgatctgatcgtgctcaatccattgccatttcaatttgtttgctcaatccattggctatttccaattatctgctcattatttgtgctgtggatagtcgttctggcttcaggactcggtctcgtcattggtttgatatgtctgttgagcatttggtgattattgacatattgttttacatgtttttcgacgttgtgttaggatttgattggtggacaaaggtagctgaatcagcttcagaattgaatttgatctttgtttgagacaagaagcattggtgtttggagcatttctgaggagttatgggatatctgaattctgttttgtcatcttcgagccaggttcactccgacgatggacctgttagcggtggtggcctcaggttcacttttctctttctccccagcttaatctttctcaggtttttagtattaagttataggattaagaatgcaactacagattatagattgctcagaatcatatactctttttagcctttattaatgtctgattcaagtcctagctactgatttgaaaccttgtcttggctgatttcttctgataactcttgcgttatacttatctttattggaagctcatctctgttggtgtgagttaaagagttattgtgcaaaataatatctcaattatac

SEQ ID NO: 3869 - DNA, 3000 bp, Unknown
  misc_feature (1)..( 3000): cDNA_ID_1459029_gDNA_ID_1620671_Annot_ID_48156 3000 nt of promoter + ATG
taaatatagcatgccaatctttttcctaaaacaaatctccaatatttaattgcaatttcggtggataatcggattccacttttgtacttgaacggccagttctttcttactagtaactttcattcatgttttttaatggttaaatacatttcaactataacagaaattgttggcaagaggcgaccaatcaccaacgaaagctcgtgtagattacatccacataaataattattacatgtattgctgtttatattccaactttatcataagtaatctagttaattgaagattagcgacaaaaatatgatattaaattggatgggagaaaacatatatttaattaagcaaacgaacatattcgcaacttgagtttttggggggtgtttggtgacgtacaaacttctcttcttctagataaggaactatgcactacaaattttcttaattatgcaccacaaattttctaaagtacgattaaaaaagaggaaatctaaagccaaagtagtaatcaaccctacaacaacacatgagtcacgactttcagttaactacaattatacaaatattacttgattaagtggtgttatcttaactagtgtaatgtatgtttgaaattaataaagtccatctacaaaccattttatcaaaacaaaaaatccatcaagcaaattgaagccactcttatagccgactaaccgtacctacaaattttctgtttcaaacttatgcatatctatatgggtgcttatgatacttcctattaaatttaataaaattagtaaaaatttccctaccatatatcatattattattttttcgatccaagaaagttactttttaaaatagttttctattttgtgacacttctaaaatattataagtgtatagccatttttccccaaacaaggaatagtctatcagtctatacagtatacacacgatttatttgcaaagaacctacatacacaatttctcttctaccatgttagatttttagtacttgttttactagattatgtatttttgtttgtctatcggtcttttaattttcacttgctggaggtaaataatgaaggaagtagttaaaaattgagataacatagttgtgtagaaattagaatacagtgcagaacttaaaagtatggttacgatcacattgacaacagtcgatattccattgagatcacatgaacattgcttcgttagaaatgctcgtcgatcgcctgaagtaaaccgatttgattggccaccatgttttgcctcttcctgatttcattgatatattttatttttctttactattttaaacaacaaaaaaatttagaatccgtattccaaaagtaaattaaatttttgcatacaatttttctttttctttaaaatatctaggttttaatataatattccataatttgatgaaaagaattaaagagaaagttcaaatcaatccatatagcttgtcctagcctatagccaaaaatattcctatgccgcgattgaacaaccgttttttaaaaatcgtcaaattaaatcaaacctttttccatgacaatgagacttggatatagtttacattagattctgattggcccctttgatataactaggtaaactagcttcttgaataaactgtctcttattttggttttatacaaaaaaaaaaaagcttttggaaaatgatttaaatgtaaatacataatacgtagcgtctaagaagcatatttgagaaaatatggatttatttatctggtatttatccattaatttacctacaaatggaatccaccattaaccaaaaacaaacaaacaaatggaatcccgtgaaataaagtatcatcatatacatatctctcttttatgtttttatggagagaattagtccaatccttcttcactgaatttaccacctgcttctcgtagaatatataaaactacccttaagtctttttctaatgactatgagttgacaaatgagaaaaacaaaaactgcttttgttggtcattaaatattccgtctagatggagttagtgctttcattgtcatattctttgtctcccatcaaattaaagctcactatacagcagattgtacaacactatacactaaagttacatttttgagattttattgattgacaatttcgtttcgatattcttagatacactaaactcaaatattgattttatgggaagagaataaaaaatggattgtgaaaaaggaaaaaaaaaaacctaaatttgggccatatgtgaagaatacttccttaagtttgggccatagtttaaatcaataggcccattagtctatctaacgattctttctcaactcttaaaaatctgaccggcggagatggctctgagttggaccagtcggaggattagggtttcaacggagactcactagtcgatctccgatcctttcttctacccgcccgaaatccgtcgaaacttctcttctttaccattgatttgcctcgtctcagctcaattctcttccgttgctgcttcgtttaggttcgcattatcgcttactttattgaatttttcctctatgtctctggtttcaatttcagctcaattttgtctttttttcggttgaattttctcttgggtggtatcgaattttgctcatgaatgctgtttcttgatgaatcagagccctcttagtttacttcacgtcgttcaattcaaaacttggtgtggtcttttgcaacacaaatcaggaatagttcgttacttagaaacaataatgtcatacgagaagacaaatctggaacagagaattagtaaattgagctggaaagtttcagtagtcaaaattctcgtaaaacttattttggtataattgtgtcatgagtcatgacattctttcttaggtttcgtacaagtttctaatttgaggtagatactagttcagaggttctttattaatgtttgattttgaaaacctttctttacttacagttgttgcttcgcttcagtactctggtggtgggagag

SEQ ID NO: 3870 - DNA, 3000 bp, Unknown
  misc_feature (1)..( 3000): cDNA_ID_4450919_gDNA_ID_1620671_Annot_ID_48158 3000 nt of promoter + ATG
agaccagtttccctggcttttgaaaacactcttgaagcaaggaaccgattcatatgaactacaaacactctggttggtttggtcatcaatttgagaaggtccacagagatttcatcatccgttgcattgggagaaatcaccgtcctataaggtatacggatgttaatcgcttgtaatgcatcagtaagaccaggcattataccttctccaaacgcattgttctcatacacaggtacgacctctctccaaccaaacacctttatgatctcacttatggcttgcacttgtgatgagtcgtcgtaagtagagcgaaagaagtatggactacggccagagtcaaggaaagggctcgttgcagaaaatgaaataattggcacctgagatttttggcctacctcgatcacgaaagaagcttgcatcgtcgttcttggccccagaattgctttcacttccttgttctttataagatcaagagctgcggaaacaaacataagacatgtggtgttatatgagaaacttgaaaacagaagaccaaatggaaggtagtgatgactatatctttgtggagctgaaaactatcaagttctatatagtttagagccgaaataaattcattgccatgaaaatgcagtactgaaggatgcattgtccacaatataccacaattacatttaaacttatgtaaacaataccacaagaaaatatatatgaatccctttatatatatgtacgcatgccaagacgtcatttcacgtaaaaacgatattcaaccgttttaacagaaaacgtacttttgcggtttttgacaacaaaaatgtgactaatcggttttaaagggaaaacatgtgattgtgcggttgttgatgaaaaacagggattatgctttttggagagaaaacatgattctaaaatatctaatttttcatactgaattaaaaaacgaacaaccctatatttcatattctcaaatttatccttccagccaggaacatgttacacgtgtgcatatatgatgcgcataattagtgtgaataaggccacatatgatacgcatatatgatcagttgttccaaaaaacaatattagcggttgcatgaacgagaaaacagaacccacaaggacaattcacatttcttgagctatactatatatagttagtataacgtggaaacggaaaaaataatcacaaacgaaattttttgctttcatttgcgtttcacgtttacttatagaaacaatcgaatcattaaagacagaacataccagccgctgcagcgccaacaacatcgtctctagagtcggcaaagttaagaagaagcctggtccgagattctggacgagaagagtaaaagtctgagagagacatgttaatggcgagcaagctcaagttggaggcagttgtcccaacatcagtcacaaccccaacattaattacttggattgtcgtattctgtcccttccccaatttcacgccgaagataaaaacgagaaacactaagacgacgtcgttgagatgtctcttcatttttcttttgtttttggttttggttaagtaccgtggaatgtatacatcttgaaaatattttgaactcatatttataaatggataagatttaacgccaaaaggtgtttggttcgaagaagtttttgtttttagaagtaaattatacatattaacgaccctttctgctaatgacgtaatataaaagttacatttccataagaaacattcttttcttttttgtttaattgaagatataaatccttacatcatctcttgtcaaaaaccagcatacaataaagtacttatcttattaaactattaaataactaataatatggttgaaattttaacaaaataggtttttattaattaaccagtactggactaacgtacctttgcaaaattaactttttttccattttaacttgacaagggcattattggacctccctacacacgcatgcatttacatagtagacgttataactcccatgttaacatattaaactcatatcatatgttatatgtgccacaaattaaatctctgctcaagtggccgcaaatttcagtatctcatattttctgttctaacttaaaagttaacacggttacttttcattcctcggtctcaagtctttcgtgatccatccagttttgtataaaaacacaaaagtaacaaaattatagatgcagcaagtcgcgggtagtggtgaaaaataagtttcatcagtaaaactaaataaagaaagcatatatatatgccttttgtaagtgatatcatgcaaccccgtttctgattaactaatattacagaactagatgtaaaaagagaagacaaatatattttacttatctaacatacagtttttaagttttgatataagaaaaacattgtttaattaacaagacgaatgtagtagtaaaagacattgcagtaaggcgtaaccacgtagtattcattcaccatcacccgtgacccgaaacattttattttatatcgttgaaatgacttggtttgtaaggaagagagatagtcaaacaacaaaaagaaagaattagtcagatatcgtactcccggaaaagaaaataaaaaacgattccgtgattgaaacaggttgcttaagagaataatcattggcagaaatttgtttaacacgaacttttttaatcaaggccaagttgcaaaaaaaggtcaaacaaaattacacattattttgaggagaaaaggtttatatatatatattttttatttttttttgaacacggaaggtttatatatatatatatatatatgtatcaaattttcttcaaaataaactaatgctatgttttttctgtttgaaattattatttcatgaatttaggaagaagaaaatgataaaagggccatcgggcccataatcgcagaaaacggcccatataaatccaccaaacgaatcttctctcttggtataaatatgctgtcttgcgttacagagaaaccctagacgtcgaag

SEQ ID NO: 3871 - DNA, 3000 bp, Unknown
  misc_feature (1)..( 3000): cDNA_ID_1822316_gDNA_ID_1620671_Annot_ID_48159 3000 nt of promoter + ATG
aaagaattagtcagatatcgtactcccggaaaagaaaataaaaaacgattccgtgattgaaacaggttgcttaagagaataatcattggcagaaatttgtttaacacgaacttttttaatcaaggccaagttgcaaaaaaaggtcaaacaaaattacacattattttgaggagaaaaggtttatatatatatattttttatttttttttgaacacggaaggtttatatatatatatatatatatgtatcaaattttcttcaaaataaactaatgctatgttttttctgtttgaaattattatttcatgaatttaggaagaagaaaatgataaaagggccatcgggcccataatcgcagaaaacggcccatataaatccaccaaacgaatcttctctcttggtataaatatgctgtcttgcgttacagagaaaccctagacgtcgaagatgaaggtgcgtgacggcgaaatcgaatagactctacatttgctcgtattcgagtttcctttgctaacctttttcatgtttcttcgtttcagttcaacgttgcgaatccaactactggatgccagaagaagctcgagatcgacgatgaccagaaactgtaagattttgcttctctgtttcatcttcattcatttttaatagatatttcgtgctaggttgccagatctattgattggtgtttgtatatatcactgttaaattgataggtctagtaaacagtaattgtcaatttttctatgttcgtcttataagcttaataagagttagaatcttcttctatgtttaatacttacattaaaataagtttcgtatctgctcataaacatatctggattatattattcagcttgatttatgttgatgcagacgtgcgttttacgacaagagaatctctcaagaagtcagtggagatgctttgggcgaggtacagattccatttttcttactttgatctaatgagtgtgaagattagcatttcgaagcagatgatgatgttttgtttatgaattgttgttattgcaggagttcaaaggatacgttttcaagatcaagggtggttgcgataagcaaggtttcccaatgaagcagggagttttgactccaggccgtgttcgccttttgcttcaccgaggtaactaaacataataccttttcttacacttttgcatctataatggatttgtatttgtgtgtgtgtgtgttttgctgtagattaacattgtttcgtaatgggtgaacaggaactccttgcttcagaggacatggaaggagaactggtgagaggagaagaaagtctgttcgtggttgcattgtgagccctgatctctctgttctgaaccttgtcattgtgaagaagggtgagaacgatcttcctgggcttaccgatactgagaagccaagaatgagaggaccaaagagagcctccaagatccgtaaactgtttaacctcaagaaggaagatgatgtcaggacctatgtcaacacttaccgccgcaagttcacaaacaagaagggtgagacactgaacttgagaaatagtggtttctgaatcacacttgagaaataatgttttctgaaacttgtttcttctgtttggatttttgacaggcaaggaagttagcaaagcccctaagatccagaggcttgtgaccccattgactcttcagaggaagagagctagaattgctgacaagaagaagaaaattgctaaggctaattctgatgctgctgattaccagaagcttctcgcctcgaggttgaaggaacagcgtgacaggaggagtgagagtttggcaaagaagaggtcgagactctcttctgctgctgccaagccctctgtcacagcttaaaaaagcttgagaatcaaatcaaagatgtcacctttctagttttgttctcttttcttctccggctattaaaaagttagttcgagttcatattcagctgtttttgttccaagacatgggtacacaatcgctttgggcttgtttcatgatttatgcttttagttgaagaccattttaaactcaatttttattgcttatctttctcagtttttgatcaaagcgtttctccattgaaaaccattttaatcacctgtttcaatcatacataatgttaaacacatgtactggcgattacaataggtatatattttgactgaaatttatggagcattgtatgacggtttgataaatttctgagaaaactcattcttaagttttaagattatctcaacaactggtgaatcaaaactgtgatgtgtggtttgggccaaacgacccataaacgagttcaacttaacagagaaagaacaaaaacaattatatatgttgacagagagaggtaacacagcaaaggggtggtggcgcagttggctagcgcgtaggtctcatagctattgagtgatcctgaggtcgagagttcgagcctctctcaccccatatatttttgtcctcttcaaactaaccttaaactcacgtttctccttttttccttgtcacactgaaactgaatcgtttttttttctttgtcgactgatgatatatctagataaagagtttcagaaagccaattacaaaagcatcaaaaacacaaccatgatgctctaaccaaagcagccaaacttacaggcttaaacaacaagccaatatacaagatcacaaaaaaaaaaaaaagaaatctcgttaggctatcttttgtgatttagattttagttttgttttctatcaaaatgtactccctctattcctaaacttcaaaagtctttagtgtcagtgaatggtgttgtcaagtgaatggtattgtcacatttttttatattgttttttattaatctaaaaaattctgatatttgaaagagattttgtcttttgtcaattcatttattgtgaaatggcgtacatataatgtagacaagaatctcctttgtattttattacattaagtcaccgagaaaacttttgggcttttggctttgttagagtgatcgga

SEQ ID NO: 3872 - DNA, 3000 bp, Unknown
  misc_feature (1)..( 3000): cDNA_ID_1807213_gDNA_ID_1620671_Annot_ID_48161 3000 nt of promoter + ATG
aagttttagaaaatcattattattggaacataaggaatatctttaatcttgaaaattttgaaactggaaaaataaattaaaatcttttttttaaaaaaaaacattgattgaaaatatttgaatttagttatatgaatactattggttcagagttatggaaaacagaaaaatgtttaatgtcactgattcagtgaatggtgttgtcataatgtgtcttaatttatgtgaaacttttacaaaaatcattatttttaagaacaaatgaagtatctttctgtagaaaattttgaaatttgaaagagattttcatctcaattcatttattgtgaaatggttatataatgaagtagacaagaaagtctattccttgtattttattacattaagtcgccgagaaaacttttttgctttgttggagtgatcggaatggcgaatgcatcacagttatctccgacaaacaaacacttcttcaagcctcttctccccggattccagagaaacctcgtacggaatctctctgtctctgtctttctctcaatctgtatgaacttatagtctcacggttctgtttctctgttgcagaatattcctgtgaagttcttctccgagcacatcgagggaaaacacgagggcgagactgtaaagttgagagcagatgcgtcgaagagaacatgggaagtgaagatggatggcaacagactcaccgaaggttggaaagagttcgtggaggcacatgatcttcgtatccgcgacttcgttgtctttagacacgaaggagacatggtgttccatgtcactgctttgggacctagttgctgtgagatccaatacccacagtctatcagccatgaagaaggcgaagagagtggtgaagttggtatgattgaatcatcattcagtgaccacatttacatttatttagactcttttctattcttgaaacgtttcaatttctgattcagaaatatccgagagagaagttgaggagaatttgcaaaaagaatatgatcagtcttcagcagatctgaattgttttagccaatccgtaacgcactcaaacatatcaaatgatcttgtggttagtcagattaacggtttctttggtgttgttatgtttatttatagttcaaatctgtgtgagtgtatataagtcccaatgcaatttgatgactgatgcagactctgcccagggatttcgcaaaacgaaacggtttagacaaaggaatgcatgagatagtattgatgaatgaagaaggaaagtcatgggaatcagaagtaaggagtagaatgtctggtcaggtttttattgttggaggttggaaaagtctctgcagcgaaaataaattaaaaggtggagattcttgcacattcaaactgctgcaaaatgcgaaaacgcccgtgtttcagctctgtagccgcatcggagaaagtcggtttgtgaagttaactcctacactaaacagccttgagattggcaaacaggtgacttttcgaaacctctatctctggtttcttcagtgcagtgtctttttaattctgaatacttttgcagcatctaccggtaagtttcacgaaagggaatggactcatacatccgggggagataattctggtggacaaagacagagttgaatggtcgatgaagcttcaggttgataatagaggagggatgcatatatttggtggtaatgactggaaaagtttctgtgccgcaaatgaagtaggcgcaggggagtcactaactttggagttgattcgaggaggcttaagtcctttattcaagttcttctccaaggtcagtatttcaaatagcttgcagtccacgttttaggttttgctaaatcaaacaacgacttgttttcagatagagcaaccctcattcgaagcagaggataggagacacaagagagctcgagtccataatgggagccaggaaacagataagggagaaccttctcgagcaactaaaatgggaccggagcttgagaaaagggagaagacagctgaaaaaggagaaccgtctcgagcatctaacaaatccagtggtaaacaaggaaacttacagaaaacgcaagcttgctctgtcacagatcacgtggctaaggtgaaagagagcgttgtagatactttaactagtatcagacggttccaagcagagcttgaaacaatggaacagaaattagaagattcattgcaggaaatcaacaagttaagttaggtatgatctgtaatctgtaatattatcattcttataacaatcttttagtttcggttttggttttgttcaaatttctaacaatttgaatttggcacagagagaggagaagataacatcttcaagtaataatcaagtttaaatgtgaaactgaagactcttgtaacctctgtttttattatatgactttgtttaagatgtagttgttttattttcccttttttcattttgttaattaatcgtaaagtttataatgttcttgttctctgttggcggactaatgtcgtatttccataatatttattaattagtatctgataagtgataacaacttaaaatggttttttttttttccttatctgcatcactgcattgaaatggtaaacaaaaaatgactttatctgctgcaacaagccatagccaaaaacaatacaaaaccaatatacagtagttttttttttttttttgtcgtaaccaatatagttttattaaggaaaagaaaagtaatcatagccaaaaaaaggaattattacaaggtaacgacaaaaaacgtagttgaaaaaggaaaacaaaaaagcatataaaggcccaatctttgtaattgcattggaaaggcccaaacccaacaacatagaacactgtcttctctactaagtaacaaaaatcaacgaagcggtaattcttgaacagacaaagaaaaaaaaaaggtgaatacttgaaatatataaaagatacagaagacacgagaagggagaagagatcgatgattttgagaagcgaattag

SEQ ID NO: 3873 - DNA, 3000 bp, Unknown
  misc_feature (1)..( 3000): cDNA_ID_2781838_gDNA_ID_1620671_Annot_ID_164123 3000 nt of promoter + ATG
gtggtcaacacagctggtggtgtgtggtactcatatgccaagtaccgacagaaaaaggctaaaccggctaagctaatgtctgatttggaagctcacaaaaaatgagaatttcggtccggtttggtttcgtttgggaaggcattaccccggtttatagactttgccactcaaatcaatgatcagaacgaaccgatgtatttgagagttgaaccaggaaaatcggtcctagagtgagatttaattttgatgtgaaacttcattgatcagttaatttctcgtttaggttaagaaaaaaaaaaaatcaatacctatttttatatgtagatgcaatcatgctaatgtataattgttaagttgtggctgtagcataaccatattaaacattagacatgtgttggtatcaactatcaactatcaagaacacatgaaatgtttgttctatttaatggtggaaaagttttttaaatgggtctactactactactaattaatactttggattaagacattttgtgatagaaaaagacagcacataagtcattacaacgtcagtgacctctgtttaagtcttaattcgtttccttaaatctacggtttgtgcatacggatcataactaatatttttggtttttgaatttgcaaacgtttttagttggactttagagatttcaaataaatgaagataaataaatgactcataattcatacgaaaggctatagcatttatagagttcattttcttggcgtgaaattagtagtacattcatttattccatgattttgctcagaatattcaaatttataaaagaaatggacattactttggaagagttgaaaaacttataaaacaaaaaacataacaatagaaaactttaatcgattaaatgaattattgaatgattgtatccactaattacaattattgaaataaatatgtataaagtagagggtgtaaagcactgtatgaaaagattatgataacatagttcaaagaatatcattatgagtcataactaataatcattcaccaatacacaatcgatcatcttaatatatacatgattaatttggattcattttaaagcacacttaaaaatatatcatgtccaataatttgtgaattattatttcatcagaattgtcatagttatctaaccatttgtgtttagggcagaactgtgtctgaggctaaattcattaaaaaatgtcactaaattctgcagtttttgtttttttccatctatgacgttatataatagctagccagtaattattaaaaccgtatagaatatattcttgagtctaactttaatctacatgacaaatttttaattactcagcaccgattggtttctgtagatgcatgtcacaagcaacacaaaataaaaaaaggtattacaaaaaaatagtactaacctacaaaattacttatttataattcttttgatctttctccttttagcttttccttttctcttattagtgtttatatgatactttcgtaaaacgttaggtattgtatagtaaataaaaccttaaaaatgccaacgaatatccttatcttctagtgttctacatgtgttgatatcaccaccgacaagtatctcgggtaacctaattgttggttggaactttcagaatttttaaaactgaaaaattgacattatccttctaatgaatcacattcttcttttttttgtcaaatacttccctttgtcaaaggcatgcaccactaaattatcttttgttttacaaaatgaccaaaattagcggcaatattttacgtcaacacttgaccaattttgattgttagagagcactttgtcaataaaccaaagtataatgtttccctccttactctcctaatgtataatatatattttgattatagaactcatagttaatattgagttgcatccctttgttttaacagtaaggctttgacttacgtttgtgattataccaattaccaagtatgatcaacactcaagatttttttttgacaagaatataataatgaaaatgcttatgctttgagtaaattaatcaggaaaacttttaactcatgttaatatagtatttttaacaaatatgaatggactacaaagagaatttgactaaatgtataaaatatataatttggaaaaaacatggaacatgacatggggagcacgtaggagaagcggtgatagcaaaatagagtgattcacttgaaaccgatttggtagtatcttttcttataaacatgttccaatgtaactagtacatagttggtcacaaatacaaatttgaatttgtcttcacctcaaattgccaaacaacccatatggtccccatccatcaatggattttcctcaattttctttcttttgaatatataacaaatttgttttttttaagaaaatacaaatatttgtaatgaagatccatgacatgacaagtgcttgtgaaagattacaaagagtgataataaaaaggggatgaattttgcatgctgaagcaatcaaataagtagctgaaagagtaacacacacatgaaagtgcaagtgacacatcttttacaacttctctcactgatgatacctttcttcctcttcctctgcctttgcttctctctctgagtcactacactctctcaccaacccatccttctctctgtcattctctaaaaaaagaggtccactataaatgagccttgagctgtggatgcttctttgtctggttttttagaatataataaaaaacaaaatgggtctctagatttcagatttctgggatctgggtgttagattaatctctttctcttccattattagtagagaaagctcactcctttcactcaaagtttctacctttttgttttcctgaaaatgggttgtgtttgaaatctcacactttgagatttgggtgtttattttgggatccttcttaccacatttagaaatttcagctagggttttcgatttctctacttctcagaggagattttagaggcaaaag

SEQ ID NO: 3874 - DNA, 3000 bp, Unknown
  misc_feature (1)..( 3000): cDNA_ID_1822300_gDNA_ID_1620671_Annot_ID_164118 3000 nt of promoter + ATG
catcaatttcttgcaatgaagcttctagattctgttcttttaccttgagctccgactgaaaccgccttacatcggttaaagtatccacaatactctgtttcacctttttaacgtgatcagatattgagcaaggttgcttttgctgcaagtttcccggatcagccctagtgctgcgagatggccctccttcctcagtaacttgagctctcttttcgacccgattatcagtttgttcttcagccagtggtgcttgatccgtcattcggggtttcctatccgcagtcttatggccatcagatgatgctgcttgtttcacctgaacacaattcgttttaaaacaacgatttcacaatagcaaaagccaagaacaaagactgtaactgattttatgttaaccttggaacagatcttgagaattggagatggtcctcctcgaataacctccaatgtgaagggatcaccaacattctttacgccattagctacaaagaaatcttgacaacctctattgtaaaactgatcgcgtcccttgatgttaactagatgcgacttccactctatgccatctttgttcaatacagttacctctcctgcttccacgatcccgttctctcttgcgaacgatgcaggaagaaactgtacattttcaacacatttaagcgaatgacaacacaaaaagacttgaaaaacacctagaacaaaggtcttgaaaacttacaaattgacatgacctgaacacgtaaggtttaagatcaaacgtcagaatcttgttctgattcaatggaatagtctctgagcaattctcagattctatctcatcaccttcaatttcagaaacatttcgtttttttcttgctttggaagagtttccttctggaatgctagaggcgttgggacacagctgtagcacaggttttattccgctttggacaagcttaaacctacagatagatccagctttgatcccgttattacgacaaaaacttctccatcctccacgcataaaagcctgaccagtttttttgttgtgtctcaaaagcagagtccaagatttttcatgttcatccctcagatcaatctcacactctctcctgtccagaccatttgaccttgcaaatttgcttaaaacacactgcaaaatcacaacttcatatatattgtagcaaaagaatagaatgagaattgtattaaagattccagcgaagtagtaatcaccatattatctcggagtaggcttgaaggtgtgacgtgtgcaacaagataagatttgtctgatgaagactctgtttcttttcttgctctcttcttcgacgaaattttctttgaacaaaaatcatcttcggatatcgaattgtcatcatcatctcctacatcgtcgtcttcatcatcatcaaaaacagtgcgttcatcatcatcatcgtcagaggtagaagaagagattaactgtatctgagagaaactacgtccgaagggtgagacgtggaagaccatgcctccgtcgtgccggaaactcaaaaggtcgtcgtctctaacagagtgggagacggagaaatctttccatccgccggcgaatctcgcgccgtccaatttcacgtcccagtttctgtccgaagcgtcagaagttagtttcatattcgttgactgaatcttaccattgaagtgattccaaatgaactcagtaggaatgatctgcaaccacaacaattaagaaaaacagaaccgattgatgcattgtaacagagacatggaaagagacgatgagatagagacagtggaaaagtacaggattggatttttgtccagatagatctatgatgaagaaagctttgttggttggggagggaatcagtggatccgccattgtcgaacagctaaagtaattattctctgaaaatttgcctcttcgaattattcttcgctggcgttatagtaaggtttataatctaaagtctaaactccgttattcattctcattaaacacctgatttattgtcattaactaaataatgactgtgttaaaaaaaaaactaaaaaaactaaataatgacttggtgaacaaaattatttaatgacaaagatatttcttgataaacgcattaataaccgaaggcttttttttttcttctgatttgatcgatgtaggactgaaaagtaagtcagaagaataagtttcaacccaatttctaaaaatctaatcgtttgatttgattatttttttcccaggattaaaaactttattttattctatttgatatctatatagtaaaaatcaacactattcaataacaaatttttgttcattcataactgatatcaaactattaatgtattaattaaatgagtcaacaaaataaaaattcatatattctttgtaaagtttaagttatttggatctttatgttgttgattcatttagctaacacatttatatctacatttttttttgttcaaccctttttttacatttatatctagagatattggaagaaaaatgtaatgagtttattgtgttacttcttcttttttcatatacaacagatttatttcttttacgttaaactttatatattgacagataaattttgatagcaacagttaacatagtgatttatctttttgtcaaccatttaattaacatgcataagattggtcaatttattccctgctttatgtgatttagttagttttttcataagttgaataacagagactaatgaagacactgtttacaaaaattatgtaagttttattcacatagttaattttattgaggatcccattactgtttctattagggcatgtcagaagacttcgaagtaagcaaaaccaaaagagtaaaaactatcttttcgctttttgcattattggatttaagtagaattgtaaaattaaagaagtaaacagagtagtactcttccaaagcaactcaaaagctccaaaatttctgtgaatctccccaagaacactttttggatctttaattcgaagtgatcggcaatg

SEQ ID NO: 3875 - DNA, 3000 bp, Unknown; identical to SEQ ID NO: 3872
  misc_feature (1)..( 3000): cDNA_ID_1807213_gDNA_ID_1620671_Annot_ID_164115 3000 nt of promoter + ATG

SEQ ID NO: 3876 - DNA, 3000 bp, Unknown; identical to SEQ ID NO: 3870
  misc_feature (1)..( 3000): cDNA_ID_4450919_gDNA_ID_1620671_Annot_ID_164112 3000 nt of promoter + ATG

SEQ ID NO: 3877 - DNA, 3000 bp, Unknown; identical to SEQ ID NO: 3869
  misc_feature (1)..( 3000): cDNA_ID_1459029_gDNA_ID_1620671_Annot_ID_164109 3000 nt of promoter + ATG

SEQ ID NO: 3878 - DNA, 3000 bp, Unknown
  misc_feature (1)..( 3000): cDNA_ID_3072066_gDNA_ID_1620671_Annot_ID_164105 3000 nt of promoter + ATG
ttcttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagagatgaagattgcaattgaaggttgtatgcatggagacctagacaatgtgtataaaacaattcaacattacgaacagattcacaacactaaagtcgatctcctcctctgctgcggcgattttcaggtaatcgtttgtttttttttaccttgaaaataaaaatccattcgattctgcttcctaagtctgaaaagattcgttctttgtggaaaacattaggctgttagaaatgagaaagacatggatagccttaacgtacctagaaaatacagagagatgaaatctttctggaagtactactccggccaagaagttgctccgattcccacaattttcattggtgggaatcatgaggcttctaactacttatgggaattgtaagttatctagtatttgagtttaggattccgaggcttaaaaaatgtgttcttgatggttgctggttgttgtgctataggtattatgggggttgggctgccaccaatatttactttttgggttttgctggagttgtcaagtttggtaatgtgcgaattggtggcctttctggtatatacaatgagcgtcattaccgttcaggtttgtttcttcttcatctctctgacaaagtaccaatttttcagcttttgaaatgggagaaagttggatttctgagttagtgtctatagtggaaatgtatagattagggaattcgtttgatttgtttggtgtcaataaagtgagaatcagtcatttgtgtgagtaggacactttgagcggccaccatataacgagagcaccatcagatcggtctatcatgttcgtgactatgatgtccagaagttgatgcaacttgaagagccgcttgatatatttctatcacatgattggcctgttggaatcactgattatggagactcagaatcacttatgcggcaaaaaccatactttcgtcaagaggtaaatctgtgggaacatgattctacttcttcattttggttttgagaggttttcaattgatttgaccaaaatttattacagatcgaggaaaaaactcttggaagtaaaccagcggctctactgctagaaaaactgaagcctcaatattggttttcagctcatttacattgcaaatttgctgctgctgttcaacacgggaatgatgggtcagtgacaaaatttcttgccctcgataaatgccttccagggaaaaagtttttacaggttctctttctttcctgtccacaacattatgctttgttcttttgaaacaaaaaggatatcttttaatttctttggatgttcattagattattgaaatcgaatcagagcctggaccctttgaggtcctatacgatgaagagtggctagcaatcacacgaaagttcaattctattttcccgctaacaaggagatacacaaacgtcaggtataccatcccgaacaagctacctactaagaaatgtttatatatcttccatttatctttctacctaccgtcccacttacgtattgttttactacaatagcactgctggaactatacaagagagccgtgagtgggtgaggaagaagctagaagaaaggcaatttaaaccttttgagtttgcgagaacagtacctgcatataacccatcacaacgtgtatttgattccattcctggtatgttaatagtgtactggatatagaggattataaaaagttgatggatcgattaaaagtgttttattcatatggcattttgtagagatcccgcagaatccccagacgctgtctttgttagagctccttggtctcccatatctccttgattcatcaccagtaacaggggaaagaaccgatatccctgcttcactggctccatcaggtatgacgatagttttctttgtagatgaggacttggtttgggattatcagatacatattctgtgaagttgttcatttactctttctatctgcctattgtcatgaaactgcatcaagcaccaatgacagagatgtttagtgcagtgtcaagaatcaaacatgtcttgttgtgtattgcagatcttccgacatatgatagcgaagaaatcccaattgatgacattgatgaaatagaagagatggaggaagcaaaagcagatgatcatacaagagacgatgcatgaatatctccattccagtggtcagaatatattttatcttgctaatatctgactgcttcatcgtcaagctggaaaacaaccacattagttgggattctgtgattagaaaaccaagttttcttgttcattttttagaatcagcataagttttatttgtgatattaaagaaaagtgaatcataaaaatgtcttggagaaataaaaagttagatattaatgtttcatccagtattcaagaaagttgatcaccttttcttccacaagttctctggcatgcattggcttgggaagttactcgccgacaaaacccatagataagtatgtcggattcacttaaaaccatggatgatgctgggaatgttggattcaactaaacacgaccatcaatgattcttcattgaatgcgttgactcaacttcatcacctcaactaattttctatctctgacactaacatcaaatgcaaattatgaagtgaacagttgcagtttattacaacaaccttcaagattcctctcattctcctttctattttcattgtcactttattcgagtcaaaacacagagacaataaaa

SEQ ID NO: 3879 - DNA, 3000 bp, Unknown; identical to SEQ ID NO: 3867
  misc_feature (1)..( 3000): cDNA_ID_2138953_gDNA_ID_1620671_Annot_ID_164104 3000 nt of promoter + ATG

SEQ ID NO: 3880 - DNA, 3000 bp, Unknown; identical to SEQ ID NO: 3866
  misc_feature (1)..( 3000): cDNA_ID_2107050_gDNA_ID_1620671_Annot_ID_164103 3000 nt of promoter + ATG

SEQ ID NO: 3881 - DNA, 3000 bp, Unknown; identical to SEQ ID NO: 3874
  misc_feature (1)..( 3000): cDNA_ID_1822300_gDNA_ID_1620671_Annot_ID_48164 3000 nt of promoter + ATG

SEQ ID NO: 3882 - DNA, 3000 bp, Unknown
  misc_feature (1)..( 3000): cDNA_ID_1822296_gDNA_ID_1620671_Annot_ID_48165 3000 nt of promoter + ATG
tatgaaaaagagtttttaaaacgaaaccacctttctcaataagctaatgctcgtagaaagggacagagacagagtacgaggtaggagtcgaagcaaggaagaagaggctgaaagaaatgtgggtttgtcgtagattgaagaactggatccgccattgttcaacaaaaaaatgactcaagtctaagttaaagatcagtgtcttttcgttatcatctcatggctcctcttatttattagacatcccgctacctgttttaatgagtcacaacatttattttccattaatgagtcagggaactcagctagtatttatggcctctgcattacctgaggtggagtatatttctagtgagtactatattggtaaaagaatctaaacatttaacctttttgttaaaagaaaatctaaaaactcttactgaagaaaccctaaaataaattaaaccctaaaacgaatgtgctttcttgatcccccattgtagctagtagtttaatattacgtgggagagtgctataaaaagtccaacctaacgctccatacatgcgtagatcatgtttcaaatcataacttagttttcgtttcctgtaacaaagcttccaaattatgttcctttgtctcgagtttagcccggaaccgtctaatactatttaaagtatcttcaacgctctgtttcaccttagccacatgatcaaagataaagcaagattgcgtttgctgcaacttttcttgatcaccagtagccttgttagatgaccgagtgcaacgagatggccctccttcttcatctaacttctgcctcacgtcatgcttctgtctactccccccgctgctactttggactcgagatctcttgtgtggccgagcctctgctccagcctttgggcggctgcagagccgaaacacgggaattttcgggttgcggagcagtttaaatgtacaagaatctccaacttctaatttatttgcagtgcagagacttgtccaacctccagctataaaaacccgaccagacttgtaacttttaacttctgattcccatgtatttccttcttcgtccatcaaaactatctcatgcctacctatgttcaaaccatatcgctttgcgaaatctctgggaataccctgcagtagttatcaaacacaaacacaaacacagtcacacatactcaaactctaaaatcgatatatggaacacaatcataactaactaaccactaaatctctcgttaggtttgaagcggtcacagattggctaaaacatgttagatctggtgaaaactgatcaggttctgttttcacattctcctcaataattttctcatttcttgaagattcccctgaagcagaaatctaacgcttaacaaatagtaaagagtctagataaatctaaatgctctctgaatgatgattatgttataccaatttcatcactctcttcgtttctgtcgtggctacgagatggtgcgtattggacttcacagcaactgggtcctatagcagtcacatggaacaacatgtctcctttgtgtttgaagacgacgaagtcaccgactcgaagatcatgtgcctccacgaactctttccaaccttcagtgagtttatggccctccatcttcactttccacgttctcctcgaaggatatgatctcaaatagacagtatttccctcgtgttttccctctatatgcttggagaagaacttcacagggattttctgcaacaaacgagtagaactgtgacatgagtctatatgttcagagagagagaaacagagagattacttacgatgtggctcttgaaaccgggaagaataggctggaaaaagtgtggactttttggagcaaagagtgtcggattcttcattgccgatcacttcgaattaaagatccaaaaagtgttcttggggagattcacagaaattttggagcttttgagttgctttggaagagtactactctgtttacttctttaattttacaattctacttaaatccaataatgcaaaaagcgaaaagatagtttttactcttttggttttgcttacttcgaagtcttctgacatgccctaatagaaacagtaatgggatcctcaataaaattaactatgtgaataaaacttacataatttttgtaaacagtgtcttcattagtctctgttattcaacttatgaaaaaactaactaaatcacataaagcagggaataaattgaccaatcttatgcatgttaattaaatggttgacaaaaagataaatcactatgttaactgttgctatcaaaatttatctgtcaatatataaagtttaacgtaaaagaaataaatctgttgtatatgaaaaaagaagaagtaacacaataaactcattacatttttcttccaatatctctagatataaatgtaaaaaaagggttgaacaaaaaaaaatgtagatataaatgtgttagctaaatgaatcaacaacataaagatccaaataacttaaactttacaaagaatatatgaatttttattttgttgactcatttaattaatacattaatagtttgatatcagttatgaatgaacaaaaatttgttattgaatagtgttgatttttactatatagatatcaaatagaataaaataaagtttttaatcctgggaaaaaaataatcaaatcaaacgattagatttttagaaattgggttgaaacttattcttctgacttacttttcagtcctacatcgatcaaatcagaagaaaaaaaaaagccttcggttattaatgcgtttatcaagaaatatctttgtcattaaataattttgttcaccaagtcattatttagtttttttagttttttttttaacacagtcattatttagttaatgacaataaatcaggtgtttaatgagaatgaataacggagtttagactttagattataaaccttactataacgccagcgaagaataattcgaagaggcaaattttcagagaataattactttagctgttcgaca

SEQ ID NO: 3883 - DNA, 3000 bp, Unknown
  misc_feature (1)..( 3000): cDNA_ID_1822292_gDNA_ID_1620671_Annot_ID_48166 3000 nt of promoter + ATG
gaacaaaaatttgttattgaatagtgttgatttttactatatagatatcaaatagaataaaataaagtttttaatcctgggaaaaaaataatcaaatcaaacgattagatttttagaaattgggttgaaacttattcttctgacttacttttcagtcctacatcgatcaaatcagaagaaaaaaaaaagccttcggttattaatgcgtttatcaagaaatatctttgtcattaaataattttgttcaccaagtcattatttagtttttttagttttttttttaacacagtcattatttagttaatgacaataaatcaggtgtttaatgagaatgaataacggagtttagactttagattataaaccttactataacgccagcgaagaataattcgaagaggcaaattttcagagaataattactttagctgttcgacaatggcggatccactgattccctccccaaccaacaaagctttcttcatcatagatctatctggacaaaaatccaatcctgtacttttccactgtctctatctcatcgtctctttccatgtctctgttacaatgcatcaatcggttctgtttttcttaattgttgtggttgcagatcattcctactgagttcatttggaatcacttcaatggtaagattcagtcaacgaatatgaaactaacttctgacgcttcggacagaaactgggacgtgaaattggacggcgcgagattcgccggcggatggaaagatttctccgtctcccactctgttagagacgacgaccttttgagtttccggcacgacggaggcatggtcttccacgtctcacccttcggacgtagtttctctcagatacagttaatctcttcttctacctctgacgatgatgatgatgaacgcactgtttttgatgatgatgaagacgacgatgtaggagatgatgatgacaattcgatatccgaagatgatttttgttcaaagaaaatttcgtcgaagaagagagcaagaaaagaaacagagtcttcatcagacaaatcttatcttgttgcacacgtcacaccttcaagcctactccgagataatatggtgattactacttcgctggaatctttaatacaattctcattctattcttttgctacaatatatatgaagttgtgattttgcagtgtgttttaagcaaatttgcaaggtcaaatggtctggacaggagagagtgtgagattgatctgagggatgaacatgaaaaatcttggactctgcttttgagacacaacaaaaaaactggtcaggcttttatgcgtggaggatggagaagtttttgtcgtaataacgggatcaaagctggatctatctgtaggtttaagcttgtccaaagcggaataaaacctgtgctacagctgtgtcccaacgcctctagcattccagaaggaaactcttccaaagcaagaaaaaaacgaaatgtttctgaaattgaaggtgatgagatagaatctgagaattgctcagagactattccattgaatcagaacaagattctgacgtttgatcttaaaccttacgtgttcaggtcatgtcaatttgtaagttttcaagacctttgttctaggtgtttttcaagtctttttgtgttgtcattcgcttaaatgtgttgaaaatgtacagtttcttcctgcatcgttcgcaagagagaacgggatcgtggaagcaggagaggtaactgtattgaacaaagatggcatagagtggaagtcgcatctagttaacatcaagggacgcgatcagttttacaatagaggttgtcaagatttctttgtagctaatggcgtaaagaatgttggtgatcccttcacattggaggttattcgaggaggaccatctccaattctcaagatctgttccaaggttaacataaaatcagttacagtctttgttcttggcttttgctattgtgaaatcgttgttttaaaacgaattgtgttcaggtgaaacaagcagcatcatctgatggccataagactgcggataggaaaccccgaatgacggatcaagcaccactggctgaagaacaaactgataatcgggtcgaaaagagagctcaagttactgaggaaggagggccatctcgcagcactagggctgatccgggaaacttgcagcaaaagcaaccttgctcaatatctgatcacgttaaaaaggtgaaacagagtattgtggatactttaaccgatgtaaggcggtttcagtcggagctcaaggtaaaagaacagaatctagaagcttcattgcaagaaattgatgcgttaggtatgatctgaataccagtgaacactacttttaattgtgtgtgtggtttattttggttccagattttttgataatgtgatgttggaaacaaaaacaggggaaaagataatgggaatcagcaaaatcttcaacattagtcaagtttaattcagaaataaagattagaaaatggaccaggtactttatgtttgcaaccatggagttaagtatgtcactggataatatttcggaacttttccgtttccacttgtcttggatattaattatcccatagcctttatctcattcacgtctccgtcaagataaagttactgacattgtctttagattcgtatcccagtgattgaactgttgtactgaacgggacatgtctgtcttggtaatgatggtaagatagacttttaatttaaactggatattttcttttttttacgaaccaatctaaacgattcgttcttatagtatgaatcaaacgggtttaaataatgggttccataacattatcattaggtatttggctatgatatttaaataatgctgacaaaaataaaaatatcttggttgaagaattaaatttacaaaattattaacaaaacgtataagactaaacaaaaaaaaagaaaaaaaaaagacaaatttggctataaaaccaaaaatccataaagacctcaagaaataacttaaagagttcaaca

SEQ ID NO: 3884 - DNA, 3000 bp, Unknown
  misc_feature (1)..( 3000): cDNA_ID_1822288_gDNA_ID_1620671_Annot_ID_48167 3000 nt of promoter + ATG
tcaaaaaccaaaaatattagttatgatccgtatgcacaaaccgtagatttaaggaaacgaattaagacttaaacagaggtcactgacgttgtaatgacttatgtgctgtctttttctatcacaaaatgtcttaatccaaagtattaattagtagtagtagtagacccatttaaaaaacttttccaccattaaatagaacaaacatttcatgtgttcttgatagttgatagttgataccaacacatgtctaatgtttaatatggttatgctacagccacaacttaacaattatacattagcatgattgcatctacatataaaaataggtattgattttttttttttcttaacctaaacgagaaattaactgatcaatgaagtttcacatcaaaattaaatctcactctaggaccgattttcctggttcaactctcaaatacatcggttcgttctgatcattgatttgagtggcaaagtctataaaccggggtaatgccttcccaaacgaaaccaaaccggaccgaaattctcattttttgtgagcttccaaatcagacattagcttagccggtttagcctttttctgtcggtacttggcatatgagtaccacacaccaccagctgtgttgaccactaaaccggacacgttcaaagcatgtacttcaacaccacccaagaggacaaaaccgagcgtctaggagattaaaaaggaggcaaagattagtaaatgattgcctctatagatttcatctcgaaagagagccaaatgagggtttatacttacagtggaaccaacgcctttgagaacaccaacgatggttgttgttagtgcagagttcacaatggtgcaaagaaacatggtgaagttgaggacaatgcccataaccagtgaaagaatgagaatcaccaagaacggcaaataagaacactgtcaaagaaaaaaaaattgattttgacattttgaagagactagtttctgagaatagccgcaagcttggaatgatgaagtttctaacctttgcaagtaatagtgatagagagtttgggaattcgccggtaactatgatgaggatggacaaaaatgggagagaaaggaagctgttatagaacattatctcgatggaggaaagcccgtcttctgcaccagacttctccaccagcacaaggtacatagtctgcagcaatgatgagaaacaatattcatttactcgtatgggtgagtggagactgatttaagagaaggaaaagaacaaatgaaaccaacctggaaaaagacagatgttaaagccaaaccatacccaaaaagatcaaaagaaaaatcaccaagagctgcaattacacagcctgcagcggtaagtagtacagatagagcaacctgaaaattaaacaaaagattcagagcttgaaacattatacaaattcacaataaaaaatcaacattcttatggtaagtacctgagttgttggtttgcctttaccaaacaaaaccccagaaatcaaaacagcaagtggagtgagtctcttaatggcgatatacattggaatgtttactcctttcaaacttgcaagagcaaatgcaacattagcattgtagaagatagaaaccggaagaagctttttggccgtagccatatcaattcctttagctcttgtgtatcccattcgtctaccaaagtgtataagcaaagaagtagccaattgctaacacaaccaaacaaaagcaaacgggaccgaattcataatcagcatttacaggaagtgaataatctctttagatatctagtacttgagaaatatggatatcagtacctgaagagtaagaacagtcatggaatgtggatactgcataatcacagccttgttgataaaaaccattgccattgaagcaatgccatatgaaacagctgcgactaaactgcatcatagaacaaaccagtaaataaggttacttaaaatgtctatagctttgattctctataactctctagagatccagatctacccagatgaagaaccgcaattcaaagtttcaaaaatcacaactttaagaagttatcgaatcctctgaaccaataattatcacccctactaactaaatcgatcagaaacatccctaatcgaattgaatttgaagaaacagagcactaaagaaggagactacagtacctaatggacgaggtaggctccatttcagcttgaacctccatggggaaagaagagtgatttgagttataaatctttggaaaattcctctcagggtacacgtttcttggcagattcaacgtgatttagacgcatttcgagaagaaagagcgattaaaaattacttctttatcagattttcatttcaatttacagtttttttcccttggattgaggatcttagttcttaagcgaggttacagctttttccagtggattactaaattggacgagagagtaatagtcaacactcaaaaagtctttaaccttctgtcggaacaagaagggcttgctgtccgttgctcatctcatatagtaaggcccaaaaggcccaaaggcttctttttccaattaaaactaatttttgtatagcgaaattatgatgaagaaaatcgtttcatggcacgtcaaaaaactttcgcacaacaatttttttttacaaaagggtcacttttatcagaacctaatctatcatagagttcccatcaacaaaaaacctatcatagagtctagtcctgtgttaacgtaggtgatgggttggtttcatggtttacatggacaattattatggtgtaagaaaaagatgatgggtacacatattccatttaaccaatgtgaaagattcacatcacctttttcgatttttaatagattcggttttaccttctcgtaacgtaattctaagaaaagaaaacgtcaatcatatttactaggaaagataattataatttattgctttttctctcactctctgacctgaaatctcctactgagatttttgaagtgtattcaacaatg

SEQ ID NO: 3885 - DNA, 3000 bp, Unknown; identical to SEQ ID NO: 3873
  misc_feature (1)..( 3000): cDNA_ID_2781838_gDNA_ID_1620671_Annot_ID_48169 3000 nt of promoter + ATG

SEQ ID NO: 3886 - DNA, 636 bp, Unknown; identical to SEQ ID NO: 3864
  misc_feature (1)..( 636): cDNA_ID_1822280_gDNA_ID_1620671_Annot_ID_48171 3000 nt of promoter + ATG

SEQ ID NO: 3887 - DNA, 3000 bp, Unknown
  misc_feature (1)..( 3000): cDNA_ID_1822358_gDNA_ID_1620672_Annot_ID_48173 3000 nt of promoter + ATG
catcattcacattgtgtttcagtttagaactgcttatatctctccttcttctcgtgttttcggaagaggcgagttggttgatgatcctaaagctatagccatcaagtacctctcctcctacttcatcatcgatcttctttctatccttccactcccacaggtaacctttagttcctaatggttttatagttccttcttgatggttctttaatattctgttgtatctgctgcagcttgtagtcttagctgtcatccccaatgtcaacaagccggtctctttgatcactaaggactatttgataactgtcatatttactcaatacattccaaggattcttcgtatctatccactttacactgaagttacaagaacatctggcatagttactgaaaccgcttgggctggagctgcttggaacctatctctctatatgttagccagtcatgtgtttggagccttatggtacttaatatcagtagaacgagaagacagatgctggcgtgaagcttgtgagaagataccagaagtgtgtaactttagatttctctactgcgatggaaacagtagtgttagaaacgatttcctgactacctcgtgcccgtttatcaaccctgatgatataacaaattcaactgtcttcaactttggtatctttactgatgctttaaagagtgggattgttgaatcagatgatttctggaagaagttcttctactgcttctggtggggtttgcgtaatttaaggtttgtaacactctctctatctagttattagtaatttaggattcatgtgacacacttgatggctggctaagatatgttgagcatgaaacactaatctgatcacttgctgtttctcactcgctgcagtgcattgggacaaaatctcaatacaagcaaattcgttggggaaatcatatttgctgtatcaatttgtatatctggactagtcttattcgcactacttatcggcaatatgcaggtatatattcatttcactgccttttttccatcacttacttgatccccaaggaagataaaacactactgatgtttccactttccataacagaaatacttggaatcaactacagtgagggaagaggagatgagagtgagaaaaagagatgcagagcaatggatgtctcatcgaatgttacccgatgacttgaggaaacgtatcagaaggtatgagcagtacaaatggcaggaaactagaggagtagaagaagaaaaccttctgcgtaatctccctaaagacctcaggagagacatcaaacgccatttctgcctcgatcttctcaagaaagtaagtgcttctagttccaccttatctctttgatcctcaaatttgacatttcattcaaataatcattgatcgaatcaaatatatataggtacctctgttcgagataatggatgagcaattgctagatgccgtgtgtgacaagctaaaaccagtgctctacaccgagaacagctatgcaattcgagaaggagatccagtggaagagatgttgtttgtcatgagaggaaaactgatgagcgccaccacaaacggtggccggaccggcttctttaacgccgtatacctaaaacctagtgacttttgcggcgaagatcttctcacatgggcattagatcctcaatcttcgtctcattttccgatatcgactagaacagttcaagctttaaccgaagtagaagcctttgctcttgcagcagatgatctcaagcttgttgcttcacagttcagacgactacatagcaaacagcttcaacatactttcaggtttgtttggtctcttttgactgatctctctgcttctccaatctccggttctgtttggtttaattcggtttaactgtcaggttttattcggttcaatggagaacttggggtgcgtctttcatacaagcggcgtggcggagacattgccggaggaaactagctagatcattaaccgaagaagaagatcgattccgaaacgcgatcacaaaacgcgaacgcaatgcggcgtcttcgtctagcctggttgcaacgttatacgcgtcgcggtttgcttcaaacgcgcttcgcaatctgcgtacaaacaacctacctttgctacctcctaaaccctccgagcctgatttcagtctccgaaacccttaaaatatctcttacacatgtccacttaccacttgtatataatattgtgtcaacgacattaaagcttaaactaattacaaaaatttagtgaccctattttataggcacgatgctccaatggtcacttttaaaatagagtttcctcaaaaataggaaaaaaatagagactaaatgtagagatctttatttatagagatgatatctcctctattttaaagaaaattctattttacatgtgaccattggagcagcctctaaaatagagtcatatctataaataaaggaaaatatagagatcactattgaagatacctttataaaaataaaacatggttatatatatgaatttgataactttaggtaaccttaattttttttttagttttaaaagctttggagtaaatataacaaatttatttaaaaattgttttttcatgtgtgtgttttgaccaaaaaaaaacaaataacatgtttaaccaataacatacaatttatcatgttattttatctaagagtaatttttccatatatatatatttattataagattcaattgtagataatttttacttaataatacatcatttaccatatcatatatagatattagtttggtcaaattgtacaaaaaaaatcgatttctcctgaccgacatagattcagacaatataaagcccagtcataaacccaaaagtgtggataagataataatcttagcccaacaagcagcgagagagagagagacttattattagggctccgtcaaatttccccaatttctctctgattcctctctagaaatcgaacttcttcttcttcgtccaagcttttgaatcgaaaatcgatg

SEQ ID NO: 3888 - DNA, 3000 bp, Unknown
  misc_feature (1)..( 3000): cDNA_ID_1822354_gDNA_ID_1620672_Annot_ID_48174 3000 nt of promoter + ATG
acaagacaacagcataactcgaatatctgtactcaagtgattcaaaactagcttggacccaaagagcacttgtcaacttggagattcttaaagatacctgttcacaatgaattttcttcaaaatctgccgccggtaggcatagataggcagtccatcctctagccttcgacactctctaagaatcaaataatgaatacgtctccaatcataggccccttccaaagaaaacacggccacgtcttcgtcatcttcatcatctacatcaaactcatacccgtcttgtcctatgagatatcgcaaaatgctcttcatggcattattgaattcgtcaagccgattcacaaccaaatctctctccgcttcaagagccttctttttctcaaaaacctcaaatttcagaccccttttagacgaaaaggacgcaacttgacgagacttgtcatcaatctccattctcaccttcttgaccccttgtccattttccataagcgaaagaacatgagacgagaaaagatcacgaagcctgtctttaagctcgtccatgtcagacggaacaacaacattaggaatcagctcaggaacaaaatcatgtctcccttgaagacgataatcccaaagagccacaacggcagaacgcgcatcgacccactgacgaaaactgaagcttgcagcgatacaaccaaattgaggcacgtgaactgattcctccggaatttcgcaaagcaaagcgatactctcgatctcttgcttcttagacagctttgtgtcactgttagcggcggcggggtgaagcagctgaacgatgaaattaggcctagcccgcgtgactggaggagagaatcccgacgacggagcacgatcacgtctgtaatttggcgggaaattagtgttatggtactgagagtgttgctggttccaagtagtacagtggttgagcggcggagaagattgtgcagagcgagagttataacggttcgttgaggatgagggaaacgactgctgacgacgatcagtcgtcgatctcccaccgtctgaaggaggaaaagagttcctcatgatgagatgatgccagttttttttcttgttaagaatgagagagcgaaagagaaagagtcagaagttgaaaagagtcacagaagagtcagagagttatatcaatcaatattaaaaccctattaaaatttatttaacttttcgtctactctttcctttttctttaacctaatttaattttcttctaatcaatattaaaacccattttgttactatcaattctttaattattggttcgacctatagaaacatccagaaatccaaatttgaggataaaagtgttaaagtaacatttcttagtatttcaattttatgtttttaccacattttaaaatttaagttagaaatagtgtatctaccaatgatattgccatatacgtattaaaatgtacatatcatcaaaagtaaatatgaaatcttaaaggtattaaatagttaactcatattcttgtaaagtttaatatttgtataccatttagattttattcaaagcattgaattttattaataattagttagtagtttcaaaaactattttaaaatccctacaaaaaaaaaactattttcaaatccctacaaaaaaaaatactatttcaaaataaaagaaaatagaaaatattgaaagcagaaaatatagaaaggtgttaacaaaattatataaaagaaaaaacaaacagaaagtgttacatgttttatataaaaaacaatttggttaaaaatttcaataacctcatatcattttttctcatctgcttaattaatgatattcaaatgagttattttcaaaaaatattgcttatataagtgatgatatgatgcggttcgctacaaatttttcgtgccaataaaaatttcatatatttttctacattttttgtcaacatcatatattattatttcctaattttattagaactctcgtctttaaaaagttttaaaagcgtcatttatcgttcttttatctacaaaaaaaaacaagatttcatgagtcagacaagacaaaagccataaacaacacaaaagtcctgcaagattgctcacttgggcggttgggcctatatgaaaatttactatctcaaaatttaactaagagcccataaaaactgtaagatctttgctttaaatcacattgtcttcatagattttgtgattcatggtagatttgtgaagatctttggtcatctttttgtttacatttggcttattgagtgtagagtgtgaacaatctgctatgaagttggtaaaattctttggatccaaacctttaaatcgtagcatatttactatttcacactgctaggatctgtttatagctgatgcattactggaatctatgatgtttactgtgttggtctgatatataacaagttctgaattttaaaatcaaattcaatatcgaattgggcttttaattaaggttaggcccatcaaatgtttttgactctttaataattccctctcttttgtcttttattgtaaaatgcacacaatttcgaagaaactgccaatggagtctccattttccagcgccatgccaagcttgactctacgatgatagcttatttgactgcttcaaaaaaaaacttcagagaattaatttcgagaattttcccaatttcagatcatcggaaaattcttactataatctttcttatatcgcttctctcagttacttcaacgttctggtcagtttcggatataaatgttttaatttcttagtttccgtttcttcttcttcttcttttttttttttttctgttactgtaaacttggggataacgaattaaagcgatcaaatcgatgttcttatgattcaggatccgttatagcaaaaaaagcttgactcatggcttttggccgcaacaatcgtgtaaggttgttgtttgcttgctttctttaatctctgtctttttttttttttagaatgaatttactgagaaactatg

SEQ ID NO: 3889 - DNA, 3000 bp, Unknown
  misc_feature (1)..( 3000): cDNA_ID_1016643_gDNA_ID_1620672_Annot_ID_164137 3000 nt of promoter + ATG
ccggagctccaaggtatcaaagaaaaggtgcatggtgtggatctcaagctcaatacccggtaccatgttattcaggttcatgggagcaaagaaatgaggcaggaagtacaaaagatggtcaatgaacttgcacgagaaaagagtgcactgggtgaaaaaccagatgagattgaacttgaatgccccatttgcttgtctgaagttgatgatggctactctcttgaaggatgttcacacctcttctgcaaagcttgtttgttggagcaatttgaggcatcgatgagaaactttgacgcattcccaatactttgttctcacatagactgtggagctccaatagtagtcgctgatatgagagccctcttatcacaagagaagctcgatgaactcatcagtgcatccttgtccgcttttgtaacatccagtgatggaaagttgaggttttgctccacacctgattgcccttccatctaccgtgtagctggacctcaagaatccggtgagccattcatctgtggagcatgtcactcagaaacatgcacaaggtgtcacctcgagtatcacccgttaatcacttgtgaaaggtacaaaaagttcaaggagaatccggacttgtcgcttaaggactgggcaaaagggaaggacgtaaaggagtgtccgatttgcaagtcgacgatagagaagactgatgggtgtaaccatctgcagtgccggtgtggaaagcacatttgttggacctgcttagacgtcttcactcaggcagaaccttgttatgcccatttaaggacaattcatggtggaatcggattagtcgagttaggtgtcccagagcaccctgttgcccagcctgttcacaggctttgaaaccggactggacccatgtatctatatcctgtaacatctggtttgcttaatgtgtacatatatgtgaacatagtgtagttcggtatagtaccttctttaaccaattgaatgaaccgatcatattctaatccggatgccaaataaactaaagattgttgtaaatgaaagacttgggacttgactcgctacatcactgattacgcgtaaatgtctacagagagtttactaagttgaaagaaaactacttcctaacatacagagacatcgccattaatggccttaacttaagagtcaaaaaaacatttgatgggcctacccttaattaaaagcccaattcgatattcgaatcgaacccaccggcctaactaaactgttcagtgtccccaaatctttttgcaacttctttcttcttcatattcttctcaccgtgaaggcgtcgtcaccgccgatgttattatctccggcgatgttttctgatcatcactgctttactcttactgcgaggttggttattttcaaatcttcttctctccgttctttctttcgaagtcagaaactttgccgccattttcagtaaaagggttgattctacattccctagaatcatctaataactagggttttcattaggttacgtattggttaaaattagttgaaatcatgtttcttatttctcttttcgaactaaatttggtaatcagatctctagagtgtatgatttgtcataacatctaatcgaaattagaatccgtatatgtttcattcagagaataaatcctgacttgttaatttgatatagaatgtcagattctgatgaagctaaaacgtcggaggaagaatctcaacttgctgagcaagaaacagagactcaagaaggtgaaatgactaaaaacttaaagaaaagagatcttgatgcagtagaagatgaagattcgaataacgaaagctccagattagagaaactagagaagaagataaaaaaagaaacagcgaggaagcttgaaactgactttgtgctaacaggggaagaggatgatgatgcattgcccttagcctgttccatttgccaaaacccattcttggatcctgttgtcaccaactgcaaccattacttctgcgacaagtgtgctctaaaggtaatcttttccttacaacaagtttcgtaatttctgaaaacacactcaaaacagattttccttgttattttttttcataatgcagcatcacactgagaacgatacttgttttgtgtgtaacgagccaactctagggcttttcgacacagccgtggagatcaaggaaagaatagaggaagaacgtgagaaagccagaggtttgttaaaaacgcaaaactctctgttttgacaccaaaaacctactcttacaaaactcgctcggtgatgtctctttgtagccatggtaaaggaagtgacagcaatgttagaaaaggcatcgacaatggcggatgacgccaagggcgtagcgcaaaaggttgtaaaaatggtggaggagattgaaacaatggtggaaaaagtggcggctatggccacaaaggcgggagaaacggcgacaatggcggcagatatggtgaaagaagctgaggagacgatggaaacagctaaagctaatatgtccaaagcctttgtggtaatgaagtcggtgaattggaacgtgtaaatcgggtcaaaacagagttttattgtgatctcatgctgacatcagctacaatctttatctaataagatagattctcacaagattcttttatctatctactttttagagaagatgagatcatacttcggagatagataggtgtcgtaaaaattgggaagcttacttggcaggagaagagagatatacacacgtgcttaaagtcaacagctaatccaaaaaggtagacgacaaaccagttaaactaagacacgtaatctatcttaaagatttgtcggttcatcgtaaatccgttggtggattaatatatgtcggtgtcttcgttgattttcttagcctaaccaaccaaacataaataaaaatcgaagctttactttgtttgcttctattatatccacttccaacaagattcctcaaaaggaaagaagagaaagaagataagagatatctggttggtcggag

SEQ ID NO: 3890 - DNA, 3000 bp, Unknown
  misc_feature (1)..( 3000): cDNA_ID_3072075_gDNA_ID_1620672_Annot_ID_164136 3000 nt of promoter + ATG
agacagttgaatttgttatatcatcagggttgataaacgggcacgaggtagtcaggaaatcgtttctaacactactgtttccatcgcagtagagaaatctaaagttacacacttctggtatcttctcacaagcttcacgccagcatctgtcttctcgttctactgatattaagtaccataaggctccaaacacatgactggctaacatatagagagataggttccaagcagctccagcccaagcggtttcagtaactatgccagatgttcttgtaacttcagtgtaaagtggatagatacgaagaatccttggaatgtattgagtaaatatgacagttatcaaatagtccttagtgatcaaagagaccggcttgttgacattggggatgacagctaagactacaagctgcagcagatacaacagaatattaaagaaccatcaagaaggaactataaaaccattaggaactaaaggttacctgtgggagtggaaggatagaaagaagatcgatgatgaagtaggaggagaggtacttgatggctatagctttaggatcatcaaccaactcgcctcttccgaaaacacgagaagaaggagagatataagcagttctaaactgaaacacaatgtgaatgatgtagaaagcatctataaacgtgcgaagcacactagctgctatctccaagttacgatgcaaattaagacagtgtctttctccatcaacaataggaatatagaaaaacaatggatcaatagccaaagcaatcactgaagcaaaaagaaagattttgttccagttctgtaaaaaagatccttgtgggtttataatattcttctgtgtagtggtactagaattagaatctctcttcttattatgtgaaccaaaacttaaaggtttcttaagtcctctacgaacattcttcaaaactgtgtttagagatggtctagctttatttcttccgtaaccatactctgttccctctgaaatccaatctctgaacctaaacaaaaaatcatcaacaaaaaagaatattttttctgagaatcattcatatccatagtttctcagtaaattcattctaaaaaaaaaaaaagacagagattaaagaaagcaagcaaacaacaaccttacacgattgttgcggccaaaagccatgagtcaagctttttttgctataacggatcctgaatcataagaacatcgatttgatcgctttaattcgttatccccaagtttacagtaacagaaaaaaaaaaaaaagaagaagaagaagaaacggaaactaagaaattaaaacatttatatccgaaactgaccagaacgttgaagtaactgagagaagcgatataagaaagattatagtaagaattttccgatgatctgaaattgggaaaattctcgaaattaattctctgaagtttttttttgaagcagtcaaataagctatcatcgtagagtcaagcttggcatggcgctggaaaatggagactccattggcagtttcttcgaaattgtgtgcattttacaataaaagacaaaagagagggaattattaaagagtcaaaaacatttgatgggcctaaccttaattaaaagcccaattcgatattgaatttgattttaaaattcagaacttgttatatatcagaccaacacagtaaacatcatagattccagtaatgcatcagctataaacagatcctagcagtgtgaaatagtaaatatgctacgatttaaaggtttggatccaaagaattttaccaacttcatagcagattgttcacactctacactcaataagccaaatgtaaacaaaaagatgaccaaagatcttcacaaatctaccatgaatcacaaaatctatgaagacaatgtgatttaaagcaaagatcttacagtttttatgggctcttagttaaattttgagatagtaaattttcatataggcccaaccgcccaagtgagcaatcttgcaggacttttgtgttgtttatggcttttgtcttgtctgactcatgaaatcttgtttttttttgtagataaaagaacgataaatgacgcttttaaaactttttaaagacgagagttctaataaaattaggaaataataatatatgatgttgacaaaaaatgtagaaaaatatatgaaatttttattggcacgaaaaatttgtagcgaaccgcatcatatcatcacttatataagcaatattttttgaaaataactcatttgaatatcattaattaagcagatgagaaaaaatgatatgaggttattgaaatttttaaccaaattgttttttatataaaacatgtaacactttctgtttgttttttcttttatataattttgttaacacctttctatattttctgctttcaatattttctattttcttttattttgaaatagtatttttttttgtagggatttgaaaatagttttttttttgtagggattttaaaatagtttttgaaactactaactaattattaataaaattcaatgctttgaataaaatctaaatggtatacaaatattaaactttacaagaatatgagttaactatttaatacctttaagatttcatatttacttttgatgatatgtacattttaatacgtatatggcaatatcattggtagatacactatttctaacttaaattttaaaatgtggtaaaaacataaaattgaaatactaagaaatgttactttaacacttttatcctcaaatttggatttctggatgtttctataggtcgaaccaataattaaagaattgatagtaacaaaatgggttttaatattgattagaagaaaattaaattaggttaaagaaaaaggaaagagtagacgaaaagttaaataaattttaatagggttttaatattgattgatataactctctgactcttctgtgactcttttcaacttctgactctttctctttcgctctctcattcttaacaagaaaaaaaactggcatcatctcatc

SEQ ID NO: 3891 - DNA, 3000 bp, Unknown
  misc_feature (1)..( 3000): cDNA_ID_3072079_gDNA_ID_1620672_Annot_ID_164135 3000 nt of promoter + ATG
caccattatctacaaacacaattaaaatcaattcaaaatgaccaaacacagactcatttataaaactgaaccttagcagacaatatgaactagtacaacaagacaacagcataactcgaatatctgtactcaagtgattcaaaactagcttggacccaaagagcacttgtcaacttggagattcttaaagatacctgttcacaatgaattttcttcaaaatctgccgccggtaggcatagataggcagtccatcctctagccttcgacactctctaagaatcaaataatgaatacgtctccaatcataggccccttccaaagaaaacacggccacgtcttcgtcatcttcatcatctacatcaaactcatacccgtcttgtcctatgagatatcgcaaaatgctcttcatggcattattgaattcgtcaagccgattcacaaccaaatctctctccgcttcaagagccttctttttctcaaaaacctcaaatttcagaccccttttagacgaaaaggacgcaacttgacgagacttgtcatcaatctccattctcaccttcttgaccccttgtccattttccataagcgaaagaacatgagacgagaaaagatcacgaagcctgtctttaagctcgtccatgtcagacggaacaacaacattaggaatcagctcaggaacaaaatcatgtctcccttgaagacgataatcccaaagagccacaacggcagaacgcgcatcgacccactgacgaaaactgaagcttgcagcgatacaaccaaattgaggcacgtgaactgattcctccggaatttcgcaaagcaaagcgatactctcgatctcttgcttcttagacagctttgtgtcactgttagcggcggcggggtgaagcagctgaacgatgaaattaggcctagcccgcgtgactggaggagagaatcccgacgacggagcacgatcacgtctgtaatttggcgggaaattagtgttatggtactgagagtgttgctggttccaagtagtacagtggttgagcggcggagaagattgtgcagagcgagagttataacggttcgttgaggatgagggaaacgactgctgacgacgatcagtcgtcgatctcccaccgtctgaaggaggaaaagagttcctcatgatgagatgatgccagttttttttcttgttaagaatgagagagcgaaagagaaagagtcagaagttgaaaagagtcacagaagagtcagagagttatatcaatcaatattaaaaccctattaaaatttatttaacttttcgtctactctttcctttttctttaacctaatttaattttcttctaatcaatattaaaacccattttgttactatcaattctttaattattggttcgacctatagaaacatccagaaatccaaatttgaggataaaagtgttaaagtaacatttcttagtatttcaattttatgtttttaccacattttaaaatttaagttagaaatagtgtatctaccaatgatattgccatatacgtattaaaatgtacatatcatcaaaagtaaatatgaaatcttaaaggtattaaatagttaactcatattcttgtaaagtttaatatttgtataccatttagattttattcaaagcattgaattttattaataattagttagtagtttcaaaaactattttaaaatccctacaaaaaaaaaactattttcaaatccctacaaaaaaaaatactatttcaaaataaaagaaaatagaaaatattgaaagcagaaaatatagaaaggtgttaacaaaattatataaaagaaaaaacaaacagaaagtgttacatgttttatataaaaaacaatttggttaaaaatttcaataacctcatatcattttttctcatctgcttaattaatgatattcaaatgagttattttcaaaaaatattgcttatataagtgatgatatgatgcggttcgctacaaatttttcgtgccaataaaaatttcatatatttttctacattttttgtcaacatcatatattattatttcctaattttattagaactctcgtctttaaaaagttttaaaagcgtcatttatcgttcttttatctacaaaaaaaaacaagatttcatgagtcagacaagacaaaagccataaacaacacaaaagtcctgcaagattgctcacttgggcggttgggcctatatgaaaatttactatctcaaaatttaactaagagcccataaaaactgtaagatctttgctttaaatcacattgtcttcatagattttgtgattcatggtagatttgtgaagatctttggtcatctttttgtttacatttggcttattgagtgtagagtgtgaacaatctgctatgaagttggtaaaattctttggatccaaacctttaaatcgtagcatatttactatttcacactgctaggatctgtttatagctgatgcattactggaatctatgatgtttactgtgttggtctgatatataacaagttctgaattttaaaatcaaattcaatatcgaattgggcttttaattaaggttaggcccatcaaatgtttttgactctttaataattccctctcttttgtcttttattgtaaaatgcacacaatttcgaagaaactgccaatggagtctccattttccagcgccatgccaagcttgactctacgatgatagcttatttgactgcttcaaaaaaaaacttcagagaattaatttcgagaattttcccaatttcagatcatcggaaaattcttactataatctttcttatatcgcttctctcagttacttcaacgttctggtcagtttcggatataaatgttttaatttcttagtttccgtttcttcttcttcttcttttttttttttttctgttactgtaaacttggggataacgaattaaagcgatcaaatcgatgttcttatgattcaggatccgttatagcaaaaaaagcttgactcatg

SEQ ID NO: 3892 - DNA, 3000 bp, Unknown; identical to SEQ ID NO: 3887
  misc_feature (1)..( 3000): cDNA_ID_1822358_gDNA_ID_1620672_Annot_ID_164133 3000 nt of promoter + ATG

SEQ ID NO: 3893 - DNA, 3 bp, Unknown
  misc_feature (1)..( 3): cDNA_ID_2173159_gDNA_ID_1620672_Annot_ID_164132 3000 nt of promoter + ATG
aag

SEQ ID NO: 3894 - DNA, 3000 bp, Unknown; identical to SEQ ID NO: 3890
  misc_feature (1)..( 3000): cDNA_ID_1822350_gDNA_ID_1620672_Annot_ID_48175 3000 nt of promoter + ATG

SEQ ID NO: 3895 - DNA, 3000 bp, Unknown
  misc_feature (1)..( 3000): cDNA_ID_2107309_gDNA_ID_1620673_Annot_ID_48178 3000 nt of promoter + ATG
aaaccgatttgtttccatttccaggtcataccaagcacagagaaaagcatttggggaagagtaggttttgcgatctgtgattttctgaggagaaacgaaaatggcgtttagagggaaggagatgatgaagaagctggtaaagaaagttggagcggagaatatcacgccggagctcaaggagaagctcaaggcttgtgttcctgataccaaagtcgtcatgggcagagccaaacgcggtctctacgccggccgccacatccagtacggaaaccgtgtcagtgaagacggtggaaacaagtttgtctctttctctctatgcctctctatctgtttatatgtgtatgtgtagtcggttgaggttggtcggatttagagcttgtgatggttttgcttaatattcaagcatcggaggagctaaactacaggttcttaggaatgcttcatggatttaggtttcaatttggtagaaatctgaaactatttaagagggttcgaaatcttagatggttagagattttatagtgcctcattttgtttagcatctctcatttgttgcctgaagatggcattgttgttttgtttctgtatcatgctactctaaagattctcaatatttgaacaatggtgtgatgaaatctatcccctttctagagaaatgtaggatacttatgagttttaatctgatttcttctgtattgtttggtaacttgtttgtggtgtgatttgagaacaggtcaagaagatgttggaaaccgaatgtccaggagaagcgattgttcagctacatattcgacagtcacattaaagtcaaagtcacaacacacgctcttcgctgcatcgacaaagcaggaggaatagacgagtacctgctgaaaacaccataccaaaagatggacacagagatgggtctttactggaaaaccaaagtagaggcaagatatgcagagctgggtcaaatggaagtagccttcttcaatccagaggatgaagccaagttggaacaaggattcaaagacttgaatatagctaagaaagatgctcgtcgggaagctagaaggacgtttcgaaagaaaggtggaggaaacaaaggtgatgaagaagcttctattgaaggtggtggagggtcagagtcacaccaagaagatgataatgggtggttagaagctaaagcttagtggctgctctcttttcttttgctgagtttcttcaacgtttttagattttggaagatgtgagaggtatgtgaggttgtaggttataggttcgattcctccctacgaatcccataactcagcgttttgactttgatcaatgtcgaaaaagtcttgtaataaatggtttacacctctttgaaatctttatttaccatttttacatacttgtcattttctttcgattcctcatctccaatggtgggtgaccttttagtgattttagtattatacaatatatccaaaataaattgaaattttgttcatataaatcatgtgtgttagtgattttttctgattttgtatttatttcagttgtagtatgtatttatgttatcaatcatttaaccattcatttcatacatttgatttggatccaccaaatattttaaatttaaagaattttgttgctctaccataaagtcacaacaaataatctgatactttattttttttagaaaagccaaataataaagaaagagagattaaaaatacaaaaatcaaggataaaggctaagaggtttgttgctataatagaggacagataattaaactagattatccttagtcgtggcatcatcaccaaatactacttatcgaattctcatgattttgttttctttttccatcttctaaccaaacaaaatttagttctttaaaaaagattttggtcataataacttttgtttaatatctttagttctctaccactacctagagacgtcgtaatctctaccaaccgtcagatattccgaccccattatcgacggcgaggatctctgcgtcttcgtcatctcagattctttctttcgatataaaatttaatgaatatttgctttaaggtcattatggaataaaaacaaatatttgatttattcttaattccaaaaagataaattacttaaaataacataataaaaaaccgaagaaaaaatatcggcaacaagaacaaaacgctcttctatttttctccatcttccaatttccaggaacaagattggacgaaagctaaaggtaatcatcgaacaaaataaacagcttaacttctaaaaatcttcctttatcatggaatttttttttatgttttgagacaaattgactttttttttgtgtttgtgatgttttggaaatgaatgatgttactgttcttgattctgaatcgatttttaagttgtaactctcttttgtttagaccaggtaacaaaaaatgaaaacatgttctgtttttgtttctctccaatcacttgtgtatagagagacacatgtattattgttgagaattgtttctcttcatgttcaagaaatttgattgttttattagttccttgtcaagatgattctttattgagaagtgattataggcatcctttggatcatcatcttatgaaaggtttcatttttatttgaaccatcacagatgataagcttttagctatagacttttgtgattgaagcactttaagtttggctgttgattgttaagatcgttattacaagagtttcataacaacaatgttttcttctaatgaatacttttatgtctggtgcaaaggttttgaatttgcaggttttcgcagtttagtctcagagagtatgaatatgtattgatcttttgctcgttgttttctttcagtctctgatctgtttttcctgtgtttttttttattctttggcgaacttttaagtcccaatgaatagttttggttaactaaaataaggaatatttttgttacaggtattgcatccatttaaaaagttcatggataggtggtccagtaaaagagccatg

SEQ ID NO: 3896 - DNA, 3000 bp, Unknown
  misc_feature (1)..( 3000): cDNA_ID_1822380_gDNA_ID_1620673_Annot_ID_48181 3000 nt of promoter + ATG
aacagacgacaggatcgaggagaagctgacctgaagtgaaccaaaccacataaatggtcaagcaacgagagagaagaagcagaaatgaaactgacgatggcacgagtcgaggtttcggccggcgatgagaaccggcgtcgatcttagccatagggttcaatttctgagttttgaagcgttgggcttttttaattcgttggctcttaggcccaaattaattctctcattaatttacggttcggttttaatcggttctaatttgtcaatccggataaaaagtcaataacatctaacatagaccaaaccattatcccaaagaaaaaaaaaacatagaccaaaccaagtcaacatgaattgaaatttaagaacctcggtcctcccaactcaaccgaaacacaatcaaaccggccaaacattgttttttttacggcaacaaagatatatcaaaacacaaattgcaacactaaaaatcatgtgttttattggtgccttatataacaaatgaaaccttacccgaaaggtttagcatatatgacatccagacaagagaaaacgtaattcatcattttcgttatctaacatacaagaatcaaaacaagatttcacattaacaaagataaagtgtacatagttgaggaaaataaaggtaaagataaagtgtagacaatattcaaaagggtggttgtccaacaatgttaccaggaggatcatagttacaaataataaatgtgtcaccggtcttgcaaaaactgattgcacacccaatcctcgaactcttcttccatacaagttgcgtgtaatgcaaacaatccccattcgccttgcagtgggaagtcctccggtcatagtatttcatctccgaggcccatgcagccaccgcatcccgtggagtccaaccttttccgcttccccagaagagattctccccgtaaggtcccccggagtggataagtttgcaatctccacggcgggttctggcccaccggctcgcatagagggcgaggctattgctccatttgagaggagggagacgaagcttggctcgtaagatgttgtgtggtcggagaaactgctgctgaatggtgttgcgggctagagctttgtcttgagaaaaaattagtgttgatgttgtcggtgttctgtttgatgggatttgaaaagagagagaaggaagtggagtgctgataactatgataatgatgatgaatatcagagttttttgttccattgggatgctaagttagatttgtttctgagcctctagatctagctagtacgatccttaccatatatatatacacacacacacataattgtttatgctttcatatttgtacgtatatatcatctaacgaatctaaacacatgctatgttaataatgcgcaatgacaagtgctaatcatttcggtggaacattgattatttgtagggaatgattttattcaaacaaagcatacattattgagctaattaatagatcattatatatgaaggaagttttaataggatgttttctttttttcttgtaagaagagactttatcatagcaacgagaatatatcccaagcataaaacattatatacaaactcattcaaatgaaaacctaagttagatatttaatttgaccactcttaaaatacttgtttagttataacatgtttactatgcagatttatgaggcgtatcagatggtgtgctagagaacgtgatacaaatttggatgccttgttttcaagaaatcttatacattccttggagatcaatttgtattgtgaggcttatagtcattgagcttaccgttgattaactaaatttatattatatagaacatcaaatagacgaaaaaaatcaatttagttgaccaccgtttgttagctaggttataaactctgacccaaagtgtcctatgctttcagtattcagtttattttataacgtgtggggtcgttttggaaacaattaaaacaataggggctatatttttctcaagttctgttggactgggcttgtcgttaatcaatatttgggcttttgaggttgactcgcttttttccgttcttcgttttccaaaatcaaacccaaaaggatttggaggagttaattcacctgacgaatccaccaccataatattaagcacatttgatctctcacttccttggtgcgagtgttttgttttccgagatccaaaatcttctcttggatccaaagctgtgttactgtggatctcctcctcctctctccctggatctcgtacctttgaggtttgtctctctgtgttaaacttgcgactcagatttcatagagatcgatcccacttttgccttttcctttgtgaaaatctacaatgttcaattattctctggcgctctttgtttgatctcgttgaatattgatctgattccggtaggaaaccgattttcatgtttgtgcagctgagtgagactgcgaattatgtagatttcattgtttgttcatctaatctggggagatagatcgcattttttttttttttgaattttggttgatccgaagctgttttaactgatttttcgtttttatgttattattttggtcgtagttgtagtacagtgatgtgtattgctggatctgaggatttagatttgtcaatgttttgcatctttgggtctctgattggacattaccgaatattcttctgaaattatgatgttttctcataaaccacggattcgagaatagagatcatgtattcaatgtattgaaatccaagcagagaggtatggattatcgccgatgatactgttgaacttcttgtatagaacttactctagcactgatgaggacactagtaaggtgcttatattcagtaattcgaacttgaaatcgccagaaatattaaaagttttgatatcttgtttttacttgtgatctatacttcattatgtctttaatcaattgtaacaattttgctctattcatcttctatttcttatattaacaaaggaacacttgttcgtga

SEQ ID NO: 3897 - DNA, 3000 bp, Unknown
  misc_feature (1)..( 3000): cDNA_ID_1822376_gDNA_ID_1620673_Annot_ID_48182 3000 nt of promoter + ATG
ctaaagcgtgcaactggagaattcaccaaggacgagaacgatgctaacaaacttaaccgcattcttcaactcacaggattcagtgacccagtctatgctgaagcatatgtgacggtacaccattatgatattgctcttgaagttacagtaatcaaccgaaccaaggaaacccttcagaacttgtgcttggagttagcaaccatgggtgatctcaaacttgttgagcgtcctcagaactacagtctggcacctgaaagaagcatgcagattaaagcaaacatcaaggtgtcgtccacagagacgggagtcatattcgggaacatcgtctatgagacatcaaatgtaatggagcgaaacgtcgttgttcttaatgacatacacattgatatcatggactatatctcccctgctgtgtgttcagaggttgctttcagaactatgtgggcagagttcgaatgggaaaacaaggtaatttattgaaaccttttatagttgtaccttcttttcgtatgtttgttggagtttggtataaccaattcctgttgtattctttatgtcaggttgctgtgaacaccacaatacaaaacgaaagagaattcctcgaccacattatcaaatctacaaacatgaaatgtctcactgctccgtaagtgtaaattcttctttcatcctgtagaaacgaaaaactcttcttactaattaatacttctttacttgcagatccgcaatagaaggcgaatgtggattccttgcagcaaacttatacgcaaaaagtgtatttggtgaggatgctcttgtgaatgtgagtattgagaagcaaacggatggagcattgagtggttacataaggataaggagcaagacgcaagggattgccctaagtcttggggacaaaatcaccctcaaacaaaagggtagtagctgaggttagctaatcttttcaaaacatattctatttctcgattaatacatgttttaatccttaaaccgcaattggtctaaatttcagtaccataccgatgatttctcacagtggcgtgcaaaggtaacaggtttagactacgtacgtttctcttgagcaattatcgttggttgaatctgcttattatatggagggaggaggcgttcaagggtatatgtaaaaagagtaattggctatcgttcttacttaaccggtatattttctggtatggtaccgatggatttcttcatctcatatggcagtgtgttttttactgtactagacgattttgttttatttgtaatgctttttcttctataatgtcgtttgttgaggactttaaaccgtgaactttatgatattgtagatttcaaagctacatttggtttgctccattttagaactcgtcatttcagatttgatctctattcttttctttcatatgcatttgaagtgaactattcaattgtcaaagctagactttaatttgctagtagctatataatacgggttatgttagcaagtaagttgtaatgaaacgcatgtattaatatggaccatattcaaaatctacaagccaaagaaaccaattgcttcacaaccaaacccataacatttgattcttacagccttttctattctcaagaaaaccaagcaataatttttaagcaaaatttaataatcttaaatcacttgcctcaaggtaccaagggacgatcacatacacattcgcgtaactagatatcgctaacatcattagacaagaaaatactagacgcgagtagaagaggaaagatccaaatacatcatcttctatcataaaatcatccatctctaaccgaaagttggagcacgtttcaaggaaaaactgacataattcctaattacgctcacttttaaaagtttggggtcgttttggaaacaataaaaaagtaggggctatgctttctcaacttctattggactgggcttgtcaacaatcaatatttgggcctgcgaggttgactcgcttctttccgttcttcgttttccaaacagaaggaaaaaaaactaaaaaacaaaatcggatttggaggagtaaacacaagggaagacgaatccacgataatattaaggacatttcataatctctcactttgtgcgagtgtttttttttccgagatccaaaatcttctaacggatccaaagctttgttactccgtggatctcctaccttgaggttcgtctctatctgttaaacttgcgactcagatttcgtagagatcgatcccacttttgcttttcctttgtgaaaatctacaatgttcaatattctctggcgttctttgcttgatctcgttgaatattgatccgatcccggtaggcaaacgattttcatgtttgtgcagctgagtgagactgcgaactatgtagattccattgtttgttcatcaaatctggggagatatattgcatttgtgatatgaactttggttgatccgaagcttttttattattcgattttatgttaatgttttggtcgtagttgtagtaaaagtgatgtgtattgctggatctgaggatttgaatttgtcaatgtcttgcatctttgggtcgttgattagacattaccgaatattcttcagcgattatgatgctttctcatataccgtggatttgagaacatagatgctttcttcattgtactgaaatatatgtagagaggtgtagattattattgctgagtagtattatggggatactctgaaacttcttgtttagaacttactcgagcagtgatgaagatactagtaaggtgcttatactaacttagtaattaaaagaaaattcttaaaattttggatatattgattgttacctgtgatctatactacttcattttatctttaaatcgattttcagtattttaggttcctattctctattcgctttgaatttcttatgttaacataggtacacttgttcttgcatgatttttccttttcatatgagctcacaattttattttatttttcactctttgtgcagcacctgaaaag

SEQ ID NO: 3898 - DNA, 3000 bp, Unknown
  misc_feature (1)..( 3000): cDNA_ID_1031118_gDNA_ID_1620673_Annot_ID_48183 3000 nt of promoter + ATG
aacttcttttttatttatttgttttcttgcataatgtaccgtgaaatttgatcgagaacatcatcagcctttgatattcttaaacgtcaaagaaactggtatattacgttaaattgttgaagttatgttcccttgtttctttctacttctttaattgaatattgatcaacatcaacatattaccactcttttctttcaaacataataaatgttttaaaaattatgtttgttaacctgtgagtagatctaaatgattgaactgttcctttgtttttcaaaactagtaatttgtgttaattatggttaaatactgtttgatgatctaaatgattagaatactacccagctcttccataaatataagaattattagtttaagttttggattttggttcccacttcaaaaaataatcgtgtttaaatcttttacgacaagtgaaattcggttgtaagaaaaagaaaaagctaatataatgttaaatccgtgtagattatcagtaatcaattcatatctggttccactgattttaattcataactttgcctttttagtaatgagtattggataaggttgaagagagtttctggtgtccacccaacacttacggtacatggccagcatcggatttaacggagacagtaaccccgaaacgtcaggctaaaatttccaatccattatcgccacgtcagcaataacgtgttaaatcgtcaaaaagtcgacgttaccgtccttccctcggatactaattttagtacacacacagagagactcaaaaatactgtcactcatacgtatatatatacgttttcgtatattactatttatcttctttttttttgttttaataaaaaaaaaactatcttttcttttttatcttcttcttcttcttctccgatcggtggagtcttgtctctctttctttttttatattacttgttaacctgcgcttgcttattggagctcttaacctacgcggatgctccgattttatgacagctgagctcgatttggttgataaacaaaggcttcaagaattctaccggaatcaatggaggttctggtaggttctacgtttagggatcgtagcagcgtcacgacgcatgatcaggccgtaccggcgtctctgtctagccggattggtttgaggagatgtggtagatctcctccgccggagagttcgtcgtccgttggagaaaccagcgaaaacgaggaagatgaagacgacgccgtttcgtcatcacaaggaagatggctcaattcgtttagttcatctttggaagattctcttccgattaagtacgtttctttattaattatcttctaattattctgttatctacacctgaatatattcgatcgatttattttattacaagaataaagtaaatcattagattctcttatgttcttgggtttgattttattgatgaatctgtaagatgttgaaattgtttcttacttattagattctcagtttaaatgttattactacatgttgtgtttttgtttagtcatgtggtttaggttttggtttttgttacaggagaggattatcaaaccattacatagggaaatcgaaatcgtttgggaatttaatggaagcgagtaacacaaacgatttggtgaaagtggagagtccattgaacaagagaagaagattgcttattgctaataagctaagaagaagatcgtccttgtcttctttcagcatctacactaaaattaaccctaattctatgccgttgcttgcattgcaagaatctgacaacgaggatcataaactcaatgatgatgatgatgatgatgatagtagcagtgatgatgaaactagtaagctgaaagagaagaggatgaagatgacgaaccatagagattttatggttcctcagactaagagctgttttagcttaactagttttcaagatgatgatgatcgatgatcgatgatcattcttcttcttttgtccaagagtagataaagtttcgttgacaaataagttggaggaagatttgacagaaaccaatttacgtgtaattgtaataaattaatttgactgtttgtatattttgaattttctcaacgaagtagactttttattttttttgtcacacttcttgtcaaccttaacatttgttagtaagcccatgagattggttctataaattttaatgtccgcatgagaacaaagtcgttaatattgacggcttagtaatttcaatagcggctgcgaagtcaatagggacatctttaggctcgttctccgaaatactcttttttttttttctctaccgagttgaatttatgtacgattcatcttagattgacgaagtagaatatttgtctcactgtgacctactgttcaactgcaaaaatatgaacatatttttctacaaaaattgactacagagtaattagaaaacttaaaaactgagagtttagttttttggttacgtatactttttttttctttcagtttacgttatagcataggagaaaatgatcgcttcaaatttcataggtatttttaggaatttttctaaagtaccattttttatgctttgtttttaaatcgatcatatcagttcaaaaagaaaaaaatcaagaatgatgtctaaatgaacaaaagtttatgagatttataaaaaacaagttgatgatattttattacttcataatatacttactgttctatagtatatttttagaaaacaaaaccaagaggttatattcttatccaatatcttcacattttcaactcttcatcgatctcgctttcagtattattgtgtaacccaagttacattttttaattccaaaaaccagtagtccacctactaacatcacgttttaaaaacaagggaaaattctgtcacctgtcaaaaaatccaaaacaaaccaaccaataaaactttttgtcttgctatataaaccacatcatcattcaaagtagaaaagtatccgaacacaaagacttaagtaagtcaaacagaaaaaaatg

SEQ ID NO: 3899 - DNA, 3000 bp, Unknown
  misc_feature (1)..( 3000): cDNA_ID_1822366_gDNA_ID_1620673_Annot_ID_48186 3000 nt of promoter + ATG
tcctgttcgatatcatcactcccaggcaacgccacttcatcatcatcactttcttgcaataaatcaacattgggaacattgctgaagacattgacttctccatactttttaggtctggcaatgggacctccaggacggccacggtcttttttcactagtagcaaagggttgatctgaaattacaataatgtaattactggttaaccacatacactgattattttgttccaattaacaaatcaaatacttctgctacctctctgaacaatgctatgagggaagcagatgctgctgagatggcttttctatgggtacggtactttttatccgttttatactgagcaagatcatgcagcaagtcttctgtcatcaactgaagtatagcagacaaaaaaaaatatagaagaagcaaaaagacaactcagaaaaaaaaaaaaaaaaaaggattggtgctgtaaaactacatttatatgagaatgttaaaccagagttaagaactagttacctcgggaatcctaaggaacatttctcgtaccacattgagtgcgacaggaatagcctggttacatatatgaaaacaatgaattaaaaaggaaaaatataaatgatagaataagctttctagttaagtccctccctaggtgtttgaaatcacacctccggacttgagcgatcgtgtaaaaacttattcactatttgcttgaacagtggctccacggcatccgaaggtacctgctcgatataaaaatgattggaaggattgcaggatgagaaaagggatgatgctttaaagtgtaagatgtttgtataccccatcatggcaagcctgaactgctgctgcaagtatttgtgtaatgtcctttacaccatcctgcatttaagagcatccctgtttcaataaattttcagcaaagaaattgtaaaaagggcagttagcaaatcttaccttagcatacgcttgaagataagtataaaatttgaataaaagcaacttgtgaagaccaattgttcgtgcaataacttttataatcatcaacctggtctgcaaaatttattgaatacatggttagttagctcatatgtttctatagaatggatgaagcgagttaaaatacaattacctcgcgccgttcataagtttccccagtgctcttgtcatcagtttccccactgctcttgtcattagtttccacagtgctctcgtcaggcttaggcctaataaggggaagcaacctctctgcaaaattctgtaaaagaagaaaaacattcaagtacatagccacatagaaaaagctaggaaatgaccactacaaaaaagctaggaaatgaacctgtgcatcatttagatgattaagaggtgaataagttgaagtagtgttctcagacgacgcacgctgctttcgtttaatacttcgcatggcgcgttgcagttttgcttgctttttcttcttgctagaagatgtacctttgttgttggcctaaacatcggaaacaggacctagtattatacttaattcataatgataaaaatgatagtgacaactatatgaaggtggaaaattctattcacaaccagtagtaagcgtcttcgtcatagtctctaacaaaattcatgtataaatatgttgtttaccttgtaaacagcctctctgttaaacacaacctgagatcactatcatcctcatcgttaatgttgtcgtagtcaagaagaaaccgaagggaagatatcctgatcctgaacatgtaaaaaaaaagagaagttagtaattcgaccaaccaaatcatatcgaaatcttgcacagttaggaagatatacctaggtgaagtatgaaagcaggcttcacaaatggcaattgctactctgtcatgtttatcaccaaaccagacttttttcttgtgaagctcacaaagggtaacaagtgctctcttagccttggtttcatcttcttgctacaaccgaagttaaaaatcatctacttgattatacactgatcagttacacaaaaaacccatgaaaagggaaaagaaaaaagaaatacctccaacatagagaaaacaatcttgtgaagagatttgtgccttggatcagtgatactcattttacgaatggtttgaacaatatgagagaaagcaagctttcgcaagtttttatcaccaagagtttgaatatctagaaacagagctaacaaatcctcgatgacaagactctttaacacacaccaaagcaaacatattaaaaaaacattactttcgattacgatcatcttagaattcgtatcaatcacgtaataaataaaaaaacatacctttcgattcataagaagaatcagagattgcgcaacttggtaccgaagccccgacggcattgccaggcatgaggtacggagtaaatcagtcaattgagctggaaaagcggcgagctggttcggataaaacggagtgacatgagcgagaaacatggctcggtctcggagttccttagcaacggaagggccggggccgacggaggagaaagtgagagccgcctgttgctgaaagagatcgacggaggctctgaactgtttgtaaatcaaatggacctccgtttcgtaaccctctggttcacgcttgatttggctctgaaggataggaaggctgagcttctaggagatccggctagaagccttcaaggactccggcgtaagacctagagatccggccataatcggaggttttttcagagagggaaaggaaccaaccaaaccctttaggttttatacaaacacacagacttttgatatatttataggtttagttcttcactgtaccagttcggtttaggatttgattctctcggtttaggattttatttgaaaccattacaaggccaaagcccatacggccagaggcccaatacaaggaaaaaacgcaccaattgaatgaacaaatttatttgatttttgaatgaacaaattaaataatggcttctccttaaaattatctaagctcgcttgaccaatc

SEQ ID NO: 3900 - DNA, 3000 bp, Unknown
  misc_feature (1)..( 3000): cDNA_ID_2107665_gDNA_ID_1620673_Annot_ID_48188 3000 nt of promoter + ATG
agttcatcttccaagaccaccatgtgcttggttcatgtttagacgttaaagtgaagaatataaagcaaaattattcgacacccaacgttacatccaaatatgcgttaaacattgatattagaaaaatacaaaatatgacatctagttgaagtccacattggattccactctcattttactttttgtcttttatctacatattcttccttacagctttctttcaatgtttatttaattagtacaagtaaaataggcatagcattgtgtcataaccctcaactctacaacatgcatgcattatatatgcatatatagtagaattgatcatgcatgtattaactgtaactgaagtgagattaagacttatgaaacaaaactaataggactacaaatattagtcttttttatcatcccatatttctctgtatataaactctgtagttatttctaattttaagatttataatcatccttgacaaaaaaaaaaaaaaaagagatttgtgatcagaacatttgttgtttaaagaacttgtttgagttgttgttaaaaaaaaataacataattgttatgtcaagattatttgaattaatattttttatccgttaaattgttatgtaacttcttgtcatgaagtacaaaatatactcaattattaatacgacaaaataaatagtacgtaacgttgcagagtcgtagagatagaattaacatgcaatttttttttaattttttttttatatcaacatgcaatttaacgaacacgtttcttgcacctgcttgatagaaaataataatataaattattggaacgaaatacaaccagagaaaaacgagcataattttattattttatttttagttttctaaaaatcatcttacttttttttatcttgttttatgtttcattgtagttttaatacggggaacgattttaccccgcatgtatagaacaaaaacaagtttacttttaaaattagtgaaagactagttccaaaaccgcattgacatgttagttttttctcttacaaatatatatttgttatcttattctaatgttaaccaaacaaatattgatcgggaagaaaaagagatgctcagaaatattataacacaatgagtgattgagacatagaaaaaaggatgatcattgagattttgtaactatgtagataatatagacgtgcacgacaataataatacaactcggtcgatcgggtcaactaccccatgttataatttaatcgttgacataagaaactgttttaaataacaacaatccatggtttcttccccacccatatatagccataaaacacgttacatgaacactcaacacgttctattttcattttttattttgttaataatttaagaattttaagctgaagtccagattaatttccaaaacatagagagacaatataattattgccagctaagataatcacaattactgaatacgattaaaatccaagttggaagattttatttttgtaaccaatggactagtatccaagataatgttgatacatacgagtacattttatgtcactatatacaatttccgatattttttatttttcaatcattcgttaataaaaattctacaaacaaaaataattcatcaaaacactaaataaattttttttccctttttctcaattttatgccttgcctaatttctgttccattcatttttgaaacaatttcaatagtggaacatgataacaaaagtcgacacgtgacaagaacttaatagctggctggagattttaataggctcataaaatcataaaaacatagtcaacacttgtatccacagatccaccgttggattgacctttcgaaaatccagtggttcatataagagttaatgggaccacccggttaccgaggtcgtcaaatagctttatgttcaaagaaataatcgtaaattcgttattttttattttcttacaataatttagtagcactactactttaacattttaaatagtcagcttttcaccttcctttgtcgtattgatgaatcgctgttctagtggacttttaaaatcattagtcaaaccattactgctattttaattataatgactattattatttgttgttttcacaatatgtgtagaatacttaggtgaatttgaggttaataaagtttccaagtgaagactgtttctaaaatgaaaacttcttgttgtaaataagtaaacagtcaaattttatcaatagaaaaagacaaaaaagaagtaaaagtccggcgccaaatatttattggttatggaaaccccttaacttagtcttgaattagttaatcgtaaatctagttgacaaatattaaagtccgtagaatttgaaagaatacagaagattcaaattgggacaaacataatatataattaaagctttataaaagtcaaatgtatccattattattattttgggattaatcaatcatctctgtctctcgttgacaactcttccttctcttgcctcaaccaaattccagctggccctctttctccattgtgtgtgaatgaatcattgacattatttttacttactttggtcatgcaaacttctttctacaccttttgcttaagctaagttgaatgatttttgttaagagtgttgttatttagagaaaattctgtccatccattatctttttgggttgaaaaatatcttgaatttgaagtaacgataaaattcggatgccaggggtgggtcccagtaacctcgaactttgaggagaccaaactgttgattgctttattccgtggaaatcctcaactcaatcacagccgttggatcaaaacctccttcccggtttgactaaaaaatcaccaaaaatctgacccggtcacctcctcttttccccatatatcacgcatccttcttcttctctcttctccatcacaaccatttctctctctcgtcttcgtcttcttcttcttcaacgttcctctccaaaatcctcagaccaagaaatcatcatg

SEQ ID NO: 3901 - DNA, 3000 bp, Unknown; identical to SEQ ID NO: 3900
  misc_feature (1)..( 3000): cDNA_ID_2107665_gDNA_ID_1620673_Annot_ID_164166 3000 nt of promoter + ATG

SEQ ID NO: 3902 - DNA, 3000 bp, Unknown; identical to SEQ ID NO: 3899
  misc_feature (1)..( 3000): cDNA_ID_2173372_gDNA_ID_1620673_Annot_ID_164163 3000 nt of promoter + ATG

SEQ ID NO: 3903 - DNA, 3000 bp, Unknown; identical to SEQ ID NO: 3898
  misc_feature (1)..( 3000): cDNA_ID_1031118_gDNA_ID_1620673_Annot_ID_164160 3000 nt of promoter + ATG

SEQ ID NO: 3904 - DNA, 3000 bp, Unknown; identical to SEQ ID NO: 3897
  misc_feature (1)..( 3000): cDNA_ID_1822376_gDNA_ID_1620673_Annot_ID_164159 3000 nt of promoter + ATG

SEQ ID NO: 3905 - DNA, 3000 bp, Unknown
  misc_feature (1)..( 3000): cDNA_ID_1822380_gDNA_ID_1620673_Annot_ID_164158 3000 nt of promoter + ATG
agagaagaagcagaaatgaaactgacgatggcacgagtcgaggtttcggccggcgatgagaaccggcgtcgatcttagccatagggttcaatttctgagttttgaagcgttgggcttttttaattcgttggctcttaggcccaaattaattctctcattaatttacggttcggttttaatcggttctaatttgtcaatccggataaaaagtcaataacatctaacatagaccaaaccattatcccaaagaaaaaaaaaacatagaccaaaccaagtcaacatgaattgaaatttaagaacctcggtcctcccaactcaaccgaaacacaatcaaaccggccaaacattgttttttttacggcaacaaagatatatcaaaacacaaattgcaacactaaaaatcatgtgttttattggtgccttatataacaaatgaaaccttacccgaaaggtttagcatatatgacatccagacaagagaaaacgtaattcatcattttcgttatctaacatacaagaatcaaaacaagatttcacattaacaaagataaagtgtacatagttgaggaaaataaaggtaaagataaagtgtagacaatattcaaaagggtggttgtccaacaatgttaccaggaggatcatagttacaaataataaatgtgtcaccggtcttgcaaaaactgattgcacacccaatcctcgaactcttcttccatacaagttgcgtgtaatgcaaacaatccccattcgccttgcagtgggaagtcctccggtcatagtatttcatctccgaggcccatgcagccaccgcatcccgtggagtccaaccttttccgcttccccagaagagattctccccgtaaggtcccccggagtggataagtttgcaatctccacggcgggttctggcccaccggctcgcatagagggcgaggctattgctccatttgagaggagggagacgaagcttggctcgtaagatgttgtgtggtcggagaaactgctgctgaatggtgttgcgggctagagctttgtcttgagaaaaaattagtgttgatgttgtcggtgttctgtttgatgggatttgaaaagagagagaaggaagtggagtgctgataactatgataatgatgatgaatatcagagttttttgttccattgggatgctaagttagatttgtttctgagcctctagatctagctagtacgatccttaccatatatatatacacacacacacataattgtttatgctttcatatttgtacgtatatatcatctaacgaatctaaacacatgctatgttaataatgcgcaatgacaagtgctaatcatttcggtggaacattgattatttgtagggaatgattttattcaaacaaagcatacattattgagctaattaatagatcattatatatgaaggaagttttaataggatgttttctttttttcttgtaagaagagactttatcatagcaacgagaatatatcccaagcataaaacattatatacaaactcattcaaatgaaaacctaagttagatatttaatttgaccactcttaaaatacttgtttagttataacatgtttactatgcagatttatgaggcgtatcagatggtgtgctagagaacgtgatacaaatttggatgccttgttttcaagaaatcttatacattccttggagatcaatttgtattgtgaggcttatagtcattgagcttaccgttgattaactaaatttatattatatagaacatcaaatagacgaaaaaaatcaatttagttgaccaccgtttgttagctaggttataaactctgacccaaagtgtcctatgctttcagtattcagtttattttataacgtgtggggtcgttttggaaacaattaaaacaataggggctatatttttctcaagttctgttggactgggcttgtcgttaatcaatatttgggcttttgaggttgactcgcttttttccgttcttcgttttccaaaatcaaacccaaaaggatttggaggagttaattcacctgacgaatccaccaccataatattaagcacatttgatctctcacttccttggtgcgagtgttttgttttccgagatccaaaatcttctcttggatccaaagctgtgttactgtggatctcctcctcctctctccctggatctcgtacctttgaggtttgtctctctgtgttaaacttgcgactcagatttcatagagatcgatcccacttttgccttttcctttgtgaaaatctacaatgttcaattattctctggcgctctttgtttgatctcgttgaatattgatctgattccggtaggaaaccgattttcatgtttgtgcagctgagtgagactgcgaattatgtagatttcattgtttgttcatctaatctggggagatagatcgcattttttttttttttgaattttggttgatccgaagctgttttaactgatttttcgtttttatgttattattttggtcgtagttgtagtacagtgatgtgtattgctggatctgaggatttagatttgtcaatgttttgcatctttgggtctctgattggacattaccgaatattcttctgaaattatgatgttttctcataaaccacggattcgagaatagagatcatgtattcaatgtattgaaatccaagcagagaggtatggattatcgccgatgatactgttgaacttcttgtatagaacttactctagcactgatgaggacactagtaaggtgcttatattcagtaattcgaacttgaaatcgccagaaatattaaaagttttgatatcttgtttttacttgtgatctatacttcattatgtctttaatcaattgtaacaattttgctctattcatcttctatttcttatattaacaaaggaacacttgttcgtgaatggtttttccttttcatttgagctcacagatttttttctctttcactttttgtgcagcaccggagaag

SEQ ID NO: 3906 - DNA, 3000 bp, Unknown; identical to SEQ ID NO: 3895
  misc_feature (1)..( 3000): cDNA_ID_2107309_gDNA_ID_1620673_Annot_ID_164155 3000 nt of promoter + ATG

SEQ ID NO: 3907 - DNA, 3000 bp, Unknown
  misc_feature (1)..( 3000): cDNA_ID_3072104_gDNA_ID_1620673_Annot_ID_164152 3000 nt of promoter + ATG
cttcttgtgaatctgtaatgttccttttcgttctttctcagtcagctggaaaatgaagcgaagcaaatgatgcagaccagcctatttgtagccagtgttcttggttttggacctctttcttctttttctttttgtttctacacataaattttattttaggtttgtcttgtgacattactcgcagcagtcgcagcctttgtacaaaaactaaacaaaaagcctttttgggatattgtagtacccttttgtcgttgtctcttctttgttttacatgcatctctggacaatgtagatattgagagtaaatcagaagtcaacgttcgtgtattaatttttaacatttctatttcagtgaacatactctttttaaagcttactcttattaccaagtagcaacacaacttggtcaaagactcaaaagtacatgaaatcatcatacaatccaacacttgagaacaagtggcacatacacagaaactaatatgggacgttattgggcaagtttcttatgacattactcttcactccgatcttggtacgcattgtctcgcctctcttgctcatctccttgcgcactttcatcctcaaagtctcctctttcgacggtactgtcttcagacccaggctcttgtacctgagaatttaccatttgttggaataaccttagtttaccttgccgattatctgattggatagactcggatgattaacgggtttggagaaaacaaaccttgaagataaagaggcaattatctggttgctgtcttgagaagttgggcgtggcttctgtctgtagtaacgcatgaattcacgggacccgagagttttagacgttgttgtgttctcggacttctccgtgatcaagagctcagaaccaccaacgagttctacagtattgtctgtttcaccagatacaacaatttgctttccagcttcatcaacatagctgctcaattcatatattccaaagaaaggtgcggattaagatttggcatagaacgaggaatacaggcgagaacaagaataatcagagatagaagagagttgaaacctgctgctgtagtcataaaactcttctagctcagcatcttcttcatcatcaccatcaccataatgcagtttgcaatgactctttgcttccatatgttttcttacagcttctaagctgctgaatggacggcacagctcattgcagtacagacacatgaagtctctcttgacctaaatgatgagcaatgtataagtaaacaggagtaagaatttcaaagcttgacaacaacgaacactgaatggtaaattgatgagtccaaaccttaagaccaaggtaagtgagaagcccttcaggatccttgagatactcaatatcgggaataaagaaaccatgatgcttatgcatgtgaagcatacagctctctaaggtcttatgttttttgtcacacatcaaacagcaggttggatccagctcatacttatctgcatcaccatcatcatccatatcttcagcagatccagactcattcacattcaacttagacaaagaatcagaggcttcttcagcagccaattcctcgtcagaatcaacctccacccattcatcttcactatcatcatcaatggaacccctgtgttgaacacggcgaggaagttgcctgataatcgctatatcctcctctccgttgattgatgtcccttgtgaaacccgcaaaacatggctacgcgactgaagatgctgctcatgagccttggaactcctgtaacctttagcacagattgcacaagtataaagcataggtgcttcatttgatttattcttctcctgagcaagagcagattgtctagcctcaaacaaggcttctgtaactccaggaactccagccacctaacataaaaaattacagaaatacaaagattcaaatgcctagaagtaaccaaatctatgattattgaaatccttgttccttagtagaataagcttcaaaacaaattttcatataaactctacgattccataaccttaactaaacaatttcgatagcaaaatggaaaagctgtttctcagaaactttcatctcatcaccgacgcaagattttcccgagaaacagataggcttgagttcaaattcgatagagaaagcagaagaaatgaaaccttgcgcttgagattgtagcggtgccaatcggatttgtaatgaaggttacgttcttcttcgtccttgaactccatgttacacgcgttacatgttaaaccaggcatcttctctccttcaatatcgatcgattctagaaatggaaactggagaagaaaagaaaatcagagaaaagatagttgggaggataagatttgttgttgatatgtgtagagcaacgacggctcgtaaatggatcggcgatcgtgtttgtctctaaaaaagcgtcgattgatgatgattgattgccatcaaaatgaaaaggaaggcgccccgcccattttagatccgatcgggttggaactgacccgttcctgacccgatacaagagtagcccatttggcccattcttttagcctttttgtaacactgacacagttgacgaattaagtattactgtatgagtaaccaaaaaacatttttctaatattgtttttaaaataactacttacaacttgattaattacttcgtttaatcatgtaacttttttttcttccaaattctaatctctctattaaattactgcatttataagatctaaacatcatgtgatatgttcaaaatatgaaaagagaagaatataatacatgattttactacgattaattttttttaatcgcaatgttttgtttttgcctaattttattagtggaagaaattttaaccgcaggcctgtaatttaggaaactaactattcacccccaattaaaaaaaaaaacaagaagacgacaaataacgagaaattaccaatttttcctcaacactttcattatttcctacaacgaacttctccctcctcctctcactttcacc

SEQ ID NO: 3908 - DNA, 3000 bp, Unknown
  misc_feature (1)..( 3000): cDNA_ID_2173338_gDNA_ID_1620673_Annot_ID_164147 3000 nt of promoter + ATG
ggatgaggaggaaaattctcgtccatcttccaagcagcgaggttgtgtcttcgtacggatcacttgagaagatcttgaagaatcttgggtgggagaggtactacagtggagacaataccgatcatctgctccagttccacaagagaacttcgatcgatctcatctctctccctcgtgacttctccaagtttaactctattcacatgtatgatatcgtcgtcaagaaccctaacgtcttccatgtccgtgacatgtagtagtcaatcatccaaaacaatggttcaatatcattctccgatcatcgccgctggtgatatatctatcatgtatatatatatgcaggtttttattttgtcgttgggtgtttttgtttttggtttattttgtttttaatgcatttaatgtacgtgttttccgttcgacgtcgatcgattggggtgggttcaagctagagccattctaataacttttatcattttgtgattttaatgaaattgtatcatgttgtcaagttctcttattatggagtggatcaaaaaatatatacagtacatcaaatttcgaatgttatatgatgaaatatcataatttggtctatgatttgcatttaaataatatgatgcgtggaatttatgtaaataatttaatcaaatatactcatggaatgcaaatatacctaacatgtgaagaaaatttgttctgtcaaaaattactattatatacagcttaattagcaatttaaacaaaaactactatatatacaagggccgatagattatacaaattttcatgaaaataaaaaataaatgtgttgtttttaaaaccccaataattatcacaaataaaaactacagttgcgtttttgtattttttcaaacaacagtctactagacgtaatttttttgataataatacataacttcaattgattgatcatccatcacatatttgagtatcgatgaagtaacatgggagattaataagttagaaactttaaagtcataatcatattatctaatcgtttaagtttttttttttttgaaaccgtctggctaaaaaaacagatatgtatacaaattaaaaccatatagatagatagatatagggtaaagatactggaatacaaatgatcaattttcaagtacgaccaaaatctaaagaaggaaagtcaaaaggtgtccaattagagaagggcccccaaatgtttgggaaagacaacggataaaatgatgggcgcacgtgacattcgctacttttttacccaactttcacacgtgtcgattccctattgctcattttcccactttgtcatagattcatatgatgggcgcacgtgacacataaaatactttttaagacgcaatgtgtgggcacgtgtcgattccccattgcccattacccccacttcgtcacttccttatcgatgtcgaacaaaactttctttttcccaaataaattcgcaccatattcgggacctctttttttttttttttttttgggattttattatatagtttgtatgattttggttttctttttcttttactcgcattatgggtctaagattctggagtgcttgatttctcaagtaatatgcaggtttaatttctgcccaaagattttcagatatccgatagtccaaaatcgtttatattggtttactaagttttctttaaacattcgatattagtaaagagacgtgactaagattttggctatatcaatagaaaatgaaaaagaagttttgggcctataaacgctgactatacacacatgcttctattagagtggttcttattgtaaattggagtatcaaactatgtagattgtgtctgtcgaagctcgcaagggttagaaaaatgattgtctcgtccagataaaagcattttcttacacaagacacgaaaatgtttgcgatcaaaacttcaaatgattaagcattttataatttaatttggataacggatacatttttccaggcaaaggtaacgattatgtttggaaaatctgaatcaagatgacatcatcgtgaacataattacattttaagacggagcagaacaacgagacaaactacgaatacattgaaaaaacatatgcagatcctgctgatttatgacaagaaattaactagtttttataatcacacatggaagtactatgactactacttctacatcatttttatagtaaaagtaggagatcaaattacatgagatggtaatggatcaaagcttaccaagttaacatgcatgaagtgatttatacgtgctattgagtatcagccatactcccgtttaaagtccagtaagctacctagcgttttatgcctcaattttgtgaaagttttatggcgtgatacttctacataatacgatgcaaaagagaattaacaatgtttgtgataaagtgtagctctagccatgaagaaaaactcatgaatggaagcaaagtaaagaagtcctgctaagtaatcgtttttttaggacaagagattcattaccatctcatgtcgccacccacactttgtaattgtagtggatcggatggtataacaactaagaatacgaacctatatataaaacgtatgttttcattagtgtattgttataaaacttatacatagatttgagtattcaattaccacacgaatatgtattgtttagttgcgaacaacgttgcacctttcgtggccacacaagactttccccgatcgcagcttcttctctgcttggcgccaaatactatcacgtatcttaacaaaccaacaaaaaaaaactgcgggatgtagaaagaaacaacaaaaagttttgggtcgatttgctacagaattacatttattgtggtctttttgaagataaagttcttttagttcttgtggttggtagtcaatttatttcattttcggaaattaatatttattttagttttttcgtccaacgtaaacgtatccactctttcgcttcttctttcttctgatcatcctcccgtagctgattc

SEQ ID NO: 3909 - DNA, 3000 bp, Unknown
  misc_feature (1)..( 3000): cDNA_ID_3072093_gDNA_ID_1620673_Annot_ID_164167 3000 nt of promoter + ATG
ttttctattgataaaatttgactgtttacttatttacaacaagaagttttcattttagaaacagtcttcacttggaaactttattaacctcaaattcacctaagtattctacacatattgtgaaaacaacaaataataatagtcattataattaaaatagcagtaatggtttgactaatgattttaaaagtccactagaacagcgattcatcaatacgacaaaggaaggtgaaaagctgactatttaaaatgttaaagtagtagtgctactaaattattgtaagaaaataaaaaataacgaatttacgattatttctttgaacataaagctatttgacgacctcggtaaccgggtggtcccattaactcttatatgaaccactggattttcgaaaggtcaatccaacggtggatctgtggatacaagtgttgactatgtttttatgattttatgagcctattaaaatctccagccagctattaagttcttgtcacgtgtcgacttttgttatcatgttccactattgaaattgtttcaaaaatgaatggaacagaaattaggcaaggcataaaattgagaaaaagggaaaaaaaatttatttagtgttttgatgaattatttttgtttgtagaatttttattaacgaatgattgaaaaataaaaaatatcggaaattgtatatagtgacataaaatgtactcgtatgtatcaacattatcttggatactagtccattggttacaaaaataaaatcttccaacttggattttaatcgtattcagtaattgtgattatcttagctggcaataattatattgtctctctatgttttggaaattaatctggacttcagcttaaaattcttaaattattaacaaaataaaaaatgaaaatagaacgtgttgagtgttcatgtaacgtgttttatggctatatatgggtggggaagaaaccatggattgttgttatttaaaacagtttcttatgtcaacgattaaattataacatggggtagttgacccgatcgaccgagttgtattattattgtcgtgcacgtctatattatctacatagttacaaaatctcaatgatcatccttttttctatgtctcaatcactcattgtgttataatatttctgagcatctctttttcttcccgatcaatatttgtttggttaacattagaataagataacaaatatatatttgtaagagaaaaaactaacatgtcaatgcggttttggaactagtctttcactaattttaaaagtaaacttgtttttgttctatacatgcggggtaaaatcgttccccgtattaaaactacaatgaaacataaaacaagataaaaaaaagtaagatgatttttagaaaactaaaaataaaataataaaattatgctcgtttttctctggttgtatttcgttccaataatttatattattattttctatcaagcaggtgcaagaaacgtgttcgttaaattgcatgttgatataaaaaaaaaattaaaaaaaaattgcatgttaattctatctctacgactctgcaacgttacgtactatttattttgtcgtattaataattgagtatattttgtacttcatgacaagaagttacataacaatttaacggataaaaaatattaattcaaataatcttgacataacaattatgttatttttttttaacaacaactcaaacaagttctttaaacaacaaatgttctgatcacaaatctcttttttttttttttttgtcaaggatgattataaatcttaaaattagaaataactacagagtttatatacagagaaatatgggatgataaaaaagactaatatttgtagtcctattagttttgtttcataagtcttaatctcacttcagttacagttaatacatgcatgatcaattctactatatatgcatatataatgcatgcatgttgtagagttgagggttatgacacaatgctatgcctattttacttgtactaattaaataaacattgaaagaaagctgtaaggaagaatatgtagataaaagacaaaaagtaaaatgagagtggaatccaatgtggacttcaactagatgtcatattttgtatttttctaatatcaatgtttaacgcatatttggatgtaacgttgggtgtcgaataattttgctttatattcttcactttaacgtctaaacatgaaccaagcacatggtggtcttggaagatgaactataaatatcaagaaaatgatgtataatgggtgatccaaaccaaagcacatataatctctagagttaaagtgggtcgaataatctctagagtttgtggaacgcatagtatctttgccatttaacgtacgtacgtatctagaaccaataatgataaaaactgtagtggattaattactcgaaactcaaaagtcttattcccaacatcaagataagtggtaaattttaatactggaataaaccattatcccacgaaagagaatattataaagtttatatattggttgactttgtgttaaataatgatgggattatattaagaaaaacttgttaaatgaatatcagaatcaataatcgtatcaattagacaacttgattaagatttgattctggtcagtaaaatatatgaaacatgctccatatgctatcatatcttcaataaaataaacgaattgaagacgagtatatcgctatcatggcaggttccaattagttatctccatcctcttttttgtttccacaaaggagccactttgtgttctttatttttgaaaatgtttgattggttaattaaccaagtgaagttgtaatactattatgcaagaattaattgcagcactctatgggtttcgtaatttggttaatagtttaatgggcctcgtacaagtcagcccattggatatatttcagattaatcgggtcgggtcacaaatgattatccttgttgccttgcctttgccaatcgtttgtttccaaaataaaaatc

SEQ ID NO: 3910 - DNA, 3000 bp, Unknown; identical to SEQ ID NO: 3909
  misc_feature (1)..( 3000): cDNA_ID_1024576_gDNA_ID_1620673_Annot_ID_48189 3000 nt of promoter + ATG

SEQ ID NO: 3911 - DNA, 3000 bp, Unknown
  misc_feature (1)..( 3000): cDNA_ID_3093332_gDNA_ID_1620674_Annot_ID_48191 3000 nt of promoter + ATG
gagaagatgatgaagttaacaatggtggaatagcgattcttcgacgacgatgatggcgaggtttgtttctgtgtcgtcttgtcagtttcatttcggcttccgtgaggtttctcctccgtcggtaacttcttatcctagacgattcgaggtaaattcttgtcatgtgttttcttcagtgacagtagtgtgtgatcggtcatttgaagtcagatgttctgaattaggtctctgatcggagatttcctgcgattccgattaaatgttcttcatctgagccggaaaacggtgaggattcggcaccgtcgctgtcttcctcctcctcatcgtctacaagtgaagtatctactagtaacagttcgacatacaactggtacaccggaatcggcggtattgggatgttagacactgcgtatttgacttacctcaaggtcactggctccgatgcgttttgccctattggtggtggcacttgcggtgatgtcctcaacagcgattatgccgtcgttttcggtattatccatcgctttattgattatagcgtttgatttatgtagctaattgtcctctcttttatagtaggcatgattaaatactcgcatgtgatagtctctgtgaatctttgcttgaagctatatcatttaggagctttggtacttagtatgcatagaattgttagagttaaatagcatgcttcactccactctatgtagtgctttgtcttcgttgtttgtccaacattgcattgcaggtaagttgaactcaatgaaaatccttttttacattttgccaggtgttcctcttccagtgattggatttgttatgtatggcgtagtaaccgctctaagtgcagagcttggggaagggaatctaccttttggaatcagtaagagcaatgggcgtttcgcgttatttgggatcacgactgcaatggcatctgctagtgcatatttcctgtatatccttagcacaaaactctcaggatcatcatgcctgtattgtctggtgtctgctttcttatcatttagtctatttttcctctctgtaaaggtatccctttatttccatttctttttttttcctgatgttgactcaagataacttctaaacttcggattatgataatgtgctccatgcatgtggtaggatgtgaagttgcaagaaatacagcaagttgtaggattgcagatatgcttagcaatcatagtagttgcctccttgactgcttcttacagtactgctcaaccaatcccttcacggtaatcaaagttcatagttttctttggggagtcccgatagaaattttagtcatttgtaacgagtagtgaacaaatagcttccgaaagatgtatgagtcttatcaggtggtctcttttaatcccgatcgttttttgtttcactccttccagctctggtgacattgaactgccatattttagaacagagatcagttcatcatcgagcccttatgctattgctttagcaaaacatctaaactccattggagctaaaatgtatggggcattctggtgttctcactgcttagagcaaaaagaggtagttagttcattcatcacctgtttgccaagaatcagttttatgcttttattatatgttcattatagttccatccatctacagatgtttggaagagaagcggcaaaagaactgaactacgtggaatgttttccggatggatataagaaaggaactaagatactcaaggcatgtgcagatgctgcgatcgaaggattcccaacatggataataaatgataaggtgagtaaatcctctgaaccccttgtacatttcatcacatgtcagtacctatttcacctcttttataaattaggtcttaagcggagaaatagaactcgctgaactagcggagatgactggattcagccttgatcaggcaaatgagaccaatcaacttcagtaaattttgtattggtgcagaaaatattaaggtgaatccgtaaatgttgtttacttgatcctcctgatagctatagggtgttctatacaaattcaagtaatgaaagtgcttattgttgccataggaggttacaacttcatctgtatcacttagcctacaccagagcatcactattttataattgaaagattcataggttcttccaaagaatgttagggtactattaattcgagaatctacagccatctagtactggctttatgtaagtataatgtctaaaagtatggtctatataagagagtcacacatgtattttgtatatatatgcgtgtagagtagtagcagatatatgatgtatgggaaacttagagaattacgtttacaatatttggtgccctattgaataccttccttgaatgtgcctcctcggtatttttctattgtaatgatccatccacaagtttcgctgttattatccgtttaatatgcagaagataatgtttttccttatattttttaaaagattccattgggcattggatagatatgaacatagagatctttataatctttaataatttgtaagctcagattagtttaactcaacatcggatgggatgatccaaaataacgcccatcttatccaataatctacatgaatcatgtgatgagacgtaacgcttaaggcggggggcgggaaaagagtcaaaaaaggcagtagccgttagatgtagcaaaaacggatggaccagattagttgcttaacaacgaaagatcaagagagggcgaaaaaggtaataattattggaatgtaggacccacaaagaggtgaggaagatcatgataaaaaggaagatgctatagaatattcgtaagagcccgtcgtttctcccattaccctccaattaatacactattttttttatttttttgtctttccctttttaaaatgatcatcatcttcttcttcactcgcctcaatttttgttcccttcttcttctataattcaactgtgaatttcaccgacgaaacaaaaaagagagagagagagagagaaacgatg

SEQ ID NO: 3912 - DNA, 3000 bp, Unknown
  misc_feature (1)..( 3000): cDNA_ID_2999332_gDNA_ID_1620674_Annot_ID_48193 3000 nt of promoter + ATG
tgattcatgtagattattggataagatgggcgttattttggatcatcccatccgatgttgagttaaactaatctgagcttacaaattattaaagattataaagatctctatgttcatatctatccaatgcccaatggaatcttttaaaaaatataaggaaaaacattatcttctgcatattaaacggataataacagcgaaacttgtggatggatcattacaatagaaaaataccgaggaggcacattcaaggaaggtattcaatagggcaccaaatattgtaaacgtaattctctaagtttcccatacatcatatatctgctactactctacacgcatatatatacaaaatacatgtgtgactctcttatatagaccatacttttagacattatacttacataaagccagtactagatggctgtagattctcgaattaatagtaccctaacattctttggaagaacctatgaatctttcaattataaaatagtgatgctctggtgtaggctaagtgatacagatgaagttgtaacctcctatggcaacaataagcactttcattacttgaatttgtatagaacaccctatagctatcaggaggatcaagtaaacaacatttacggattcaccttaatattttctgcaccaatacaaaatttactgaagttgattggtctcatttgcctgatcaaggctgaatccagtcatctccgctagttcagcgagttctatttctccgcttaagacctaatttataaaagaggtgaaataggtactgacatgtgatgaaatgtacaaggggttcagaggatttactcaccttatcatttattatccatgttgggaatccttcgatcgcagcatctgcacatgccttgagtatcttagttcctttcttatatccatccggaaaacattccacgtagttcagttcttttgccgcttctcttccaaacatctgtagatggatggaactataatgaacatataataaaagcataaaactgattcttggcaaacaggtgatgaatgaactaactacctctttttgctctaagcagtgagaacaccagaatgccccatacattttagctccaatggagtttagatgttttgctaaagcaatagcataagggctcgatgatgaactgatctctgttctaaaatatggcagttcaatgtcaccagagctggaaggagtgaaacaaaaaacgatcgggattaaaagagaccacctgataagactcatacatctttcggaagctatttgttcactactcgttacaaatgactaaaatttctatcgggactccccaaagaaaactatgaactttgattaccgtgaagggattggttgagcagtactgtaagaagcagtcaaggaggcaactactatgattgctaagcatatctgcaatcctacaacttgctgtatttcttgcaacttcacatcctaccacatgcatggagcacattatcataatccgaagtttagaagttatcttgagtcaacatcaggaaaaaaaaagaaatggaaataaagggatacctttacagagaggaaaaatagactaaatgataagaaagcagacaccagacaatacaggcatgatgatcctgagagttttgtgctaaggatatacaggaaatatgcactagcagatgccattgcagtcgtgatcccaaataacgcgaaacgcccattgctcttactgattccaaaaggtagattcccttccccaagctctgcacttagagcggttactacgccatacataacaaatccaatcactggaagaggaacacctggcaaaatgtaaaaaaggattttcattgagttcaacttacctgcaatgcaatgttggacaaacaacgaagacaaagcactacatagagtggagtgaagcatgctatttaactctaacaattctatgcatactaagtaccaaagctcctaaatgatatagcttcaagcaaagattcacagagactatcacatgcgagtatttaatcatgcctactataaaagagaggacaattagctacataaatcaaacgctataatcaataaagcgatggataataccgaaaacgacggcataatcgctgttgaggacatcaccgcaagtgccaccaccaatagggcaaaacgcatcggagccagtgaccttgaggtaagtcaaatacgcagtgtctaacatcccaataccgccgattccggtgtaccagttgtatgtcgaactgttactagtagatacttcacttgtagacgatgaggaggaggaagacagcgacggtgccgaatcctcaccgttttccggctcagatgaagaacatttaatcggaatcgcaggaaatctccgatcagagacctaattcagaacatctgacttcaaatgaccgatcacacactactgtcactgaagaaaacacatgacaagaatttacctcgaatcgtctaggataagaagttaccgacggaggagaaacctcacggaagccgaaatgaaactgacaagacgacacagaaacaaacctcgccatcatcgtcgtcgaagaatcgctattccaccattgttaacttcatcatcttctctcctccgctccactatctcagccacttgtttcaatattgggcctaaacgaggcccaaatacgataatttggatccataattagtttatcacaattgggccttacggtcttcttatccgtccgagtcagcaagttatcctcttcaacacgactcacgaggcaccgagttggacttatcatgattcattatctacgcattgtttacattttggaatcgactttggtacataattgaatttatccatagaaatgatagagactcgaagatcggacataaaacttgctgacgtgacacccatacctttgtgtctgtatgtattatataaacgctatagaactaagagaagaagtatctaagtagcatcaaagcattctaaaagaagtttcaaagaagaagtgaaa

SEQ ID NO: 3913 - DNA, 3000 bp, Unknown
  misc_feature (1)..( 3000): cDNA_ID_1822424_gDNA_ID_1620674_Annot_ID_48194 3000 nt of promoter + ATG
agtcgagggaggcactatgatcgtgatgattacagagaccgtaggtcaccaagacgcgactattcacctcgtgatgaaagaaggtctagaagagatcggtcttactctcctcatggaagaagcccagagagaagatcagagagaaggtctgagaggtcagagagaaggtatgaaccccgtggctcgagatgacctgttttcatccttttgacaaaggattcaaaaacttctctgttgatttaggttgtgtaattgatcatccttaaaatagcacaaagattctgtcaggcaacgctttgggtttcatttattttctgttgttaacgtgttattctgtcggaactctctgaagtgaaaactaaaaactgtaatagcttctctgttatgtctctactctacttgtttttgaatgaatcagaatatcttatgtgattagaatctttagattgttcgcaattttttgttaaacaaaaaggtggagataccaaattaaagcttgaaagttgaaacttaactaaaaacaaaaccccaagttgtgaccagagacaaaaataatcaatcgtatatacttgtttaattatcgaatactaacacaaacctcatcaagaattggcgtatttgtgccaacaaagcaacataagaatacatcttctagctatataaaacctagaacgtctctccttcaccatggctaaacatcctttattcctcctctccattgattctctgcaacattcttcttcccttttcctctttctcctcatctttgtcgccgatgagcattgccccataattgttctcttctctttgattacttcgtttcttcacacttttacgttattgctctttttgtgctctacggagagatgatttttcgttataaaagacaaatggaagaagaagaagaagaagcaatattaaagggaccaaatgtgaaaagagtggagaggaaaaataaaatgaaaaaagactataaatagaggagtggtggagcaatgatgatgcgatgacgttcaacatcattaagttctttcatttatttacgtattcgtaaagaaaatatattatttcattttgcatatgtacttacgcgattaaacaattccacattactacgctttatcattgttacttaaatcgtttattagtggaataattgtctttgtgtctaataccataaaagatagtactaaagtcttcatatgactagatcatcccttccgttttttaacgttaattcgtatgttacatttcaaatcatttattgtggcttattaaagatatactataatgtaaggatcggagaactaatggtgatcatgtaatgaaagacaaaacattgtcacatatattgtaattatttttggttttcgttattaattaattgttagtatcttccggattttgattcataaaccaaccaaaaacgcgtctcaggtggttttagcgtacccgacgttgcaactggcttatctttttcctacacgtgtcttcctctggttggtattatatcatacgtgtaaaatggacttttaccttaattaaccgcatcttatggtcatcaattcatttcttaagctacttttttaatttatttgtatgacttttcttatcgttacttatttgattaaacctttcttacgccatttttttttctcgacaagtatgttgcatgaattcatattggagaaaaattaaagatcaaataggattgaaattgtttggtaaaccgcatccaaaaccgcaccgcaacagtgctgtaacagtatcaaaatctctacatatacatatgtatctatgtattttcgttactatttgaaccgcactgcactttttccgcaccgcaaaatgcagtcaccattcggaccctaagtttagttataagaagggcttcttcgtaaacgcaaaagcaacgtacgtcagcatgaactggtggaagagaataaagtatctggaagaagagaaggcagtagtgaccaatcattggtacttgattggtttacgccacgtcatcacactttcctttcacagctgtataatattcccctcttcttgttttttcttgacaaaaagaataaaaatcatttttttcattttcttatttttatttcggctgatcatttttccagtttctggatacattttatgattttaattaccgaaccagatatgggatatggttataagcgtcgtcatatggatattgttgtcgccattttcattttgtctttaactttgcgaacgttgcccacttgccactttatttacttgtgttaaagtgtgtaaaataccaacaccaagcaaatatgggccacaaggcccgacaaaaatgatctgttgcgttaggattgaaatttgaaaggcctattatcatttaggctcactcgtacctcgtacgtattgctattgcctattggttgtaacaagatcaacttttatgtaattaccaatattaaacttatagtgttatacaacaaatagtgaaataaaaacaaacatgtccattaatatgtcatcatatttgtatcataagtagcaaaacataaaaaaaaatatatataaaaaagtcatcaccatccaccatcatctccttttctttttgcttcataaacatgaaaaccaccatacatttatctcgaagccaaaaaagcaaaactgtccattatccatttaaagcattacaataactaaaaaaataagagtattctcgtgacccacactcatatggaccctacataatgacgtggatgagtcctacgtgttacacaacgaaacgttcatgtcctccctggctttcaacccaaactcatacattacaccctctctctctcttctcttcaatttccgtcttctcactctctaatcttttcgcctttagttgaatctctgggatcattctacctttttgtggatttaggatcgaagaagagatcactcctactgttgaattctggttttacttgagagagtttttcaattctgatctgctgttttgcgatg

SEQ ID NO: 3914 - DNA, 3000 bp, Unknown
  misc_feature (1)..( 3000): cDNA_ID_1822420_gDNA_ID_1620674_Annot_ID_48195 3000 nt of promoter + ATG
gatacagaaggtgtgaacctcttagctgtcatgtgtcacgaagatgtggatccaaagaggacaacaagcaatcacttgattgaaattattgaagttctcggaattgaggcagttcgtcgtgctttgcttgatgaactccgtgttgtgatatcctttgatggttcttatgtgaattaccgtcatcttgccatcttgtgtgatactatgacctatcgcggtcatctgatggctatcactcgacacggtatcaatagaaatgacactgggcctctgatgagatgctcttttgaagaaacagttgatattctgctagatgctgcggcttatgctgagacagactgcttacggggtgttactgagaatataatgttgggtcaacttgcaccaattgggacaggagattgtgagttgtatctgaatgatgagatgctgaagaatgcaattgaacttcagctccctagctatatggatggtcttgaatttggaatgactcctgctcgttcaccagtgtcaggcactccttaccatgaaggcatgatgtctccaaactacctgttaagtccaaatatgcgtttatccccaatgtcagatgcacagttttctccatatgttggtggaatggccttttcgccttcttcttctccaggatatagtccatcatcgcctggatacagtcctacttctcccggttacagtccaacttcgcctggatatagcccgacttctcccggttacagtccaacttcgcctacctacagtcccagttctcctggctatagcccaacaagccctgcttattctcctacaagtccttcctattctcctacctctccgagctacagcccaacgtctccaagctatagcccaacgtcgccaagctacagcccgacatctccgagctacagtcctacttccccaagttacagcccgacttcgcctgcttacagcccgacttcacctgcttacagcccaacttcaccagcatacagcccaacctctccttcttacagcccaacttcaccttcttacagcccaacatcgccttcttacagccctacttcaccatcttacagcccaacatctccgtcttacagccctacttcacccgcatatagccccacatctcctggctacagccctacttcaccaagttacagtccaacatcaccaagctacggtcctacgtctccaagctacaaccctcagtctgctaaatatagcccatctatagcttactctcctagcaatgcaagactatcaccagctagcccctacagtcctacatctcccaactacaggtaagtagtaatatcttaatttttacactttctatgaagcttctcttatctgttgtggtgatattgtgtcatcttctctaatcgttaactcttattaaaaatttactctgcagcccgacatctccatcatactcacccacatctccatcttattcaccttcaagtccaacatacagtcccagcaggtttgacttttacccgcttgaaaatcttggatctgttgtaatgcatccatctcaattgaattccgcaaaaagtttaactgggttgttgttattaaatctgtctcagcccatacagctcaggagcaagcccagactacagcccaagcgcaggctactcgccaacacttcccggttattcaccgtcatcaacgggtcagtataccccacatgagggcgataaaaaggacaagactggaaaaaaagatgccagtaaggatgataaaggcaacccttgaaagagagtgagaattggcaatccatgttttaggtaacgtctaaatctcttggaaccattggggtttacaagtcttactagctcacgaacttagccacttgggatatcgtgtaacccgcaggtcatgatttaagagacagtgaaagctgagaaaaggaagggaccgtttcaaagtgatcttctgtggataactttgtgaacaaggttttcttaatagatccttttttcgtgagttgtatattattccaaactgatccataaatccatccaatcctcatcccccaaaaagaaaatagtataaacatagaaaaacgaaaacatatcagactttgggcttttcgtatggtttagtttttggctttttgctgtgttgttctatttcagaaagtaaacatgtgaaacggttcatttgtaatccatgaaaggattctttatgttactgctgttgcttcattgagtagatacgaatcgagaatgccttttttccttgtttccgacaattatcgattgacgtgtgaccactttaaaagtttaaacagctcgactttccaatatgggtttatttcttgttttatccacaccattaaagaatggtttttgggatttttatttatgtgataattaatcatttttccaaattttattttgtatataataaatgaagcaaatgttggaaaactatccaatggatgtggtgggttaatatcaccagattcgcatagctggtttttgacttgtcttcttaattatttgtccagaaaaagagaagaactcttcacatcatcattgtcaactttagcattattgtattagctttttatttctttacgtctacaaagctattggtacaacgttctaaaatcaaattcgtcatcagtagattttgtaaactaattaagtaaagttcagtgattaaagaagctagatgaagaacgtgtgcaacgactcctctgagatctacacggaataatgtcgtcagtgagcaaacaactcccatcacgtcgtccctccacctgtcctctcttctccttccttgcttgtctttctctctcaaatcatttcacctaaaaataataaatatctttcgttttctaaagaaaaaaaaaaaaaaaacttttcaaattcatctttggtttctgcagcagcaacaacaaccgagccctgttcgttagggttttcggtttttgttagcttttcttcttcttcttcttcgtttccttccacctgaattgttgtaaccatg

SEQ ID NO: 3915 - DNA, 3000 bp, Unknown
  misc_feature (1)..( 3000): cDNA_ID_1822416_gDNA_ID_1620674_Annot_ID_48196 3000 nt of promoter + ATG
tgtatgcaggtgtatatcttgtgtttatcagtggattaaatacatttgcagctaggtaaaatatctcaacagtagattgttggaaagagttcaactcataagtgtggtgtggaataaaacaattatcgtacttgaaatagtctaactactcaactgtatatttatttgtttgttgaatataccgcaagataataaaattttaacagtgtttttttttttccttcatactaaacacgacaaaaggaaaaaagttcgtgtacataattatatattatgtgtatcaataagattttaacttaaatgccataacgtgattttgttggtgtagcgtttgagagctcctgagagacgtatcaggatgaaattgacaatgatacacacatattagtacatgttggtgagatcatagagacctgccaaagacgacagaaacattgaaacaatcttgagacaatacaaagctttcatcactaaagtgaggtttaagagctttacatcttcaaaagctatctatcttcttttttattcaagtcaattgtactcgtgaacgtgaaaccatttagttgatgaccacttgtttcctttgatcactggacaaccacctataccaatcagaaaagattttgagaggtttggtttcagatatcaaatgggttccttgagatttaaaaaagtttcaagaaagacacaccatgcaaactagaagggtctagagacgcgtcaggcttcatgctccagaagagtaaagcgtctctcttctttggcagaacagagagtccttctttaccacattgtgagagctcgtcccaccatgggacatcactaacgtttcctttggctgcagggaaaactgtttctccgccttcatcgacatccgagctaataagtacaaatcaaagaaagaagattaacaaacacattgtggctaataagaaagattattgtaagggtttaaaggctacacacaggtacattagtactgtagcaattcgttgccctcctttcctgacattgaactcatcaaagaaatagtcatggtgaggctcatatctctgcccaacttcataatgaagaacttgcagcccctctccattttctgtaattccattacattaactccacaatgagttccaagacagagaaaccgatataaacattacctggaggaatgaaggtgaaatctgaaatcctattctcaatctcttccactatttcgtcatgtcctctgttaagaaaagttcctgaactggttcgtactctgcataacgaaggatttgcaaatttagaattctcgaatctttccaaattaagctgaaaggtaaaaacaacaacactagttagagtacagaacctgctgtcgatgctctttccggttttcacatcaaccacctttgatttcatcatactaggtttcgcaaggctaatcaagtgctcacattcttcatttgtcttacaaaatttacagaaacagagcatataaattccacacctttgttagcttgtctgacaagaaacacttaaaaactatatgaactaactagcatgaagatgttaaattgtgattacgcataaaacaaaatcttgataagaaattaatccgaaaaagttaccaagaagttgtggtaaacaaaagctctaggctcccaggagataacttccagccagcggtcaccattaccgtcttcttcgtctccaaaactctcccttaataaattcaaaaactattacgtaacaacaagcaaaaacacaaaacatcagagaatcatatccctaacctctcctggatcgtttgtacaatggtggtcaaatccatcggcatagaagaggtcttgttggtgctgggtagtgaaaagattccgagaccgacaaggatcaaaatgacaaagagtacaagtacgacaactgtgaaagtttgcgtcgaaaaagatttacgcggcttgttacggagctgcttcggtttcttcgccatttttgtttgatgatctagatagtttgaagaatcctattgagcgatcttaatcaaaagaacaaaagaagttataacgaaaacatgcatttgaagataaaagctataaagtataaataattttctttcttttttcgttgttttgtttttgtatcagcgtgtgtgttatatacataacaaagtgggcttcacataacttgagactatgcctccgtacgtgtaatatttatttgttagttttccgtattataataatgggttcaccctactttgctagagtagaagaataatttcattttattaactcccaactcattcattactcacttttgggatattgaagaagttaggtatttactattccgaagatgaaatgaagataattaatcgtttcaatctaaattacacattagatttcttttagcgtagggactcctcttcctttagagcttcggccactagcagttaaaactttaatggttcagatttttcagtccactttaccaaacatggtgaaataagggaactattatcgttttgctcttttaagaagaaatctatttgacggaaaataagaagaaatcttatttttgatatatcggtttgaccaactgaaccgatataaaccaatcttactagcattcttcgttacaacacgtttctttggtcagtgccgacgcaggcccgttaatccgtttaactgggcctgagacagttacagcccaattaaccagaacagacctttgagccgcctatttttctataaatagaggcttagggcatggatcgtgtttcttttgctcattcatctctcctcgtgaagagacgagagaattccagatctggtcgtgtcaaaacccagagagggaaaaaaaaaacggaaaaaagtttagctcaagtaactgtaaactactgactcacagattcaaacaaattggcaaaagagggtttaattaatttttgattccccttttaattcacgttctagggttttcgatttttgattcgtctttgatcggagcttagccgccatg

SEQ ID NO: 3916 - DNA, 3000 bp, Unknown
  misc_feature (1)..( 3000): cDNA_ID_1822408_gDNA_ID_1620674_Annot_ID_48198 3000 nt of promoter + ATG
cagttaaacggattaacgggcctgcgtcggcactgaccaaagaaacgtgttgtaacgaagaatgctagtaagattggtttatatcggttcagttggtcaaaccgatatatcaaaaataagatttcttcttattttccgtcaaatagatttcttcttaaaagagcaaaacgataatagttcccttatttcaccatgtttggtaaagtggactgaaaaatctgaaccattaaagttttaactgctagtggccgaagctctaaaggaagaggagtccctacgctaaaagaaatctaatgtgtaatttagattgaaacgattaattatcttcatttcatcttcggaatagtaaatacctaacttcttcaatatcccaaaagtgagtaatgaatgagttgggagttaataaaatgaaattattcttctactctagcaaagtagggtgaacccattattataatacggaaaactaacaaataaatattacacgtacggaggcatagtctcaagttatgtgaagcccactttgttatgtatataacacacacgctgatacaaaaacaaaacaacgaaaaaagaaagaaaattatttatactttatagcttttatcttcaaatgcatgttttcgttataacttcttttgttcttttgattaagatcgctcaataggattcttcaaactatctagatcatcaaacaaaaatggcgaagaaaccgaagcagctccgtaacaagccgcgtaaatctttttcgacgcaaactttcacagttgtcgtacttgtactctttgtcattttgatccttgtcggtctcggaatcttttcactacccagcaccaacaagacctcttctatgccgatggatttgaccaccattgtacaaacgatccaggagaggttagggatatgattctctgatgttttgtgtttttgcttgttgttacgtaatagtttttgaatttattaagggagagttttggagacgaagaagacggtaatggtgaccgctggctggaagttatctcctgggagcctagagcttttgtttaccacaacttcttggtaactttttcggattaatttcttatcaagattttgttttatgcgtaatcacaatttaacatcttcatgctagttagttcatatagtttttaagtgtttcttgtcagacaagctaacaaaggtgtggaatttatatgctctgtttctgtaaattttgtaagacaaatgaagaatgtgagcacttgattagccttgcgaaacctagtatgatgaaatcaaaggtggttgatgtgaaaaccggaaagagcatcgacagcaggttctgtactctaactagtgttgttgtttttacctttcagcttaatttggaaagattcgagaattctaaatttgcaaatccttcgttatgcagagtacgaaccagttcaggaacttttcttaacagaggacatgacgaaatagtggaagagattgagaataggatttcagatttcaccttcattcctccaggtaatgtttatatcggtttctctgtcttggaactcattgtggagttaatgtaatggaattacagaaaatggagaggggctgcaagttcttcattatgaagttgggcagagatatgagcctcaccatgactatttctttgatgagttcaatgtcaggaaaggagggcaacgaattgctacagtactaatgtacctgtgtgtagcctttaaacccttacaataatctttcttattagccacaatgtgtttgttaatcttctttctttgatttgtacttattagctcggatgtcgatgaaggcggagaaacagttttccctgcagccaaaggaaacgttagtgatgtcccatggtgggacgagctctcacaatgtggtaaagaaggactctctgttctgccaaagaagagagacgctttactcttctggagcatgaagcctgacgcgtctctagacccttctagtttgcatggtgtgtctttcttgaaacttttttaaatctcaaggaacccatttgatatctgaaaccaaacctctcaaaatcttttctgattggtataggtggttgtccagtgatcaaaggaaacaagtggtcatcaactaaatggtttcacgttcacgagtacaattgacttgaataaaaaagaagatagatagcttttgaagatgtaaagctcttaaacctcactttagtgatgaaagctttgtattgtctcaagattgtttcaatgtttctgtcgtctttggcaggtctctatgatctcaccaacatgtactaatatgtgtgtatcattgtcaatttcatcctgatacgtctctcaggagctctcaaacgctacaccaacaaaatcacgttatggcatttaagttaaaatcttattgatacacataatatataattatgtacacgaacttttttccttttgtcgtgtttagtatgaaggaaaaaaaaaaacactgttaaaattttattatcttgcggtatattcaacaaacaaataaatatacagttgagtagttagactatttcaagtacgataattgttttattccacaccacacttatgagttgaactctttccaacaatctactgttgagatattttacctagctgcaaatgtatttaatccactgataaacacaagatatacacctgcatacatgaggtgaagagtcatcatttataaaattgaccaaaaccataatgataacaaaaatgaaaattaaaataacttgccgacaggtgtcactctattacttgctgacattcattattagttttttttccaatgattttcatattctagttgtattgatttatttatttttgttctttggacttgtataaaaggaggatcagacggcaaaaaaatatatattagagtttgtattttatgaactcacacaattcataaaaggaaaaccctagattcgtgttctctctaagttttgttacgagttcatgtatattttctgactcacttgtgaacgca

SEQ ID NO: 3917 - DNA, 3000 bp, Unknown
  misc_feature (1)..( 3000): cDNA_ID_1822404_gDNA_ID_1620674_Annot_ID_48199 3000 nt of promoter + ATG
ggttttgcttagcccttaagagagaagatccgatgtctggcctacttgcaattaagttttttaacctcaagtaggtgaagtaaaatctagggtttgcctgtcatgatctatgttgaaaacaccactaatttttttttaatcatttcaatgctcgaaagatagaagcagagagttataaagaaaaggttatttatagtttaataaaataacttcttcgttttttacataaatttttaaaatgtgttagattttaattataagaaaactacgggagatatttagattgtctgaataataccaaaatatggtagggtcgatcattttcgaatcatacaagcaatcagaagaaacaattagatacgaaacagaaataatttctatacatgttaactatttgaggaaatctcaaaatcttattttgattcttcctttccttttatagtaagaaccttaatatgagcaatactttattgttataccaaactaaaatgggtacggtgagactttgttattgtgctattacgtgcgagaagctgaatgattacccttaccgtttctgtataattgtattccaagactctgtgtttttcgatctctacagtggtaagccgattaattaatcatttcaagagataattagttgcagcgtatgtctcatctaatgagtatttgcatgatcggatcatttatataactttgaaattttcatatttctttatttagtcaaaataataataataatattgttgatatgtaaaatttcaaaagatggacagaaataatgacatatagtatttatgtttactgaatatatttgacaaggctctatgacgattttttttaacatactgtatttcttaaaaatatctatctaccttagatagttgacatgataaaaaaaaaatatatatctaccccaatatatttcacctgtattttaatttatagacattatggggcaattaatggtccagaagctggtcccatgagtgattaaattgaaatctaagcatttgcatgatatatagttacgtgtcacttacatacatgtcttgtattgtttagtttcactgctgagagtgagtttctctatgtactgtaatgaacttggccgatcgtgttttactagtttttctcttgaaagaaaaattcgtattactggtacttggactaaaatttggtctccacaccactctcctctaatcattttacaaacaattctatatttgagagaggatattattgaacatgatacaaattaaataatattttatgagtacgtatttgcatcttgtgagaaagaattaagtgttttctaagggaaatattaacaatgggtaagtgaaagtaacagaatgttttacctataaggatgtataataatataaagagagaggaaaagaaaaagccaaatagacaaagaagatataattatgattggtaggttatctacatgctgaccaaagtcacatttttaccggtggtgcgtctttgtgttggcgtgattgataatttaacccggccaccacttgcatctgctccttaatttatttgtaattgtatggaagcatcatcaaatcaactccataaatataagatactttataagctttcgtccatattaaaataaacaattttttttttttataacttctttcttattgatattagcttaaaagatcgtataaacaaacttatatacgatcaaacaaactaaaaaagagagttctttatcaaaaacaaacaaactaaaaagagacgataaatgaaagagataacaatagtatgtaattgtccttacataaaaaaaaaatatgagccacgccaaatctaaaacgatttcgttaaacatatatagttctcgatatttatcaacaaagacgatgtaattcgtaatctatatacgtacatcttcttaacttttttaaaaatataaaaaggtgcttcagattcaagggactgaaactagtgaggtttcttaaaagcagatatatacactgaccacgttcaggttaatagttagtagatttttaggtggatagtaatatattgatggacaatatttaaatacagactataaaatttaagagacttgaagtgttcctaagagtaaatttaattatacattttaatcatggcctgaaaaactaaacaaggaggggtagaataattaatcatctcagcagctttccatctggacacaccattcagctaaacgacattgtttaatctctaaccaaactgggctagaccgaactgggtacaaagatgggttaaactgggctaggcccaaattaatcagaacataaatttcgaacggagcgacccatttccaaaataaaaaaatgttttttatatatatatatatatatatatattttttttttttttaaatcgttgcatgcaggttggtggcgatattttttggttttgtcaccaggtggtggtgaaataaacgacgatcattgaatatttttggtgtcttgtatatgtttgtgtcattgtgtgtatttttttttggtgtgttgtaacgacgatcattgattgtatatgtttgtcagaaattaaggtttttttaatcaatcaatgccatgtgaaattgagaaaccttgaagaaaattggattacataaaactagatactatagagaagaggcacatatcagattggtggattataagtttgtgaaaataaaatcatgattgaacagatataattcacttgatacaaaaaaaagcaaagaatggatattcacaaaaaaaaaaagttggataattaagaaaatagaatataaaataaaaataaaaatcaaacagccatcagttctgacgaaaagagcccaccacggatctgtcagatttatttccttcttacatataaaaaaaatctgaatcggctcaggctcgtgtagcctcaccaactccgcttataaactttctctcttctgaaaacagatctctctactttgcttcttcactcgacttgtatctatcatccatg

SEQ ID NO: 3918 - DNA, 2037 bp, Unknown
  misc_feature (1)..( 2037): cDNA_ID_3072158_gDNA_ID_1620674_Annot_ID_164213 3000 nt of promoter + ATG
ttcagagaatcacaatttagatagcattagagttccctaagcaactaaatcttttttattcttaacttgtttgaatcatggttaatgccacgttgtatattgacagactaaaagtttaagcagatatagtttggttagcgattgtatcagccgcaaacaagccaaatacacagagcagagcagcaacattgtactactaagtttcaaaaccaacaaagacactaatttatgtgacaagtagagagatacagtgagattgagaacttacagacaagtccagtattatcaatgttgtatcgattagatatctcgaagtcattgagatcactacaattatccactctttgtctgcatatattttaaagaagctcttaggagtggcaaatctatcgaacaaaacataacattgtttcatttgatgaaaacttcagatcaaaatcctaacgttagatagagtttgggagagccagtgatgggaagtgtgtagcaaacggatgcttcacgagacttatccgattgaggagaagagtccaccacttgacaaggaatcaagttgaatccttgagttgctttccttgaaatccgtttggtctcagtttgagattgagaatctgaggaaaattgaaagatgatccattagctatgcgaatgtgtgaaatcgaaaagtggatgcaggaaggagaaggagtaggggagtatcaaccagatctacggagaagcgcttggcgaagaattttccatctaagagcagaggaagaagaagaagtgggatccattgaagaatcgttatagctttctccgccggaatctgaaatttctcttgcagactaaacagcaaaacagggaagatgacgatttcgcttcccggcgaactttagtttggtttttttgcctttttaacacagtactttttgggggtcaaacaaagtacagtgaaaattaaattgtcaactgtaaagtacagtaacatttagattctgatctcactgatgttaattattttaaaattgaggacttgttttgtaatttaatattaaaagtgacacaagatgacaacacaactgctataactcaaaagtcaaatgacaattgtcaagggataaaagctgtatgttagaaataaatcttattcactctttagatttggtgcacaattttttttaaaatctatagattttcttaatcttacttatttatacagttttaattactctaaaaactctattgattttttttttgacatctaaaactctattatttaattttcaaataattgtacttcatagagtgatatgagattatgcaattgatttcttcttaaacaaaatagaaaataacatgtgacagaatattatgtttttagtagacatatatttttatacaaaaaatagtataagtgttatatccctttaaatcttattcttatttttatacaagaaaaaattttcatcatcataattgattataccttttaatcattttttttgccttttatgttttctaatagaaaaaaaaaccaaagttttcctccatggtttaggtaagatcctactgttaaatagaatttcatttggcaaaacaaagtcaatacagattaccattatcatagtcaattacacatcttaattacttgaataattcttgtttagtgtgacactaaaaaaggtggcaaaacaataaacaaatgtacaatatacactcaacaaaaagaaattttggatataaacaaatttaatatttggataaagcgcgggaaaatctcctaaaatagttaaaaaaaaggttaaaccggcccggttcatagtcaaaaagtatgctcctcttgaaacacgcaacgcccacgtcttcctatctccgagactccgacagcaaggttacttaacagttaatcaaactagattcgctttcttccatcactaatcttctgactttttctatttctgccccaaatctttttcaaattcatataaataaccaaacacttgttcttcttcattcccccttcgtcttcctcctcctaaatcaccggcgataatg

SEQ ID NO: 3919 - DNA, 3000 bp, Unknown
  misc_feature (1)..( 3000): cDNA_ID_1824395_gDNA_ID_1620674_Annot_ID_164203 3000 nt of promoter + ATG
gtaattcctaatctaaattttccacagtttcagctgcttgcgaattggaaatggcttgtaattcctcaggctgtgagtcaggttgctatgaccgtgagaaagataatggaagtaagatagtggatgatgcagtatctggtggcggtaatcatgagagtgtctgcgtcaagtgtaaatgcaatgcgcctatgacatttggtgacggtggcttcgacgatggaagattctgcgcagattgttttaggaacaatgtctttgggaaattccgtcttgctgttacttctcatgctatgatcactccttcagataacgtccttgttgctttctctggcggatcatcttccaggttttgctctctttttttcctttagtttctgttttttgatatgttattgattggtgtctaaacgtagcaagtatgatgttagggtttctcttcaatttgtgcacgagttgcaaatcaaggctttgaagaattacgaggcgagtcgagatagatctttacctgtgtttggtgttggtgttgcttttgtggatgaaactgcagcttttcctgctctttccactgaaatgattgatgcaattgagtgggttcgatatactgtctcgtgtttgtctccacctgctaaggatctccatgttgttccagtcgaaagcatatttggttcagactctcttgacgcacgggatagacttctgaagctattagattctgttcctgacgatactggaaaagaagaccttctgctgcatctgaaaatgttatctttgcaaaaggtttggacattatattgcttttgtttctgtctgggaaagaaattcagatttggaaatatcttttgtttaatgttgtttgataaacctttttaggttgccgctgaaaatgggtacaatagattagtgttgggatcatgcacgtcgagaattgcttcccatgttcttacggctactgtcaaggtgtgttgcttagtgccctgacttgactcgtgtttcctctggcttagttattctatagattgcatcttagagtgagaacttcatgccagaaagcaatcaatggctaccttaaagaatgtagatattttggacttaaccaattacatctctaaaaattgaagttttggtgtaaagattttatttcagtacacaatgttttgtgtactttatttggacattccctttagactatgttctatcagaattgtgagttgaattgctttttcttgaaacagggacgaggttattcactatcagcagatattcagcatgttgatgctagatggaaggttcccattgtacttccacttcgagattgtgttcgactggaaataactagactctgccttttggatgggttcgtttattggctgcctagtctacattgtattgttatagtgaaccttattcttgcataatccaactattgagtgacgtcacatattctgggcagggcagacttaagactgtggagttggcttgtcgttctcaatgcggaatcaatgatttggtgtcttcatttgtcgctctgttgcaggttcagataatgttcatcttctgcatatgtttaagtgcatgcatggttacctgttactttgtttttactgattcatttgtctctgggttctgttgtgcaggaagaaaatccttcccgggaatgcacaattgtacggacagctgcgaagctgactccattttacttcaataaaattccggaaacagacgactctaatgtacctatggccactcagaggcgcctaaagagattcaatctcaaatatgatggatcaatgactactgaagctttctgtcctatctgcaatggcccgctaaatagatcagactcatcagagttggatacttttgaagaaggccaggaatctgatgtcctctatgctgcttgctgttcaagttgccggtttcaaatacttccacaggatggatcatctcttgagcaattcagttcatttctaccagatcacatgatttcccaagtgaaacatcaaaaagttgatagtcaagcttatctgaggtgagtagtatgcattaactctgatctcaaacttggattccttttccattcgttttacctacattattggtagttcatgtctctaggaagcatcagatttaaaacaaccaagatcaagactgagtgaaacactatttgagattcctaacattggtttccatttatttcagggagaaaattaaagactgtctgctcttggacgatgaagaggttgtctaaatctgcattcggatgcttgcacaaggtatgagaggaagtttaaatcctgtcatgcttatcaaggattattcctagaaacctaagatcatcttagtttaatgtcgatctgatatcatcgtagatgttaaaagtgtttttactcattcgttacaatgattgtctcaatgtgaagcaaaatcactgagcaattgaatgaagcatctacagttttacacatataatacaagaatcatgggaagtttacaatttgtaacacaagtagtaaacttgttaggggtgatgcgagaatcaagttttgtaatatttctatgcgcagaatcagagattcaggagcattaatctagagtgcaagtgatcaacatcttccaatagctggataagaaatctgtgtaaattctaaccaatgtcccatagacattataacacgaagcgcttaatgtttgatcaatttataaagtccgacggacgaatggtcaacaaattagaattgagggcatcaaacaagaactataaaatatagaggcttatatttgaaaattttctcccctagctagaataatatatacacattgaagggaccgtttgtgaaacataaaaattgaggggcatggttggaaacttttaaatttataggggcgttttgcgtttttactcaaaaagtccaaaactatcgctcaacgccggtcgattctaccggagatcggaaaaaaggaaaaagtccggagagagctaaagatcaaagctttagaatg

SEQ ID NO: 3920 - DNA, 3000 bp, Unknown
  misc_feature (1)..( 3000): cDNA_ID_2134143_gDNA_ID_1620674_Annot_ID_164201 3000 nt of promoter + ATG
attctttctccatgtgtttcggtcatgatggagttggaaggatcagttttggggacaagggtagttctgatcaggaagagacaccgtttaatctcaatccttcacagtaagtggtgattcacttatgcgctaaattggaaattctgttcctttgtggatggcacctttaagccgtggttaaattcattgttgcagtccaaactacaacatcacggtgactcgggtacgtgtggggactactttaatagatgatgagttcacagctctctttgacaccggtacatcatttacttatttggttgatccaatgtatacgacagtctctgagagtgtaagcatctaaacaccatcatattcgtgtttcttccgcatgatgctgagttttgataactctatgattcacattatcttcttcagttccattctcaggcccaagataagcgccattcaccggattcaaggattccatttgagtattgttatgacatgaggtatgagtttgtatctatccacgctcaatgtctatttttcattgtcactcaaatcttaacatttttcttgtaaacggtgtgattagcaatgacgcgaatgccagtttgataccgagtttaagcttaacaatgaaaggaaacagtcacttcaccatcaacgatcctataatcgtcatctctactgaggttatactctctgtctacttctttctctattgctccgtctcttcttcaaccaaatctgttatctgtgtgctgatactattagaatctctgcatttcctcagggcgaacttgtatattgcctggccattgtcaaaagctctgaactcaacattattgggcgtaagatcagtttttcttcctatcaatcatggaacatccgctaaataatgacattgtttactcttaatgaaacagaaaactacatgaccgggtatcgtgtagtattcgacagggagaaactcgtcttagcttggaaaaagtttgactgtaagtttcctcttacgtgtgttatatatcactaaaaccctctgtttcctaacttatgatctgtgaatatctcttaacgcaggttatgatatcgaagagacaaacacaactgttgccggaacaaacaaaacagcagcggtagctccagcaatggcagctggaataaagactcataacaattcctcagagctacacaaaacaaaccaaaccatctccaaaagtaactcctccccaaaccaaatatccaaaacagtagatgtatggtcttttttcagatttgtgttcatattacttccacttgtgtagatttgtaagccccatccaaaacacatgccaatagtattttttttgtatcataacgacactatagggattttttcaggaaatatatgctcttcatacgcatcttactatctttgcaaattctcgtcttttttctcttcaataatgaggtagttaaaccgagataaaccgaaccaaaagggaatttggctgtaatgttgaacgccgaatattctaaaggaaattaaatgggttccacattgataacctgcctcggcaagtggccaacgctcgacacttttacacgaccgagacaatgaatctttcattttttcgtcattttattctaaaattccaatattggttcgagtcttagatataatttttagtattggatttgaaaatacactcattaatcattgttaaatatactaaaatcactctgatagcattgtttagtatatcatcatatgataatgcatcgtttgtccatagttaaaagttaaaactgtattctataaactgtaaatcgtgtgataatgttaacatttacagactatgtatcaatttgattattaaaaagcaaccaacgactattatgaatatacagtagtttttggtgagtatgaatatacagtagtttgttaagatagttttgaacaaatccacatttttacgatcatatctcataataaccataaagccatatatacattgctatttatcatatccaatgactaaagtgaatattgttaaatatgctagtagtatttgttaacaaatttatcttatgcatatattaatattatatattagccttaacaacaaaaaaatctatgacttgattttttcccatatatactaattagaagattatgtaagaaataagaaaaaatggatactgtatccctgatttggaaaacagagattttaatccttctataaatattttcatttatttgcaatcttacaattacatatgttttatataatggtatatctattatagtataatataaattcaaaattaagtcgaaagttgaccacataacttagcgtttttctctcttcggaacttttttttttgtgtaatttaatttatacaggaaaattaatttaggggaaataaatgatttaattgtttgacctattttaagagaattaaaaaaagaaagatttttttatttttgtgaaaagattagatcaaatcttacatggtaattttctaatgtcaacgtcaacaatcctgccattagctttttggccaatcagattcatccaaccaaagaaaaacaaaagtgtgtttttttccttgtgtttacttcaagggtaatttagtaacttctaatatccgcggtagccaagtaaaaccaaaaccaaacgaaaaaaaaacaaatggaaagaacatataaaatcgaataaaaaataaaggagagagagagagagagaagagaagagaagaggagactacactgctccatcatcttctccttctggggatttttttttggaaaaatcgttctgttaccttttttttgcccattactcaaaccctaaccctaattttctgaaatcgcagagagagagagagagaggtttcttcgaattctttcatcatcaattcgctaactttgtttttttggggttaaatcgattaatcgttattttattagatactgtcgatcggagctaatcgactctctcttaacaaaccctaattttttggtcctctctc

SEQ ID NO: 3921 - DNA, 3000 bp, Unknown; identical to SEQ ID NO: 3911
  misc_feature (1)..( 3000): cDNA_ID_3093332_gDNA_ID_1620674_Annot_ID_164184 3000 nt of promoter + ATG

SEQ ID NO: 3922 - DNA, 3000 bp, Unknown
  misc_feature (1)..( 3000): cDNA_ID_2991529_gDNA_ID_1620674_Annot_ID_48202 3000 nt of promoter + ATG
ccagacactgttagatgccgctcaaacttggaaagatacgagagcgcagaagggattacaatgtacatactaacaaatatgaagacgttgggcaggaactgaaaaatcagagatccaatccagccagaagtttgcacccaagtgagccaatactgagcactatccaatgcttcagcattgaagattctcccggcacttaccaatgcactgatcaaggccaatggggagctgaaaaacacaagaatcaacagtagaatagtattaacaatcactcttcgcacaataagagcaacttttgtcaatcccagatgattccaataaatatcagtagccaagggtgctctgtccactttccactggtttctctgtaatcgcagctctgtgacagagaagaactttccagtacgccttgatctctcgtttcgaaaatcctgaacagccttattagctgtgtacacatccttaaacatcacaaaagcaaccccagcgccttgtgctcgtccttctttataagctgctaactgagactccaaatcagctctcagttcttgcagcttcctcagtttttcatcatctgtaaatccaaacctctctgtaatctgagaccacaaaaccttcaccctaacccacaaagaacacacacagaacactagtccgttatctccaacattctcatactcatccggtagaagcctagagtccatcttggcaactaaccaagtaatctcatctcgaacacgaaccaactctgtagcaagatcatccaaagcacacaaatccatgggaacaataaacttataaactttcccagggtacttcagcctaaagcaatcttcaaactcaactctatcagaccctaaattcttaggcaaaccctgcaccattatagtaaacacagcagtagaattcgcgttcgggtcactgatattcccattcccatctctaaacctagtaaacttcaacctagcttcaatagcagcgattccaaaatgcgagataacaacaacaataacaacaaacacaaaatgcagccaaagcaaagctgaacctttctgaatatgcgtaatcatcgttttcgaaagctcatcactcaacaaagcagtcccagcatataaattcaacggaagcataaccgaaacagctaaaacagcaatggagaaaagaagcacaaagcttccaccttcaattaaaagaaactgagcagcatcagcaccacagtgacgagcgatctcgcgacacgtggctttccaaacggcgaggagcttagagaagagagcagaaggaccaggcatacgacggtggtcgctgcgtagcttaacgaagagaaagatggagacgcagcataagagaccaatgaccgagatattaagcagatactgaatgttgccgtaccaagcatctgggatttcaggtaagtcgccggaagatggaggaggagagaatgaattatctattgtcattgatgaaatcggtggcatcgcagctggtgaaaaattgcgattcatcgcgaatttctcaaccaaattgagaaacccaaatcttcgaagtttcttcagagattcaggatttatacaacaaggttttgatcaggagaaatttgggggctttagggttagactttgggggaagtagatcgacgaagatgatggcaaaagtagaaaggtaaatagaaaaggaggaacaaggaatgctatcgcggtttcgaatctctcaaaagattcttctccttaaatcatgaaatttaatcccatctttttaagataaatacacccaaaaaaaacgaattaacacaactaaaaaatataaataatttgatagaagtatatcaaattggtaatttacagagtttttatgaataaaacgatagttctttaaacgataattacatattctctaaatatttcgtgattagtagaataagagaatataatcaaattcataactcttgtatattcattttaatcaaattctccttaaagcatgaaattaatcaaataatttgaaggtaaaatacccaaaaaaatacgaaataacataactaagatcggtttgagtttgggatgaaataacatcccctgttctctaatggatggaactctgtttcgaatttgcttctcgaatttgccattgtagactataagcatttgtaaggaactcatctctaatgtaggatttgagttcttcttatcttcccactagaacattcatcttaaacacagttatgtaatttccataagagatatgaaacagagcatactaccgtgataatccggacacaattgatattagtagccttgtatcaaggtacgtgtgtattccccatcatataataaaagaagcttttgctaatgcaaatttctggtaagttcacagttttgatgtgcaagttcttttgtatcatcaatttagcgattatggactgcgccatgcttcagatgaatagaaaaaagaaacttatgctggtctcgaaatccactaaccaagccattcaacatcaaagaaaaaagcccacattataaaaaaataaaaaagcccactttaaactatcaaatgcccaacaatggatgatgcactagtcgagtcagagtggacggagccaaaggcagagatggattttaagctttaatttgtttcccagatatttttcatctggtccctctgtttttaaataattaactaaaacgactataataattaataaattatactatagagtattttgtgtggatttttatttactgttgaaacttaaggatacaaaagaaaaacaattattcagataattcgtcattagatccctttaattttagtaattaagtaaaaagattataaaagatgagaaggagaagatagcttcttcatcgagaaacctcgaaatcaaaaagcacgtcggtgacttgtactcttcaatctcttcttcctctctttcacatctccttctctcgaacccatcgacctgcgctaattcatcatcgaccttgctcaaattcatcaaccatg

SEQ ID NO: 3923 - DNA, 3000 bp, Unknown
  misc_feature (1)..( 3000): cDNA_ID_1822388_gDNA_ID_1620674_Annot_ID_48204 3000 nt of promoter + ATG
gcaatttttcaccagctgcgatgccaccgatttcatcaatgacaatagataattcattctctcctcctccatcttccggcgacttacctgaaatcccagatgcttggtacggcaacattcagtatctgcttaatatctcggtcattggtctcttatgctgcgtctccatctttctcttcgttaagctacgcagcgaccaccgtcgtatgcctggtccttctgctctcttctctaagctcctcgccgtttggaaagccacgtgtcgcgagatcgctcgtcactgtggtgctgatgctgctcagtttcttttaattgaaggtggaagctttgtgcttcttttctccattgctgttttagctgtttcggttatgcttccgttgaatttatatgctgggactgctttgttgagtgatgagctttcgaaaacgatgattacgcatattcagaaaggttcagctttgctttggctgcattttgtgtttgttgttattgttgttgttatctcgcattttggaatcgctgctattgaagctaggttgaagtttactaggtttagagatgggaatgggaatatcagtgacccgaacgcgaattctactgctgtgtttactataatggtgcagggtttgcctaagaatttagggtctgatagagttgagtttgaagattgctttaggctgaagtaccctgggaaagtttataagtttattgttcccatggatttgtgtgctttggatgatcttgctacagagttggttcgtgttcgagatgagattacttggttagttgccaagatggactctaggcttctaccggatgagtatgagaatgttggagataacggactagtgttctgtgtgtgttctttgtgggttagggtgaaggttttgtggtctcagattacagagaggtttggatttacagatgatgaaaaactgaggaagctgcaagaactgagagctgatttggagtctcagttagcagcttataaagaaggacgagcacaaggcgctggggttgcttttgtgatgtttaaggatgtgtacacagctaataaggctgttcaggattttcgaaacgagagatcaaggcgtactggaaagttcttctctgtcacagagctgcgattacagagaaaccagtggaaagtggacagagcacccttggctactgatatttattggaatcatctgggattgacaaaagttgctcttattgtgcgaagagtgattgttaatactattctactgttgattcttgtgtttttcagctccccattggccttgatcagtgcattggtaagtgccgggagaatcttcaatgctgaagcattggatagtgctcagtattggctcacttgggtgcaaacttctggctggattggatctctgatttttcagttcctgcccaacgtcttcatatttgttagtatgtacattgtaatcccttctgcgctctcgtatctttccaagtttgagcggcatctaacagtgtctggggaacaaagagcagctctcttgaagatggtttgcttcttccttgtgaacctcatcattctcaaggctcttgtggagtcgtcactggaaagtgcactcctgaaaatgagccgttgctatttagatggtgaggattgcaagaggattgaagaatacatgagcccttccttcttatcaaggtcatgcgtttcagctctagcttttctcatcacaagcacgttcctaggaatctccttcgatctactcgctccaatcccgtggatcaagaagaaaattcaaaagttcaggaagaatgacatgcttcagcttgtccccgagcaaaatgaagagtacgctttggaaaatcaagagccaagcagtaaccttgagacaccacttctccctgaaaacatgtttgagtctccaagattcggggacatagaacctatgagccaagacctctctgaatacccaatcagccgaacctcaccaatccctaaacagaaattcgactttgcccaatactacgccttcaatctcaccatctttgccttaacaatgatatactcttcattcgctccactcgtggtccctgtaggcgcagtttactttggttacagatacattgtcgacaaatacaacttcctttacgtgtacagagtccgtggcttccctgcagggaatgaaggaaagctaatggacacggttttgtgtatcatgagattctgtgtcgacctgtacctcgtctcaatgctgctcttcttctcagttaaaggagattccacaaagcttcaagccatattcacacttggagtgcttgtgatgtacaagcttttgccttcggatacagaccggtatcacccagctttactaagaagtattcagaccgtcgatagcatcatcgacggacctgtggattacgaagcttattctcacccaaacttcgattgggacacttacaacaacagatgattctacgaccttttaagtcttacaaattttgctctttgaccaaatacaactggaatctatttgtatatctcttctttgtgtatattccatcttttgtgcaattattttttgttcacgggttaagtttgcaagatttatcagttgagtccctttaatcattaattttggggttgtaatagcttcattcttaaaatatggggtatgaaatcggaagaaagagaattataaaaatagtaggtgggacccagtgttctctgaagtgagtatatcagagttctcttttcaacacatggactgttacactcacctaacgacgacgaagaagaaccaacatagatctcttctcttcctctcaaactcactaagcttcattgttaccccaaataaaccctaattttgctctcactattcgaagatctaaaatcatctcgcattttgatttccgaatactttcctgagttttgctggtcatgatttctcatttgctctttgttttcccgagaaaaatcttcaggagagtaggataatctctcgagtttcgaaatcgtttcca

SEQ ID NO: 3924 - DNA, 3000 bp, Unknown; identical to SEQ ID NO: 3920
  misc_feature (1)..( 3000): cDNA_ID_1824402_gDNA_ID_1620674_Annot_ID_48205 3000 nt of promoter + ATG

SEQ ID NO: 3925 - DNA, 3000 bp, Unknown
  misc_feature (1)..( 3000): cDNA_ID_1824395_gDNA_ID_1620674_Annot_ID_48207 3000 nt of promoter + ATG
agatctctgagatgaagaagtatcctgagactcgagagcctctcgaagggcttgaggatgctttgagaaggtcttaccttctggtcaatagctgtagagaccggagctatctttacttgttggctatgggttggaacattgtttaccagttcaggaaacatcaggatgagattgatcgttttcttaagatcatacctctcatcactttggtcgataacgctcgcattcgggtaattttacctgcattttggtctaacaagtttctctgcttgatgttatggtatattgaaattttgattgttatacaggagaggtttgagtatattgaccgtgatcagcgtgagtacactctggatgaagaggatagacatgtgcaagatgttattttgaaacaagaatccaccagagaagcagcatcagtactgaagaagactctctcttgctcataccctaacttgcgtttctgtgaagctctcaaaacagaaaacgagaaactgcagatcgaacttcagcggtcgcaggagcattatgatgtggctcagtgtgaagtcattcagcgtttaattggtgttacacaagctgctgctgctgttgaacctgactctgagaaggagctgacaaagaaagcttccaaaaaatctgaacgtagctcaagcatgaagacggaatattcgtatgacgaagattctcccaagaaaagcagtactcgtgcagcttcgaggttagaatctcatgtttgttctaaagatccaaatttccttacaagtttaagaaagtataatcttcaattctttgctgtgactgtaatgcttttaggtctgttttcatgtttgaaggctaagatttggtacaatgttctataacatcggttacacaattgttccatgcagatccacttctaatgtttcatctgggcatgatctgctttcacgaagagcatcacaggcacaacaccatgaagaatggcataccgacttactagcttgttgctcggaaccttctctttgtaagaccacactatttgtttacaatgtggctccactttgttttctctgttacatagatgattagcgtttcacattctatacttccttgttatctgcaaagttctcaaagattcaatgatggaaccgcaggcttcaagacattctttttcccgtgtggtactttggcaaagattgccactgcagcatccaacaggcacatctgtaagggatattattgaataccgtgactttattaattttcaatcttttagtaatacatgtgaaagctaataagtcaactggattttttttaattttcgctctcccagcttcagctgaagcatgtaatgagctaatggcgtattctttgatactttcttgttgctgctatacttgttgcgtgaggaggaaactccggaagacactgaacatcacggtattacattctcattctcttccactcgcttgaatccttaccattaatcccatttgatcccaaaaatctatatgcttccgagaaaatttctatcatttgcataccataaacaacaaatgaaatttcggttaaagattaagtagacacctgcaaaaaaattcagtagtaactatcatggttgagattgaaatggctatgtttatgccactcaatgtagagtcggaatgaatgcttaatgttttctgatttcgcagggaggattcattgacgattttctatctcatgtaatgtgttgttgctgtgcccttgtacaagaactgagagaagttgagattcgtggggcatatggtatgatttacatacaaacatattatcaatatttgtttcaatcttgaagcactaacaaagatctgtctctcatatctttgcaggtacggagaagacgaaaataagcccgccttcgtcgcagttcatggaacattgaaatcttctattatacaaaaggtgaacaaaaacaacgatttgttgtaactctggatacgagacgagattcttcttcgtactactcacttaatattattgtgttaaatcgtggagtcgtatgtaaattagtttgggattctcatcttaatttcagcaatttgtgttgtgtgtatcacatatagactaactaattcttatttcaaccttttatcacaagatagggtattaggtttaccggatggccaattgaaccaaacttgtgttttgggtcaaaatagtagttttcttttatgaatcaaggagaacatatacaatttgctggtgggtgaatattaatattacaatagcaaattaaggaaaattctttgaagaagaaaagagatgaagaaatgcatgtgaggtatcattaccatgactaaaaagcctaaaacattgacaaaattgatatgactgatgatgattctcttctattgctcccaaattggacaaaacttgtcggttccttttaatggatggttacatgtttacggtttagcatcttttaaatacttatcaaaccataatttctttactaatcgtctcaccggtatgggtagactcgtaaataaccactttcatcttcttccccaatttttcttgctttctctaaaccctagtttcagacaaagtagtgacatttttctaacaattaaaccaatatcgccgtagtcaaccaccgcataacgttttggcgccgcctgaggctgacctggggctgctaaagattttatcgcgacgactctctttctctctcaaactggtaactaatcacttatttgcttgtttcgattttgaatgtgcacacatcgctatctattcaatatattcgctttatagcaagacttagcaatatacagtgtaataggattgattatatactgattgagtaaaaaagactaatgatttcgtttagagtaacaatctcttaattatctcgttaatggcggaaagtagttaagtctcgtgaattagatgttgatagcattgtctactcctttgtgttgtaattcctaatctaaattttccacagtttcagctgcttgcgaattggaaatg

SEQ ID NO: 3926 - DNA, 3000 bp, Unknown
  misc_feature (1)..( 3000): cDNA_ID_1824387_gDNA_ID_1620674_Annot_ID_48209 3000 nt of promoter + ATG
tccatacatatgcatacgtgggaagggtagacattggtagtggtggtggtggtcctggtggactatgactactacgccctctatcttttcgagagtgcctatataccatgcgttttactctatatatgtaaccatttcttttttccaaaagtatattactgattttaacatttaaatactagtttttataaagtgttttatactgttatagttgctccatgacggaaatgatcaaaatgtttacttatataaaccttgtaaatgtccattcgattcttcttttaaaacaactcacacattacacacacaaaactgcaaattaaactccgatgctaatcaagtccaaacaataacataaccttttttttgtatgtactctagtagtttgtattaatatttgttgctttatatggattagtgaattgtatacgatataaatcaataacataacaaaaagtatcaggaatacattacactaaagttgatgtcaactacccatttgcactatagatcgtttgtctagtgctgtaatgtattttaaaagagcaagtagatcacatcaaatttgttctttaaacgtagtgggaatgtatcatatacacgcctataaacggttttggtatatatgagtgtgttttactatgcaacaaacaaactaagttaacctaatttttgtaagcaaaatttcaaacgaactaacacaacatgatctatgtaacatgtcataattgtaaaagtaagagaggagacgtcttattattggaggtaaagaagatagacaaactgttgttttagtcgttaggtgaattgtctccatgtgatttagttgggaataatcgtgcttcttactttatgttaaaaaatatgtctcgaaatgtccttatctgtaacaataaatgggacagctaaattttccatacacatttaaaaaacaaaatatcactactaaaacctaagtatttatacagtacttttaactaatttttgtttggggttatcgaatgtctaacactttgtcggaatcacatctaaaaaaaaatagtttaacgaagaaagtacttctcagaatctgcattgcttctgagcacataaaataaataactaaactataagcatcaacacactttgtacctatctttttcatttttcaatgcttttaccaataccgtttatttttccctttctcagttagtttccaatacaaattaagttaaacctagactaatatacaaattatatgtgtcgatcaacattactattgtttataatttgataaaacgactgtatattattacaatcatatattcatatgcatttacaaacacttattatatactaaatacaatataacttcataaaataaataaaaagttatgtgctaatcaactaacctgtaacatatactaataatagctttaaataaacacatttaatatatgctaaaatacgaataaattatacccaatagtaattatttctgtaatttaatagcagctattaagttccagtttttttaaaaaaaatttaaatccaaaattgtttaaggttgtgtttgcacaaatggattgttactttaaaactttaaacaagaacataaacccatcattatacaaatgggctgaactaattgattagtaagcccattctatttctcacgtaactcagttattgcgttattggcccaaaccgaaatggacttttcatagacaactggtactctcgtcgtctagctgtgcaattaaagataccagaccaaaatacccttcacgtgatacaaacaacgagaaaaggaaattaataccaacacgagaaaaaatggaaattcagatttcgttttgtgatatatcgaaaagcttttagttatatagtttccaaaattttgaatctattcactcaattaataatccagtacgttattaatatcctatagagattaaaaaaaaaactcacaagaaaagccactctcgtaattaataaggcgtgatttaggttaatagtgtccttttctaacattcaatttaatcatgctaagtaccccaacattggacccgcacttcatagctcatactggaaattcctaattacccttcattcccaaagcgtaaaagcccacaaggataaggatacaaacgtcattacacgaaatgattaaagaataaagtaaaaaagaaaagtcgtactactacttaaaccatcttttaaaataaaataaaaatctaaaagtaagaggtcgaatctatctgaacgcgcaatctccgccgtcaaatttggtagagctagtgaaaagtggtcccacgtctccgataatctatgcttaaccaatcgtaacgtaccacgtatagcgattactttggtaattgtagcgtttagtgaaatcgttttggcgggcgtaattaataaattcaaaatcagagcccaaattaaaaacaaatcaaaaccctagcgcctctttttttgttccatttctctctctctcactccctctttgctcaaatcgattctccctcgcttatcgccatttctccctcgcttatcgccatttctccctccattttcgctctctcgatatcgagcttcctctttccgcctatcgaatctctaatctgaagctgtctttctcgatctggatgtttatcgaagaaggaggtctctgttaatttaggtaataatcattctccgtgacttttttttccttttcgatttctagggtttaaatttgctcgagattctccaacttctttgatttgatagtttattcaagtgtaatcgattgaatgatttggctgaggtttaacttttcaatttcgttatccatcagttaatcgttttttacccagctagagcaaagtctgaagaatctggacttttcgatatctaatttatcataatttattgattcaattctggattgatgattttcatactgctttcactaggtgtatagggaaattaatctattgggaagtgttgtagtagctgttaggaggataaagaaggcat

SEQ ID NO: 3927 - DNA, 3000 bp, Unknown
  misc_feature (1)..( 3000): cDNA_ID_1824383_gDNA_ID_1620674_Annot_ID_48210 3000 nt of promoter + ATG
accatcttttaaaataaaataaaaatctaaaagtaagaggtcgaatctatctgaacgcgcaatctccgccgtcaaatttggtagagctagtgaaaagtggtcccacgtctccgataatctatgcttaaccaatcgtaacgtaccacgtatagcgattactttggtaattgtagcgtttagtgaaatcgttttggcgggcgtaattaataaattcaaaatcagagcccaaattaaaaacaaatcaaaaccctagcgcctctttttttgttccatttctctctctctcactccctctttgctcaaatcgattctccctcgcttatcgccatttctccctcgcttatcgccatttctccctccattttcgctctctcgatatcgagcttcctctttccgcctatcgaatctctaatctgaagctgtctttctcgatctggatgtttatcgaagaaggaggtctctgttaatttaggtaataatcattctccgtgacttttttttccttttcgatttctagggtttaaatttgctcgagattctccaacttctttgatttgatagtttattcaagtgtaatcgattgaatgatttggctgaggtttaacttttcaatttcgttatccatcagttaatcgttttttacccagctagagcaaagtctgaagaatctggacttttcgatatctaatttatcataatttattgattcaattctggattgatgattttcatactgctttcactaggtgtatagggaaattaatctattgggaagtgttgtagtagctgttaggaggataaagaaggcatatggggaaggtatctccaaaggatttggattcaaaaacctcggtgaggaaaaagaagttgaaaagttcaagtaacaagtatttaaagccaggggctttggttcagctttgttacagcaaagcatcggctgctaagtcatgtaatgaattagggaagaaacgagtacctgtgtttgatactaagtcctgcaatgatttggggaagaaacgagtacctgtatttgatattaagcatgcgaggaacaataaaatggcagtggaacagttgaattctccaaaaagccctcttatgttgtcccctgtcaacgttgttaagcggagtactctggtgaggccaatgaagtttgatgatctgcaggtggagagtaataatacttgtaagaaaagccctttaatgttatccccaatgggtattgttatgcaaaacactctgttgaggacaccaaaaactccccaagctgatccttgcgtttcagaatcacagcttgagtctcttcccatggatttactggtaagtttttcgtttacatttaagttaataggttctttttggtagtcatctgaatgtatgaagttagttcttataaagatcacactttctgtaacttccaggttaaaatagtttgtcatctgcaccatgaccagctgaaggctgttttccatgtttctcaaagaataagaatggccgtatgttcttctttcccctgtttaagtttgcatccataaaagctcaattttttgcagttttacttgatgtgtattaatctgttttgacttttctttgaaacagaccatacttgcaagacaatatcatttcaattatacaacaccagaccgctcaagacaggaaatgttgagggtcatgaccccagttccaataaatcgttggccatttcgtaggtacatgttttacttcaacttttacccttttgaaaagagcatcaaacaactcgtttggctcataacaaaaccttctttgatctaaattagcagaggagatggaaacccaacaatggtgtcaagcccacatacccccaaagcaccaaaacatgctcctagaccaccctctcgaaccaaactcgcggagatgaagcaaatcactgctgttcttttccaagaccagacaccatttccttcaagatgcatcgttccttctgttctccagaggccgactttgttcaaaccaatggctccaaagcaccctcgagtgctcttctatgaggatgaactatgtcaagctgttgctcaaaacaacctcacctgattacacttagctgcagtcatatcggtttcctctctctgttgatagtaggttttgtcttcattgcataattgatcattgctcttgatgatcatcattacctatagtaagaagcatgcaagttttgtagcagtgctagttcagggttttaggtttacatgggaatctcctagtatcatttaaggggttttcaagtttttactctcttgagtttgtcataataagcgtctttgatttggtcagttgagtcttgtgtatattttctgcatatcttatctggatcagttgcttttttttttttaatataatttgattgcttatccttgctttcatcttattggttattgagttctccaatttatcgtaccgcgattcaaaccgtacttaaatgttaaaccggatattattaaatcgattgaactgaataagattcggttcaagtttggttatatttttcttaaggcctctgatttagttgggcctatttacgatcttacaagcccaaacttattgccgaagatccattattgaaaagtctcgacgcgtgtaagcttactatatccctgttgccaaacaaggcttttgtcccttgtagggccaatcctttatttggctataaataaaggatgtatgtcttctaaacaaacactttttctaatcggagagcttcgaagggttctgagatctcgcggctccttcgatcttctccgctcaactattacctccgatcgttggcttatgtctactgtaacctcttagatttgattttggcgcgttattagaaacccctaacatctttaaactcactcgaggtctctcgtgatcgatctagggtttcgcgagatctgagatttcatattttccgattcaccttcgcaatccaattttttttgttgcttggattttgtttgtgtgtaatcgtgtggtaag

SEQ ID NO: 3928 - DNA, 2037 bp, Unknown; identical to SEQ ID NO: 3918
  misc_feature (1)..( 2037): cDNA_ID_1824374_gDNA_ID_1620674_Annot_ID_48214 3000 nt of promoter + ATG

SEQ ID NO: 3929 - DNA, 3000 bp, Unknown; identical to SEQ ID NO: 3923
  misc_feature (1)..( 3000): cDNA_ID_2147267_gDNA_ID_1620674_Annot_ID_164199 3000 nt of promoter + ATG

SEQ ID NO: 3930 - DNA, 3000 bp, Unknown; identical to SEQ ID NO: 3922
  misc_feature (1)..( 3000): cDNA_ID_2991529_gDNA_ID_1620674_Annot_ID_164197 3000 nt of promoter + ATG

SEQ ID NO: 3931 - DNA, 3000 bp, Unknown; identical to SEQ ID NO: 3917
  misc_feature (1)..( 3000): cDNA_ID_1822404_gDNA_ID_1620674_Annot_ID_164194 3000 nt of promoter + ATG

SEQ ID NO: 3932 - DNA, 3000 bp, Unknown; identical to SEQ ID NO: 3915
  misc_feature (1)..( 3000): cDNA_ID_1822416_gDNA_ID_1620674_Annot_ID_164191 3000 nt of promoter + ATG

SEQ ID NO: 3933 - DNA, 3000 bp, Unknown
  misc_feature (1)..( 3000): cDNA_ID_3072185_gDNA_ID_1620674_Annot_ID_164190 3000 nt of promoter + ATG
tacagcccaacgtctccaagctatagcccaacgtcgccaagctacagcccgacatctccgagctacagtcctacttccccaagttacagcccgacttcgcctgcttacagcccgacttcacctgcttacagcccaacttcaccagcatacagcccaacctctccttcttacagcccaacttcaccttcttacagcccaacatcgccttcttacagccctacttcaccatcttacagcccaacatctccgtcttacagccctacttcacccgcatatagccccacatctcctggctacagccctacttcaccaagttacagtccaacatcaccaagctacggtcctacgtctccaagctacaaccctcagtctgctaaatatagcccatctatagcttactctcctagcaatgcaagactatcaccagctagcccctacagtcctacatctcccaactacaggtaagtagtaatatcttaatttttacactttctatgaagcttctcttatctgttgtggtgatattgtgtcatcttctctaatcgttaactcttattaaaaatttactctgcagcccgacatctccatcatactcacccacatctccatcttattcaccttcaagtccaacatacagtcccagcaggtttgacttttacccgcttgaaaatcttggatctgttgtaatgcatccatctcaattgaattccgcaaaaagtttaactgggttgttgttattaaatctgtctcagcccatacagctcaggagcaagcccagactacagcccaagcgcaggctactcgccaacacttcccggttattcaccgtcatcaacgggtcagtataccccacatgagggcgataaaaaggacaagactggaaaaaaagatgccagtaaggatgataaaggcaacccttgaaagagagtgagaattggcaatccatgttttaggtaacgtctaaatctcttggaaccattggggtttacaagtcttactagctcacgaacttagccacttgggatatcgtgtaacccgcaggtcatgatttaagagacagtgaaagctgagaaaaggaagggaccgtttcaaagtgatcttctgtggataactttgtgaacaaggttttcttaatagatccttttttcgtgagttgtatattattccaaactgatccataaatccatccaatcctcatcccccaaaaagaaaatagtataaacatagaaaaacgaaaacatatcagactttgggcttttcgtatggtttagtttttggctttttgctgtgttgttctatttcagaaagtaaacatgtgaaacggttcatttgtaatccatgaaaggattctttatgttactgctgttgcttcattgagtagatacgaatcgagaatgccttttttccttgtttccgacaattatcgattgacgtgtgaccactttaaaagtttaaacagctcgactttccaatatgggtttatttcttgttttatccacaccattaaagaatggtttttgggatttttatttatgtgataattaatcatttttccaaattttattttgtatataataaatgaagcaaatgttggaaaactatccaatggatgtggtgggttaatatcaccagattcgcatagctggtttttgacttgtcttcttaattatttgtccagaaaaagagaagaactcttcacatcatcattgtcaactttagcattattgtattagctttttatttctttacgtctacaaagctattggtacaacgttctaaaatcaaattcgtcatcagtagattttgtaaactaattaagtaaagttcagtgattaaagaagctagatgaagaacgtgtgcaacgactcctctgagatctacacggaataatgtcgtcagtgagcaaacaactcccatcacgtcgtccctccacctgtcctctcttctccttccttgcttgtctttctctctcaaatcatttcacctaaaaataataaatatctttcgttttctaaagaaaaaaaaaaaaaaaacttttcaaattcatctttggtttctgcagcagcaacaacaaccgagccctgttcgttagggttttcggtttttgttagcttttcttcttcttcttcttcgtttccttccacctgaattgttgtaaccatggcggagaaagtatcggaggacgttatgcttctacacggtgacctcgatttgaaaattgttaaggctaggaggttacctaacatggatatgttctcagaacatttgcgccgtctcttcaccgcctgtaacgcctgtgctagacccaccgataccgatgatgtcgatcccagagataaaggcgaattcggtgataaaaacatccgtagccaccgtaaggttatcaccagcgatccttacgtcaccgtcgtcgttcctcaagcgactctagctcgaacacgtgttttgaaaaactcacaagagcctctttgggacgagaaattcaacatttctatagcgcatccgtttgcttatctcgagttccaggtcaaagacgacgatgttttcggtgctcaaatcattggcacggctaagatcccggttcgagacatcgcatcgggagaacgcatttctggttggtttcctgtactcggtgcttcgggaaaaccgcctaaggcagaaactgctattttcatcgatatgaaatttactccgtttgaccagatccatagctaccgatgtggaatcgccggagatccggagcgtaggggtgttagacggacttatttccctgtgaggaaaggaagtcaggtgaggctttaccaggacgctcatgttatggacggaacgttgccggcgattgggttagataacgggaaagtttatgagcatgggaagtgttgggaagatatatgttatgctatatctgaggctcaccatatgatttacattgttggttggtctatcttccataagattaagcttgttagggaaacaaaagttccaagagataaggatatg

SEQ ID NO: 3934 - DNA, 3000 bp, Unknown; identical to SEQ ID NO: 3913
  misc_feature (1)..( 3000): cDNA_ID_2140554_gDNA_ID_1620674_Annot_ID_164187 3000 nt of promoter + ATG

SEQ ID NO: 3935 - DNA, 3000 bp, Unknown; identical to SEQ ID NO: 3912
  misc_feature (1)..( 3000): cDNA_ID_2999332_gDNA_ID_1620674_Annot_ID_164186 3000 nt of promoter + ATG

SEQ ID NO: 3936 - DNA, 3000 bp, Unknown
  misc_feature (1)..( 3000): cDNA_ID_1011433_gDNA_ID_1620674_Annot_ID_164185 3000 nt of promoter + ATG
aacctttaaaattctacaaaaaacttaatttcctctttccgtctccacaaaattcttttaatcttcttagaacagaggtacatgtctttaatttctacataattttggacaggttgtcaaagttgccgattttggtgttgccagagtgcagactgagtcaggggttatgacagcggaaacagggacataccgatggatggctccagaggtattacttctttgtcttgttcttttttttgactttccatgcttttgacactagactctgtgaacccaggtcattgagcacaaaccttatgatcacagggcagatgtcttcagctacgcgattgtgctgtgggaacttttgactggggaagtaagactcctagttttctctctctggattttagtcgaaagttgctaaactcagtaaatctcatgtgtttaacacacttttttttcttactggtgtataatgaatgaaaacagctcccatattcttacttgactccactgcaagctgctgttggcgttgtccaaaaggtatcatgtctataggactttatagttatttttctcgtgctttgattaacggccttcaacacaatgacttgtaattaatttacagggacttagaccaaaaattccaaaggaaacacacccaaaactgactgaacttcttgagaaatgctggcagcaagacccagctctaagacccaattttgcagaaatcatagaaatgcttaaccaactaatccgcgaggtaattgatttatcattgcatctctctctctaaccaacacgattcttagcattaatatgttttgaaaccaccaggttggagatgatgagcgccacaaggataaacatggtggttacttttcaggcctaaaaaaaggccatcgttgactctctcgggtgcgctgaaaaatttggtttgatcggtttgatagagctctactcacttctcgttttttcgttgtacagtttcttagagcctcactctttttgtccatgtataattttcttaaaaaacaatctccttttgatacaattatcactgcagagattgatttggattgcaactcaataaagtgaaagccattcttttgaagccattcttaagagcggctacggatttctttgttaatcaaagcaagtaatcatattaactgatcgtaaacgattcagatacagaaacacctgtgttgagattgatattagttttcataatattagtttcggttcctttcggtttgatcttgtccatgtataaatatgtttttctatcattttataaatttaacacttaaacttaaagaataataatttaaaaccaatttaaaacttaaattttaagaaagtaattaataatttttaactaaaataatgttaatttcactattatcatttaaaaattagtttaagtattaaaattttaaaacggcgaaaactaaacgtgtgtaggcatgcatccccgtccttaattggtccgtaaactttgtggtgttcgaagttcggtaaagctttcacccaatatagatttgacagttaaactatgttttagagaataataatgatgattgatacttgcgttgagaacatctacagaatttattgataattacaggaggtgatatggctatgattgttttcactcttctaccggcagctcattctctgtccaagcgacgtatcctccagcaatgtctgtgatcgccgtgaagccctgtacatgtggcgacattaaacccgcttgtcctaaaccggataacggctatataaattgaagtgatattacacacatacagcagtgagaagatcagttgaggccataaatgacatttgaccgctctcacaaccctgcagaagtagtttattacgtgcatcagagattttgtgaaacaagggattgtcttcataggggtttatttagtctctgaatgtcaaaactgaaacttacgattatgatttcatcgtgtttcctgaagtgggacgagacctgtcttagaaaactcgggttcttaaccattcctgcaacggttttggcttggtgttagttttaagttgtttttcattttcactctttctcataagaggaaccttaaggtcggtgatgaaaacctgatccgactctgtacatgtaaggtacgttgatggctctagtcggatgtccgatgctgaattcgtctggtgtcctcacgtcgagatagcggtatcctgcttgagctagctcacgcgccactcttactggtactgacgtaggaattttaactgcctctgctgcaacatttcctctgcttgttgtcgttgctttcctccttgagcaagaagttaatactcagatttaatatttattcataatctaaaatcagatagagaaggcgattctcgtcgttgattgctagcttaccatcggaagtttgagtttcgaagatcagctacaataacacctcttcgtgttggtaattggcacttgaaagatccacatgtttgtagaggtggagaaatagccgatgaccagtttccaattcgtgatgttgtgttaaaagcagtggtttccattttcacttcttctttgaaacttcttttagaatgctttgatgctacttagatacttcttctcttagttctatagcgtttatataatacatacagacacaaaggtatgggtgtcacgtcagcaagttttatgtccgatcttcgagtctctatcatttctatggataaattcaattatgtaccaaagtcgattccaaaatgtaaacaatgcgtagataatgaatcatgataagtccaactcggtgcctcgtgagtcgtgttgaagaggataacttgctgactcggacggataagaagaccgtaaggcccaattgtgataaactaattatggatccaaattatcgtatttgggcctcgtttaggcccaatattgaaacaagtggctgagatagtggagcggaggagagaagatgatgaagttaacaatggtggaatagcgattcttcgacgacgatg

SEQ ID NO: 3937 - DNA, 3000 bp, Unknown
  misc_feature (1)..( 3000): cDNA_ID_1822512_gDNA_ID_1620675_Annot_ID_48215 3000 nt of promoter + ATG
attaaaattgtaaattgctatttattctgcatattttcccttctgttttatcacacggccgctcaagtttatttttaatttgtttttgggtaaaagtaactaaactttgcgcatgaaaacttttatgtgaggtttatgtattattttttttggtttgttgctgacttgttgttgagtgttattaaagaactaaatcgattttacctaaagcgtaacttttgttataggttttattacttaaatattaatttacactttcattttcaatgctacaagaaaaagaacagaaaatttacaattctgattccatttttcagctgctgccacatgtgggaaataagaccagccctccaataactccaagaaccggtagagaaatgaaggtatatatgatctattaaaccggggggtttccggtttatcattgtctcaaatcaaatcatatctttattaaaaggagtcgacgtaaagaatgaaaaaaagctggttggtttcggaactttttcgttgattataaaaattaaccgagagaaaagagaaagcattataattgtcatgatgaaatcatgcaattgtttattcaatccatatccttttctttttgaaataataaaaagggtaacacagtgagtaatgtgcaatgagcggaaattctatggttaacttttttttacgttcgaaataattgctgacaaaaagaaggacttcatttgagaaaactcaaatataatgtcaaacatcaatttggctagatctacccgttacatgaattcggttctagttttattggatttttagattcggattaatatgttatgtctggagaatataataatatatactagtcaattagactactcctcgccaagtgactattactagatgatatattatgagaatcaaaacatatgagcaaatatgaataaaatcgttgtgaatgatacagcatttgtacaagagcatgataagaggaagaacaatgggaagaagattaaaggatcagaaggagaagaagaaacaagagaccagaactcgcaacgctgagattcacgccgcggtctctgtcgcaggagtagctgcagttgttgccgcaaccgcagcatctaacgctattgcggccgcagaagatgcggttgaatcaacaaccgttgcagctgcaatggcatctgcagctgctctcatcgcttcacattgcatcgagatagcgggagagattggggcgggttataaccagattgccacggctgttagctccgcgaccaatgctaggactaacggagacattatggctttaacggcaagtgctgcaacaggtatcatttattgttttctcgcatagtctaccgctttcaaatgataccccatatgtgattttgaggttttgttgagagattttagcgttgcgaggagctgcgattctaaggtcacgaatggaaaggaacaacgagaacaaagcaatgctatatgcaacaaaggagcacgtcgtagaaatggaagagagaaatgtatttggagcgatgactttcgtctctagaggagaagagcttctcaaacgcacccgcaaaggtaacttgtgctccaagaaaacaccgttttgatcatgtgatgaatctgtcagggttaagtttccgaggatatttggtgacaggggatcttcattggaagcaagtatcttttaacatcaattccaattggcaagtaagttttttttttttttttttaagaactttcataaaaaaatgatatatatgatgttcctcatactcataggctcttgattttgaaataggtggttcttaaaatgaagagcaaacatgtgggtggaactttcacgaagacgaagaaatgtaagcttacatgacacaagtttctagcgaattagtgaataccaaagttgatagtcttcttaattaccttgtacaaaccaacattcccttggcggtttatttggatgcaggcgttgtcaatggagtgtgccgagatatacccgaatgggcacatagaggacgagcagataaaatggtagagcgaagagcctactttggggtgaaaacagtggaaagggtgattgaattcgaatgtggaaacaaaagagagaagcaaatgtggatagaggggattcaacagttgcttaactcactcgaaatcggttctagtgttcaatggaaacattagagttaggatcaaattaaaacactatttcacatttgaacatcatgtaataacgattgattttttttttcgatttcacgtgtgttgaagaatgtatgtttgtgtctggtgtaataatatttgacattgatatttatttgtcacactaacgacatttattatttcccgtctttctcactttatcgatttacagctggatttctgagtttttatttctttcttaaaaaggaaaacaaatataagaaaattagaacttaaaaaattccctctatcagtcaaatggagttcttcgtccttccggtggaaaattctcggaaacgattgaacttctgataatcaaatccggttcatgcgagttatgtaacatttatcggtaatatatcttcccactctactgcagtaattcgagttcaatttaggatagaattgctttacaaataaatttgagttatcttctacttcagtcttgtattgtatcttacaagttcatgggtcaattcaagatctcccttttcatgtttccgaatcaattttcttttacttgagagaaccaaaacttagcaggattcgcgttttcttaatttaatttgtttcgattcagctccgtttgcttcttgtcgcttccaatttcccgaccaatgggtgatagatttgtcctagcatagaaaaaaataagattaattgatgtctcagatgtaagatccattacagtaaaattcagttgtaacatccaattcgtgtgtttgaattcaattctctgttttttattctatcctgcagatcattcgttaagatggtgatattgagttgtttcatggagtctacatg

SEQ ID NO: 3938 - DNA, 3000 bp, Unknown
  misc_feature (1)..( 3000): cDNA_ID_1822508_gDNA_ID_1620675_Annot_ID_48216 3000 nt of promoter + ATG
gtatatatgactttaaagattgcttacctaaagtttttactcatgcatagatcgacatgagctagttttggggaatacttttagtgctgtgccaggcgcaaaggctccaaacaaggaggttccaccagaggttctcactcctcccttgttggttactttgttatctgttaaatagttttccaattgtatccggatagtgttctacttctccttgtagaaaatctcaagtttttgttactcttgctattctcttggatgttgatttgtaaagcatgtcgttttattgtaggaatttaacagaagagtgtccgaagggttccaagctactccattttggcatcaaggtcacatttgcgatgatggccggtaattatatgattctatgcacaacaagaattcactatattataaatattggatattgagtatttttgttgaaaatttctgtgtttaaatctgacttgacttgttttgtcagtactgactatgcggaaactgtgaaatctgctcgttgggagtatagtactcgtcccgtttacggttggggtgatgttggggccaaacagaagtcaactgcaggctggcctgcagcttttcctgtatttgagcctcattggcagatatgcatggcaggaggcctttccacaggtgtgagctttgcttgattgacttaaagttaataaatagacggttaagtttacttgcctagtactaacagaaaattaagaaagaaaccaccctctttctatcagcagaaactgctattgtagttcttattttttctcttgtatttgcagggtggatagaatggggcggtgaaaggtttgagtttcgggatgcaccttcttattcagagaagaattggggtggaggcttcccaagaaaatggttttgggtaaaacatttcatccttttgctacatttcttgttgcagactttagttagctagtggacctgtgtatacacccacatgtagtatacttgtttgatagctttatttgtcaatgtctctttacaggtccagtgtaatgtctttgaaggggcaactggagaagttgctttaaccgcaggtggcgggttgaggcaattgcctggattgactgagacctatgaaaatgctgcactggtatgcacttataagatcttcttaagcaatgacagtgagtattagaaggcagatagtttacaaaagctctgggcccttgtaaatctgcaggtttgtgtacactatgatggaaaaatgtacgagtttgttccttggaatggtgttgttagatgggaaatgtctccctggggttattggtatataactgcagagaacgaaaaccatgtggtaaatttgttttactagtttcattcagttttacttttgacatcatatcattcccttatggctagattccaacacccgatgaatgtcttgtgacaggtggaactagaggcaagaacaaatgaagcgggtacacctctgcgtgctcctaccacagaagttgggctagctacggcttgcagagatagttgttacggtgaattgaagttgcagatatgggaacggctatatgatggaagtaaaggcaaggtatgtatgctaatgtgatccaatccctgtagttaaaagtcttaacaaatcctaaggcagtgaaagaagattatgaacgtttgttatggttaacaatgatgcaggtgatattagagacaaagagctcaatggcagcagtggagataggaggaggaccgtggtttgggacatggaaaggagatacgagcaacacgcccgagctactaaaacaggctcttcaggtcccattggatcttgaaagcgccttaggtttggtccctttcttcaagccaccgggtctgtaacattgatgagtgttttgtttgttgatagagacccatgtgatgaatgaagccttagtcatgtcattgctagcttcactattatgtatgtatgattttagttcgttcggtccttgtggtaaatgatacgggccagtgtaaagtctagttcaataaaagccttgagtcgcataatttcaatttcaaattgcatcagaatttcatttttactttttaggtatttcttctattttattttttgtttctccactcattgttcctaggtagaaaccacgatctataatggattggtaatgatataggttcgaattgttggatattgtataactatgagtgggaggcaaaaaggagaaaagaagaagttccttaatatcggctcactttgtcttagcatcattacaaatgcactctctctggctcccacaatcttacttttattcttcctcacataaataaacccttctttccgttacactcatatatatgtataaacattttctcacttctaaaatataaaaacatttggtaattttgttttcctaataaagagttaagatctatatatgaacttaaagcagcattttttttccaacaaagcttcaatttaggcaataattaggacacaaatggcaaaaccatcattttgttttatatatatttaaacccgcgaaacccattcgaggcagtcgaaagaaaacaaagaaaaaagcaaagtaaatcgttaacatattttttttttttctacttgtgagttgtgagcttctatctctgttttattatttatcatgttatgtttttaaacttattaatacatgagttaaagttttgggagtagaatgatcttaatagagttgatgatgttagtgatcatgaattatctcctaagctaagaaagactttttgtagcattttagttaaaataaaaagtttctatatcataaatatacaataaaacctttattaaagaagataaaacttgaccaaactgtattttataatgtttctttatgtattagttattaacaaaacaaaaaacgtaaattactttgaagtgtacgaaaaaataaaagaggaatcaattttcatatatagccaaagtcacatagtgattcttctccaatcaaatctctatcaacaatg

SEQ ID NO: 3939 - DNA, 3000 bp, Unknown
  misc_feature (1)..( 3000): cDNA_ID_1822504_gDNA_ID_1620675_Annot_ID_48217 3000 nt of promoter + ATG
caggccaagtgaccttgtaaaagttttttttttgtcttataacatagctattgatttatactgtccaacgttttcacagagctacatcgagctctggtaacggggttctaaatcagttggccctccctgcaccacctgtaactaatggttcagccaattccaaaatagacctcctcagtggcgatgatcttgcccttgttcctgttggacctcctcagccagcaagtccggttgcatcagatcaaaatgcactcgcccttatcgacatgttctcagataatactaataatccaagtcctgcaactgcaccaagtggcaatccagctcagaatattcctttgaatcctcaagggcaccaacaaccaaatagtcaagctggagaagctggattacaacaatccaatggatttgcgcctcaagtgggttattcgcagtttgagcagccatcatacgggcaaggagtctcttctccctggagcagtcagcctgcacagcaaccagtccagccatcttatggtaatatatataaacagtttttgtttttcacacatctggagattagattgcagtatgccaatgtttctctggttatggcaacaaggagaaagaatttccttcttttggattcagaagaatcagcttcaattgtgtctcatgtctaatcattaattgttctgtttttatggtaatcttgtaatataaagaaggtgcccaagacagtacggcatttccacctcccccatgggaagctcagctccaagactatagtccctctgcggagtcaggaagtccgttttctcctggaatgcatccaactcagactgccttcacacatgctcaaccagttaacaacaacaatccatatcctcaaattccccaaaccgggccaccagtcaacaataacagtccatatgctcaaatgccccaaacaggtcaagcagttgccaacatcagtccatatcctcaaattccacaaaacggcgtgtacatgccaaaccaaccaaatcaggctcttgggtcaggctatcaaccacagcaacaacagcagcagcagatgatgatggctcagtactatgcccaacagcaacagctacagcaacaacaacagcaacaggcgtatggaaaccagatgggaggatacggatatggctataatcaacagcaacaaggaagcagcccatatctggaccagcaaatgtacggtttatccatgagagaccagacatcgcatcaggtagcatcatcatcatctaccacatcttatctgcctccaatgaaacctaagaataaaccagaggacaagctatttggggatcttgtggacatctccaaattcaagcctacaaaaccgacttccggaagagctggtaccatgtgaaaattcctccatccattcatcatttaccagtattcatctcctctatcctcctcagctaactctctttcttctctttgttaagcttttttcatcattgattttattaccctcttgggagataacatagatatacatatgtgttatgttcttccttataatttaccgttggttatgggtttgtatatttcttgtagagaaaagaaaactggaaaatcttttgttgagaactcagcgatttggggtttgtctcgagattctattttaggacattttaatctctcatttgtattttcagaccttttatttgttatatccattggcaataaagtttgatatcaattggatgagagttatggttcttaaatttgccaaaaggacagtttatgttctttgtatatgattgcaaccctaattccatagtcaatggagacatcaaaatgtcaaactatgcttgcattatataatctctttcgactcaatgatgtcaattaccgaaaaagtagaaaggaaggatttgttttgtttgcgactgttgttagttcttatgttgctcgtcgtaaacaagaaaaacctgccattcgtttgggtttttgaaatctagtctaacagaaagaaacaagagacaaatgaagaagagtaaatctagtccattcatcatcatcagtcttttggatcgtgcatatattaatttgtataagagtctgtctaacaaaattgtcaatatgtccgagtggttaaggagattgactcgaaatcaattgggctttgcccgcgcaggttcgaatcctgctgttgacgtattctattttgttttcttttcagctctcttcagaatttttgtaaatattttaaaagggaaaaaaatctcaaaatacgatttcaattaaaattgtagagattctcctcacgtctgtttgtgaaatgttgtctctaataaatttccgtaaattactgaaaacaagacacgagaaattgttaatttaacaaaataaaaatacgttacgtttggggtttgccacgtaactacttaccgccacacgttctcgtccttttcttcttcctctctgcattcttcacagagtttgtcaccaccaacaccaaacacacaatttcacattcttttgcatatttcttcttcttcttccattatggagatacggagcttgattgtttctatgaaccctaatttatcttcctttgagctctctcgccctgtatctcctctcactcgctcactagttccgttccgatcgactaaactagttccccgctccatttctagggtttcggcgtcgatctccaccccgaatagtgaaactgacaagatctccgttaaacctgtttacgtcccgacgtctcccaatcgcgaactccggactcctcacagtgggtaaattgatccattccattccatttctcttctcttgtttgttttattaagctccaatttcagtttcgtcttttaatttatatgttcttcttacgatcagtgggacttaaaaaattgctcctttaaatgcttcagtatgttttgagtattacaaagttgtaagattttatttttattcatttggtggctcaccattcgacgactacttttgaatttgagtttttgaaaaatg

SEQ ID NO: 3940 - DNA, 3000 bp, Unknown
  misc_feature (1)..( 3000): cDNA_ID_1822500_gDNA_ID_1620675_Annot_ID_48218 3000 nt of promoter + ATG
tgcataagtgtcataccaaattcttctttgcaagaatcaagatctttgcctgcttgaaagagtatgagttacattcggcacttcattgtaaaagtcaggttcgtcttcttcttcatcagatgataataaagatggtcccatccatgctttaaacccctcgttcactcgtctttcaacgtctggtgtgaattccaacggattagcttcaagcatctccaagccctgatcatttctgttcccaaactctccttcgtcaatagttaaagcagctcttcttctaagggagaaagcagttccagcatacaagattactaaaccccatgaagaaatctcgtagcaccaaaacaaaggcacagaacagctgcttcctaatgtgaggaggcttgagccgagaaatatagcaaggagaccatagatgatagcaaacacaacattcagaattgacagacaacggaccccacctgtgaatttattggacatgataaagaagatcaataacctattttgaggtccaagcttagtgataaactctgaagagcccagattctcaaaggtagaaacatagtaattactagcagatgaaatagaattacacataaaaatttataagataaagtctggcactgaaaaggaatgaatctattacacgaatgcatggatatacaaagaacaaatatggaaagctgaatacatattaaagagagaagagagtatacctcttcttgaagcacagtagttattttcaacgacttttagaaacccatgacggtgaggagcggaataagccacaaaaattcctgcagtattgcaacaaaatagcgagaataataagcagcagacataccacacctgtaaaacttagaagggctgccatgtggaggcagaaagcaataaaggaaataaatcagctccactaagttacatccatataaaattcaaatccaacaaaatctagcagaggaattaactggatttagcaaactccacagcttgctctatggctaaccccctaaaatcccaataaacctgaaccatcatcagacctgtctttatatagtggcttcaatcaaaacgagtgattctagaactaaacataacaacgagcattcagattttgaggacacatcaatcaatcaaccctctctgacaatatttcacctcaccaatcgaaaaattcagaagccattttgccagaaatttgctaagcatcaatatctagcgtaaagccactcagaactgagcatcatctaatgaaatcagccaacaaaacacaaatgcaaacccagctctgtagatatgaaataacgaagaacaaaagctagagacttgacgctcacctgctacaagataaacagatgatacaaggaaaattatagtcgagggaacgaaaacgaccatccagtaataatcaacagtttcttgatcggtcaagtaaaaagcaccgggaaagagatcggagtcacgagctttgccatagataggcaaaggttgtagctttatgtcgctgcaaaatggcctcttaagaacattcgaaggaaatacaattttcaagctgacgatcgtgcaagtgaagatgacaaaacaaaggaaagccacgatcgagactaaagtcggcctctgaagcttaatccaggctctatcttcttccctaaggctctcgtactcttgctttggcataaacgcttgacgcaacgcatctccaatgatcgccattgaagaaacacaaaaaaaaaactaatccacaatcgaattagacccttctcaccagataattccgaaacaattcaaaataggggtttccgaagtttatcaggaaccctaaatcaatgaacaccgaactggggaaatgaggaagaagtattagtgatgcagaaacaattaggcgcgtgtaaaggtacttgctttgataacttctgtgtaattacagtttgacccccaatagtttgttaaagttcgaatctatccccacttcccgctcaattattatcataatcatagaattagaatatgcttagctatagagtcctaattaattcaactgatgaagttagaactaacactcttatgcaattttgatgtctataaatctaaattattttttgcaagtgggtgaatacatccaacacagaaagtgataaagaaacgagaactcaatagaatagaatagagagtaaatagatgtgtagcaagttggtttaggtttgtatcacaccaatcacgactttcataagaccaaaatgttttctttatgatgaattttgtaaagatgtggatttaacggtttcatagcgttatcaaatgacactcataattaattgcatacgtgtgcaatcgcaatcgtaatcgctggttagttttgttttgcaaatactttgtttcgatcattaaaaagaaaacattgtaagctgttgagaatcgaccaatcatcaaactgtaatgttccatctaaatctaattcattcatttagattggataacattattatatttagctcccaaaaacgaaaaaataataatactaataactaacatttactgttagtgaaacgatgaccgtcggatttataggtgggtcaaaagcaacggtccgatggaaagcaatgacctgactgaattggtgtaactatccaaacacaacgatatgaacacgtggcaatcttttagtggacccttttccagaagatattcgacttatttccttttttgctatttcgtggaaaataaaaaatgatctgaagtacagaaaatacatttttaaaaaacaaattctgaaaattaacaattagagaaaaagaaaagaaaaggaaaaaaaaaagatttctagtagaaagagagaagggcgtgaattcctgagcgagagattcttcgccggagtaatctctttgcgtgatcttaccggctgcttaattcgtcttcgcctgattcgttggtttcaaaattcgtctctctctttcaatcggaggttaattgtttttctgtttgggggtcaaagcgaagatg

SEQ ID NO: 3941 - DNA, 3000 bp, Unknown
  misc_feature (1)..( 3000): cDNA_ID_1822480_gDNA_ID_1620675_Annot_ID_48224 3000 nt of promoter + ATG
attcgtgcttgctgcaacaacttcaagtttctcaacacttcaaaaacttgtgctttttgaaatctgacctatatcgattcaaatggatgaaccttgtactttgttgagtcttcgattcattggattgttttgggcactcccagtaacttgaattgaatcacattttggtggaatcctatcatttgaattttctactaagtcagtgaagtcttttcatgaacaaagtcttacactttgttaaggattttccatgaattagattaaaaagtaatgtttttaaagctttttcttcagtcaaattttgaaattagttaggatgaatgagaagtgggtcaaaagtcggagttttgtgacattgaagcttaagtgtgtttgtactgaatcatttttcttatgttgcttgtcactgtactatcagttttatgtatcgaagaagaggaaacaccagtcaccaaatttaaagtctgggaggaatgagaaaaatgtgaaggtgacaggggaaagatctcctggagacaaaggcactttggacagttacttgaaagcctctctggatgacaagagtactaccaatagtgggttgcaggcaaggcaggaagcgtttacaagaaaattggatttggaggtttctgcttcgtctgttggtcaaaatatacacccttgcctgcctaaacctgtaagttttgcaacttttaaggagtgtttgggccagaacggatctcaagatttgcataaagaaggtgttgcagctgaaactcatgctacagatggtttactctgtgctaaccagaaagataattcagaactacgagactttgccactagtttcttgtccttgtattgtaggtaatgtgctttcattgtgccacatttttattctttccattatcatcgaggagttagttacatgcttacattcttttattatgtctgacttttgttctgaaatttagattttgtaaattgtgcttgtctgttttttgcagtggagtgcagtctgttgttggctcacctccacatcagaaggaaaatgaattgaagcgtcgaagcagttcatcatcacttgcccaagatatacaaatttctcacaagaggcgttgtgagtccgaaaatataccatcactagatgatcttacaaatcctctcgggagtaagcctgaatcactcgctaggaatggtaataatagagataaacctgtttcagaccctacaaagaaggtataattggaatcaacaatcgtgattacctgtcctcctactaaactaatttatctcaaataattttatgtgtttgctctgatatattcatagatgccgagcaatgaatctgttgaaattccaatgggcttgaggaagtgtagtaaggcgccagaatcatctgctcatctaactgaattccacacgcctggatcagccattaaatcatgtcctgttggaacccctaagtcaggatgtggtagctcaatgttctcacctggtgaggctttctggaatgaagcaattcaagttgctgatggtttgacaattccaattgaaaattttggttctgtagaagctaaagttagagatcaacatgtaactattctttcatgcagcaagaaaacagataaatgcactgaaaagttagagaggagtttagatttagatgaaatcagagtaaaggataaagatgccattggtttttcaaaggtagtggagaagcatgggagagattttaataaagaagtatatcagcttcctgtcaagaatcttgaacttttgtttcaagataagaacattaatggaggtattcaagagcgatgtgcttcatttgatcaaaataacattactctaggaagcagtaggatctctgaatctgctttcgtcggtaataaaggatgtgaaaatcttgatattgcaaataatgctcaggcagataaaggtttgataggcaagatgtatccagaacccgaaggaaagaaagttttactgtgtgaggaaaatcgtggtgtaagatctgtttctatgataagcaacatgaggaaaccagttggttctagtgaatccgaagaaagtcatactccttcaagctctcatcgtaattacgatggcttgagtctcagcacttggcttccctcagaagtttgcagtgtatacaataagaaaggaatatctaaactctatccttggcaggtacataactattagttgatgtgtgggttgttatttgttaattatttttggatacagctgataatatttttgaagtgcctactcctatagatagatagatagatagatagatagatagataaatagatagatagatagatagatagatgtaaatctgtttctctattgcagttcaaaaataaataatatcagttgagagcctgctgctagtattcgccatccaaagttaatcggctcttcatgcattgttcctttcatgacatttatcatatcacttgtgccgtggttgtacatgtgatgtatgttggttttcttattttttaatgtttttcatgaacttgcacaaaatttattgacaatttttatcctcgactctattcttatatcttgtatttatactttctaaatatgtgccgttgattaatgagtgattttaggtcagtatcatatctgaaaaagttttcctattctttcttgtatgcctgtttgtacgcatgctattgcctctgaagtccttttcatgagctgaatacaaattgttaattttctaggtcgagtgtcttcaggtagatggtgttttgcagaaaaggaatctagtatattgtgcttctacaaggtatcttcatcgttggctatgaatctgattcaaagtttctttttcatacattttctttggatcatgatagcagtattattaatctcactaggaggcttctatcttacaagaatttattatcaatttcaaaaccatgctgtttgcgcagtgctggtaaaagttttgttgcagaagtcttgatgctgcgccgggtcataagaactggaaaaatg

SEQ ID NO: 3942 - DNA, 3000 bp, Unknown
  misc_feature (1)..( 3000): cDNA_ID_1822469_gDNA_ID_1620675_Annot_ID_48227 3000 nt of promoter + ATG
caccgatgccttatcttgcagcgattgcatctccctctctctctctctctctctggttttcgtctctctcgcagtgatgaagaaactgtgggtgattgaattgaattttaaaaaggaatggtgggggctctggtcgtggtcgcgtggaggcaacgctctcttttttctattacactagttgggcctttttggcatatgccgtgaccaaaactaaagacacttgtcttgatgattctctttgacttttggtcctatccaatcaatttaggattttgaagtaattgggcacacttgaattggcccgttaagaagcccattattctaaacgcgacaaactctttagtgacgacgatttgcgtttgaagaaataagtgatttaaaatccgcgtttaaaaaggactaagctgagctgaccccgtcgagaattggtttcctcttttcctcgctccgaagacaagaaatattccggtgaggcaatggcgtcgaacagcagagaagccaggaggcggaagatcctagatagaggatctgatcgtttagcctttatcactggtcagatcaacggcgttccttctccacctccttccgattctacttcttccctttcccagtctgaccttcaaactgaccaatccttaccggatacgattccccctcgcgatcagattcttaaagctcaagaaatcggtactctttcgctctctctttctctagggaatattgtcatccttggattgtttgtgtgtgtaagaatttgagcgacacaatcgaattttacttactctattgggtgaaaggataatcaaattggcttctttgatcagattttatgtgtgtttggctcgtttcagagtggaattcatgtgtgttaagaacccggcttgaaccattggatgtttgaaatagggcaaatttgtagagaagaataggacaacgcattatctacatttttatcttttagtttattttgtcctctgagtatagtagttaatgggcagtgaagctgttaaatccagatttcaacttggaacctacttgtcttaagctgaaattagatattatgaacctgatttcactgttctctacttttgcttaagtcacctcgccccttgaaattttctttgccattctgtgaaattctttataggtgtggttcaaccacagtcaagtgtttggaaagcttattatgttgtgtgtttttgaaatttgcttgccttgtattgtgtcacaaagtttggaaggaaaagattgctacgctgcttgattggagccaataaatcttaaggcgttgtatatattcacaatcagtgggttcttagtggtggtggaaaaacccattgattgtgaatgttctttttggcgtttcttgaagctaacctttgctgattttgatgatccttggttgtgaaattgcagctttcacaagtcaccaggacaacatctctgatgctgcaatgcttgagaatgtggatcatatcatccatcaaagcagggaagaacctcttcagcctcagaggcatgctgaaacattggcagaagcctctgcttcagatcctagagacacaacaacaatacaaccgcctcctacaacatcaagtgttcaaaacccatcagtggtagatttaggtgcttctcaagcatttattcctgtggttagttttgtgaacgccatcacaccaaagcacattggagcggccattgatgcttcggaatacgcacggatgttcacagctcttgcgattgcacttgttgtcatactatctcatctcggtttctcttccctaggcaacattgtaagcttcaggccagttttcttgcttgtcttgactgatgccacaattgtgcttggacgtgttctgctgagtcatcgtggagactcttcctcggcctcagggacggtgatgagcgggcagggtattgtggaccaagtaggcaacgctttggagacggtgatgatggtgaagaagataatggatgcacttcttatggattttagcttatacgctgtgattctcatatgtggcctcttggtcacccaaagcatctttccttaggtcaccttttaaattaggtttctttgtgctcggtagatttgtgttttgcttatggtttgaatatcttaaaattatagttagttccaaaacataattacatgtttcagatatctttctctttccttttcttttgcgtgagaagatcaatatttattggtgtttggtagtttggaagaataaatttaaaggttctcctccaattttttttaaagttatcattgcatcactgaattagggtgtattttttcttgttttgagattttgtgatctctgaaaggaaaagaaaagttaaggtgggaaagtgcagactgaagagaaagacaaaggaagaagtaaataaatttttggctgtcacacaataaattaccgagaaattagggaagcaacgtaagaaagtccctctgtcgctgtcaaaaaaacaaaggtaaaaatacgtcatacgacgaatcataaacgtttgtttctttttttttttctttttttttgattatttataaattacttttttttttctttttggcagccatttttttcatttgccgctaaagtgaaagtgcagactgaagagaaagagagagatacaatcgaagttccaaggtttctagttcccggaaatggagatttctccggcggaagacaaactcgttggctccggcgaagctgttactacagaagaagtatcagacataaataacaaagctgtagacatttgtcggatttgccaatcaccggaggaaccagacaatccgttgagacatccgtgcgcgtgtagaggctctctcaagtatatccactcagattgtcttttcctctggctcaatcgccgtaaacgcaaccattgcgaggttttaaacccctttttcaaaaactctgtttctgctacgaattgagtttaaagtttacttctttttcaaaaatttcctcttttctatgtgatttgaggaag

SEQ ID NO: 3943 - DNA, 3000 bp, Unknown
  misc_feature (1)..( 3000): cDNA_ID_3072217_gDNA_ID_1620675_Annot_ID_48228 3000 nt of promoter + ATG
cacggtagtgagtgtgacaatggaccagtacattgagtaagtgtaccctaaccatacacttctttccttaaaatcctcaacttgcgatcctatccatgtatccgtaggccttggataatggtaggctatccagtataaaatgcaacccgccaaatgtatccaaaatatcgttacctgaatcaaatttcacaatttgaataaaagtcatagattgacatagccaatttagtgattgtatggaccacatatagataattcaatataagtaaaacttacacatagaagtttgatgactcggatcacgaaatagttgaaatgtgcgtctttctctagtctgttaaaaaaagaaagaaaggaagtgtaaaatagacacacacatatgtactatatgataagtggatttcaatattgcatattatatagaaagtagtaaagaaaaaaccttttaaagagttcggctacacgacggagacgccagaggcggagtaaattaaggaagccgaaagcttggcctcgtccgacatctccggtaatagttttataaatgaattgaatgggtaacgttgatgctacgtccatcacaaaagccacgctcttcaagtacctataataatgcacaacatatataattcaattctaacttattcattttacttatgttatttttttaacatataaaaacaaattgatttgttaccgtttggcgatgagcttgtggtcggtgacattgaggtaagtagtattatccaagtaggaaacaaaaaaggtgaggatgatatcaacggcgaagaagaagtcaacgacgagatcaatggtcaataacgctccttcggcagctttctcgaaagccaactcgaacaaagatgcccacgccgaatacccaaccaatatcaccaaaaacaattcccacaacctaccattaatttttatatggaaagattaaaaaaaaattaagatatatgaatattaataagaaataacaattttaagacgtaaaaatatgaaaattaatgaacgaatcatttgatcattaatttatggactaatagaaacagaaaagttatgaaatctgtaaatcactatttattgtttgataaccaaaaaacatttcttcgttgtttagttagtgagaaatgaacctgtaacgacgatcaaagtgaagaacgatgaaaggtttggaagaaggattatcatcttcgatgaaagtcccaaaagcaggcaagagactgctcgaaactgacgttatgttcctcacatctttgctcgatcttcttctgaactgcagtatcgataacggcgatcttgcttccgccgtcgacgccgataacgccgtcgaagaccttcctcttctcaacaacaacggcaacggtgatctcgcctcagtagtcgtcgtagacattcttttttccttcttcttcttctctctcttcttcaagcttgatgatatatacttccctcttttgtctctttcatttataccttttttttttagttttgaattattaaagaggtgtttagatgatcaagaaggtggtgagcaaattaagttgacttttttttttactggtttttgttttccctatattttttggaaaaaaagaatataacaatactataaaacaaatttacttaaccatctaataaattataatttttcaagattgtagtatgatgaattttactctttatatattcaactttgttgttatatatgcagaaggcttcatcgacttttttgactcttatttacgtctctgtgtgtatttaatgtggcatcaggtgtagtgattacaatcgagatctacaatatcagggggataaggtttttttttttttttttcttacgataaattatgtaataattagctgtttaaatactggagttgaaaaaattgaggaactcaaaagtcaaatcttgacgtcttttttgttgttgttattaaatgagaccgtgacaggaatagtagtgttgaaaacaaaacgaacaataataaacaaatgaattacgtatcaatatctatcatcagtcagaatttagtatgtttttaatacaatcatttcagtttttttgagataacatatcatatatatatacttctttccactttccagtgttggatgtgcatgtttacaatttttttaaaaaattctaaggaaaacaatgttttgaaattctaagatacgtttaggtaatacatgaagggggatacactttgtcttcgtcccttaattagctcctatgaagaatttcacatacacaaattaagaagatgcatgcaataacaaggctaaagccatttcttaatagttcatttgtacataaagtaagtttgtgtatgttaaaaaaaaattgtgtatgtactgatgtacagtatgttgttgattgttgatacgtaaaaccaaatagtcaaatactatacatttttacgtttgctcgtataaattaggaaacgaaagcataattgttacggataaaaaaacacgaaaatcaattaatgaaacaaaacccttttgtaaaaaagcccatttttatggaagcccattttgagatggaccagttaatgaaaaaaaatccaagaaacaatgaaacgaacgtttaagatccatgatggaaatttgggccaagattataagaagatctcaccacatttcatttgggccgggtgggcgaaacattccgggtgatcgtgtagacccaattttttcggtggaaagtgcaaaaaaaatgcaattggtggatgtcgtcgcggttcgaccccaagggatttggccggtaaaattattgggagttgtctttctcttgcactctctctagttccaaaccctagcaattcctctgttttcaccattttcggagattatcaccttctccccgattcgccgccttgtgattacatctacgtaaagagtttctggtagaaattttccctcttttagctgcagattggcatcagattccgttctggatgtgtcggtgatcgattttccgcgtcggtgatg

SEQ ID NO: 3944 - DNA, 3000 bp, Unknown
  misc_feature (1)..( 3000): cDNA_ID_1822461_gDNA_ID_1620675_Annot_ID_48229 3000 nt of promoter + ATG
tgctacagattccaaaagctggcatccaaaatcccgaacaagggccagaggaaatgcggagtatttatttctctttagaaagtcaaacaaacttggcccaagcttctcgaacacctggtatcaccattagagttcattcacaggaaggttccgtttagttccaaacttcgaaaaaatccacatgagtaaacaaactacacaaacactatacacggaattggatttctgtcacttgggcatcaaacaaagaaaggtagccagaaatattatgattcattcatttgtaacactaacaaacctcacaggtcactgaacatagaaccaattaaatattagagatgcatttgaacggtggtggaaatcaatgagcttagttgggatacttacaatgcaaatatgatttcggtaatcaaaccagttcttcatctgtacacagctgcaaggacaaagcagaaatgaagaaactgagcaatgatatacacctctgaaggaaacgatgtcatcaactaaagtctagaagataaataaataccgtgtgcggcctttatcactcttaacaagtttctgaagtacatcaatttcaatcattgctgcatcccggtatttcttaatgcttcgaattatctttattgccacatattcttttgtatcacgatcccaacattccaaaacccgaccaaatgtgcctacaacaccagcaagttcactgaaatggcacgatttgattcacataaacattttttttatctcgaacacaccatgccacttgacagctaaccttcacccatcttgctaagtattttatctgtcaaaagtcaaaacagaacacacaatagcgtaagttaagcaattaaaaatgttcaggaaggattctcatcccaatgaaacgaaagcgaaaaaagattatccctaaggcaatggtgccaaacaaaacaaagagttactagcaacaatacacatatagaagcaacataggtaaatatcttagctcacatagaatagaaagttagcaactttatccatcaaaaactcacatctaggagtgagattgtccctcaaactgaaaacataatgaccatcacgatcatcgtcccttaatggtggtgacaaaatcctcccatcgcttccatgtcctttaatcacagcccttttagcctatcacaaaaaagtcaaaattcattcattgtcagcatatcaaaatctcaccaaagaaacataaatgctcggtctttcctccacattctaaaccctaattcgaagttctaaatgtcaaagattaattaaaaaaagaagaagaagaaagaggagcaacctctggttcagctggggcctcgtcccaggtcatacgaggacgtttcctgactcgttctttatccatactctcgaatccgttagctatcatcaccgacgcggaaaatcgatcaccgacacatccagaacggaatctgatgccaatctgcagctaaaagagggaaaatttctaccagaaactctttacgtagatgtaatcacaaggcggcgaatcggggagaaggtgataatctccgaaaatggtgaaaacagaggaattgctagggtttggaactagagagagtgcaagagaaagacaactcccaataattttaccggccaaatcccttggggtcgaaccgcgacgacatccaccaattgcattttttttgcactttccaccgaaaaaattgggtctacacgatcacccggaatgtttcgcccacccggcccaaatgaaatgtggtgagatcttcttataatcttggcccaaatttccatcatggatcttaaacgttcgtttcattgtttcttggattttttttcattaactggtccatctcaaaatgggcttccataaaaatgggcttttttacaaaagggttttgtttcattaattgattttcgtgtttttttatccgtaacaattatgctttcgtttcctaatttatacgagcaaacgtaaaaatgtatagtatttgactatttggttttacgtatcaacaatcaacaacatactgtacatcagtacatacacaatttttttttaacatacacaaacttactttatgtacaaatgaactattaagaaatggctttagccttgttattgcatgcatcttcttaatttgtgtatgtgaaattcttcataggagctaattaagggacgaagacaaagtgtatcccccttcatgtattacctaaacgtatcttagaatttcaaaacattgttttccttagaattttttaaaaaaattgtaaacatgcacatccaacactggaaagtggaaagaagtatatatatatgatatgttatctcaaaaaaactgaaatgattgtattaaaaacatactaaattctgactgatgatagatattgatacgtaattcatttgtttattattgttcgttttgttttcaacactactattcctgtcacggtctcatttaataacaacaacaaaaaagacgtcaagatttgacttttgagttcctcaattttttcaactccagtatttaaacagctaattattacataatttatcgtaagaaaaaaaaaaaaaaaaaccttatccccctgatattgtagatctcgattgtaatcactacacctgatgccacattaaatacacacagagacgtaaataagagtcaaaaaagtcgatgaagccttctgcatatataacaacaaagttgaatatataaagagtaaaattcatcatactacaatcttgaaaaattataatttattagatggttaagtaaatttgttttatagtattgttatattctttttttccaaaaaatatagggaaaacaaaaaccagtaaaaaaaaaagtcaacttaatttgctcaccaccttcttgatcatctaaacacctctttaataattcaaaactaaaaaaaaaaggtataaatgaaagagacaaaagagggaagtatatatcatcaagcttgaagaagagagagaagaagaagaaggaaaaaaga

SEQ ID NO: 3945 - DNA, 3000 bp, Unknown
  misc_feature (1)..( 3000): cDNA_ID_2135468_gDNA_ID_1620675_Annot_ID_164246 3000 nt of promoter + ATG
actaagcaactcggaccgaggatcaactgaattcttaccagaaggcaatggatgcaatctactcgcagatggtgaaccaggagtaacagaatttgaaggaaactgggtacagtttggatcaaaccgtgaagacagcattattgcagcattagcttcaagattctcctcatcatcttcccgtgataccttggatattctaccagaagcatcacctgaagacttggcctcttttcccacgcgtctgtttgatgctgaggacttcctttttctgctgttactatttctttgtttaacaacaaccagctgatcatctttcactggagactgattagaatgcccattttccaactgcaacggagctgcggaattagattctttgatatctttgtcagagtccttctcttcaactttagagggttgatcctgaacactagattcttcagcagtaaccttagggatattaacaaccagctcctcctgactatcagactcccctgcagacttctgtgctaggccattctcaaacctactcctcccaacaaaatctctcctgcgtctaggaacataaatcgtactacttgccaaaccaacagaaatcacttgaagcccattactgtcacacaatttctcatccaaacccacctccttggagtcctccaaattgtgcaatatagtggtgccattgcatgccttatccagaatactctcgttctggctacctactttcttaaaactacttagagaaacaactttcctgctcttcttgtcctgcttcaactgatcaccatcaatcccagacctatgttttcttttaaagctcttattcactgaatccttggaaatgctagacttatagagcgtcttaagatctaaagacctggatttcttcgaaattcccactccattagagttacctagtctattttccatgaaagccacctcgaaccaatacccagaatcaaaagccagcaggtctcaaattccatcatatacgcaagcaaacatttttcagatctgtgacaccaaaaccaaacccagaatcacaaaaagtacccaaagtatgataaaagaagaacacacaagtcacccaaagaaacagatcaaatcccacttcaggaaaaaactttgcattgaaatccaagcaattgttttttcaacaatcaagcaaaatttaactgcaaaaaattaaaaaaaaaaagagagaaatttgcatgcctacctgcatcactttatcagacgaaatcgagtctcttaaggacctttatagtcgccacaatcccaaaatcaaaattagggtttcggtaaatcggactgcgaatcggatccctaaatcaaacaatcgaaaatttcccaaaagtattcgttcaatttagccgaaaataaaaaaagcaaaatttgcttcttttttttttcttttttaaccgggagaaacgggagagctagggtttcgtctggttccgcgagagtaaggttttttcagttataaagaaaacatattccaaataaacatcgtatcacgggtaccgtccgatggagacgcgttactatatctacggtccatatttagtttcgaaataagcactaaatttttaactctgcaacagaaaagatataatggacgttcgagattctcagctgcgaaatatttgtttggacggtcaggatttaaagatttcttcagagagaataatttattgttgtcacgtgtgttgctaacctaccgcaatcttgtgtttgtccacctagccaacaattgttagagacatcattcaacttaacaactattattactagaatactaggggataatttaagtataaaatcatcacattacagtattatctttttaataatttatatatatatatatatattattgttattttcttttaatatataaacttcattcatccattagcttaacaattttccaatattttgtaaaaatatatatatacatattattaggagttttcggaccatatttaagtattagtgtattactaccttattatgtgtttaaatatatatttttattaaatatagacatatagcaaaaagaattagtagtagagagattgattggaatcaatttttgattaattatatagtgtaaactaagctttaagaatatttaaaaaatagatttggtttccttataaatatgaattaaggtcattattaacgtatcataagatttagagcaatgtataaacacaagaagaaaaacaataaaagttcagaaattcctttttcgattcaaaaatacgttaaaaattgacaaaatattttggcgggtggattgtatattggaacccaaaatttgcttttttaatacagaaaaataaaataaaattggcttaattggaaaaactaatattgagttcataaaccaaattaaggtttaattagacagtctaatccaatgttcggttcaattttgtaatcaaatgttcggttcaattttgtaatcaaatgttcggtttgatgatccataagagaggagataacatcccaaatagagacagatccccttcccttgtcgtgtagcccagtagctctaatcgctacgattgctacacaccacatcccttaagaaaaccctaatcatctctctctcgcattctataggaatcgcttcccgaagcttccaacattctcttgtttctcctttgtctctcaatttcagtttcctatattatacgcttgtattaatcaccagtatacattttgtcgtttctgggtctggaaccctagtagttattatagcatccatcgctttcttcaatcgccgtccatcagagtttcaagggatttgctttaaagatcaatcctttcctaagaaaatagcgacaattcatcagcttttcctttcccatccttcattaccttaacttactcgagattcatcttccagctgaaattgtgaaacttcgtttctgggtttttatcagaaaacactctgtgacttattgtgtggtgatcgaggaaagaaaaaag

SEQ ID NO: 3946 - DNA, 3000 bp, Unknown
  misc_feature (1)..( 3000): cDNA_ID_2135462_gDNA_ID_1620675_Annot_ID_164243 3000 nt of promoter + ATG
cacacagggcacatcaatttctgcaacctgggtcagtgaataggtttacacatgctatgatgtggaaaggtggaaaagattggaccttggagttccctgataggggccagtggttcctttttaaagagatgcatgaagagtgctacaatagaaatactcgggctgctttagttagaaatattcctattcctggcatccgcatgatagaaagggataattttgatggaacagaaactgaatttattcgcagttcttctaaatattttcggcagactgaaactgatgttgagatggcattagatccttcacgtgttatgtatgacatggacagcgatgatgagcagtgccttttgagaattcgtgagtgttcgagtgctgagaatagtggctcttgtgagatcactgaggacatgtttgagaaggcaatggacatgtttgagaaggcttcatttgtaaagcagcgtgataactttaccttaatcgaaattcaagaattgacggctggagttggatccttggaagcaatggaaacaatatatgagctttggagaacaaagaggcagaggaagggaatgccattgatcaggcatcttcaggtacaatctctgatgccttttcatcttttattatttatttggttttcatgtttttcttgagatttaaaaatctgcatgactaggctcaacatagatctttttggaatcgggggaaatgcagaattgtggacaataaggctatgtctagtagtaggtattacttagtgttcttttcaggatattgaatgatgtgggtgttttatgcaaatggaacgtctattagggggaaaattgcatctttttgcattccagtttgttgtgcacgaagatgtctggaagtccataactgtagcatcttctatagtctgttgattttactccttgttgattagtcttacttgctagctcaacaataatgtagttactctgctgcaatatttttaattttgcctaacgtaaacacttgttttctacccttgcaattcagccacctctatgggaaaaatatcaaagggagctcaaagactgggagttggttatgagcaaagcaaacactccaaattcctgtgggtcgcagaagaaacagtcacctactgagaagccagcgatgtttgctttctgttttaagcctcgaggtttggaagtcaaacacaggggaacaaaacacaggtcacagaagaaactctcagtttatgctcaacatagttctgctttgggagattatgatggctgtaattcatcaggtaactcgtttttacctgcttgatattctataaatcctctattgactctgatttttcaaaatgaagtctgtgtttaatccaacttttccatttctctagcaggaagaagacctgttggttttgtctctggcgacgagaggtttttatattcaaatcaaagctatgagcactcgaatgaattttctgtacatccaggaacatattcccctcgtgacctaggcatgggatatttctcgagcggtggaaatggatatcataggaatcaccaaaacaagtcgcaaagaatcaatgggaagaggaatacgagtgaacgatgggatgcaggctattctgaatgccccagttccaatcttgtctgttactccaacggatctcagcgtcctgatgtggaaggaatacggaatagtacagacattgatgagtacaaattgcgagatgcagctggtgctgcaaggcgagcatgcgctttggcgaagctcaagcgggaaagagcagagagtttgaggtacaaagcagatctagcgatccagaaagctgcagctgctctcatgtgtgcagaggcagttaaagcttcttccgaggacctaggcaacaacaatggggtagaaagctcaagcgaaggatgagtcaatagataccactcttgttaagtctgggtattgtcacctcttgagcaaaagaagagatagtgattcgacatgtcctgttcaacacacgagctggtcttgacacgaattaaaaaacgacccagatgagctccactgtacagaaatttgcctccctctgctttaagtaagctatattttgatgcagcaataacaccgaactgggactctgaaacttgatctcatgtacccatcggctgggaatgttcttagtaggttaagaagagagacaaaaattgaggagatggtaaaaaaaaaaaaaaaaaaaaagagagaaaaaagaaaagaggagattgtaagtaatttggtttattaggcttcttttggtagagagatttagtttgagcaaaaaaaagattattctactgcaagtattttgcggtgctcttcttctccatatttcttctctgccttcttttcaattttagtcaagatcataaagtttgaaaaatattgaaacgaagtcaaacttgcaacacttgccatgtagtcatataattacaaaaattagttacaaatcacatttgtcaatactcttccaaaaatttagtattctcttataatttgtaaaacattgggaaaaatgagagagaagaaaaggtggtgagagaaattccaacggcgggaaatctttgaagttagcagttttgtcggaagatgtctcattcgtttgctggcttcatgatctctctgttacttatttcctaaatttgtcatatcttggacaacctcctgagagaagttctttctcatcattctttccaccccaaattctcttcttcgactggttcctcttctttttgtaaggtttttctcttctctttttttttttgtttgtttgaacattttagagcatcaggggcttgaagcttaaaatttcccatgtttctcgcatgtaacgtaagattaaggatttaaagatgcacgagaataacctcaatgtttttggcttaagatagtaatttcttctcaggtaaatgatgacattgctctttgataggatttctcatttgagatattgtttttcttcatgagagaggcatttttccaagaatg

SEQ ID NO: 3947 - DNA, 3000 bp, Unknown; identical to SEQ ID NO: 3944
  misc_feature (1)..( 3000): cDNA_ID_1822461_gDNA_ID_1620675_Annot_ID_164242 3000 nt of promoter + ATG

SEQ ID NO: 3948 - DNA, 3000 bp, Unknown
  misc_feature (1)..( 3000): cDNA_ID_3072217_gDNA_ID_1620675_Annot_ID_164241 3000 nt of promoter + ATG
gcttgtgtatcgcaatatatcattgatcgcactcctctgttcagcagaagaatgattattgtacgactggtagagtaaatgaatgagtaaacaatcttttcgggtttaagcaatgaatgattatataccatggcgaatgtacgaagagcgccatggacaactagattggtcatgataccgatgatataagaagtgaggccaatgttgaaaagcatgtagaacatgttgaatgtcttctcacggctattaactgcatgcaaatcaccgtaacccacggtagtgagtgtgacaatggaccagtacattgagtaagtgtaccctaaccatacacttctttccttaaaatcctcaacttgcgatcctatccatgtatccgtaggccttggataatggtaggctatccagtataaaatgcaacccgccaaatgtatccaaaatatcgttacctgaatcaaatttcacaatttgaataaaagtcatagattgacatagccaatttagtgattgtatggaccacatatagataattcaatataagtaaaacttacacatagaagtttgatgactcggatcacgaaatagttgaaatgtgcgtctttctctagtctgttaaaaaaagaaagaaaggaagtgtaaaatagacacacacatatgtactatatgataagtggatttcaatattgcatattatatagaaagtagtaaagaaaaaaccttttaaagagttcggctacacgacggagacgccagaggcggagtaaattaaggaagccgaaagcttggcctcgtccgacatctccggtaatagttttataaatgaattgaatgggtaacgttgatgctacgtccatcacaaaagccacgctcttcaagtacctataataatgcacaacatatataattcaattctaacttattcattttacttatgttatttttttaacatataaaaacaaattgatttgttaccgtttggcgatgagcttgtggtcggtgacattgaggtaagtagtattatccaagtaggaaacaaaaaaggtgaggatgatatcaacggcgaagaagaagtcaacgacgagatcaatggtcaataacgctccttcggcagctttctcgaaagccaactcgaacaaagatgcccacgccgaatacccaaccaatatcaccaaaaacaattcccacaacctaccattaatttttatatggaaagattaaaaaaaaattaagatatatgaatattaataagaaataacaattttaagacgtaaaaatatgaaaattaatgaacgaatcatttgatcattaatttatggactaatagaaacagaaaagttatgaaatctgtaaatcactatttattgtttgataaccaaaaaacatttcttcgttgtttagttagtgagaaatgaacctgtaacgacgatcaaagtgaagaacgatgaaaggtttggaagaaggattatcatcttcgatgaaagtcccaaaagcaggcaagagactgctcgaaactgacgttatgttcctcacatctttgctcgatcttcttctgaactgcagtatcgataacggcgatcttgcttccgccgtcgacgccgataacgccgtcgaagaccttcctcttctcaacaacaacggcaacggtgatctcgcctcagtagtcgtcgtagacattcttttttccttcttcttcttctctctcttcttcaagcttgatgatatatacttccctcttttgtctctttcatttataccttttttttttagttttgaattattaaagaggtgtttagatgatcaagaaggtggtgagcaaattaagttgacttttttttttactggtttttgttttccctatattttttggaaaaaaagaatataacaatactataaaacaaatttacttaaccatctaataaattataatttttcaagattgtagtatgatgaattttactctttatatattcaactttgttgttatatatgcagaaggcttcatcgacttttttgactcttatttacgtctctgtgtgtatttaatgtggcatcaggtgtagtgattacaatcgagatctacaatatcagggggataaggtttttttttttttttttcttacgataaattatgtaataattagctgtttaaatactggagttgaaaaaattgaggaactcaaaagtcaaatcttgacgtcttttttgttgttgttattaaatgagaccgtgacaggaatagtagtgttgaaaacaaaacgaacaataataaacaaatgaattacgtatcaatatctatcatcagtcagaatttagtatgtttttaatacaatcatttcagtttttttgagataacatatcatatatatatacttctttccactttccagtgttggatgtgcatgtttacaatttttttaaaaaattctaaggaaaacaatgttttgaaattctaagatacgtttaggtaatacatgaagggggatacactttgtcttcgtcccttaattagctcctatgaagaatttcacatacacaaattaagaagatgcatgcaataacaaggctaaagccatttcttaatagttcatttgtacataaagtaagtttgtgtatgttaaaaaaaaattgtgtatgtactgatgtacagtatgttgttgattgttgatacgtaaaaccaaatagtcaaatactatacatttttacgtttgctcgtataaattaggaaacgaaagcataattgttacggataaaaaaacacgaaaatcaattaatgaaacaaaacccttttgtaaaaaagcccatttttatggaagcccattttgagatggaccagttaatgaaaaaaaatccaagaaacaatgaaacgaacgtttaagatccatgatggaaatttgggccaagattataagaagatctcaccacatttcatttgggccgggtgggcgaaacattccgggtgatcgtgtagacccaattttttcggtggaaagtgcaaaaaaaatg

SEQ ID NO: 3949 - DNA, 3000 bp, Unknown; identical to SEQ ID NO: 3942
  misc_feature (1)..( 3000): cDNA_ID_1822469_gDNA_ID_1620675_Annot_ID_164240 3000 nt of promoter + ATG

SEQ ID NO: 3950 - DNA, 3000 bp, Unknown
  misc_feature (1)..( 3000): cDNA_ID_3072232_gDNA_ID_1620675_Annot_ID_164236 3000 nt of promoter + ATG
caattagcttctcccagtttggtgatgattttttccaggaaacttcagatcaaacgatggaatcaaaatcaagagtcaaaaaatcttgccgcagaagtagacgtcaaataacaacttttctaaaaatataaactaattttgtcgaacttgtttacttggctctttgaactcgatcgttgaatttcacaaagcatgattttctatatatagctcaatctatttttgctctgagttaagaatatttataacgagtgttgatgatgaaaatgaatacttgtaatgagaataaagattaaaacacaataaatttcttcaagtaacacgaacaaaagattattatcaactattttaattaatcatgaaatttgctacttgctttttagtttcttacgttcttgtctttctcgttcttagcgtctgtaaaggtaatatataccagatattttctttcgattctgtttcgttacttgcgtaatatagaactatgacccttacaaattattggcaaacaaaattacagtgttgacattagaaaaaactaacaaaaatgttgttctagaacaatgttttttgttttgtttttttttttttgcattatcaataattgttttatctaaagagcttcaaccaaaaacaaactaacagttcttgttgtagaagtggaagccaaagaactgtgtaatagaatagaagacatcgatggaaattgtgactttgaaggagagaaggggtgcttgaaattcatgacgaataaatataagaaagaaagacatgttagctgcacatgtactaacctttacatgttacacaagaccaaacgtttttgcgactgtaaacatcgctgctcaggataaactcccctaaccaacattgcttttacctattttttagtttttactaatagaattgttatgagtgtttgtagtgttgtcattttcatgacccataaataagttatgttattctaatgtatctctctttttccacacaaatttttaataaagttatgagttacttctttctaagtagttagtatgagttttccaatcaatctattttccacgttcagttttccaaattgtattgatcctgttatagtgtaattacgcattttgtaattggccatggtactacaatactaatactatcatgttatctgcagacttcaatcttttatttttaaaaattaattattagcatttgtaatattgatgtaattttaatacaaactgtttattaatttgtttgaaaacttatgtggacaaataaaattagtatacagaacaaaaaaatatgtttcaataccaaaaaaagttcactccctaagcttttctgtctcttaaggataacatcctggatgaggtctctcgatgattccccccacatacaacataaccatataaaaaaaaaatcatcagccaagtgaagcctcgggaacagtagtgtgaacctttggatccttggcctatcgtcaaatgatcgacgacggtcgagttgattgatcctacacagtacacaacctgaatgttttcccatagcatctctgcttcatctattccttgctagtaggattgatcccagaaaaccataaatttgttttataaagattgaacgtttgtctatagattaattttcaatggattaaacattgtaaattaatggtcttatggattttgtgagtttagattatcaaggttagaactgtgtattttgaaaagaataggtgatgcgtcatcacaatacacgcaaaaaaaaaaagtgaaaaatatataatactagtaagtagatttacaaagaagaatttttccaaaaaagaaagagttgatccgtcgaactcgttaattaagaaggctcgttgaattttacaaagcaaattctaaaaaaagatgcatctatttttacgatatctcgaatatatttattatgagtgttgttgataagaaagataaaaaattcgagaggcaaacaatagttttctgcaactatagagataattaataattcttatcagcttttcaatcatgagatctgttatttggtttatagtttcttatactctcatgttactcgttctgagaggtggtaaaggtaatatgttgagttttttttgtatggacgtaactcgtatataataagatataaaacaaggatgttctttctaattgcaaaaacggtgttgtgattaaaggaaataaaaagcattgttacaacgttaacatatggtttaatagtgaacttatttggattgtcatttgtttattaatcgaactaaaattaacgtttttttttttttttttggtttgtgtggttgagaaaacaatagaagtggaagctgagaaactgtgtacaacgataggagacttggacggtaaatgtagccaagacggagaaaagttgtgcatgagatacatgactgatcaatctaaaaaaaagtttcttagctgcacatgtaataacgttgttatgttacacaagtacaaacattattgcgaatgtcaatctcattgtactccaaaacaaacgtaagctgtaactctataatcaatatatctctttacaactaaataagaattgttgatagagtttgtagtgttttcacgactcaaaaatacaaatgttgtgctgattgaagtatgaatttttggttcaagtcttgatcttgatcattgaaaaaaatcgtgaaaatattgatcaattgccaacgaaaagacgtaatggggtgaatcagatagtgtaggattatttggggtaattttgttacattctaaagtatagtgggtggggttaaattgatagtattaaaaaagtcaagggttaatacgaaatacaaatataatcaatagcgaaaaaccaaaaaataaataaataaatgacaatttgactcgaaaactttaagagaaaatggaaactgtgtctcaataaaccctagtaccctttttctctcttattcttctatcttcctcctcctctatctttcgctcgagccattgagcaattatg

SEQ ID NO: 3951 - DNA, 3000 bp, Unknown
  misc_feature (1)..( 3000): cDNA_ID_1012450_gDNA_ID_1620675_Annot_ID_164233 3000 nt of promoter + ATG
aaggacgttgaacaaaaagtagctaaacatatattacgacaatttgttagatatagcaaggacgttgaaattttcccaacaaaatattgtatgcttttgttaaaaatttatgaacttaaaactgcggagttgcaacagaagatatctaccttagagtcggaaattctggctctgctgaaggttcaggcacatcattaccaggtccagcgttacgaagatttggagggtaagatgtcaaaggctgtgtttgaggaggtgtgaacacaggagctgatctctctgatctctgagggaaaacagcaccagcacgctgaaagggacatgagtcactggtggttaggcaagagtagtagaagattttctaacagaactcacaaaaggatctaagaagaattcattatgagatgtaataaaatttcagtatgagacatctggacacccagaatcagaaacactactctactgaaggaaaaaaaaatgaaacccaaaataagtatatcaaacaactaaattatgtagacataccaacaattcctggtatcctgcatagtattgtggatatcttgccctagggccaccaaaggcctcttgccatgtatcgataaggaccagaatcttctctttgacatggaagtccggctatatgcatcagaccaattaggattagagaggcagagcaagggagagagaaagagagaccaatttggaagaaccattaccttcttcttaactatccggaccatctcatgaataacacctttctcagccacatgcatatgaaccatgtcaccacagttcttcactattgtctcaagcagctagaacataacaaaaagcatgacgatgagtgaataactatcattgcaaaacaaacaagaaagatgaaaaaacgtgaaaataattatcagcatatcattcttgttagaaaacttgtaagtcattaaaatcctcatcatgtacattagtatcatgaacaagtaatctctgatcatgtcaacttccactaataaaagaggtttgtgaaacaaacacgctatccaaatgcaccgtttcagaaacaacagtggctatttcaatgaagtagccatcaaggaaaataaaaaggagagacagttatctaggagctcacagttaaggcaagaagctgagcttttggattcctgctaccaatccgttttttaatgcctttcacaacatcttttgcttgcctacaaaacaggaaccagtttcagacatcacatagtattggtgcagttagtacacacactgaaatctccttcttccaatcacaaagcatataaagaaaataacttgagagcttctacaattaaagccctatgaaagatgactaaattgagcaaaacagtaggccacaagtattccaattggtcctagaaaacatggaaatatctaactctggtaaagaaacgaaatttgatttccatcttactgttaactctctctctctctctctcactgaaccaaaaatccaaatccgtatagagagttacaatagtttacaggagactaatcgagaagtatagaaaacaaaaggtagagagagagagagagataacaacaaaaacaaaatcggagggagcagagggaaacatacgctggatcgctattgagcatatcacagatctcgaggttcatagcccaatcaggcccgatcagcatctcgctcgtcgctctctccaccatagcgttcaccatcttcgctttgacccccaaacagaaaaacaattaacctccgattgaaagagagagacgaattttgaaaccaacgaatcaggcgaagacgaattaagcagccggtaagatcacgcaaagagattactccggcgaagaatctctcgctcaggaattcacgcccttctctctttctactagaaatcttttttttttccttttcttttctttttctctaattgttaattttcagaatttgttttttaaaaatgtattttctgtacttcagatcattttttattttccacgaaatagcaaaaaaggaaataagtcgaatatcttctggaaaagggtccactaaaagattgccacgtgttcatatcgttgtgtttggatagttacaccaattcagtcaggtcattgctttccatcggaccgttgcttttgacccacctataaatccgacggtcatcgtttcactaacagtaaatgttagttattagtattattattttttcgtttttgggagctaaatataataatgttatccaatctaaatgaatgaattagatttagatggaacattacagtttgatgattggtcgattctcaacagcttacaatgttttctttttaatgatcgaaacaaagtatttgcaaaacaaaactaaccagcgattacgattgcgattgcacacgtatgcaattaattatgagtgtcatttgataacgctatgaaaccgttaaatccacatctttacaaaattcatcataaagaaaacattttggtcttatgaaagtcgtgattggtgtgatacaaacctaaaccaacttgctacacatctatttactctctattctattctattgagttctcgtttctttatcactttctgtgttggatgtattcacccacttgcaaaaaataatttagatttatagacatcaaaattgcataagagtgttagttctaacttcatcagttgaattaattaggactctatagctaagcatattctaattctatgattatgataataattgagcgggaagtggggatagattcgaactttaacaaactattgggggtcaaactgtaattacacagaagttatcaaagcaagtacctttacacgcgcctaattgtttctgcatcactaatacttcttcctcatttccccagttcggtgttcattgatttagggttcctgataaacttcggaaacccctattttgaattgtttcggaattatctggtgagaagggtctaattcgattgtggattagttttttttttgtgtttcttca

SEQ ID NO: 3952 - DNA, 3000 bp, Unknown; identical to SEQ ID NO: 3940
  misc_feature (1)..( 3000): cDNA_ID_2992728_gDNA_ID_1620675_Annot_ID_164232 3000 nt of promoter + ATG

SEQ ID NO: 3953 - DNA, 3000 bp, Unknown
  misc_feature (1)..( 3000): cDNA_ID_1023707_gDNA_ID_1620675_Annot_ID_164252 3000 nt of promoter + ATG
cggcttcggctgcaaagaaaaaaacgaaaagtctcttctgagttttgaaacgaattgtatcaataatcgacgagaaaatcgcgccgagagttacaccgaagaactcgagctctatctcaagaggcgtcactgcagaaatcccctgaggagatgatgcttgagaagaagaagaagaagagctgttacaggagattacgcgagctcttccacctccggaaacttttcgatgctgctgaatttgtgcattggagaaggtgaagccgaggttgaaacctaacgaagccatttcttccggctaaatcttcccgtgttagcttccgatctccggcgactttggtacgaagattccagaaactaaagctaaaccacgaatttaattatgtggacttcatcttctacatgttataaggctttttgtctctgttgttaacccattaacaagcccatttaacttattttcaatttatatcttcgacttatctttaaattataaattgaaaagacgttaagtgggccttttagtgctaattttttcaagcccatttaacttatttgagtcttggaatatttcacttggaaaacaatgcgctaattccatctcctataatttccctgtatatattttgagaagatggatggattgagcaattttaaagacaaatatttatgtaactaaaaaattattcttaactttctgatgatttatgtctgagggaagcatctagtatgcattgtttctgtttcatgtgagataagcaagaaaagtaagtgggaaacaagaaagcagaacagtgagattaccaattgtgcaaacaatcatatcatatagtatactttgttcgccatcttactgtcacttaaacaacaaaattcactatcatcgtttagcggattattttcaactatataacccagtaaaagatagtttacttgtcatgtggtatatttgacagttatcaaacttttgagagtttgtgacacgtacgatacagacacaaaatcaaatctccctctccgaccatttttttttcttagttacataaatctcttttccttctccagcaacagaagaattctgctcgataatagattggtaatcacaaaaagaaaagaaaaagtgttggagatccttccgagagagacgcgacatctccttcctcttcgaagatgagtggtactgtgaaggatatcgtttcaaaggaggagcttgataacttgcgccacagcggagcaccactcgtgcttcacttctgggcttcttggtgtgacgcttcgaagcagatggatcaagttttctctcatctcgctactgatttccctcgtgctcacttctttagggttcgtcgtctctgttcgaattttatctctttcaattggtttttgactttgattggttttatttatcttcttaggtagaagctgaggaacatcctgagatatctgaggcttattctgttgctcttgtgccgtatttcgtcttcttcaaggtaaactttaggcatattgattctttgtttggttgcaattttttggcttattgacaaagcttgaatctttgtcactgcactgaatccttttcttattgaaggatggcaaaactgtggatacacttgaaggggcagatccatcaagtttagctaataaagttggcaaagttgctggttctattactcctgcaagcttagggttggctgcagggccaacgattcttgaaactgttaagaagaatgcgaaagcttctggacaagaccgagctcagcctgtatctaccgctgatgctctcaagaatcgtttggaaaaactcaccctgttatgttattcatgaatggtactcctgaagagcctcgatttttaatatctattgagtactttctttatagttggaattcttgtggatatatatcaggtagctacttggagcaaacatgttgctaaagttgacctgctactgttgtttgaagaacacgtgctatgtcttgtcgttgaaggaattatgttcatatgggaagaacataagcctactggaaagtttacccctagctctattgttaacccagatacttgagcctccatatcacaaacatctagttaaggtttgtgtagtaagaacaagaaaaacaacacgtgttcccaattcccatataaatgaccattatacttctatcaacccaattaatcacagtccggagactagttgattaaaaaatcagctaatactaatttggtggtttcaataaacatcttaaatactccataattaaactagattaaagtgggaaaaatcgtcatgagtagttgtaaaatcgatttcatttaagagtatagaaattcgtcatgagtggttggttcatgagttctctctcttactcatattagagtaagaaatcaaacacttataatcattcaaaattcaacaactctcatctcaaaaccatatatttaggtaaagttatatgcatacattttgcattttaattttaaaacagattatttggcgcgtaatgataaaattatgtgtataaaaattatttaactaatcgatctaacaaccacatatgagtaaagtagttaacattgtactactacaccaaattatagtgtgttggttagattagatacacaaactcactttctcaaatcaataacattatgaatctatgataaccttaatttaaaaagagtctataatgccatgattttacaatcgtacttttttcttttgggctgaacttttaatcatatattatttgaaagatgtgattattataatattaaagggaattaaaatcatgtaagagaaacccaataaagtagcttgaagaagaaaaagacaagctttattatacacttacccagaaaaacaaaaaacaaaaaactgataatatctctctctctctctctcgttgagtgtgtccatgaaataatactctgccagagacagagagaaagactgtaacggaggatgtggtggcgaagtggccacactgacacactggtttc

SEQ ID NO: 3954 - DNA, 3000 bp, Unknown
  misc_feature (1)..( 3000): cDNA_ID_1021721_gDNA_ID_1620675_Annot_ID_164250 3000 nt of promoter + ATG
acatcaggagagagagatagagagacagagcagaaccgagatcggaggttgaggagagaccgccgagtccaccggcggaggaagcagaagccgtggaaggagtcatcgccgctttagccgccttattatccggtggtagcctatggtcagccatggaagtggatgctaaagtaggattcttggagcctaaaaagtcatggaacaagagcttatcttgttctgtctgtcggagacgagaatcaatatcagtgggtcgctggccattgttgtggttcaccatcatgaaaccagtgtgtcagtgtggccacttcgccaccacatcctccgttacagtctttctctctgtctctggcagagtattatttcatggacacactcaacgagagagagagagagagatattatcagttttttgttttttgtttttctgggtaagtgtataataaagcttgtctttttcttcttcaagctactttattgggtttctcttacatgattttaattccctttaatattataataatcacatctttcaaataatatatgattaaaagttcagcccaaaagaaaaaagtacgattgtaaaatcatggcattatagactctttttaaattaaggttatcatagattcataatgttattgatttgagaaagtgagtttgtgtatctaatctaaccaacacactataatttggtgtagtagtacaatgttaactactttactcatatgtggttgttagatcgattagttaaataatttttatacacataattttatcattacgcgccaaataatctgttttaaaattaaaatgcaaaatgtatgcatataactttacctaaatatatggttttgagatgagagttgttgaattttgaatgattataagtgtttgatttcttactctaatatgagtaagagagagaactcatgaaccaaccactcatgacgaatttctatactcttaaatgaaatcgattttacaactactcatgacgatttttcccactttaatctagtttaattatggagtatttaagatgtttattgaaaccaccaaattagtattagctgattttttaatcaactagtctccggactgtgattaattgggttgatagaagtataatggtcatttatatgggaattgggaacacgtgttgtttttcttgttcttactacacaaaccttaactagatgtttgtgatatggaggctcaagtatctgggttaacaatagagctaggggtaaactttccagtaggcttatgttcttcccatatgaacataattccttcaacgacaagacatagcacgtgttcttcaaacaacagtagcaggtcaactttagcaacatgtttgctccaagtagctacctgatatatatccacaagaattccaactataaagaaagtactcaatagatattaaaaatcgaggctcttcaggagtaccattcatgaataacataacagggtgagtttttccaaacgattcttgagagcatcagcggtagatacaggctgagctcggtcttgtccagaagctttcgcattcttcttaacagtttcaagaatcgttggccctgcagccaaccctaagcttgcaggagtaatagaaccagcaactttgccaactttattagctaaacttgatggatctgccccttcaagtgtatccacagttttgccatccttcaataagaaaaggattcagtgcagtgacaaagattcaagctttgtcaataagccaaaaaattgcaaccaaacaaagaatcaatatgcctaaagtttaccttgaagaagacgaaatacggcacaagagcaacagaataagcctcagatatctcaggatgttcctcagcttctacctaagaagataaataaaaccaatcaaagtcaaaaaccaattgaaagagataaaattcgaacagagacgacgaaccctaaagaagtgagcacgagggaaatcagtagcgagatgagagaaaacttgatccatctgcttcgaagcgtcacaccaagaagcccagaagtgaagcacgagtggtgctccgctgtggcgcaagttatcaagctcctcctttgaaacgatatccttcacagtaccactcatcttcgaagaggaaggagatgtcgcgtctctctcggaaggatctccaacactttttcttttctttttgtgattaccaatctattatcgagcagaattcttctgttgctggagaaggaaaagagatttatgtaactaagaaaaaaaaatggtcggagagggagatttgattttgtgtctgtatcgtacgtgtcacaaactctcaaaagtttgataactgtcaaatataccacatgacaagtaaactatcttttactgggttatatagttgaaaataatccgctaaacgatgatagtgaattttgttgtttaagtgacagtaagatggcgaacaaagtatactatatgatatgattgtttgcacaattggtaatctcactgttctgctttcttgtttcccacttacttttcttgcttatctcacatgaaacagaaacaatgcatactagatgcttccctcagacataaatcatcagaaagttaagaataattttttagttacataaatatttgtctttaaaattgctcaatccatccatcttctcaaaatatatacagggaaattataggagatggaattagcgcattgttttccaagtgaaatattccaagactcaaataagttaaatgggcttgaaaaaattagcactaaaaggcccacttaacgtcttttcaatttataatttaaagataagtcgaagatataaattgaaaataagttaaatgggcttgttaatgggttaacaacagagacaaaaagccttataacatgtagaagatgaagtccacataattaaattcgtggtttagctttagtttctggaatcttcgtaccaaagtcgccggagatcggaagctaacacgggaagatttagccggaagaaatg

SEQ ID NO: 3955 - DNA, 3000 bp, Unknown
  misc_feature (1)..( 3000): cDNA_ID_1985369_gDNA_ID_1620675_Annot_ID_164249 3000 nt of promoter + ATG
ttaagaataattttttagttacataaatatttgtctttaaaattgctcaatccatccatcttctcaaaatatatacagggaaattataggagatggaattagcgcattgttttccaagtgaaatattccaagactcaaataagttaaatgggcttgaaaaaattagcactaaaaggcccacttaacgtcttttcaatttataatttaaagataagtcgaagatataaattgaaaataagttaaatgggcttgttaatgggttaacaacagagacaaaaagccttataacatgtagaagatgaagtccacataattaaattcgtggtttagctttagtttctggaatcttcgtaccaaagtcgccggagatcggaagctaacacgggaagatttagccggaagaaatggcttcgttaggtttcaacctcggcttcaccttctccaatgcacaaattcagcagcatcgaaaagtttccggaggtggaagagctcgcgtaatctcctgtaacagctcttcttcttcttcttctcaagcatcatctcctcaggggatttctgcagtgacgcctcttgagatagagctcgagttcttcggtgtaactctcggcgcgattttctcgtcgattattgatacaattcgtttcaaaactcagaagagacttttcgtttttttctttgcagccgaagccgggtagcgacgggtcatatccggtagataaagcaaaggctgtgagtggagataagcttctcagaagcattatgcaggataacaaaattgaactctacgctgcttacgtgagttatgttgatttctctctctttaattacgaaatttaacttcagattttctcaatcttaatacattgattgatttgatgtttgaactagtttctggaataatttagtagacaatgaaaatatttagttctagattttgatgtgaggagatggtttgttgaaggcttatgtaaactttggattttggtcaatttgtgatgattaggggaaagtgatgaactgtggtggtggaggaagctgtggaacttgcattgtggaggcaagtgacttcatacaatgttaattagattctgattatgaatttatgagctatgattgttctagcattcatggatatcaatggaggaaaatagatttgtgtttggtcttcttatgatgaccagtaactcaaagcaaaaaaatacacatttggtcttcttgtgtgcagatactcgatggcagagatcttctgaatgagagaacagatacagaaaaccggtacctgaaaaaggctagttatttgatcactcctctctatattattgttagattcacaagtttctcattgctagtgtttggaatgggtatgtgcactaacaagatgaatgaaatgttgagcattgtttctggttaaatgtgaatatatgttttgttgtctgatatggttactaagtaacttttcttagatatgcaaattttggataaaataagagccttggctgtttaaatcttaagggttttgttactattgtgcagaagccggaatcttggagactcgcatgtcaaacaatagtagggaacaaagaaaactcaggaaaggtacctactttcatacaccaatttatgcatatgcaaattgcaaacgctaatgtgcccattatttgggatcataagagtttatttttcctttttatgatctttctcattgagaaaagtcggctttggatataggttgtcgtgcagcggattccacagtggaagaagtgaattaatgtaaaggttatttgtctcagatttatgtgtatataacacatctctgtatgaatgttgtctcgtattaatggaagattcgtttgtctagacgtatttttctttagttcttggatatgtggtgccatgatagtgaaatttaagagagaaactatcaactagctcgcatgattgaaatgtttaaaatttgcttaaagatacggtaggagtgaagctggtcagaagattcggtaggaagtgtttttatgatgatctgaaaatcagtagcatgttttacctttttgagctgaaaatggcatttgtttcttaagctttgaaaacgtgtttctaaaaaataagaacttggtttagtattcgaaccgtttctttgacaactttcagatcactttatttatcgaatgtcaccgaagagacaactttcagaacatctaattagattacgcgccgccccgtaaaacaggggtaaagtcaaaaagcaatatcttctcatttttactttttacttttttcttgttgagggaaaatataaagaggaaggagccaaagaaagcatcactatctgaatttttctttgtacatttatttatatataatactagtttttgtgtgattgctgtttggctccgaattttatatccataattttttttttttaatctccccttggttgatcggtgaacacaaaaaaaaaaatctaaaataatcgcaaaatacatttgaagaagctacacgatcaacaacagcaaaggatttcgattgttgaaaaagttgactcttcttaatttgattcgttgtcttggtttctgggttttcttcttcttcttctgcggcgctctccaattttacaccttgcgaccagcgagaaaagaaacaaatttcacccccattgaagaaggtttgtttcccctaattgcttgattttattctgagattaatcccaggcgccaattatatgcttctgttcttctgataaatctttgcccttttacgatttttctttgattttaccctagttttatggtataatctgggtgagtttctttcctttaattcatgtatgattaagcttggattggtcgattctgatgagtcaaaatcttgaaacagacataaattgatgatttttcgtggttgttttaggtcatttgagggtttaagctttctttgtggatttgcaggacctttggttaagctccatggtgtggtatgcgcaaagtggacaatacctagatg

SEQ ID NO: 3956 - DNA, 3000 bp, Unknown
  misc_feature (1)..( 3000): cDNA_ID_1013621_gDNA_ID_1620675_Annot_ID_164248 3000 nt of promoter + ATG
tataggaatcgcttcccgaagcttccaacattctcttgtttctcctttgtctctcaatttcagtttcctatattatacgcttgtattaatcaccagtatacattttgtcgtttctgggtctggaaccctagtagttattatagcatccatcgctttcttcaatcgccgtccatcagagtttcaagggatttgctttaaagatcaatcctttcctaagaaaatagcgacaattcatcagcttttcctttcccatccttcattaccttaacttactcgagattcatcttccagctgaaattgtgaaacttcgtttctgggtttttatcagaaaacactctgtgacttattgtgtggtgatcgaggaaagaaaaaagatggttggtggtggaaacaggagagatgagggatcgatgccgattcagaacaccaacttgtttgctgctttggatacttcgaggaagaagaagaagtctgataaggctggtaagagcaaagcttcctctaagagagaagattcacagaaggagcctgagccacaggttttctgggcacctacgcctctcaaagcaaaggcttgggctgatatcgatagcgatgatgaagatgatgattattacgctaccactgctccacctcagtccctgtggagcacttctgaagcctcccattcagatgctaaagacgttcccgctgaggtcacaagtccaaatctttcatatatatgttgattttgggttcatcatcatagctttatgcatttcacatgttgaaaattgtaacactggtttaatatgtctcttgcaataagcctctttagatttcaaatgcttccacgaattgaatgagttggcctttttttctactgttgttatctcgcttaggcttaggcttgtgttgtctgaattctgaaagggaaattaatgttattgtgaagtaagctgctttgtctcctgaaggttcatatatctaattgcattgttatcgaaatttttctaggcaatgtaagtttgttgtgcaatggtttctctaaaccgtggttgtgtgcctatctgttcatttgtttctcatagagatgcatttgatttcaatgtcgcaggaaattgaaagcgaagaagacactcttgatgatggagatgatgatgatgtggaggaagatcacgagcagggaacagagacacaagttcatccagaagcagagcctgaggtgaaaaaggctcctgaagttcgtgctcctcctaaggaggcagagaggcaactttccaagaaagagaggaaaaagaaggaacttgctgagcttgaggctttgctagcagattttggagttgcaaccaaagatgagaatggtcaacaagactctcaaggtatagcacaatttcactttactatattcactcgttggtaacaattctactctactctattcactcgttggtgatatttatctgtggatacctttctacgctgaggtatcactggctgagaaaaccatgttatggctaatactgatagacgtttcttctgcaaatatgaacagataagggggagaagaaagaagtgaatgatgagggagagaagaaggagaacacaaccggagaatcaaaggcctcaaagaagaagaaaaagaaggacaaacagaaggagctaaaagaatcccagagtgaagtgaagagcaactcggatgctgcaagtgagtccgctgagcaggaggagtcttcttcttccatcgacgtcaaagaacggctaaagaagattgcatcaatgaagaagaagaaatcaagcaaggaggttgatggtgcttcaacagctgctgcaaaggaagcagctgcgaggaaggcaaagttggccgcagcgaagaaaaaagaaaagaaaaactacaatcagcaacctgtgaggtgaagaaatcaatccacccaccgttgtgatatgaacataggttttgttcatatgagacttacttgccttgaacaaatcttttgatggggaatgtggttgggtcgtgttttagagttatgataactttggatcttttaatcctatcacaatggaacatgacaagaagaaactctgtttgaatttttccttttacatacattctttgctcatcatggttatacttggatttgttttatctcccacaacaatttctacttcttgatcttacatattattagttgtggctaagccagcgcttaataaagttaatctatgagtctgaatcgacaaaatcaattgattattttaattatatgtttatcaaacgaattagatcatatttttgacaaacctaaataggtatatttctcttgcggtttattcgacgaaaaagaaaagttggtacagtatttattttactctcttaagacaattcgtcgtgttgcttgctactctcgacgacggagaagtagaaatgtggagaagagtgatcggaaatgtcgccgtccggcatcaattacagcgagcgctatctagtaaagccggtggaagtggaaagagcgccaacgtttcagctgcagtggattcgatgcttctgcgttccctcaaggaacattacttagaggtttctaagatgactcctcctccggttcgttcctcctcttctctctctctttctgtgttttctctctatgtctcgtcttaggtacaactgaaatttcagtactgttacttaaaccctagcttagctgctgcttcctccacttagggtttatggtgggatttacagatttttgattgattttgcagaaagtgagtcctccgtcaccatttgagattgtgaaagggtcgcttgaaggaagtactggtgctgttctgaagaaatctgttggaaatgaagagatcaatcttttcgttatgcgcttggctcacggaggtgatgaagaagacgatggtgggatcaaccagttgttccttcatgttgctgtatcaaagccaaatcagcctgattctttgcatttcctttgtggcctttaccctgatgcattgggtattcattctgtttcc

SEQ ID NO: 3957 - DNA, 3000 bp, Unknown
  misc_feature (1)..( 3000): cDNA_ID_2135426_gDNA_ID_1620675_Annot_ID_164231 3000 nt of promoter + ATG
tactcttctttacctcgcaactttgtttttcagggacgagtctttgttatgtcaaggtctggctttgaatgatgacttgcagcgtgtcttaaccaattatgaagcaattgcttctggattacctggaacttcttctcagatcgagaagcccaagtccgagacaggaaaatcccttgttgatgttgatggtccacttattgatacaggggacagcagtaatcaggcgaacgggtacgttctaccaaacttgactgttatgcacccaagaatgttggataaaatcacctatttttggatatgggttaccgatcctagctgcaatcttgagctcgatatatggcttgcacgtccaaactattacaatctaggatgtgaaaacgaaaagttacttatgaatctgggagtaactttataatcattttaatataaacggtgttaatttgtctcttaaccaagtaagaactggggtttcaggccaagtgaccttgtaaaagttttttttttgtcttataacatagctattgatttatactgtccaacgttttcacagagctacatcgagctctggtaacggggttctaaatcagttggccctccctgcaccacctgtaactaatggttcagccaattccaaaatagacctcctcagtggcgatgatcttgcccttgttcctgttggacctcctcagccagcaagtccggttgcatcagatcaaaatgcactcgcccttatcgacatgttctcagataatactaataatccaagtcctgcaactgcaccaagtggcaatccagctcagaatattcctttgaatcctcaagggcaccaacaaccaaatagtcaagctggagaagctggattacaacaatccaatggatttgcgcctcaagtgggttattcgcagtttgagcagccatcatacgggcaaggagtctcttctccctggagcagtcagcctgcacagcaaccagtccagccatcttatggtaatatatataaacagtttttgtttttcacacatctggagattagattgcagtatgccaatgtttctctggttatggcaacaaggagaaagaatttccttcttttggattcagaagaatcagcttcaattgtgtctcatgtctaatcattaattgttctgtttttatggtaatcttgtaatataaagaaggtgcccaagacagtacggcatttccacctcccccatgggaagctcagctccaagactatagtccctctgcggagtcaggaagtccgttttctcctggaatgcatccaactcagactgccttcacacatgctcaaccagttaacaacaacaatccatatcctcaaattccccaaaccgggccaccagtcaacaataacagtccatatgctcaaatgccccaaacaggtcaagcagttgccaacatcagtccatatcctcaaattccacaaaacggcgtgtacatgccaaaccaaccaaatcaggctcttgggtcaggctatcaaccacagcaacaacagcagcagcagatgatgatggctcagtactatgcccaacagcaacagctacagcaacaacaacagcaacaggcgtatggaaaccagatgggaggatacggatatggctataatcaacagcaacaaggaagcagcccatatctggaccagcaaatgtacggtttatccatgagagaccagacatcgcatcaggtagcatcatcatcatctaccacatcttatctgcctccaatgaaacctaagaataaaccagaggacaagctatttggggatcttgtggacatctccaaattcaagcctacaaaaccgacttccggaagagctggtaccatgtgaaaattcctccatccattcatcatttaccagtattcatctcctctatcctcctcagctaactctctttcttctctttgttaagcttttttcatcattgattttattaccctcttgggagataacatagatatacatatgtgttatgttcttccttataatttaccgttggttatgggtttgtatatttcttgtagagaaaagaaaactggaaaatcttttgttgagaactcagcgatttggggtttgtctcgagattctattttaggacattttaatctctcatttgtattttcagaccttttatttgttatatccattggcaataaagtttgatatcaattggatgagagttatggttcttaaatttgccaaaaggacagtttatgttctttgtatatgattgcaaccctaattccatagtcaatggagacatcaaaatgtcaaactatgcttgcattatataatctctttcgactcaatgatgtcaattaccgaaaaagtagaaaggaaggatttgttttgtttgcgactgttgttagttcttatgttgctcgtcgtaaacaagaaaaacctgccattcgtttgggtttttgaaatctagtctaacagaaagaaacaagagacaaatgaagaagagtaaatctagtccattcatcatcatcagtcttttggatcgtgcatatattaatttgtataagagtctgtctaacaaaattgtcaatatgtccgagtggttaaggagattgactcgaaatcaattgggctttgcccgcgcaggttcgaatcctgctgttgacgtattctattttgttttcttttcagctctcttcagaatttttgtaaatattttaaaagggaaaaaaatctcaaaatacgatttcaattaaaattgtagagattctcctcacgtctgtttgtgaaatgttgtctctaataaatttccgtaaattactgaaaacaagacacgagaaattgttaatttaacaaaataaaaatacgttacgtttggggtttgccacgtaactacttaccgccacacgttctcgtccttttcttcttcctctctgcattcttcacagagtttgtcaccaccaacaccaaacacacaatttcacattcttttgcatatttcttcttcttcttccattatg

SEQ ID NO: 3958 - DNA, 3000 bp, Unknown
  misc_feature (1)..( 3000): cDNA_ID_1822457_gDNA_ID_1620675_Annot_ID_48230 3000 nt of promoter + ATG
cattttgttttatgcattttgtctagagttaatatgtgaacaagttgcattttgcagatgactgcatcatctgagaaaatggaaattcctagaagtttaattgatgatgtaccagtttcagaactatctgatgaaggcattattaagaattcaagtgaaattcctgcatctctaaagaccactgaggagccagctcctaattctttggaagctttgttgtttggatcctctgttccttctgttgtccctggaacaaacaactatgaactatggaacacaagtgatatttcctctactgaaaactataccgcagttaacctcgggacccagacaatgccaggaataccagacagtgttacctcttttgccacatcaccaacaactgcacatgctcattccggttcttcaggtccagtggtacctgttgctcctgataacttaaatacaaaagagacggctacacttgcaaataaccaggttggtctctgtagcagtttttaaacacacatttacaaatattttcttgaattcaggagtttaagctgcatcaactgttagtaacagtagatgtaaccggatcatttacagactttgaaaaagaagaaaagactatagtttcaataaaacttgttctcttcatgtgctaaccctttgcaaacacatgtggcatctacatatatcatctaagggaccatcagatttctctatggaacagacaacactggctatcacagattatgctcatggagttggatctgagcatcatcaagatgatgagacacaatctagcataagaaaggcgcttcctgaggtaacgaacccttctcttataacagaaatttggatactcttttgggaatctctgatcataagaatctaaccattggcaggaccttttcactggaggcttctcatttgcccctcagcaagttcatggtcaacatcatggcatgggatatggcatgcaatattatcaatatcctgtggtatatgttccattgacataattattacagcatctggttttatgctgatatatgtcctttttcttagcaggctatgggagccttaacatatacagcaaaagcagcaaatccctttgatcttagctatgatgatacagctccaaaccaaacaccacaagtatgaatcctagagttaatttcctgatagtatatatgatgaaaatgaatatatatatatactcagttcctttctcttttctatgtcttttacagtttcctactatggcatatgtgcaaggaggaggcttacctcacgtgtcatctccaatagggtattcagattcttcaagtccagctgcagattccattggactgatgacctctcagtcaccttttcatgcaaccgctttatccccaaactctccagctcttgcatcccatctttcccctggtgagacgaaatttatgtaaaaagactgttttcagtggttggagtttatattctaagagttgaaatctggtgaacaggtgcactaatggggcagcaatcacaggtgaatatgtccccatcattcaggtacatacatactctgactcttcttaattagtgttcactgaatggttcttgactctaaattgattttggtgtgcaaaggcaagagtatagtggtcttggtacagaaggaaatacgttcaacggagtacatacatttcatcaagcaaacaatggatatccttctgcaaacccaaatgcttatgtatccagaggaaatccctttgaatgagaaacagcttaatgcagaagttttctgattacggaaatgggatagatttcgtataatccttctaaaacatgacttgcttgacgatgaaacagaggtttcaatcatctactatttgctaattgatcaaatgaacattgatgtggaaagatattactttgtaataaaaagattatagaacttatgtaatttatctacagagcttgttctattggccatttgacaatcagattttagtgtgcatgtgttaagtgtattgtaagttgtaaacaacaaaacaaatatttcttacaaagttataattaactacgcaaactagtatcacaatttcaattaatatatattttaaaagttcatatcattcttatacttattaaatatacaatttgcgcataaacttaaagatatttaatggcgttttaacaagaaaataaaattgaataaattttgtatatttttgacataacaataccaaaaaaattctagcattcgattgaaccaaacttgacgtgtgaatgagtctggtttactacagtcaaattgataactcttttttttctaagttccaactcttcaacgttttttattcatgtacccttgcattttgttgaaattttgcaatgtgaattttctgtcttctcttacggacaacaaaattttagtttttatcagtcgtctgaatcctgtgacagacaccgacgccgttaaccgtcgtcgctgtcgctgtgtctctctttctcactctgttccatagatctgagcttctatcaatattctcggatcgctatcagtcaaatcttaagaatttcgtcgctttagctcaattcgggtacgtgtttcaattttctcgatagacccttttgagattcttgccttttttgttttttctcctttagatcagatttcggtttcctgatttattagtttattaccattgatgaagttttctagattcgtctcctttgtttatggtcttgatagggtctttatgttctgaaggaataaaaaatcttgtctttggatggataattattgtcttcaattgtatttgttgtttctaagaagaagttgtgtagttactgccaccaagtctgtgtgattgatcggatcattgttagtgtgtcagtgtttttatcttcaatttctttaattgtggcatttgctgattgattacttgaatttgttgattttcgcaagactttagattgtggaggaagttttaggatttgatctccatctcgtatccaagcatg

SEQ ID NO: 3959 - DNA, 3000 bp, Unknown; identical to SEQ ID NO: 3946
  misc_feature (1)..( 3000): cDNA_ID_1822453_gDNA_ID_1620675_Annot_ID_48231 3000 nt of promoter + ATG

SEQ ID NO: 3960 - DNA, 3000 bp, Unknown
  misc_feature (1)..( 3000): cDNA_ID_1822449_gDNA_ID_1620675_Annot_ID_48232 3000 nt of promoter + ATG
ttctccggttgtgttctccttcttctctccctcatcattcacttctttcttctcccccttatctgttcatatttgcagaagaaacgtctatcagtattagccataacatggttttctcagccagtgatacctcagcgtagaaaggtatccacagataaatatcaccaacgagtgaatagagtagagtagaattgttaccaacgagtgaatatagtaaagtgaaattgtgctataccttgagagtcttgttgaccattctcatctttggttgcaactccaaaatctgctagcaaagcctcaagctcagcaagttccttctttttcctctctttcttggaaagttgcctctctgcctccttaggaggagcacgaacttcaggagcctttttcacctcaggctctgcttctggatgaacttgtgtctctgttccctgctcgtgatcttcctccacatcatcatcatctccatcatcaagagtgtcttcttcgctttcaatttcctgcgacattgaaatcaaatgcatctctatgagaaacaaatgaacagataggcacacaaccacggtttagagaaaccattgcacaacaaacttacattgcctagaaaaatttcgataacaatgcaattagatatatgaaccttcaggagacaaagcagcttacttcacaataacattaatttccctttcagaattcagacaacacaagcctaagcctaagcgagataacaacagtagaaaaaaaggccaactcattcaattcgtggaagcatttgaaatctaaagaggcttattgcaagagacatattaaaccagtgttacaattttcaacatgtgaaatgcataaagctatgatgatgaacccaaaatcaacatatatatgaaagatttggacttgtgacctcagcgggaacgtctttagcatctgaatgggaggcttcagaagtgctccacagggactgaggtggagcagtggtagcgtaataatcatcatcttcatcatcgctatcgatatcagcccaagcctttgctttgagaggcgtaggtgcccagaaaacctgtggctcaggctccttctgtgaatcttctctcttagaggaagctttgctcttaccagccttatcagacttcttcttcttcctcgaagtatccaaagcagcaaacaagttggtgttctgaatcggcatcgatccctcatctctcctgtttccaccaccaaccatcttttttctttcctcgatcaccacacaataagtcacagagtgttttctgataaaaacccagaaacgaagtttcacaatttcagctggaagatgaatctcgagtaagttaaggtaatgaaggatgggaaaggaaaagctgatgaattgtcgctattttcttaggaaaggattgatctttaaagcaaatcccttgaaactctgatggacggcgattgaagaaagcgatggatgctataataactactagggttccagacccagaaacgacaaaatgtatactggtgattaatacaagcgtataatataggaaactgaaattgagagacaaaggagaaacaagagaatgttggaagcttcgggaagcgattcctatagaatgcgagagagagatgattagggttttcttaagggatgtggtgtgtagcaatcgtagcgattagagctactgggctacacgacaagggaaggggatctgtctctatttgggatgttatctcctctcttatggatcatcaaaccgaacatttgattacaaaattgaaccgaacatttgattacaaaattgaaccgaacattggattagactgtctaattaaaccttaatttggtttatgaactcaatattagtttttccaattaagccaattttattttatttttctgtattaaaaaagcaaattttgggttccaatatacaatccacccgccaaaatattttgtcaatttttaacgtatttttgaatcgaaaaaggaatttctgaacttttattgtttttcttcttgtgtttatacattgctctaaatcttatgatacgttaataatgaccttaattcatatttataaggaaaccaaatctattttttaaatattcttaaagcttagtttacactatataattaatcaaaaattgattccaatcaatctctctactactaattctttttgctatatgtctatatttaataaaaatatatatttaaacacataataaggtagtaatacactaatacttaaatatggtccgaaaactcctaataatatgtatatatatatttttacaaaatattggaaaattgttaagctaatggatgaatgaagtttatatattaaaagaaaataacaataatatatatatatatatataaattattaaaaagataatactgtaatgtgatgattttatacttaaattatcccctagtattctagtaataatagttgttaagttgaatgatgtctctaacaattgttggctaggtggacaaacacaagattgcggtaggttagcaacacacgtgacaacaataaattattctctctgaagaaatctttaaatcctgaccgtccaaacaaatatttcgcagctgagaatctcgaacgtccattatatcttttctgttgcagagttaaaaatttagtgcttatttcgaaactaaatatggaccgtagatatagtaacgcgtctccatcggacggtacccgtgatacgatgtttatttggaatatgttttctttataactgaaaaaaccttactctcgcggaaccagacgaaaccctagctctcccgtttctcccggttaaaaaagaaaaaaaaaagaagcaaattttgctttttttattttcggctaaattgaacgaatacttttgggaaattttcgattgtttgatttagggatccgattcgcagtccgatttaccgaaaccctaattttgattttgggattgtggcgactataaaggtccttaagagactcgatttcgtctgataaagtgatg

SEQ ID NO: 3961 - DNA, 3000 bp, Unknown; identical to SEQ ID NO: 3945
  misc_feature (1)..( 3000): cDNA_ID_1822445_gDNA_ID_1620675_Annot_ID_48233 3000 nt of promoter + ATG

SEQ ID NO: 3962 - DNA, 3000 bp, Unknown; identical to SEQ ID NO: 3955
  misc_feature (1)..( 3000): cDNA_ID_1985369_gDNA_ID_1620675_Annot_ID_48234 3000 nt of promoter + ATG

SEQ ID NO: 3963 - DNA, 3000 bp, Unknown
  misc_feature (1)..( 3000): cDNA_ID_1822633_gDNA_ID_1620677_Annot_ID_48274 3000 nt of promoter + ATG
ataatctcaaatggtttgaaggaaactcgggcttcagaatatcgaaatcattgtcgcggatattagcacttttgagcatgaagggacatacgatcggatattctccatcgagatgtttgaggtttggatttgtttctttaagtactgtgcttcattatatttttgcctgtcaaagatcagaggtttatatcttagctttggcttgggattgtgattagcatatgaaaaactatggagagctactaaagaagataggaaagtggatgaaggaagatagtcttctgtttgttcactatttctgccataagacatttgcttaccactttgaggtatggatcaatgtctaacttgatagcttcttgttttcttggcaataatggaatcttgagattgtgttgattcactataggatgtgaatgacgatgactggatcacaagacacttcttcagcggaggaacaatgccatcagcagatcttctgctatattttcaagtaatatacattataacttgtgtatgattcagtagattatgatcaattgaaatatatcaatatgttgttgttttgttcaggaaaatgtttcgattgtggatcattggctcgtaagcgggacgcattatgcaaaaacaaggtaaaaaaactcggaagatttgttgtaaaatgctagagaagacgagaattatcttgtaatgtttgtaactttataattaaacaacattttgcagtgaagagtggctaaaaagaatggataaggagatagttgcagtaaaaaaaatcatggaagtgacttatgggaaagaagaagcagtgaagtggatggtttactggagaaccttcttcatcgcggttgctgagcttttcggatacaacaatggagaagagtggatggttgcacacttcctcttcaagaagaaatgatgatgatttctttatttttcttccaatttttcaataaagaatacaacaatcccattctactttgtattctatgatgttatggtttcataccaaaggagtttgttcaatctttttaaagtgacaatgttatctcgaaaaacatggggatcaagtatcatgaactggattcttttgaatcagtagcttgctttgttggattcagctccccatctacctccaaaatgcgagtgagaagcttaccatctaaattctcctgtttaattacatgaaaaccgaaaatcaaaactcaggaacgagaagcttatcatttgattaaagatcacaggaaacatgaatagagctgatgaagcagagaagcagagtgagttaccgagagacagtctctgtattttttccactcggcaacacactcttctttatcccattggcctttaacaaacttctccgagtaccatctgcagaaaaaaatcaagaaaaaaagatgcaatttttagcgttttggacagacagataaatacaccaaccaaagggaagaattagaaaggaaaaaggaataagacaatgccatccaaatggtccaaacctttcaaaagaccagaaatgaaatccctgaaaaaaatacccatttggctaaccaaagctaaacccttaaacccagcaactagctaaatccatcaaaaggagaaacaaacgaaactcacttgttgaagcaattgtggtaagcgtttcgcaaatcggcgcagggagaagtagaggagcgagctgaagttgaatcttttttcttcaataagcccattgtcgttgcaatcaccactaatactctgtcccaccttagcaactctgaaaatccatctatctataattcagaaaaaaaaaaaacctatatcatcactcttaagaaaaggataaaaatgtaaacagtgagacaataagaatctaacacaacaacaagcttcagaattcatcacaaacagagaaatataatccaagatgaccaaaagacaactaaaagattcatttttgatactctaaaaatataaatgaacataaccaaagttgcagaaagaatcaaatagagagattgtatcaaaaatgaaactcagacaatgcaaagttttaagaagtatgaagcttttcaaggataatagaatttcaatacccaaaaaaaaaagaaaaaaaatcagatctcagaaggaaaaagaattgaaatttaccctgaatttgattaaaacgggatatcccgtaaaacctcagattctccgagattgagagtctctcgtctaactcagaaaccgtaaatttaaacacccgacctagacgacgacgacgacgaagcttgggaagaactcgattggaaagatcctaacgacgtcgtttcagaagacgaaaaccctaggcaagaaagaaaactaaattagtctcgttgaccaaaaaaagaaagagaggaaattaacattaaaaaagagaaactatacaattcaaaattttaaagtcttattatgatgatataaataagggaataaagatcatcttcatctcactgttaagtataatggccgagctccaagggacagaggctacaacctgatgaagctacgtggaacatggcggatgctcctcgagaaacggacacgccgagccaagaagatcaccctggtcatcagtacaacatgggactcaggggatgttgggaatctgatcaaggagatgattgaggatatagaacgattaaatgtgtgttgttcaaactagatccgcgggactttgagttgacgagtagtagtgacattgaatcttcttatgaacaagtgtaatctgattaaacatttcttcactggtcaaaacacattttgtcatattcggcctagcttggagatgctaatggataatccaacgtcattgaatttgatagtgatattattgaatgttttgtaaatgttattaacgttgcgtcctctactagaaacgaatcactcgcgtggcgtaacataaaacaattgcttacaaccctcgtattataaaagacaaaactccaacaagagaaaacaaaaaaaaatcatatctgcaagtaatagaaaatg

SEQ ID NO: 3964 - DNA, 3000 bp, Unknown
  misc_feature (1)..( 3000): cDNA_ID_3593713_gDNA_ID_1620677_Annot_ID_48275 3000 nt of promoter + ATG
ggccagttcatgagcaactacagtggcaacctagcagcagaaatttaactgctttagataattgcacaagagagcacaagacaatttcctctagagaataaatggacatgtttacagtaccctctgtttgttagaagcagctgaatgttgttcatcatagagaagagctgtttcacggtatgtaactaaaccataattctccatagctccggcagcaaaatctggtattgcaatcatatccattttgggaaggggatatggcacagcaaagtacctacaagaatgattggacttatgcaatgagatgatacatccattaaagaagctcagaaatatgcatgcacataaagtttcaaatgtcaacgaaggacctactctttgaacagatccaatgtcttggcaccaacatgcaatgcaaatttcccttggtcggctttgcccacttgacagtatactctgactttaatccctgagaaaaagatgaaacttgatttagagcttctcgacttgactagacgggagataataatggataaaattaatttaccatcggatgtatgatcttccacgtagtcaaacaaaccaacaacaattgctaccaaatatgtagacatgattggtgactcttgataggagacaatcttcagattcccattgactttctcctccattattggcatattggagagagccaccaaatcagttggcacctctaatgtaatcttgaaggtagcctgttgaacaatgtgtcaatattgatagataaagacagaagaagaacaaaatcaccaacttgataaactcatgctgatagaaagaggagggaatgagaaagaacaagtggaaaccttgcaagcaggttcatcccaacatggaaagcatctcctagcatcagctggttcaaactgggtaactgccatattcttcttctcaccgttatgttcataagtactgccaccaagacaaatacaagatcgttctagaattaatctcgagctatctaacagtaaaaaaagatcgaaactcattgctttaccttctgtagaatcccttcattttgtcatttagtactccattgaaaccaagtttcagaactcccactccatggggaagaatctcaccaaactcaagcacgagaatctcatcctcctcaaacaagacaacttttggagctgcaagcgcctgcttaacaaaacataagaagcaacaacaagctaaatctttgctgattccagattcaattccaatccatgacagttttctaaagttgaggattggtttttcagtcgaacagaaaagtctggctgaaacgtgattgtatctctctagttaatttaccattggaatcaaaaatcatagatgatgatatccaaatactcagatcaagaagctaatcatgaaaatgaatatctccaaggcgctaattagctcaaaaccataactccaatcacattgctaaaatcggaatccataacagcaaaaaagaaacgcgatagagagaccttagaggaggaaggaggagtgaaggaaacggaggcatcgttgacggagagatcagctgcgttgagaacgatgaaacgagtatcggcgactatgtcgagatcgatggctacagttccagtgaaggtgcaggcgatgagatcgggattgaggcggagatcgtagcgcttggggacggcgaacttgggtagacgaggctcacctttgaactgatccattttctattacttgcagatatgatttttttttgttttctcttgttggagttttgtcttttataatacgagggttgtaagcaattgttttatgttacgccacgcgagtgattcgtttctagtagaggacgcaacgttaataacatttacaaaacattcaataatatcactatcaaattcaatgacgttggattatccattagcatctccaagctaggccgaatatgacaaaatgtgttttgaccagtgaagaaatgtttaatcagattacacttgttcataagaagattcaatgtcactactactcgtcaactcaaagtcccgcggatctagtttgaacaacacacatttaatcgttctatatcctcaatcatctccttgatcagattcccaacatcccctgagtcccatgttgtactgatgaccagggtgatcttcttggctcggcgtgtccgtttctcgaggagcatccgccatgttccacgtagcttcatcaggttgtagcctctgtcccttggagctcggccattatacttaacagtgagatgaagatgatctttattcccttatttatatcatcataataagactttaaaattttgaattgtatagtttctcttttttaatgttaatttcctctctttctttttttggtcaacgagactaatttagttttctttcttgcctagggttttcgtcttctgaaacgacgtcgttaggatctttccaatcgagttcttcccaagcttcgtcgtcgtcgtcgtctaggtcgggtgtttaaatttacggtttctgagttagacgagagactctcaatctcggagaatctgaggttttacgggatatcccgttttaatcaaattcagggtaaatttcaattctttttccttctgagatctgattttttttcttttttttttgggtattgaaattctattatccttgaaaagcttcatacttcttaaaactttgcattgtctgagtttcatttttgatacaatctctctatttgattctttctgcaactttggttatgttcatttatatttttagagtatcaaaaatgaatcttttagttgtcttttggtcatcttggattatatttctctgtttgtgatgaattctgaagcttgttgttgtgttagattcttattgtctcactgtttacatttttatccttttcttaagagtgatgatataggttttttttttttctgaattatagatagatggattttcagagttgctaaggtgggacagagtattagtggtgattgcaacgaca

SEQ ID NO: 3965 - DNA, 3000 bp, Unknown
  misc_feature (1)..( 3000): cDNA_ID_2156563_gDNA_ID_1620677_Annot_ID_164286 3000 nt of promoter + ATG
cagctgcataaacagacacactgcttctacttctaagccattttgagctattccggcaataactgaattccacgaaatcaaatctcgttcactcatattgtcaaatactgtcctagcgaaaccgaattttctcagtttacagtacatgtttattagactattcgaaacagtaagcatcaaatcaagtcctaacttcaatgccatacaatgaacttgctgccctaatgctaaactatctactttaacagctgtagctaacattaaaataaatgtgacttgatcacattccacgtcggactctaccatatccgcaaaacatttgagaagagctgaatactggcctgaatggagatattcactcaatcctttgttcctgaatattatttctgaaacagaagaagcatcattaccatttgcaaaggatttcacttgtcctgcatcagaatcatcacctgaaattctagcaagtaaacgcagagtgatttcattgggatttaaaccacttgaatgaaatgcagaagagaggtctattgcttcttccttaaaacccatttccagataagccttcaacatcaagttccataacaccacatctctataaggcatctcctcaaacaaaaccttaccttccttaaccttaccaaacttcaaatatatgttaacaagagctccggcaacaaattcatcaccgtccaaaccaatcttgcaagcatacccatgaaatgactctgaagcccacacatacccagaatgcaaacaaagtttcaacattggagacagagtcattcgactggtatacacaacgtcctggcgtaatatcctgaaaagaagaaaagcttgttgaatgttctcgacaacgcattcggaagactgagcataggcagctaaaatcgagttccaggaaacaagatctctgtcaggcattttatcgaacactcggcgagcataagtgagtgatccacacttggagtacatggagatgagattgttaatcaggaatcgttctgggttttcctcgaaggttaggatacgtgcgtgtgtacattttccgagcatcaagtccgacgaggtgattgcattccgaagaaagccgaaccattgtgacgaagacgaggaagatgaagacggcgaagcagcagaagtaaaacgcagaggacggagacattgaacaatgagagatgtgtgaaaggagaaagggatggccttggaggttgatcgcatgatcgggttaaaaatgtaaccttttaaagttgagaggtgttatcttgcaaaccaagcaactcatgagatggtaaccggtttttgcgtaatcttgtctccggagattccaattagcatttgaccaaattaattggttcaaaattaaacctaacaaacaagttttcttatttaatcgacgcttagacaaccaattaaagtttatttaatcggcgcctatacaaccaattaatttttccatatgcccgttaacttatattcatgtgctttaaaaggttaaaaatacaactatattttgatcaaaagttaatgtacgtgcctaaaatagtttaaaaaacaactgtagtcgtttgtgcttttggtccaatccttatagcttttatacctctctttaagttgggttaggtatccctttatcggggttgggtcttttaagtttcagtttttaaaaatatttgggcttgacccattttgtaatgttccatcttatgataaaaagtcaataaacagatctttaggcaaaaaaaaagaaaaaaaaactgtacagtagtgaacaataagttacacaacaaatgaaatctcgacccacgcgctgcaggtcctctcaattttaaatttatgaaaaaatccccaaaaaggagggttatagtccacggattatagtctcacgcgctgcaacgcgcatgtgatgcgagtggttttgtatttttaattcctacacgcgtgtagttctatttgaataaacttcaccaatcacaaccataatcgttctatgtttctttttgaataaacacttcggatttcctatatttcggactccaattcggattttcatggctaaggttgtctgaataaattaattcctatgaatttaacacgaaaataaaaatacaactatatatttgctcgtattaaaaacaaaaatatataaaagatttttttaaaaagatagaaaaccccttaaactaatacaatgtacgctcaggcaaccatgaaacacgttttaggctccaaccacctgaaaatctgatcttggcctaagaatattggacatatctaaacacaagttttaagatttgacacgaatttcgacataaataaggctttaaatgggggagatttatcatttgagtatagttttgtttttttggcagctgtaaaaattttgttattatatttttggaattttgttttgagacacaaaaatcgtaaaaacagtttttggattctctaccaaaaaaaaactcctagattttaggaaaacaaaatctttaagaagttgattaggtaataaactgttttttttttaatagtaaatctaagaaccgttgtctttttgtttggttcaacttcaaaaaccattgtaatatctagtttttttacatggactttagaaatcattcttgtacagattcaaggaaaaacaattatcgtgtatattaaagaatggaaacaaatataaaaatcacaccattccttcaacgttacatccctacacattgaatacgattatcttccatattatgatctttttaaaaaaaaagattttgtccatttctcaccctttctcatactctctttttttctcggacaagaaggctacagaaagatatgtcgctgtcgtcttacctcagcccgacgcgccttctagaaggctacctccgccgttgtctcagggcggcaggactgacgtcgcagacgctttccatagactctgaaacaaccatccacttctggggcccaccacctctagaccaccggagcgacgatgacagaccggtt

SEQ ID NO: 3966 - DNA, 3000 bp, Unknown
  misc_feature (1)..( 3000): cDNA_ID_1822624_gDNA_ID_1620677_Annot_ID_164283 3000 nt of promoter + ATG
gagagagacaagtaaaaagggaaagaatgtgtgttgtgcaacttcttcttcactactatccccaaaaccaaaactataacctgtgaacataaatattgactttaaactgctattctttgtctgattggagaaataattgagacaaaacagaatacaagtacataaaacaaaaataataatttatgacagcatttttggagttattcaatagggaattgactaaaaaaataacaaaaagaaaaacttaggccaactaacttttgtttgagttagctgaaataacgctaactagctaccttttttagttggcgtaagttttttcaccattgatgttcacatacaggagaattaaagtaaatcataaaaccaggattaacgcacggagagtgtggagatggcacggtcacgggtgtgaaataaaagatggagacaaaagcaaaagagaaagttaggagctgcctcttctcttctcttctctcttcaaaagtggcgattcgtgtgggttgtcttctcttctttctttctttctttctttctttttttttcattcctttttctttttctttttttattttaaacagttttacctttcgaataataaattaaaagtaactactttttcttttgctcgtgtttctcttatatatatacgtatcaaattaaaattccataaaacaaacaaatctcttttctcttttttttttgggcatcaagtcacatttgtcttttatcattttgtcaaacttggcgttgaattctccatccaagaatacaacaaccttttgtggtcatgtcatacaaatgctattgttctatggttatttgagtttgtgaaatctctcactttgaaagtgaatatattttttattttttttggtaaaaggttgagttgaaagtgaatatttataaatccaacatcatgtttctagatgcacattcaactcgaggttgttgcatgatgtttcatttaccaaaaaaatcatagtcaaattatgtaagcaaatgatattacagaaaagttttactagagagtttcagatttacacatgcacaacgttaaaaaaaatagcagaaaaaagaaagaagaaaagttctttatttgtgagaaaaaatgtatgaaaaaaaaagagatgggtgtaaaaagcaaaaggataggaccactgttactttgtagcctcgttgaggaatctcttctcgcatctcgacttttgtgccattgcaaagtcaatgcccagaacttgttcccaggccatctccaattaactacgtctatttaattaaacttttaaaagaaaacctaataaattaaacaaaagaaaagccgtcaacgaaatctaagcttgcagcgatatcgatgaactgataccaaaacaatgttcaagtttcactttcaaattgttttttcttgaaatagtttattgggtaaggcccatagatatttcataagaagaacacttgtcgaggttgaatcgtatgtctgcccaccgcggcccatgcatcctctgttggtagcataatcgttttaggccatactattgttcgtacacactgattttgaagtcacctttgtgcactccttaattcctaaattgaagaagcttgttctcattcttctttgggttacaaatgccaaggcaaaaggaacttgggccaaattaagacaacaactcaagcccactctctgcaaataatacttgggaatttttagtaaaacggtgcgtttcatccaagaatctattaatatccctaacttgaaatcatcatatacgtaacccaacatattaaagagttaataatgttaaaaaaagtctcagaagagagagacgtagagaacacggaaagtggtaactggtaagcgtcgtcatcgaggatatagtagctacgtgagcaaacgtcttcactcatctctgtctatttctcttcgaatacacgtaatacattttcgattggattgatcctccctcggtcctatccaagtatccatccacgtaaacaagagcttgttcctttcttgtttttgctttctttaaatagtaaaaatacttatttcatttgtttcgtttgatttcattattattgtctatggcattatatactatatatattatttttacaacattggctggctcacgttgttctcgtgtatacaacaaacttaattaatgtctctctattgcattagatagtttcggagcatatccattatgtgaaagccacattaagttataactaaaagtagttttcgaaagagcttaattaagttatgttctgtttcaaaaaaaaatgaacacgaggatttttttttttttttgacagatcattattaacaaaaatgattacctgaagaaaggggaaaataattatagctgattacagatcattattaacaaaaagaattcttgtcacatcatacattataacaagaaatattatattatattaatttaatctttcgctaacacgcccacaatatattaatcatatacgtaatttagcttataaaaaggacggaaagagattattactgcgcctaaaaaactcactaattccaaagaaaaaaaaaaacttgtattttttcttgacaaaccagctcacaggcattgcatgatcaaactcatcaggtacgttttgattccttcttccataattttcccatcttgaggaatgcaaatttggagagcgctttagctaaatcactgccttcattttttcactttggatttaataatttgcgttcctctcttcctctctgctctgttctgttctgttctgttctgatttgagttttcaattaatcgctcgagcaaaagctatttctcaactcgttaaatttctgttcccagtttgttcgattttcaacagtttcacattaaagtttgggtttttgatgtttggttgatgaaactcgaaatatgaaatgtttgtgaatctattccagggtgtttaaaataagggtttgttgttcatctgcagagattatatgtttttacatgaaagatg

SEQ ID NO: 3967 - DNA, 3000 bp, Unknown
  misc_feature (1)..( 3000): cDNA_ID_2156553_gDNA_ID_1620677_Annot_ID_164281 3000 nt of promoter + ATG
ctacacactacttcttattctaaattaacaatcatttgtcaattatcagcactttctttgttaatattttcaatgcagcaatcacaatcttcaggtgtaattttatattttggacaggccatagtgtttatccattaaggctcaatataattataaacctaacgcctcacattatcattcttttaatttaatcggtagttaaccgatcataatatagattaattacttttatatcttctgttagtccaattgtaattacaaaacctactctttaagttcttaaaaatttagttccggatggcaactactagttcatgttctaatcaacaagcattagtccattatcaacagtttctttgttaatattttcaatgcaacaattgtatggttgttacaaattttaataaggttatgataaactaatagaggaaccaaaaaattaaaaatcttacgtaatttactttaaatccaagggagatgactttaacttatacaaccaataatccccttagtgattataagcctaccacaatggattctatgcttagatgcagaatacaattaagctcctcactgcagctcctcctgcagggcataacccgtcctatcaaccttaccccttagtgtatctttctaagatctcagagttcttattgaatagatgctcagggaccagctcggtgagtctgaaaggtgattctaaaattagaggagaaagagtttgcccatgggttgatctctccagccaatatggctatccctaagatcacataataactctttgcttcttcattctacttgcaaagcttcactatccaaagaatccacttgtttactctctcttttcctcgtcacctgtcaaaccagaaggaattatctgtttagaaactagaacaaaagaaggcagaaaactttgtaaagagagtcataccgacttgttagggaaattttgagcattagtgaactttgaaggagcagaataatgagacttcttttgtagaatctcagagagacgccgctcgtttttctcttgcctaagtagatatctcaaggaaactgattcttgctcaagctttgacaccgtgatttccaatattgctaagctatccaaaagctcctgtgcctgaaaaaaatctctataaagttattaaagaaactcaatagcaaaaacaacaaataagatttttatatgtcggagaaagaggattgagtaccttatcaggaagttcacaaggcgaatccataaacggtgaactagaatgctcaactgcgctagttagagctaaccgtaagttaatctcctcttgtaactgctgctgcaatctcttaatctgtatcatcatcccaaatatcattaaccattaccattagcagtagtagtacaaacttttcagtggtttcttaaatgtgacttagttctataaataagtacgacaaagagaagcaagtgagggatctgagtgacttacatcttgttcaagctcacatttgtaccatagtttggtctttccatcaaatctaccactagtttgatcaatcatcttgctttcctgcttccaaaaaaaaaacaaaaatgcaatttcaaaacctttggcgtgaccataaccccctcaaaaccctagatttactaaatacattccaagaaatcagataagaataaaaggcagagatatatgagagagagaaagaggtacattacatcgagatcaggaaaaaacaaagagccatcaccagaagagtaagatcttctcgagaatgtaccagtcttcttcagatatctccggatcgagcttcccctgtatcagaaaacatcagcaaaccaaaaaaacaaaacaaatcgggagcatagagagaaggaagaagaagtatagatttagagagagtatatataccaattgatgggaagacgaaaagtggcatttccgaaggtgcgatcggtgctaggagaagaagaagaggaagcaaggttttgatcttcatgaagagcttcggctttgatacagagcatcgtttgtcacggagcagagaagaagaagaaagactctgaagaaagaaaggttccaactttgaggtttttttattattgtattgaagacagaagagtttggttgggttctctcactgctcacacttcactctctttcctttttttggtctgtcgcttttatgattttgtaacataaaattataagtagaaaaaagctgaaaagggaaacgaaggaatttattcgtgtctcacacaatttgactaggtgctcctcattttcataatttcattttacacacttttttttttggtcaaacatttacattgtctctatattttctagtagtatattatttaatagaaaaagagaagaaatttcggtttcatattattgcttttcatttcattatattccatttcggtatttatttttccataaattacgaaaaatgcttcatgtgtttttgaggactcaatgtatcatgtgtagggtaaatgatgacgcagataaacaaacagtggaatatctaactttaacatgttctttttctgaatcggactcaaaagaaagacctgattgcaacatatgagtcacacactcacatagagaaaaagattccaatcgtatcaaagagtgaaccgtattatggtttagtcaatttgacacaaaaccggatcaacccaatcgaaccagcctcaatgacaattttgggaccgacttttaaagacgtgtgtctctttattgtcgccgttcaattggtaagaggccacggcgtaatcgtaggacgacgacgaaacatatttttctttagtgtttattttatttttgtgttgggtttcagtttcaaagagtcccaccaatgaccaaaaagtgctccaatgcatgattattacgttggagcctcttcgatagagagatttttgctttctcaatttattattttttgtgtctctctctcgcccgatttggagtttttagggtttgatttttgtaatgtgagaaaggtttcgtt

SEQ ID NO: 3968 - DNA, 3000 bp, Unknown; identical to SEQ ID NO: 3963
  misc_feature (1)..( 3000): cDNA_ID_3072264_gDNA_ID_1620677_Annot_ID_164275 3000 nt of promoter + ATG

SEQ ID NO: 3969 - DNA, 3000 bp, Unknown; identical to SEQ ID NO: 3772
  misc_feature (1)..( 3000): cDNA_ID_1821876_gDNA_ID_1620677_Annot_ID_164271 3000 nt of promoter + ATG

SEQ ID NO: 3970 - DNA, 3000 bp, Unknown; identical to SEQ ID NO: 3774
  misc_feature (1)..( 3000): cDNA_ID_1821880_gDNA_ID_1620677_Annot_ID_164269 3000 nt of promoter + ATG

SEQ ID NO: 3971 - DNA, 3000 bp, Unknown; identical to SEQ ID NO: 3775
  misc_feature (1)..( 3000): cDNA_ID_1821883_gDNA_ID_1620677_Annot_ID_164266 3000 nt of promoter + ATG

SEQ ID NO: 3972 - DNA, 3000 bp, Unknown; identical to SEQ ID NO: 3764
  misc_feature (1)..( 3000): cDNA_ID_3071828_gDNA_ID_1620677_Annot_ID_164265 3000 nt of promoter + ATG

SEQ ID NO: 3973 - DNA, 301 bp, Unknown
  misc_feature (1)..( 301): cDNA_ID_3092966_gDNA_ID_1620677_Annot_ID_164292 3000 nt of promoter + ATG
ttcgagcttggaagattgaaatttgagatcttttgatcttgaatcaagcataaattctggattttgaagtttgagagtgacccagtgactttggtctgaatctcggaggtatcttattccaggtaaaatccattaacatctctctctctctctctcaagctcctttcttcttttaagagaagtttatgttgattttcgtggttaccattcatcttcagggatcaaggattagacttaatgcgattaagcaaatgggtttttcacgatgactctccttgttgttggggagattcaataaatg

SEQ ID NO: 3974 - DNA, 3000 bp, Unknown
  misc_feature (1)..( 3000): cDNA_ID_1822589_gDNA_ID_1620677_Annot_ID_164291 3000 nt of promoter + ATG
ttgttatactcataggcaaggtagtctgacaatatctgttaagaaactgcctgaattgctacctgggcaacgtgaagggaagatttggatgtggcatcggtgcctgaaatgtcctcggatcaatggctttcctccagccacacgcagaattgtaatgtcagatgctgcgtggggcctgtcttttggcaaatttttggagctgagcttttctaaccatgcagcggctagtcgtgtggccaactgtggtcattcccttcacagagactgtctccggttctacgggtataaatagatgcttcctaatataaatattttctgcggattgtttcacttgttattacacattactgattttccctcgtccaatatgtctgattctcaagtagcatcttgcgtaatgcaatcaggcttagcacttagtatatattacatcagatgtactgtctagataggctctgcataagtagtactgtagtgttggtcattcacttctctaattgtcatctatacggcaagtgtcagtctatgtttgacggttgtggccttgtattaaacaaccatgaccacgccagtaatgagtatcacttaaatttttcttaatgcagttttgggagaatggttgcttgcttccgctatgcttcaatcaatatttacgcagtgactctgccaccagcaaagctttattttaactatgagaaccaggaatggctccaaaaggaatcaaaagaggttacaagtttcccacatttttaatcgaatatttgtacatattcaacaaagccaggagtcttattttacttaattgtcatggtctgtatactataggtgattaaaaaagcggaagtcctttttaatgaggttcaggaggctcttagtcaaatttcagcgaaaactatgggcgcaggttccaagggcagcactcccaacaagatcaagctttctcttgaagaacttgcaggacttcttgagcaacgtaaaaaggaatataaggtagcctgtcatgtaacttacacaccattagaattaagaagaaatagagttgcatttggcgcattacatcactcacactcactctaactcacgcagacagaacccacccacctgcacactacacacacattcacacatacctacactcatacacacccccaccacgttcatacttctcacgaatcatgtgtgtaaaatatagacagagtcaaaactttttcttataaataattgtagaagcttgtctcataatctgctggcctttataggaacgagtcttttacatagcctctgtacctagagtcctttcttcactgtaggatgatttttcagttttctctgtatgcaataccgattaaggctgtcgctggttttcaggattcattgcagcaaatgttaaatgtggttaaggatggacaacctactattgatatccttctgataaataaacttcgaaggctgataattttcgattcatatgcttgggatgaatgcctagcaggggcggccaatatggtaagaaataactatttggaagctccgaagaattcagccccaaaagttatgggtcgtaacgtctccttagagaagctcagtgatgaaaaagtaaagtcgataccgacccatgttgcaatttgtaatgactctcttctccaggatgcagactacgaaacgtgtcttaaccaaggtaaatcatttgctgatactagtggcaaatttgctattcctgaagatgtaggctcagacagacccccagattgtaggatggagttcgaccctagtgaaggtggtaaagataattttgtagagtcttcgcaggtggttaaaccagcacacaccgagagccagtttcaagcaacagacttatctgatactcttgatgcagcatggataggtgaacaaactacttcagagaatggtattttccgtccgcctagcagagctgcttcaacaaatggaactcagatccctgatttaaggctgttgggttcagaaagtgagctgaactttaaaggaggccctaccaatgatgaacatacaacacaagttcagttgccttctcctagtttctactattcactcaacaagaattattcgcttaattctcgcaagcatatcatggctgaagaccggcctgtttatgtttcttcatatagagagcttgaatggcgaagtggtgcaaggctgctgcttcctctgggatgtaatgacttagtactgccagtttatgatgacgaacctactagtatcatagcttatgcccttacatcatcagaatataaagctcagatgtctggatcagataagtcaagagatcgcttggatagtggaggttccttttcactttttgattctgttaatcttctctcattgaactctttgagtgatttgtcggtcgacatgagtagaagtcttagctctgctgatgaacaagtctcgcagctgctacattcatcactgtatttgaaagatctgcatgcgaggatttcgtttacagatgaaggtcctcctgggaaagtgaagtactctgtgacgtgttattatgctaaggagtttgaagccctgaggatgatttgctgtccttcagaaacagatttcattagatctcttggtcgttgtagaaaatggggagcccagggtggaaagagcaacgtcttctttgcaaaaagtttggatgaccgttttatcatcaagcaagttacaaagacagagcttgagtccttcatcaaatttgggccagcttacttcaaatacctgactgagtccatcagtactaaaagccctacaagccttgcaaagatcttgggaatctatcaggtacgaaaaataacaaaatacttaactaacaatctctctgaactacatgataattgagaatgcttttgttcgactcaaaacataatttttcttgttatctcttttgttgacatttgacgagacccgttattctttgctaaatctttaaaggtttcatccaaacaccttaaaggaggaaaagagttcaaaatg

SEQ ID NO: 3975 - DNA, 3000 bp, Unknown
  misc_feature (1)..( 3000): cDNA_ID_1822593_gDNA_ID_1620677_Annot_ID_164290 3000 nt of promoter + ATG
tgataaataaacttcgaaggctgataattttcgattcatatgcttgggatgaatgcctagcaggggcggccaatatggtaagaaataactatttggaagctccgaagaattcagccccaaaagttatgggtcgtaacgtctccttagagaagctcagtgatgaaaaagtaaagtcgataccgacccatgttgcaatttgtaatgactctcttctccaggatgcagactacgaaacgtgtcttaaccaaggtaaatcatttgctgatactagtggcaaatttgctattcctgaagatgtaggctcagacagacccccagattgtaggatggagttcgaccctagtgaaggtggtaaagataattttgtagagtcttcgcaggtggttaaaccagcacacaccgagagccagtttcaagcaacagacttatctgatactcttgatgcagcatggataggtgaacaaactacttcagagaatggtattttccgtccgcctagcagagctgcttcaacaaatggaactcagatccctgatttaaggctgttgggttcagaaagtgagctgaactttaaaggaggccctaccaatgatgaacatacaacacaagttcagttgccttctcctagtttctactattcactcaacaagaattattcgcttaattctcgcaagcatatcatggctgaagaccggcctgtttatgtttcttcatatagagagcttgaatggcgaagtggtgcaaggctgctgcttcctctgggatgtaatgacttagtactgccagtttatgatgacgaacctactagtatcatagcttatgcccttacatcatcagaatataaagctcagatgtctggatcagataagtcaagagatcgcttggatagtggaggttccttttcactttttgattctgttaatcttctctcattgaactctttgagtgatttgtcggtcgacatgagtagaagtcttagctctgctgatgaacaagtctcgcagctgctacattcatcactgtatttgaaagatctgcatgcgaggatttcgtttacagatgaaggtcctcctgggaaagtgaagtactctgtgacgtgttattatgctaaggagtttgaagccctgaggatgatttgctgtccttcagaaacagatttcattagatctcttggtcgttgtagaaaatggggagcccagggtggaaagagcaacgtcttctttgcaaaaagtttggatgaccgttttatcatcaagcaagttacaaagacagagcttgagtccttcatcaaatttgggccagcttacttcaaatacctgactgagtccatcagtactaaaagccctacaagccttgcaaagatcttgggaatctatcaggtacgaaaaataacaaaatacttaactaacaatctctctgaactacatgataattgagaatgcttttgttcgactcaaaacataatttttcttgttatctcttttgttgacatttgacgagacccgttattctttgctaaatctttaaaggtttcatccaaacaccttaaaggaggaaaagagttcaaaatggacgtcttggtgatggagaatcttctgttcaagcgaaacttcactaggctttatgacctaaaaggctccactcgggctcgttacaatcccgatacaagtggtagcaatacagttttgctggatcagaatcttgtcgaagcaatgccaacatctccaatatttgttgggagcaaggcaaaacggcttcttgaaagagcagtctggaatgatacatcatttcttgctgtaagtttccagttgttactcttcttttaaaccgctttgaaataccgaacttgttcttgagctttacatagtaatgctgatgcaagatcttggtttgtttctggctgaagtcgattcacgtaatggattactccttactagtcggggtagatgaggaaagaaacgagctggttctaggaattatcgatttcatgaggcaatacacttgggacaaacatctggagacttgggtcaagacttcagggctccttggaggacccaagaactcaactcccacagtgatatcgccgcagcaatacaagaaaagattcaggaaagcgatgacggcttattttctgatggttcctgaccagtggtcgcctgccgcggttgtgccaagcaacagttcttcagcagaggtgaaggaggaagaagagaaagacaatcctcaagctgttggtaacaagtcctgaagtattttcagcaaacatacacaatattcagttagcaaatatagtttttattttttttggttggaatggtcttttgggtaatttgtgtttatgtattacccttggccttaagtgtggcatatgcctcttccatcgcctttgcatcagaattaataaaagaaagatgcaattgtacagacactgcttctatcttttagtgtttgttattcgtcgtaacttatgtttttatcaacaattcttcttggttagtctttcaaatgctctcaaatcattttattaaatttctcgaacgtttgtttaaagatgggatccttgaagaaatatgttgtttgatcagattgagttctaaaattacatcttgaattttgtagatagtcccaaccaaatgcatcacacatggggactaaactaactttagagtgtttctctaatttctacttaaacaaaaaaccctaagtgaaacttgaacaaacgaatgaatcttagggacttattttgactcatcacttataagtcttaacgcataaattttagtttcgtataggaagctaaacttagaaggcgtgaaattggctcaaaacaatatgcatcaatcaaaacagaggaaaataaataaacacaagaaaaaatagaaagactgatcttcttccattttaacctccctgccttagcttgcttctaaggcagaggaaaattcaattttcttctctcaaagtgacaaaaagacagagaaaaagttttaagcaaaaatg

SEQ ID NO: 3976 - DNA, 3000 bp, Unknown
  misc_feature (1)..( 3000): cDNA_ID_1822597_gDNA_ID_1620677_Annot_ID_164289 3000 nt of promoter + ATG
ctggaaaaagctttcactgatatgaccctttcctattgttaagacctcaagattcctgaaacagatcaaaagcattacgtttgatatataataactaagttatcgaaagcatatccgagggtaaacaagacagatacctcaaagtggtagcggctttcatagccagagcattaacagcaggagcgccataaacattaacttcagtagcatttggatagcgactacacatgttttcaactgcacataaagcacaggaggttatattgtatcccacgtatatttccacaattagcaactgtttttttgttttcctcaaacggcaaataacagaaaagacagatttaatgtatgtatgaagaacaacttacattgttccatagaaatccttatattttcaaagttcaagaccctccagaaatcctcatgagcactagctactctccactgccgacataccatagcagagcgacagaggtcgacatgattcaagaacgagaatacctgaaagaaagaaaatttttaaaaaaacaaaaaaaaggatacttacatgtatttatcttaaaatgcaagaaagaaaaaaagaataccatatgtaagaggtcatcagtcaaatcaatatgaacttcaaaatcttctgtgtctgaagaaccattatcatctccatcatcctttttcccatctttccgattataattcaagatgaaattctggcagaacatatcagtatccgtccgggaagaagaggcaatgccaaaactaacagttctctccaccgacgaaacagaatttccagcatctgaagatacccccgaaactgacctgcactcactgcaattgaacttcatagtcagaaacacatgaaatcagacagacgaataaatgacagattaaggattgatgtcaactaaaatatcactcttgatgacgctgataagccttaaacaaaacaaaaatccaagaaatcgattctacactaaagtaattgaacaaaacagagtttacgaatcatgcatgatacaaaagtaagagagctcacgcaagcccagagtagactttggcacgcttgtgatacgaatcatgatcagcttcctccatcgtacaatcctctgcttctgcaaccacattgctactactctcaccctgaaccaactgattcaagggaatctcagaggtccaaaagcgatccaattcagcccaagcggcttcactttcctcggcacacagcctcagcctccaacgtgggactcttggtgccctctcgttttcaccgaaattaacaaaatcaccatcgccgttactgttatccatggccgttgctaaagattgtttcttcactctgccgccgttatcgtcttcctcgtcttcgtcttcgtcggtgaagcaagaaaaacaccaaatcctcatgcaacccctaagcccacctccccaaaaacgaaatcttgtctctcgatctaccacatttatagaaaacttgctcacaaaaaccagaatttggggaaaagtaacggaattcggaaagcccagatagaattgagaggaaacagaattgaatctctaattctggatttaaagtgacgggaaggagaagatcaaacgctaatctgattcaggattagggtttgagagaaatgaaaaggtagaatcggatcagatcttgcgaggggcgagtagaggcatattgtgaggtttctttggaagaaaaggtggtcgatgatataatctggatgccgattcggaagaagaagcaaaataaaaatcggcgaaaatggaaagggaatgataaaaattaaaaagacaaaactaatcgcgaaacacaagggactttggaagtctttggttcttgcttcaccgttgtttttgttcagaaaggacgatgtaaaaacggtgtcgtttgacaataagtactactgtgtgtaaagtagatagatagatactctgaactctgaatactaggatattataacaatgtttagttcgtacgataaaataatggtttagacacaaccgtttatgtttgggtcaaagttacaaaatttgcgtcacgtgagcagtcgactgaaaatcgaagatagtcaggcgtcagtaggtagaccgagccacaactgtagtatattgtattagcaatttagcatacgtaacgtacaaatacttgttgttttagtattttggtgatgttatcgttttgtgatttaaataaaaaaatttttgtttttattcaatcaaaattctaaatttttttatcaaaatttgatattactagtttaagatttgtaaaaaataatctaaaatcttcataaatctgaagttattggattcatacttttataaaattattttgaaaagtttatattatttaattaaaacaaaataaagtatgattgctaattaattaaaattattgtattattgatttatgactttctaccatttttttgtgttaaattctatcattttcttcacaaaataaaatcatcaaaataaagaaattgattgaaaaagtttcaaaattataaaaaactaatcaacaatattatataaaactctgtgtttaaaataattcatttatttacgttcgatgatattattaaagttaataaagtttgggatcactaatcaaaattcatttccgagtaaaaaacacagacatcacatcactgtaacttttgtaccagcgaaacccacattaatattggggttgtttctctttatggcccaatggctatatcttcgttgtaactaggtcacgtgagccattgacttttcgcccaatatttaagcccatttaaaggcccaatatttaagcaacactcatatacaacatgatgataaaattaaaaccgttgaagtatgtaattaagattgagatgacggtggatgtgtgaaacagctgcttccggtgtgctagtgccccgataggaccaaagctgagaatataattgaatatgtggacggttgagttataattaggagaatctcataaatattattgaaatatcaacg

SEQ ID NO: 3977 - DNA, 3000 bp, Unknown
  misc_feature (1)..( 3000): cDNA_ID_2156571_gDNA_ID_1620677_Annot_ID_164288 3000 nt of promoter + ATG
ggtacatcatcttttattggagtcgtggagagtttaactaaataaattccaaaccaatagagttgtttgttgtacaggtgcatcgtatatcttgttttacaagaatatacagtaattgctgttttgctgttttatgtacataacatttataatctaaaatctttatcaaagcaaaaaaatacaacatttataatctaaatttttttatcgaagaaaaaaaaacatttataaatttttatattacattttgtatttatatgtataattgttttatattattctgatttgtatatataattattacaaataaatcaaccgaacatctggactgattaatgagtcgcttaactgttaaatgggcaccaaacattcctttgtcatttgatcaaaaatcatggcatttgaatataaacaactgagtttaaaaatctttctcttttaattggttggaatggaaaaggcaacaagttatataccaagtaatcacactctttctaaacatagcaaccagtttcacaaacgtcaattttatcctactttccatataccggcaataagcatatctatatcccgtttgtttgtttctttttgttaatttaagttgtcgattactcaaatttggttattatcatcttttcaaatttcacccaagaaaatatgtattgatttaatctcataacagtaattttgacctcgtgatcagagttaaaaaaaggtttatgcattcaaagtttccaactctataaggatgtgataaaactagagagattgatatatgttgtaaactagagtttaagcctttaaggtaccttttggattctcagaagcagaagcagaccaagtgagctcctctgaagaaaagtcaagcagatcaaggcaatcggaaaccgcattctgcagccggcgatctccgctgaaatcagcgaactgagacaaaattgaactcacttgtcttatcactaccacaattgtgtttatggagctcacaaactcgcttgccggaactttcaagtagtcatattgaaaattctcctccgatggagacacacagtcccaacatcaataagatcaagaaatacttcaaacatgacattttgtaggaataataaataaaatagttagaaaaagaaaagaaagttttgtggtttttgatgatatcgaagatcttctcgagtcagtggaacctataaaagaaggagatgtattaaattccaaccacctctctgtccacttctaaacagttagtctaatctttaatattgggacttaacttcattatcccacccaacatttgcgttccttcatcgttgatatttcaataatatttatgagattctcctaattataactcaaccgtccacatattcaattatattctcagctttggtcctatcggggcactagcacaccggaagcagctgtttcacacatccaccgtcatctcaatcttaattacatacttcaacggttttaattttatcatcatgttgtatatgagtgttgcttaaatattgggcctttaaatgggcttaaatattgggcgaaaagtcaatggctcacgtgacctagttacaacgaagatatagccattgggccataaagagaaacaaccccaatattaatgtgggtttcgctggtacaaaagttacagtgatgtgatgtctgtgttttttactcggaaatgaattttgattagtgatcccaaactttattaactttaataatatcatcgaacgtaaataaatgaattattttaaacacagagttttatataatattgttgattagttttttataattttgaaactttttcaatcaatttctttattttgatgattttattttgtgaagaaaatgatagaatttaacacaaaaaaatggtagaaagtcataaatcaataatacaataattttaattaattagcaatcatactttattttgttttaattaaataatataaacttttcaaaataattttataaaagtatgaatccaataacttcagatttatgaagattttagattattttttacaaatcttaaactagtaatatcaaattttgataaaaaaatttagaattttgattgaataaaaacaaaaatttttttatttaaatcacaaaacgataacatcaccaaaatactaaaacaacaagtatttgtacgttacgtatgctaaattgctaatacaatatactacagttgtggctcggtctacctactgacgcctgactatcttcgattttcagtcgactgctcacgtgacgcaaattttgtaactttgacccaaacataaacggttgtgtctaaaccattattttatcgtacgaactaaacattgttataatatcctagtattcagagttcagagtatctatctatctactttacacacagtagtacttattgtcaaacgacaccgtttttacatcgtcctttctgaacaaaaacaacggtgaagcaagaaccaaagacttccaaagtcccttgtgtttcgcgattagttttgtctttttaatttttatcattccctttccattttcgccgatttttattttgcttcttcttccgaatcggcatccagattatatcatcgaccaccttttcttccaaagaaacctcacaatatgcctctactcgcccctcgcaagatctgatccgattctaccttttcatttctctcaaaccctaatcctgaatcagattagcgtttgatcttctccttcccgtcactttaaatccagaattagagattcaattctgtttcctctcaattctatctgggctttccgaattccgttacttttccccaaattctggtttttgtgagcaagttttctataaatgtggtagatcgagagacaagatttcgtttttggggaggtgggcttaggggttgcatgaggatttggtgtttttcttgcttcaccgacgaagacgaagacgaggaagacgataacggcggcagagtgaagaaacaatctttagcaacggccatg

SEQ ID NO: 3978 - DNA, 3000 bp, Unknown
  misc_feature (1)..( 3000): cDNA_ID_3072252_gDNA_ID_1620677_Annot_ID_164287 3000 nt of promoter + ATG
cttgttggctgtcgtgctgttacttctcttgagttgaagtgccctcgcatagagcagatctgtttggatggatgtgatcatcttgaaactgcattcttccaacctgtgagtgttacttttctcatatcaaataaccaacatatcttaactgatggatttcttgcttcttccttcttgttgtgaataggtcgctctgcggtctctaaatttaggaatatgcccaaaattgagtgtgctcaatatcgaagcaccttatatggtgtcccttgaattgaaaggttgtggtgtactgtctgaagcatccattatgtgtcctttattaacatctttagatgcgtctttctgcaggtaattatttgtttttttttttgtttttttctctatttatgtgactgatattatcgtgctgctaatcattttcccccattccagtcaactgagggatgactgtctgtctgcaaccactgcttcttgcccactcattgagtcattggtgctaatgtcatgcccgtctattggctctgatggcttgtcttccttgaacgggctcccaaatttgactgttcttgatttatcgtacactttcttgatgaatttggaacccgtcttcaagtcctgtattcaacttaaggtaattaaggcattaagacttgtatgatgctggatgtttccctttccgtcagcagtagagcatatacattatcttgccaatgaaaacttcttgagttatgttgttgtgtgcattctttgtatatcagctattcatgattcatattgcttttgggcttactttgagactttttattgtttaggtactcaaattacaagcctgtaagtatcttactgactcatcattggagcctctatacaaagaaggtgctttaccggcacttgaggagttggacctgtcatatggaactctctgtcagactgcgatagatgatctacttgcgtgctgcacacacttgacccatttgagcttgaacggatgtgtaaacatgcatgacctggattggggttcaaccagtgtacatctttttgattactttggggtctacagttctagtgacaatacccaggaaccagctgaaacagccaatcggttactgcaaaacctaaactgtgtgggttgccccaatattagaaaagtgctgataccacctgcagctcgcttttaccatttatcaacactgaacctttcgttatcggtcaatctgaaggaggttgatctcacctgttccaacctggttttacttaatttaaggtttgagcttttgcatttgctagataacttatattctttatcttccatgaaatgagtggtcttattctattgctaattccatttcgaattgtctagcaactgttgctctctggaagtattgaagctcggctgtccaagattagctagtctctttcttcaggtatgtttttgctccgtaacttttaccactaaacacactttggtaccttaagcttgggtctatatgttaccactaaacacactttggtaccttttgtctttggtagtcttgtaacatggacgaagcaggagttgaagcggctatatcaggatgcagctcactcgagacattggatcttcgtttctgtccaaaggtactaacaataaacgagtgttaacttcgatattgaaaacttagcaagtaatccatttttatgtaacaattaaaaccttgtcttggtgaattaacagatatcctcggtgagcatgtcaaagttccgaacagtgtgccctagtttgaaacgcgttttcagcagtccaaatctcttgcaagattagggttttgcgccaaatgtttgattatatacaactttttctgcagattatagaaataatgtgttgtgtggtgtggtgtttgggttgtaaatggctccaagtcataagtttcagtagtgcatataggcctctggagtttgtactgtggccttcttaggatgcttgtgtgatgacacaaacctaaacaacattagtactttttttgtgtacgtggttgatgatattgttgctactgttatatgtagatcttatatttaccttatcaatttaccttttaagctttgatccacattgactcacataacaaagataaaaattaaataaaacttttggaataagtagggggtaagaaaaatttagtatattttttggaaactaaagtctaaaatatgaatgaaggaagaaatctggaatgtaaatttggactcatgcgtattggatgataataatttggacttcttcttcccccaaactcttatttggactctcatcaccatatatgaaattacaacaacaataatcgacaacaaattttggaatattttctctataaaagagatctagtaattataataaatataaataaacctcactaactatcgtttaagaatgttatattcaaatattgccttctacatttttgacttactatttttaatttgctaaattactaaaaataacaagtttttagcgtcagtaaattaactacacagtttgttttactaatgtgaaatcaattttgcgagtaaggattaaaccctataaatgattcgaatcaaagataataaacttggcatttactccggaatgtgacgtaaatttttatccctaaaaacttctgtgtttttgttttggatctagtcttcttttgttttttaatgcaaaatccgagagggcgggaagtaattgttgttgttgatgctcttttttttttttgttgcttttgggaacttttttgggtagcggtttaagtaactttgaacctttaaaaaaaaaaaactccacagtagtaaaatttcgccccttctctctctatctccttagggtttctcaattcttcttcattttgaaatttgaaaaattctctggcgcaacctcacggactctctttctctctctatgactcttgcttcccccaatctaattctctagggttttctcgtcgagctcttcacgagttcatgagaaattgtcttccaatg

SEQ ID NO: 3979 - DNA, 3000 bp, Unknown
  misc_feature (1)..( 3000): cDNA_ID_1841049_gDNA_ID_1620677_Annot_ID_48277 3000 nt of promoter + ATG
cattctagttcaccgtttatggattcgccttgtgaacttcctgataaggtactcaatcctctttctccgacatataaaaatcttatttgttgtttttgctattgagtttctttaataactttatagagatttttttcaggcacaggagcttttggatagcttagcaatattggaaatcacggtgtcaaagcttgagcaagaatcagtttccttgagatatctacttaggcaagagaaaaacgagcggcgtctctctgagattctacaaaagaagtctcattattctgctccttcaaagttcactaatgctcaaaatttccctaacaagtcggtatgactctctttacaaagttttctgccttcttttgttctagtttctaaacagataattccttctggtttgacaggtgacgaggaaaagagagagtaaacaagtggattctttggatagtgaagctttgcaagtagaatgaagaagcaaagagttattatgtgatcttagggatagccatattggctggagagatcaacccatgggcaaactctttctcctctaattttagaatcacctttcagactcaccgagctggtccctgagcatctattcaataagaactctgagatcttagaaagatacactaaggggtaaggttgataggacgggttatgccctgcaggaggagctgcagtgaggagcttaattgtattctgcatctaagcatagaatccattgtggtaggcttataatcactaaggggattattggttgtataagttaaagtcatctcccttggatttaaagtaaattacgtaagatttttaattttttggttcctctattagtttatcataaccttattaaaatttgtaacaaccatacaattgttgcattgaaaatattaacaaagaaactgttgataatggactaatgcttgttgattagaacatgaactagtagttgccatccggaactaaatttttaagaacttaaagagtaggttttgtaattacaattggactaacagaagatataaaagtaattaatctatattatgatcggttaactaccgattaaattaaaagaatgataatgtgaggcgttaggtttataattatattgagccttaatggataaacactatggcctgtccaaaatataaaattacacctgaagattgtgattgctgcattgaaaatattaacaaagaaagtgctgataattgacaaatgattgttaatttagaataagaagtagtgtgtagttgtcatccggaattaaaactgaagagttggttttaaattttaattacagttggtttttggggccttattatgtcttttaatcagtagtttaccgattatattattataatataaattaataacttttatctattttgttagtcaaagtcctaaaatatttttgaaagcccattaatgtcctaaatcggccctgttccaaattttttggcttagcaaaatggtgatatccgattataagcacggactaaaaagataagataaggttttgttaaagttttattgttaaaatttatatatggtagtataaattatatttaaaaaagttataattagtagcgatatatagtatgtttttggaatctttaaaaccaggtcacatggaagtgtcgaacaaaagaataagataatacaggtaattaacaatccttagtgggctgaacgttgaattaagaaataaagccacgagtttggttttcttgttatttaatttacgtctctctctatttatatgtttaacgttacacttattaagatcgtaccttagggaaaaaacactcaacagacaaaaaaaaaaaggaaggcgcatcagtgatggagaagattattgacgtagcttatggtgcatcagtgaaggcgggtttgacgttgttggagaagaatctgttgccggatcttgtcattaggcggctcatacgtctgcttttggccagtcgtctccgttccgtttacaaacccacggcggagatgcaactctccgatctcctccgttttgttgactgtaagtgacactgaaacatatatagttgctccttttcaacatctagattttatttatttatttgagattatagtttacaaagctattatagagaactagcagattttattaattttgctttggtgttattgagtgattattatgacgatttttaaacatctggtgtgtgtgttgcaagttgttacacttacacatacatagtttgtgtagggttttgactgtatacacttaacatgacgtttttaccatctccaatgtctatttctctattttttcttactttagagtcgattatattttaaaggtattttactttaagatcatctctaatagttgtttctattttcttctaaatatattaaaaaataaggatctttattttagaaataaaaatatagataagttgaactgaaataaatacaaaaatatagtataaagataaaaatagagttgaaaatactctaatatatgttttaaaatagagtttactctaaaatagaggagaaagataatgtatatctctataaagtaatctaatgtctctcctctattttaaaagaaattatatattagaaatttacattaaagcaaaaaatatctaaaatatagttaattctaaaatagaaaaacatatagagatgaacattagagatgctcttagcgccgcacaactgtgaaacaaaaagtagtttagagatattgttgtcgagtgatccacgaaaacaaaatttcttcttcttttaatatatttgtataatttttaaaaaattagatgtcagtttttttgggttaattggatctccggtctctaagcctctaagactaattcaaatgaaaaatatatacatttggataattagaacattttatagtttgtcacataatataatttgcaaaatgtaaagaaatgttttataaatgtcttgtgaatgatgtatacttcagctctaaagaagatg

SEQ ID NO: 3980 - DNA, 3000 bp, Unknown
  misc_feature (1)..( 3000): cDNA_ID_1822628_gDNA_ID_1620677_Annot_ID_48279 3000 nt of promoter + ATG
ttttcaatgcagcaatcacaatcttcaggtgtaattttatattttggacaggccatagtgtttatccattaaggctcaatataattataaacctaacgcctcacattatcattcttttaatttaatcggtagttaaccgatcataatatagattaattacttttatatcttctgttagtccaattgtaattacaaaacctactctttaagttcttaaaaatttagttccggatggcaactactagttcatgttctaatcaacaagcattagtccattatcaacagtttctttgttaatattttcaatgcaacaattgtatggttgttacaaattttaataaggttatgataaactaatagaggaaccaaaaaattaaaaatcttacgtaatttactttaaatccaagggagatgactttaacttatacaaccaataatccccttagtgattataagcctaccacaatggattctatgcttagatgcagaatacaattaagctcctcactgcagctcctcctgcagggcataacccgtcctatcaaccttaccccttagtgtatctttctaagatctcagagttcttattgaatagatgctcagggaccagctcggtgagtctgaaaggtgattctaaaattagaggagaaagagtttgcccatgggttgatctctccagccaatatggctatccctaagatcacataataactctttgcttcttcattctacttgcaaagcttcactatccaaagaatccacttgtttactctctcttttcctcgtcacctgtcaaaccagaaggaattatctgtttagaaactagaacaaaagaaggcagaaaactttgtaaagagagtcataccgacttgttagggaaattttgagcattagtgaactttgaaggagcagaataatgagacttcttttgtagaatctcagagagacgccgctcgtttttctcttgcctaagtagatatctcaaggaaactgattcttgctcaagctttgacaccgtgatttccaatattgctaagctatccaaaagctcctgtgcctgaaaaaaatctctataaagttattaaagaaactcaatagcaaaaacaacaaataagatttttatatgtcggagaaagaggattgagtaccttatcaggaagttcacaaggcgaatccataaacggtgaactagaatgctcaactgcgctagttagagctaaccgtaagttaatctcctcttgtaactgctgctgcaatctcttaatctgtatcatcatcccaaatatcattaaccattaccattagcagtagtagtacaaacttttcagtggtttcttaaatgtgacttagttctataaataagtacgacaaagagaagcaagtgagggatctgagtgacttacatcttgttcaagctcacatttgtaccatagtttggtctttccatcaaatctaccactagtttgatcaatcatcttgctttcctgcttccaaaaaaaaaacaaaaatgcaatttcaaaacctttggcgtgaccataaccccctcaaaaccctagatttactaaatacattccaagaaatcagataagaataaaaggcagagatatatgagagagagaaagaggtacattacatcgagatcaggaaaaaacaaagagccatcaccagaagagtaagatcttctcgagaatgtaccagtcttcttcagatatctccggatcgagcttcccctgtatcagaaaacatcagcaaaccaaaaaaacaaaacaaatcgggagcatagagagaaggaagaagaagtatagatttagagagagtatatataccaattgatgggaagacgaaaagtggcatttccgaaggtgcgatcggtgctaggagaagaagaagaggaagcaaggttttgatcttcatgaagagcttcggctttgatacagagcatcgtttgtcacggagcagagaagaagaagaaagactctgaagaaagaaaggttccaactttgaggtttttttattattgtattgaagacagaagagtttggttgggttctctcactgctcacacttcactctctttcctttttttggtctgtcgcttttatgattttgtaacataaaattataagtagaaaaaagctgaaaagggaaacgaaggaatttattcgtgtctcacacaatttgactaggtgctcctcattttcataatttcattttacacacttttttttttggtcaaacatttacattgtctctatattttctagtagtatattatttaatagaaaaagagaagaaatttcggtttcatattattgcttttcatttcattatattccatttcggtatttatttttccataaattacgaaaaatgcttcatgtgtttttgaggactcaatgtatcatgtgtagggtaaatgatgacgcagataaacaaacagtggaatatctaactttaacatgttctttttctgaatcggactcaaaagaaagacctgattgcaacatatgagtcacacactcacatagagaaaaagattccaatcgtatcaaagagtgaaccgtattatggtttagtcaatttgacacaaaaccggatcaacccaatcgaaccagcctcaatgacaattttgggaccgacttttaaagacgtgtgtctctttattgtcgccgttcaattggtaagaggccacggcgtaatcgtaggacgacgacgaaacatatttttctttagtgtttattttatttttgtgttgggtttcagtttcaaagagtcccaccaatgaccaaaaagtgctccaatgcatgattattacgttggagcctcttcgatagagagatttttgctttctcaatttattattttttgtgtctctctctcgcccgatttggagtttttagggtttgatttttgtaatgtgagaaaggtttcgttatgttaaagaggcactctatcgccattctctccagaatcgcaagcttcgattcccataaaaccctt

SEQ ID NO: 3981 - DNA, 3000 bp, Unknown; identical to SEQ ID NO: 3966
  misc_feature (1)..( 3000): cDNA_ID_1822624_gDNA_ID_1620677_Annot_ID_48280 3000 nt of promoter + ATG

SEQ ID NO: 3982 - DNA, 3000 bp, Unknown
  misc_feature (1)..( 3000): cDNA_ID_1822620_gDNA_ID_1620677_Annot_ID_48281 3000 nt of promoter + ATG
atatatatatagaagaaaaaaaggaactctttttaatgcaaattcccacacctcaggttgtttgattccaagtataagcccacaatcagacaaatcatcagaaatttcacacccaacatcttcatacaaggcatcatgatggatacgcttagcagatggctgaaccacaatgcgggaaatgccggttctgtctttcccaccgtgtaaaaggcgagcgcaatgcgatggcgtcaatggtgttcgtctctcccatttgttaactgtttcagctagaatccccacaactccattccccaacttcttctcctcctcatggccatttgaattcatctttcatgtaaaaacatataatctctgcagatgaacaacaaacccttattttaaacaccctggaatagattcacaaacatttcatatttcgagtttcatcaaccaaacatcaaaaacccaaactttaatgtgaaactgttgaaaatcgaacaaactgggaacagaaatttaacgagttgagaaatagcttttgctcgagcgattaattgaaaactcaaatcagaacagaacagaacagaacagagcagagaggaagagaggaacgcaaattattaaatccaaagtgaaaaaatgaaggcagtgatttagctaaagcgctctccaaatttgcattcctcaagatgggaaaattatggaagaaggaatcaaaacgtacctgatgagtttgatcatgcaatgcctgtgagctggtttgtcaagaaaaaatacaagtttttttttttctttggaattagtgagttttttaggcgcagtaataatctctttccgtcctttttataagctaaattacgtatatgattaatatattgtgggcgtgttagcgaaagattaaattaatataatataatatttcttgttataatgtatgatgtgacaagaattctttttgttaataatgatctgtaatcagctataattattttcccctttcttcaggtaatcatttttgttaataatgatctgtcaaaaaaaaaaaaaaatcctcgtgttcatttttttttgaaacagaacataacttaattaagctctttcgaaaactacttttagttataacttaatgtggctttcacataatggatatgctccgaaactatctaatgcaatagagagacattaattaagtttgttgtatacacgagaacaacgtgagccagccaatgttgtaaaaataatatatatagtatataatgccatagacaataataatgaaatcaaacgaaacaaatgaaataagtatttttactatttaaagaaagcaaaaacaagaaaggaacaagctcttgtttacgtggatggatacttggataggaccgagggaggatcaatccaatcgaaaatgtattacgtgtattcgaagagaaatagacagagatgagtgaagacgtttgctcacgtagctactatatcctcgatgacgacgcttaccagttaccactttccgtgttctctacgtctctctcttctgagactttttttaacattattaactctttaatatgttgggttacgtatatgatgatttcaagttagggatattaatagattcttggatgaaacgcaccgttttactaaaaattcccaagtattatttgcagagagtgggcttgagttgttgtcttaatttggcccaagttccttttgccttggcatttgtaacccaaagaagaatgagaacaagcttcttcaatttaggaattaaggagtgcacaaaggtgacttcaaaatcagtgtgtacgaacaatagtatggcctaaaacgattatgctaccaacagaggatgcatgggccgcggtgggcagacatacgattcaacctcgacaagtgttcttcttatgaaatatctatgggccttacccaataaactatttcaagaaaaaacaatttgaaagtgaaacttgaacattgttttggtatcagttcatcgatatcgctgcaagcttagatttcgttgacggcttttcttttgtttaatttattaggttttcttttaaaagtttaattaaatagacgtagttaattggagatggcctgggaacaagttctgggcattgactttgcaatggcacaaaagtcgagatgcgagaagagattcctcaacgaggctacaaagtaacagtggtcctatccttttgctttttacacccatctctttttttttcatacattttttctcacaaataaagaacttttcttctttcttttttctgctattttttttaacgttgtgcatgtgtaaatctgaaactctctagtaaaacttttctgtaatatcatttgcttacataatttgactatgatttttttggtaaatgaaacatcatgcaacaacctcgagttgaatgtgcatctagaaacatgatgttggatttataaatattcactttcaactcaaccttttaccaaaaaaaataaaaaatatattcactttcaaagtgagagatttcacaaactcaaataaccatagaacaatagcatttgtatgacatgaccacaaaaggttgttgtattcttggatggagaattcaacgccaagtttgacaaaatgataaaagacaaatgtgacttgatgcccaaaaaaaaaagagaaaagagatttgtttgttttatggaattttaatttgatacgtatatatataagagaaacacgagcaaaagaaaaagtagttacttttaatttattattcgaaaggtaaaactgtttaaaataaaaaaagaaaaagaaaaaggaatgaaaaaaaaagaaagaaagaaagaaagaaagaagagaagacaacccacacgaatcgccacttttgaagagagaagagaagagaagaggcagctcctaactttctcttttgcttttgtctccatcttttatttcacacccgtgaccgtgccatctccacactctccgtgcgttaatcctggttttatgatttactttaattctcctgtatgtgaacatca

SEQ ID NO: 3983 - DNA, 3000 bp, Unknown
  misc_feature (1)..( 3000): cDNA_ID_1822605_gDNA_ID_1620677_Annot_ID_48285 3000 nt of promoter + ATG
tcgctagcaagtctttcccttgttggctgtcgtgctgttacttctcttgagttgaagtgccctcgcatagagcagatctgtttggatggatgtgatcatcttgaaactgcattcttccaacctgtgagtgttacttttctcatatcaaataaccaacatatcttaactgatggatttcttgcttcttccttcttgttgtgaataggtcgctctgcggtctctaaatttaggaatatgcccaaaattgagtgtgctcaatatcgaagcaccttatatggtgtcccttgaattgaaaggttgtggtgtactgtctgaagcatccattatgtgtcctttattaacatctttagatgcgtctttctgcaggtaattatttgtttttttttttgtttttttctctatttatgtgactgatattatcgtgctgctaatcattttcccccattccagtcaactgagggatgactgtctgtctgcaaccactgcttcttgcccactcattgagtcattggtgctaatgtcatgcccgtctattggctctgatggcttgtcttccttgaacgggctcccaaatttgactgttcttgatttatcgtacactttcttgatgaatttggaacccgtcttcaagtcctgtattcaacttaaggtaattaaggcattaagacttgtatgatgctggatgtttccctttccgtcagcagtagagcatatacattatcttgccaatgaaaacttcttgagttatgttgttgtgtgcattctttgtatatcagctattcatgattcatattgcttttgggcttactttgagactttttattgtttaggtactcaaattacaagcctgtaagtatcttactgactcatcattggagcctctatacaaagaaggtgctttaccggcacttgaggagttggacctgtcatatggaactctctgtcagactgcgatagatgatctacttgcgtgctgcacacacttgacccatttgagcttgaacggatgtgtaaacatgcatgacctggattggggttcaaccagtgtacatctttttgattactttggggtctacagttctagtgacaatacccaggaaccagctgaaacagccaatcggttactgcaaaacctaaactgtgtgggttgccccaatattagaaaagtgctgataccacctgcagctcgcttttaccatttatcaacactgaacctttcgttatcggtcaatctgaaggaggttgatctcacctgttccaacctggttttacttaatttaaggtttgagcttttgcatttgctagataacttatattctttatcttccatgaaatgagtggtcttattctattgctaattccatttcgaattgtctagcaactgttgctctctggaagtattgaagctcggctgtccaagattagctagtctctttcttcaggtatgtttttgctccgtaacttttaccactaaacacactttggtaccttaagcttgggtctatatgttaccactaaacacactttggtaccttttgtctttggtagtcttgtaacatggacgaagcaggagttgaagcggctatatcaggatgcagctcactcgagacattggatcttcgtttctgtccaaaggtactaacaataaacgagtgttaacttcgatattgaaaacttagcaagtaatccatttttatgtaacaattaaaaccttgtcttggtgaattaacagatatcctcggtgagcatgtcaaagttccgaacagtgtgccctagtttgaaacgcgttttcagcagtccaaatctcttgcaagattagggttttgcgccaaatgtttgattatatacaactttttctgcagattatagaaataatgtgttgtgtggtgtggtgtttgggttgtaaatggctccaagtcataagtttcagtagtgcatataggcctctggagtttgtactgtggccttcttaggatgcttgtgtgatgacacaaacctaaacaacattagtactttttttgtgtacgtggttgatgatattgttgctactgttatatgtagatcttatatttaccttatcaatttaccttttaagctttgatccacattgactcacataacaaagataaaaattaaataaaacttttggaataagtagggggtaagaaaaatttagtatattttttggaaactaaagtctaaaatatgaatgaaggaagaaatctggaatgtaaatttggactcatgcgtattggatgataataatttggacttcttcttcccccaaactcttatttggactctcatcaccatatatgaaattacaacaacaataatcgacaacaaattttggaatattttctctataaaagagatctagtaattataataaatataaataaacctcactaactatcgtttaagaatgttatattcaaatattgccttctacatttttgacttactatttttaatttgctaaattactaaaaataacaagtttttagcgtcagtaaattaactacacagtttgttttactaatgtgaaatcaattttgcgagtaaggattaaaccctataaatgattcgaatcaaagataataaacttggcatttactccggaatgtgacgtaaatttttatccctaaaaacttctgtgtttttgttttggatctagtcttcttttgttttttaatgcaaaatccgagagggcgggaagtaattgttgttgttgatgctcttttttttttttgttgcttttgggaacttttttgggtagcggtttaagtaactttgaacctttaaaaaaaaaaaactccacagtagtaaaatttcgccccttctctctctatctccttagggtttctcaattcttcttcattttgaaatttgaaaaattctctggcgcaacctcacggactctctttctctctctatgactcttgcttcccccaatctaattctctagggttttctcgtcgagctcttcacgagttcatg

SEQ ID NO: 3984 - DNA, 3000 bp, Unknown
  misc_feature (1)..( 3000): cDNA_ID_1822601_gDNA_ID_1620677_Annot_ID_48286 3000 nt of promoter + ATG
tagtctttttctatatctatgtaaataaacttgtataactatatattactacgatacaccatgatccatgaacgatcatttattctatttttgcatggtacatcatcttttattggagtcgtggagagtttaactaaataaattccaaaccaatagagttgtttgttgtacaggtgcatcgtatatcttgttttacaagaatatacagtaattgctgttttgctgttttatgtacataacatttataatctaaaatctttatcaaagcaaaaaaatacaacatttataatctaaatttttttatcgaagaaaaaaaaacatttataaatttttatattacattttgtatttatatgtataattgttttatattattctgatttgtatatataattattacaaataaatcaaccgaacatctggactgattaatgagtcgcttaactgttaaatgggcaccaaacattcctttgtcatttgatcaaaaatcatggcatttgaatataaacaactgagtttaaaaatctttctcttttaattggttggaatggaaaaggcaacaagttatataccaagtaatcacactctttctaaacatagcaaccagtttcacaaacgtcaattttatcctactttccatataccggcaataagcatatctatatcccgtttgtttgtttctttttgttaatttaagttgtcgattactcaaatttggttattatcatcttttcaaatttcacccaagaaaatatgtattgatttaatctcataacagtaattttgacctcgtgatcagagttaaaaaaaggtttatgcattcaaagtttccaactctataaggatgtgataaaactagagagattgatatatgttgtaaactagagtttaagcctttaaggtaccttttggattctcagaagcagaagcagaccaagtgagctcctctgaagaaaagtcaagcagatcaaggcaatcggaaaccgcattctgcagccggcgatctccgctgaaatcagcgaactgagacaaaattgaactcacttgtcttatcactaccacaattgtgtttatggagctcacaaactcgcttgccggaactttcaagtagtcatattgaaaattctcctccgatggagacacacagtcccaacatcaataagatcaagaaatacttcaaacatgacattttgtaggaataataaataaaatagttagaaaaagaaaagaaagttttgtggtttttgatgatatcgaagatcttctcgagtcagtggaacctataaaagaaggagatgtattaaattccaaccacctctctgtccacttctaaacagttagtctaatctttaatattgggacttaacttcattatcccacccaacatttgcgttccttcatcgttgatatttcaataatatttatgagattctcctaattataactcaaccgtccacatattcaattatattctcagctttggtcctatcggggcactagcacaccggaagcagctgtttcacacatccaccgtcatctcaatcttaattacatacttcaacggttttaattttatcatcatgttgtatatgagtgttgcttaaatattgggcctttaaatgggcttaaatattgggcgaaaagtcaatggctcacgtgacctagttacaacgaagatatagccattgggccataaagagaaacaaccccaatattaatgtgggtttcgctggtacaaaagttacagtgatgtgatgtctgtgttttttactcggaaatgaattttgattagtgatcccaaactttattaactttaataatatcatcgaacgtaaataaatgaattattttaaacacagagttttatataatattgttgattagttttttataattttgaaactttttcaatcaatttctttattttgatgattttattttgtgaagaaaatgatagaatttaacacaaaaaaatggtagaaagtcataaatcaataatacaataattttaattaattagcaatcatactttattttgttttaattaaataatataaacttttcaaaataattttataaaagtatgaatccaataacttcagatttatgaagattttagattattttttacaaatcttaaactagtaatatcaaattttgataaaaaaatttagaattttgattgaataaaaacaaaaatttttttatttaaatcacaaaacgataacatcaccaaaatactaaaacaacaagtatttgtacgttacgtatgctaaattgctaatacaatatactacagttgtggctcggtctacctactgacgcctgactatcttcgattttcagtcgactgctcacgtgacgcaaattttgtaactttgacccaaacataaacggttgtgtctaaaccattattttatcgtacgaactaaacattgttataatatcctagtattcagagttcagagtatctatctatctactttacacacagtagtacttattgtcaaacgacaccgtttttacatcgtcctttctgaacaaaaacaacggtgaagcaagaaccaaagacttccaaagtcccttgtgtttcgcgattagttttgtctttttaatttttatcattccctttccattttcgccgatttttattttgcttcttcttccgaatcggcatccagattatatcatcgaccaccttttcttccaaagaaacctcacaatatgcctctactcgcccctcgcaagatctgatccgattctaccttttcatttctctcaaaccctaatcctgaatcagattagcgtttgatcttctccttcccgtcactttaaatccagaattagagattcaattctgtttcctctcaattctatctgggctttccgaattccgttacttttccccaaattctggtttttgtgagcaagttttctataaatgtggtagatcgagagacaagatttcgtttttggggaggtgggcttaggggttgcatg

SEQ ID NO: 3985 - DNA, 3000 bp, Unknown; identical to SEQ ID NO: 3976
  misc_feature (1)..( 3000): cDNA_ID_1822597_gDNA_ID_1620677_Annot_ID_48287 3000 nt of promoter + ATG

SEQ ID NO: 3986 - DNA, 3000 bp, Unknown; identical to SEQ ID NO: 3975
  misc_feature (1)..( 3000): cDNA_ID_1822593_gDNA_ID_1620677_Annot_ID_48288 3000 nt of promoter + ATG

SEQ ID NO: 3987 - DNA, 3000 bp, Unknown; identical to SEQ ID NO: 3765
  misc_feature (1)..( 3000): cDNA_ID_3072275_gDNA_ID_1620677_Annot_ID_164263 3000 nt of promoter + ATG

SEQ ID NO: 3988 - DNA, 301 bp, Unknown; identical to SEQ ID NO: 3973
  misc_feature (1)..( 301): cDNA_ID_1822589_gDNA_ID_1620677_Annot_ID_48289 3000 nt of promoter + ATG

SEQ ID NO: 3989 - DNA, 3000 bp, Unknown
  misc_feature (1)..( 3000): cDNA_ID_1822677_gDNA_ID_1620678_Annot_ID_48290 3000 nt of promoter + ATG
ccataaagatagaatcaagtcagattttgctacttcgagaacattggtcaatgagtcaaaatgtcaaatagtcaatactaaaatcaaaattgaactttgtttattaattttgttctaatctatttaaccccacaaaagtttccaaaactgcttcactcaccaaaatagatctaaaacatggaaaccaaaaccctaattttctcaattctcttcgttgttctctctctcatttacttaattggaaaactcaagcgaaagccaaatctacctccgagtccggcatggtcattaccggtgattggtcatctccgccttctcaaaccaccgattcatcgcacattcctctccctctctcaatccctaaacaatgctccgatcttctccctccgactcggtaaccgactcgttttcgtgaactcgtcacactcgatcgccgaggaatgtttcaccaaaaacgacgtcgtactggcgaacagaccaaacttcatcctcgctaaacacgttgcgtacgattacacaaccatgatcgcagcttcctacggtgaccactggcgtaacctccgccgcatcggctccgtcgagatattctccaatcaccgtctcaatagctttttgtctattcgtaaagacgagatccgacgacttgtgtttcgtctttctcggaacttttcacaagtaagcgagctttaaaacttagttaattagctcttaatcacgaatttggatttaattaatactctgttttattctaactatactctgttttgtggactctctgttctgtcattgtaggagtttgtgaaagtggatatgaaatcaatgttatctgacttaacattcaacaacattttaagaatggtggccggaaaacgttactacggagacggtgttgaggatgatccggaggctaaacgtgtccggcagcttatagcggatgtggtggcttgtgctggtgctggaaacgctgttgattacttaccggttttgcggttggtttcagattacgagacacgggttaagaagttggcgggtaggctcgacgagttcttgcaaggattggttgatgagaaacgagaagctaaggagaaaggaaacactatgatcgatcacttgcttactctgcaagaatcccaaccggattacttcacggatcgtatcattaaaggaaacatgctcgtaagtaccctttttcgatcaattctttagatcactccttgtcatattttggtatgaaacatgctagtttagtgacgtgtatgtgtgcaattttcaggctttgatactagcagggaccgacacatcagcggttacgttagaatgggcattgtcgaacgtgttgaaccatccggatgtattgaacaaggcgagagatgaaatcgatagaaagataggtttagacaggcttatggatgaatcagatatctcaaacctgccttatctccaaaacattgtgtctgaaacgttgcgcctttatcctgcggctcccatgcttcttcctcacgttgcctcggaagattgtaaagttgcaggatacgatatgccgcgtggcacgatactattgaccaatgtgtgggctatacacagagatcctcagctatgggatgatccaatgagcttcaagccagagaggtttgagaaagaaggagaagctcagaagctaatgccgtttgggttaggaagaagggcgtgtcctggttctggactggctcatcggcttataaacctgactcttggatcattgattcagtgtttggaatgggagaagattggagaagaagtggatatgagtgaaggcaaaggtgttacaatgcctaaagccaagcctttggaagccatgtgcagagcacgtccctctgttgttaaaatcttcaacgagtccgtttgacgtttagacttttggtaatggctatgtatacattagataactagttatgtttgtatgttttctttttttttggtgaaaatattatgtttgtatgttaatgtatatgtgaatatttaacctatattcctagatgatattttgggtatgtgatttaaaatatttaaggttgatgaggcttgtatgttattggtttctagcggacgcttgaaatttaatgttttaagttctctcacacgttgaacgatgctgatacgagcgataaaaatgatgaagatacaaaaccaaaactaaattttgctacggggaaatctactagcaataaataacaaagtgttttaactttaagcattaaaccaaaaaaaaaggaaaaaattagatattaagtatctccaatgcaaggttctcttgataatttgagagagttttcttgattttggtgattaaaataaaatcatcaaaactgattaaatttgagagagtaaactatttgaagagagattttggaagctgagggagccgtgataggttgaggagataaaacttaattcaagttcttaagtttgataaaatcaaaatttaaacttaaaaaagggtgagagcctttcatgtggttctcaacattagagatggttttataattgggatttggaagtaagcctctattctattgagagtttttggattggagatataaaatcatatttcttcaattctgtattttaattcattttatattaagggtataattggtttttaattttccttaaaacctatttcaccaaatttttatctatataaagtatagaggacaaacttttggaaaagatccttaatatacaatttccccaaaataaaggtgtatcaaagtgattttactataaaataatgtgtaattaacaaatgaaactgagttaaaaaagtcaaaaaatccaaatatcaacaaacaataaatgtgacacaagaaaatcatgtaacgttttcctcaatgagtccatttgtcaaaataaaaaattgggtttttgtttgagtctattttttgttctgtttttcaatctatttaagcacactagatttgccaacttcatcactcaccaaaatccaacgtgatcaatatg

SEQ ID NO: 3990 - DNA, 3000 bp, Unknown
  misc_feature (1)..( 3000): cDNA_ID_1838404_gDNA_ID_1620678_Annot_ID_48291 3000 nt of promoter + ATG
tcgtgttacaaatataaatggatggttaccgtggaattttagatagtattagattccaacattaaaacttcaaccggaaacgaatatatagttcaaattttctctagaatttacttctacaatatctatatttttttctcacgtaatttctacaagtaaaaagaatttaattaaaacagaagttgacgggaacgtcacatgactaaggtcggaacacagaacatagctttagttctgtagacacaattaatatgtctcttcttcttacaccttttgtctcgttcccactttttttctttttcttttcactcccctctaggttttgtccctcttctttccttttttgattacaaatgtaaaattttaatcttcttgactattactttagttgtaggaacatgcatatattgtaaaatttctttgatctctttgtctcaaccaaaatctttctttgatctctttgccccaaccaaaatcttttttatccctttagtttactatactatatgctctatatgctgttttttctttccacgatttgtcttggcttgtgaattttaaaaatacagtataatttaattaattagctacatttactcgtctcgtcttcatctttaaatttataagatgggcctgtaattgatcaagaataatgggcctattccattaacatacgggcctgaagtttttcaaagcaacattaatgaattaaacccattttattggaaatttagaagatggcttcgtcaccacttctcgccacgtcactaccgcagaatcagttatccaccaccgcaaccgccagattccgccttccgccgccagagaaacttgcagttctaatcgacaaatcgcaatcagtagatgaagtgctccaaatccacgcagctattctccgtcataacctcctcctccaccctcgttacccagttctaaacctcaagctccaccgtgcatacgcttcccacggcaaaattcgccactcgttggctttatttcaccagacgatcgatccagacttgttcctcttcaccgccgcaatcaacactgcctccattaacggcctcaaagaccaagccttcctgctttatgttcaattgctttcttctgaaatcaaccccaatgagtttactttctcgtcgcttttgaaatcttgctcaactaagtccggaaaattgatccatacccatgttcttaaattcggattggggattgatccttacgtggcgactggtctcgtcgacgtttatgcgaaaggaggagatgtggtatctgcccagaaagtgttcgatagaatgcctgagaggagtctcgtttcttctacagctatgatcacctgctacgcaaagcaggggaacgtcgaggctgcgagagctttgttcgatagtatgtgtgagagagacattgtttcttggaacgtgatgattgatggatacgctcaacatgggttccctaatgacgctctgatgctatttcagaaacttttggccgaaggtaaaccaaaacctgatgaaataaccgttgtagctgctctttcagcgtgttcgcagattggagcgctggaaactgggcgttggatccatgtttttgtcaagagcagtcgtattaggctcaatgttaaagtatgtacgggtttgattgatatgtatagcaaatgtgggagtttggaagaggcagttttagtttttaacgatactccaaggaaggatatcgtggcgtggaatgcgatgattgctggttatgcaatgcacggttatagccaagatgcattgagattgtttaatgagatgcaagggatcacagggttgcaaccaacggatataactttcataggaacacttcaggcttgtgctcacgctggtttagtaaacgaagggataagaatctttgagtcaatgggacaagagtatgggattaaacccaagattgaacattatggatgcttggtcagtctactcggtcgtgctggccagttaaaacgggcttacgaaaccataaaaaacatgaacatggatgctgattctgtcttatggagttctgttctcggaagctgtaaacttcatggagattttgtgttaggcaaggaaattgcagagtatctcattggactaaacatcaaaaactcaggaatttatgttcttctttcgaacatatatgcatcggtgggtgattatgaaggtgttgcaaaagtgaggaacttgatgaaggagaaaggaatagtgaaggagcctggtataagcaccatagaaatcgaaaacaaagttcatgaattccgagctggagatagagaacactcgaaaagcaaagaaatttacacaatgctaagaaagatcagcgagcggatcaagtctcatggttatgttccaaatacaaacacagtcttgcaggatcttgaagagacagagaaagagcaatctctacaagttcacagcgagagactcgcgattgcatacggtctaatcagcaccaaaccgggaagtcccttgaaaatattcaagaacctacgagtatgttctgattgtcatacggtgacaaaactgatatcgaaaatcacaggacggaaaatcgttatgagagatcggaataggttccatcatttcacagatggttcttgctcttgtggcgatttctggtaaaaccaaacaccacacattgtaatttgtacgtgaaaagaagatcaaagtgaacaaatttagttggattatctaaatatcattctttcatgggaattatgttgaacacgtggagggcattatttgtgaagttgaaacgaggactatttttcaaactttcttgaggaacaagacttgacttttgtaaccataaagatagaatcaagtcagattttgctacttcgagaacattggtcaatgagtcaaaatgtcaaatagtcaatactaaaatcaaaattgaactttgtttattaattttgttctaatctatttaaccccacaaaagtttccaaaactgcttcactcaccaaaatagatctaaaacatg

SEQ ID NO: 3991 - DNA, 3000 bp, Unknown
  misc_feature (1)..( 3000): cDNA_ID_1822669_gDNA_ID_1620678_Annot_ID_48293 3000 nt of promoter + ATG
cgaaattattggcggaatggttgttgccaagaagggtcccaagtctatattatccaaagatatcttcacaaatatcgtcagcaacgaaaaaccataaaataaatagtaacgacgccatgccttctttggatctaatctatatatctctctctttaacatagaataatcgtgttcttttttctttttttcttttttgatagaagttgaattggtcaaattttagtttgtacaaaactaaattcgcttactagatgtttttttttatgatcaaggaaatctcaggcaaaaaaagtaaaccaatcattaacatatgtaaaaaaaactgtaataatatgttgaaaaatagtcacacattgaaaagactaatcatttttatttttatcctctgtttgatttttgttctataaaatctaccaaaactatcgccaaaagtaatctaatgatcatgacattatcactcattcaactatggcgtccagtaaatgggctagattgaattaaatgtgcgagttataaattttgattgtcaaatttggattttaaaatggtcgtggaatattatcatttatcagtactattgcctacctaattcaagggtcaacttgagtactgtataatattgactttaattatatatggacaattgacaacaaattaacgtaaaaaggaccatataaaacaccctatgttttactgtctatatgaacatctatttcaaatttgttttgaaatttacataatatgttacatactaattaattgaatggtaattttgtacaggggacaataaatatcttttagtgaataagaatcagccttccaaaaatatattgataataattattattatagtagtcagcagccttcgaatatatctactattcatataagaaaaagctaatgccgttaaaacaaaatcctactaatatatgagatagttgaagtgactattctaatgaacaatttgctccagaagaaaatttgttcccgaaatgtctaatcaaagataatgcattatccgtgcgattagcctcttcctaaaatagcgaccaacgtctttttatttcgttaagttatttataattattggtccctttggctttttaatcttattgttaatattagtactatttaatcaaggcccacatgtcgagcgacccaacgccatgaccgaatttatattctatcaaatatgcatatatcatattgtttataaatggtcttggtgttgaaacataaatgtatatacagttgatgcattcgtttaaaaaaattccagagtcctattgtggtaaagaaatagactatatataatatagtgaaaactagtgttgtatgtctataacttcaaattagtctatttcagttttgacaaatcgttatccaataaacaaaatttagtaatcataccaaaaatgtagaaacctaattcaatctgcactgcggcataccatttaaaccccgaatgattaaactttattcattggtgattttttttttcttagtttgaaaatatggtttacctaaacaacggaaaacaaagaagaataaagttttgatgaattattgcaaacacaactacacaaggaacaacaagtaggagattaaagtctcgaaaccatattaaaaggagattggtgacataagtgctctgtaattaccgttgtttgtaaaaagaacgaattttcaggaaaaaaataaaatgaattaaatggagcaagttggggagggtacagcacgagcgacgatcatgaagccaattaccaaatgaaattgtgatttagggtgctgatattcataaacttgggttaagtcgttgtttaaaattgtgttttggctgttagcgatgaattatagtaaaacaagaaagagttctagtaaaaaacaaaaattgcttagtactaataaatttcacaagaccattcacactatacaacaataatccttcgttgccagcagtctaatgggactgtgttataggttaatctctctttcacggactattaatttttggctcaacctcaatgtaatttatttaaattatatttcaacgcatacacgtgaatttatacatcttttcataggatttgcaattccggattctcatccgtcctaggaggttgtatatgtatattattggtaactacagcattaaacaactttaacactaagtacgatgatattatatgtacatgtacgtatgctatagattgatataagaaaaaagtaaagagagagcggatgattgttgattgaactaattaacaatagtgtattaggtaggcttgtatccgacagtcaacttaaacttcatagttgaaaccaataaaaccagaagaaaaaaaatttatatactaatcataatcagcatgatgttagacgatttgatatctaactttcttcgttatgatagagaaataatattcgcaataaatcacatataaaaaaaattactttacgtcatagattatcaacttgcctccaaacacaacaacatgatcccctacgctacaatacataatatgaaaaataaattaatcgttgattaacttaaagtcactccgttaataacgttataagcaaagcttattagtttttttgaccgtcattatcgacgaccaaacaaagaaagagtcccaacaaattatgccacgtaagtccagaacgacgcctatgaaaccaataagacaaaaattcaaaaaccaaaacatccgtgaaaactcttacgtggcggtgacatgtgggtcccttatgtctccattaactaacataagcttattgtcgactgtaccttttgtcccccgtctcggctacaaccctgtgacaaacaaagatcaagtcaaaatatctaacctaaagtactctcgtccacgtggacattgctgacgtggaacttctcccttctataaatacaggcttctcttcgccgaattatactcatcaaacgagtaaaacatttgctaatattaaacactttttcttttagaaaaaaaaacaaat

SEQ ID NO: 3992 - DNA, 3000 bp, Unknown
  misc_feature (1)..( 3000): cDNA_ID_2999361_gDNA_ID_1620678_Annot_ID_48297 3000 nt of promoter + ATG
caagaggctgggttctcccacgcggcggtgtatggaaacgatacgtgcacctggatgatgtatcttgacgtagacgagtttctcttctctccggcttgggataaacaatcacaaccgtcggatcagatgattaggtctcttctaccgtcggatcagagcatgattggacaagtgtcgtttaaatcacacgagtttggaccgtctaatcagacaaagcatccacgtggaggtgtgacacaaggttacacgtgtcgacgagaagaagatcaacggcacaagtcgatcgtgcggctaagcgcggtagagcactcgctttacacggccatccaccacttcggtttgaagagagagtacgagtggcgcgtggcggacacggaggagggagtggtgaaccattacaagtaccaagcgtggcaagagttcaaggccaagtttaaacggcgtgtgtcggcttacgtggtggattggactagagtctctaatcctaagtcgagagatcgaactcctgggttgggctttaggcccgttgaaccggaaggatgggctcataagttttgtgaagtcgaggatttgagattgaagatattaaccagaaaatggtttgggtacccagttaaaaacggttataggatggcatggcagagatgatttttttttttattagatgggttcttttgttaatagcatagttgttttggtaacagttttttttctgtttttgtgaacaggtttgaagttttttgttaggtgaaagtacggaactcaaaatagtttgaaatgtgactagagttatttttgtctagtaatcccaatgtcccatttaaaatatctgaaattcggtttcaaaatataatttttcttcgtgatacaagacaaaagtaaagtataaaaaggtacattcagaggcctggctaccttatctgtaacaatcattgtattctaatcaatgaatgtattttatgagttcaaagaaagaaagaaaaaaagaagattggaaacgtacgtacgtataagtttctgtgatttggtgcgatgataatagtttacgtaattataaaccttttaaccatcttggacctcatcaataaaattcagaagacaacaacttcaaaggatatgaatagttgactaactgaaaacgtacgatgaagaaaatgcaaagcaaacaaaagaatgttatcaagagcggtggaaaagaaatgctttaatgatgtgattcaacatcagtacatcaccatactcgtgtacgcaactttaaaagttgtcaaaaaaaacagacatgtgatcaaatatgattcgcaaatgcatcgtacacatgtgacatgaacaattatatgacagaattttgtttttgttagtgacaaattttcttcttttttttttctttctgtagcggtagattccaattagtatgataagaaaccacatacatatatatacacctttttttcacgaccacaagaaaatatattattgtttccttcttctgcctccaacattgatatgctttcaaaattctctaatatgagttgtcttactgtttaggtgacttttgattcaatagaataattttcttttaaatcaatttatgaacacctcacggaaaatcatctaagcgcaatgatgtatgaatgaaacggttgaataattcttgattttatgtttaaaaacatataagcacctcgatcgcagcaagcatgggagtgtgatttgcacgtttcatatattctcctagtccaattctctaagagaaagatatcgatctatgagatgagttctatttattgttcggtgagttttaattgatcaaataaataactttctttgttaattaattaaacaccatgcgactatagtattactccatatacagagatgtatgattagtgaacacgattgtagtatcctcgatttctttttgttatcaatttcttttacaccttgatcacaatctgagtggttgttactacttattagcacgtttcatataaagtaaataattttatcaattaataatacatatatgcttcaagttgagagcaattaacgctgtcaaaacaacacaaacaaacattaacaatgaattttgggaaggtgtctctcatctatgattgattttaagatttgtttttccttctatatttgcaggaaggaatagttctatacaatcatcagctaaacttcaaattctttgtaatcgtagatgttaatagtaaactcgaatattccccaagtcatactaataaacaatgaaaattgaagaaaataaaagtcataaacaatgaagaaataaacaaattgcaatataacaatttcttacaattctcgacttttgcgcctttgagacatggtcaattaatattatgtatagtaatggtagtggacgagtggttgatatgtgaatccgaatttaatcccacatcacgaatttgaatgttttcgaatttctatattaaaaagttttaaaatggttgccaagttgtattggttcgagtatctttattccgagactagcatatggaaaagattaaagaaagaaattctagagtttgagtttagtagctttattggtggagttttgaattagattgatttatatggaaaacgtgaaaacttgcatgtgttcgaatttccatgtgaaaggttaaaaaattgttttcaagctggcatgggttaatatctttaatcttcgacgagcacatagaaacaaatttcagagtttttatttaacttaataatggagttttgagagaaatgataatcataatatggagaactcgaaatcgtagaagatgttttttgtttttttcctctggtcttttaaaacgaaaagcacaactttcaagttccactactaattgtcacgttacagatatgacatcactactttgatttgagtaaaattttctctataaataaaagaacaaacaaaccataagccaaatcctcgcacaagtagaaaaaaacacaaacatcctgaaactagaagagagagacaaa

SEQ ID NO: 3993 - DNA, 3000 bp, Unknown
  misc_feature (1)..( 3000): cDNA_ID_1822659_gDNA_ID_1620678_Annot_ID_48298 3000 nt of promoter + ATG
gccggattaggtcagaggattgtgacattggcgcttggatcgttgattcaatgctttgaatgggagaatgtgaaaggggaagagatggatatgtctgagagtactgggttgggtatgcgtaagatggatcctttacgggccatgtgtaggcctaggcccattatgtcaaagcttttactctaataagatgagtagaggttaaaaaagaaaaaataacttattggatgtaactggtaattatctttaagataaagatgaataaaatgaatctttgcctcataaataacaaataaataatagataatttagattctttttattgttaactaaattatctccataaaatactttttatatatatataatttattccagtaaaattgagtttaggatgttattttactaagatgcagttttcttatacaaacgatttcaaagcttattttccgatataaaaattaattttgcttaaatcctcaagaatttttttattccactgacgaaatttccaggcttcaaatctcgctgaaatgaaaaataaagttagcaataagcaaataatcagtttaaaatacgtatcagaataataaaataacatgattttaaactaactagcattttctataagatactaaaaatgttagcaattgcgttttaacgaatggataaattttcattttaactagttacatttaagtttactctaactagttacataagatttagacttttttacaataattaataatcggaatcatgtcaaaactgaaaattttgtatgtgaattgtgaatgatacgtgactaaaatgctcgttgttgttctttaactgtgactttcataaataatcattgttatctatataaatttaccttccgagattgaactatatccaacgtcttctggaaatcttcctctcgacgtttaagttcagctagtgattcccactgatctggtatttccaggaaacgccttaaaaaagaaaattagagaaaccaatattaacgatttatccaaaaatacattatccatgtctattagaaatatttaataagcatatctataaaataagatatttactccaattgtttttccacttcggccagtcgtgcattgacttcttcgatctcatcttcgatctcctattttaagaaaaaaaaaagcatgcataagtactttaacttttttttgtttatatacctatatattgccaaatcatgagatttttattttattttaatcaacatgcctttggttgaattagataacgaagcccatcgtcaagactctcgtcactgcacttggtttctgaacgcatctgcatgaccaaccgttgtatattctagattctccataccaatcaagaaaaacaaaaaatttaggtaacgttaaacaaaatcactatacgaaaatcgagatgaattaaccgttagatagttttgatttttttaccggttcatgagggaggctgtgttcgatcagatggaccaaccgagtacaatatcaggagttcatgcatatgtataaaataagaatattagaactcatacaataaaattaaacaaacctattactttatgttcttatatataaatgcatgcattaacacaatgaatttaccgtgtgcgtacagcccgagcaagaaacttgcatataatctcttcgggtctataatcatgaacaataacgatgatttgatatcagatgatagtaataatatatatgatgaaataataaaatattggagctacaagaagaagaagaaaatgaaaacgtaatttattaatataatatacctctctttggcataaaagacgaagagtttaccagaaggagagaaaagaatgagagcaactggtacattacatagaacaaagagttcataagctttctttaaaagcccattttttcttttggcgaatgcaatatttctttgttgcctatcatttattcttttaatctgtatttttactctccccattttttcttgtcttcttttcacaatgttttctctttctcaattagctttcaaaatattttttataagtttatttatatagttatgagaaagaactttctatggctaaacttgtagattttccattaaattgtatcaaaattactaattactttaaattaaataaatttattaattaacatagaaccataatcttgtttgtcaatcaaaagatttagttttcttagttaatcttttcttctccagatatataaatgggtattatctattgcacatatattttataaattgaagtaaataattaatatatttataatataaagtaaatgttatattcattagattatgaatttggataagaaatctcatttattatggctcagtggcccatttcatcccatatatgaattgtgttatcaaaatttatgtcctggatgaattttttttaccaaatactatatgtaatgaaatgttttgaccaaatatatgtaatgaaaaaaataaaaaaaattgggtcaaaagggaaagaaatccttctctagaggataatggaccccacttgtgtaagataaaacagtctctctctctcccccacaagaaaaagcctcgaccacctaacgataatggtggctatgagatctccgtcttttctccgtcgtgtttctcaccgccgattataaaatacttatctactaccatctccttgtcggaaacggcgagctaagtcgattaggtatttattccttttatctcttttatctgttaaagctttcttagggtttttgtttttgttgttttgcatttgaaattgtgatctcatcgactatcaagcttcgaactttacattagggttttgtgtaaattcgtgttcttcttcactttctctttccaattcgacgcatatggatacgtgatgaaagttttcgaaaatttgttcaatttcaagtttagttctttatgactctactgattccggatttttctagggttttaattgagaagaaataaaaaggatattttggt

SEQ ID NO: 3994 - DNA, 3000 bp, Unknown
  misc_feature (1)..( 3000): cDNA_ID_1822652_gDNA_ID_1620678_Annot_ID_48300 3000 nt of promoter + ATG
ctgtaaatcgcgatattttaaataatttatttcctcttccacagatacgaatttttttataaagaataatacgtaacactctaaaacaacacaaatatcataatttctccacgaactgactaagagaggtaccaagaagaaaaccagagaagaatcttctttagagagatgggtgtggtagaagaagctcacaacgtgaaggtgattggttcaggagaagccacgatcgtgttaggtcacgggttcggcacggaccagtcagtatggaaacacttggttccacatctggtcgacgattaccgcgtcgtcctctacgacaacatgggagccggtacgaccaaccctgactatttcgacttcgatcgttactcaaatctcgaaggctactctttcgatttgattgcaatcttggaagatctcaagattgagtcttgtatctttgttggccactctgtttctgccatgattggtgtcttggcttctcttaaccgtcctgatctcttctccaaaatcgtcatgatctctgcttctccgaggtataactttttcacaagttgtacatagaaatatgttttgctttttatctcatcctgacatagtttagacaaaagggcttctctgttccttctcttgtctgatttcataaaaactattaaacattacaatttaaataaaaaaaaatcatcttaagtccttaaatttacacaattatctattatttcgaaatatttatttctcattctgacataatttcgacaaagtgcctctttgtttatcctcttgtctgaattatcctatttctcaaaatcagtgaagcatttcattatatatttcaataaaaatccgtaaattatgaacaaaaaatcatgaaatacccatttgtttatttgtttttttttatttggttttactgaggtgttacttacactttttttaaaaaaaattgttgaaacggtgctcacacagtatattatatattttaattttcttctgacaaaagaaacatatataatcaaattatattgttttggtacgtttatagatacgtaaacgatgttgattaccaaggtggattcgaacaagaagacttaaaccaactattcgaagccatccgaagcaactacaaagcgtggtgcttaggtttcgctccactcgccgtcggtggcgacatggactccatcgccgttcaagaattcagcagaacactcttcaatatgcgtcccgacatagctctctccgtcggccagaccattttccaaagtgacatgagacagatcttaccttttgtcactgttccgtgtcacattctccaaagtgttaaggacttagctgtaccagtcgttgtctccgagtatcttcacgccaatcttggctgtgaatccgtcgtcgaggttattccttctgatggtcatcttcctcagcttagctcaccagattctgttattcctgtcatcctccgtcacattcgtaatgacattgctatgtgattgtaagagatttaattagttaattattaaacgatgtaagaaaagttgaaaaaaaatatctgatgtgatatgtctgtctagtctattgagaacattatttcgttgtcgtttggttctgattcgtttatcttgagtatcttgatctttgttgttcttatcttgtttaacgaaaagtctctgtcttttgtccacagctttgctcagagctcattattgcttgatgtaatagtgatgttcgtaattgatggtccatagtgaattattgcaactttgcaagagtgcttgtgctatactgtgtgaagagtaattaacatgtgatactaggaattagcattgagtttgcatttatggatgggtaatccaaaccataaaacatacatattgtgatggttttgaaatttgtttgtttgtgaacaaaaattagccaagttttaaacaaagtaaaatgaaaatttagggttttgaattaggatggagttaagtcatattttgttaggtttgtttgcttatgaaattatggatttgtttgatgttattatagggatgcggtgcaaaagatattgttttctatattatcatttatcactaataactttcaaattttattgacgcgcctgctcagattttattcgatttgttgtttatgaaattagttatagattggtaagtaaatagctttaaaaaattagtgatacaaaacaaaatggtaaatattgtattgcttcttactagtcaatactatgattaaacttccattttataattcactttatataaaacttctatttattttcttaaaattattttattattgaaatttaaatatcatttggtacaatattatttcttcatcactagtcaaatactatgattagcctacccaaaaaaaaagtcaaatactatgattaaacttccatttttttaaaattcattgcaggtcatacaatttaaatgtttacatagtcatgaaagaattgagaacatatatatacttcaaatttgttctccaatacagtcacacacctaacttcaatttgcttagaatttctttggcaagacgattaacagagctagcccattgtaaaagggtaataaataataagtgggctaggcccatatatacacaacaaaaagtcacgtgacaagaaacttcatacgtgtgcgactcttgccccaaaatttgattagcaccacttattgagaagcagcagcagcaccacaagcaccaccaccagtatcacattcacattcaccatcatcgtctcttcgctcttatctctccgttacttttttatttactatctctctcttccccgttacttttttttcttccccgtttcgttctccgtcaaagtcttctctctttaccattttctccactgtactaatttccctttttacccctaaacccatcgttcccgtgacacgacggccacgaagaagagggataaaattgagaaagattaaataggcgattgatttctccatcggagacaccaccgctcaaaaaatg

SEQ ID NO: 3995 - DNA, 3000 bp, Unknown; identical to SEQ ID NO: 3369
  misc_feature (1)..( 3000): cDNA_ID_2156784_gDNA_ID_1620678_Annot_ID_164329 3000 nt of promoter + ATG

SEQ ID NO: 3996 - DNA, 3000 bp, Unknown
  misc_feature (1)..( 3000): cDNA_ID_2156949_gDNA_ID_1620678_Annot_ID_164323 3000 nt of promoter + ATG
ttttctgtacggcgtttctaacgatttgttcgacgttaggacaacttccggcgtagaagttacggcggagttgtgcggaggagaggtcgagggtgagacatagagagagaagaagcaataagagattcgttttgttcaccacaaccatttaaaaaaaaatattttcactcaatctctctatatgtgtataattacatgaatcgagtgagggatcttatatatatgcttttatgtgtgcgcacaagtagcgccggccagcttgcatatcattttttaaaagagaaaaagactaaatacttatctaattgttgacatcattttttgatggcttttttttactattgaattttttgttaattttaaaatatttgattagtatttacaaaaaaaagactttttccaattccattatttttgtatttttaaaatttaaaatgaatttttccaatttcgttttgttctctatcaatgtttgtgtgtgtatatgatcactaggatgatctatctatatgagggaatagagagtggtggtggtggggattgagagggataagttgaaaagtgaaaacgatgcttcacttgtcattgcgaataatatttgtgttatggccaccttgaatctttttgaaatctcaactactactcctgactattatacttttttggttcatatattagttaattagtctaatcaactacgataaccttaatcctaacaagtaatacctaaagctgatttaatgacagaaattcatatatagcctcatgtcttttttaccaaccatacaatttttacaaacgtccatttgcgtcttgctatttcattatcaatttaaatgtttactacgtacactacacatggtccgaaacagttgacatggtcatggctttattaagggctgttttactttgtttcagaagctaatggtttctagatttaaagttttctttatctatggttactggttaggcgataaattattgttattgatatagactttagttgacgtttaaaaaagaaacaaaaactttagttgacgagaatagttatactttaagagtttagagcagtcattcaaaatgggagactactgcatctgcatgcaagtaaaggcaatcacgcttctttctgttatttgtcatttatcttatattcttttctaagaaaaccatgtcctttatccaatcgatcgagaaaaatgataaatcatttaaccatatatatacatgtatgtcttaatcagtcaaaactttatgtctggctttttaaaatgcaagaaaattaattgatttctgggaagataattcatttgcgctgactgtaattttaaactaagaggacaacttcatacttaactaaaaatcgattaccatttttttttatgatggcaaggatctatattacatcagaatgacgagatcagaatgcaacaaaacaaaaaaaactatattacatatatagttgtggaaagatcagttttcaatataatgttcattctggatatagaggttaaacaagtcaggccataattagctaattattcaattttatcaaaactttacatgtctgtagcattcctctgctaaaaggcccgcatcatagagaaaaaaaagagacatgcacgttgtctttaatcaattaatctacatgttgtgtcctacaacattattaaatatactacagccaaaatgctatatgtttgtaagtcaatattaggatcgtttcgcatggagttacttagaatgcatgtatcattgtatcttgtcattaccttagcgattcactaaaattttccttctctattaaactctacacatacatgggtttgtgataaattttaattaaacactattaaactatagactctacacatacatgggtttgtaataaatataaaacagaaatttatgtgatcgagtgtaattgtagaacctaattcgttaatgagtatagtctttagattgcttcctgtcatagcatttttgtttatatatatacaataactaatgatatttgttagttacatgttttgatacaagtttcagtgacatgtatacctataagccgtgcttatgatttatgatgaaagttataacgccaataattacttagaaagagaggatctcatttccggtatgtttttcttttgtcaaccctttccaatatgtttaatatataatataatagtgttttgaattctataattggattctcattctttcaaatcgtttacaaaatactataatctaatttagatttaattttaccaattcattagattacttagataacacgcgtagagactcttgaccatgaaacagtaaacaatataatgtttgtacttaaataaaacaaatagttgtaagaaagaccaatataggatgacttgtacgttttctataatttttctaaataatgcaaatcggattaacatgtgccacgtgatttaaagaaaaaagaccaacacaaaaggaatctttttcctgcaaagtgtgacatatttatatataaagtatcatagattatatgattatatctatagtctattgtcatgattacgtattacatatgataattcatgctgcaatacaatacaatttatacaagcaaaataatatagattttgaatgcatgctatagaaaagtatccaacgtaacagagatccacatatagatttgagcatctttgaattttgaatgtgaaataatctaagtctaagctatattaatgatgatcatttcatactacaatgtcttacgggtcttgctatattattgggctttataataggcttttacgggcctgaatgatttacactgaaaccatgatccattagaaaaatctccccgccatgaccttatccatggaactctgcaatcttcttcgttaccattttcttctactgctgcaaaaatcgtgtcttttgcgtgttctcgagtcgaattggatgatttgattcttaatttttgtttgatagtaacagtctaaagaagcaatg

SEQ ID NO: 3997 - DNA, 3000 bp, Unknown
  misc_feature (1)..( 3000): cDNA_ID_1822644_gDNA_ID_1620678_Annot_ID_164321 3000 nt of promoter + ATG
tagattatgtttctgttgaatttgaagggaaaaagctaggttggcaagatattgctacttacaaggtaaataaaactgcatgatataacaaaatcacagtctacttctttggtctatctaacaagagtgatttctttattttttctcctgttgcttcagcctcctgaagatgctttattcgcacaccctaggctattcagagcttgtgttccaccgggaatgcatcgtttcagagggaacatatgggattttgacagcaaaccaaaagttatgcagaccctcggataccctttaacgatgaatgatagaatcaaggagataactgaagcaagaaacatcgaacttggactcggtttacaggtacaaaagctattacttctggctttgtcatgtgatatgttactttccttctctaaacttttttcacttaccttaaatcacacagctctgcttcttgcatccttcaaagcataagtttgaacacccgcggttttgttttgagcggctggaatatgtaggacagaagatacaggtgaggataacgatctctcatcttaaaagatcaaaagaacggttcttttctttctttctttttttttaacccgatttttcgtctcgggatcatgcaggacatagcaatggctgaacgtttgttaatgaagcacttggacgcaccagggaagtggttgcaagagaagcatagacgtctattaatgaacaaattctgcggccggtatcttagagaaaaacgtcttcacaactttataatatactcagaggaggttcatgatcggtatgaacataaccggagacttaggaatccggcgacaaccgctgtccaacaagccattcacggcctcgcctacaccatctacgggaaacccgatgttcggcggctcatgtttgaggttttcgacttcgaacaaatccaacctaaagctgtctgaaaatcgaagctgtctctctcatttgtctaatgtcttttagtatactactgggtttgatttatgtagttaaatgcttaattacctttggtgaaaagttgaaaactttaaactagcaaaatgagcttcatcagtataatcttaggttcatcagtttcaaatttgttgccaccaattcaaagagcttcttcttatggttgcataccttgagaagagaaactgaatgttgtgagtaaagtttcttcttaaggtattttgtagtttccaggtctgcaagtgagtaaagctcctggttaaatccatgtatgagctgcatctccccacttgagctcttctaaagctaccctcagcgaatggagttgaaattgtgtttagatgcaacaggctccaatttagctataatctgctcaacagcgtctaaaactgcagcaccatacatatcagagctcgcagaagcagcagtaggtgacgcgttaggaacctattaagaggcaatcaaaacgacaagggagcaataacagtgtgtgaggcatttggaacctattaagagaccacaaaaatgataagagagaacaatatcagttttgtcttggccaaaaagtccactgagtgcatgtaaccgagttagatgtaccttgtatgtgcttgtttctgacacaaaaactgaactaaggggaatgacacaacctttgtatgcaaatccttgacccatttcaacacctccatgtgtcaccaaaacagtcccattggtgcaaacatgaacaagagcaccggcctgtaataataatatgtgttggagtaagtatcttaaaatccagattctagatttgcaagcaaaggtagtgcaatgctgagatttccaaggaagcttcatcttattcttttacctttaaagttcctcgagagatgactaaatttgaaagaaaaaggattcacttctaacatgattcatgaactttgtggtaaatgaatatgacaattgtgtgggaaccatagctacaccacaccatgcaatgtgcggaagagagtgagattaatgtgtgatgggatctttgcagttgaaagttcatctcctaaagtcaagaaaacattaaactaacaaaatgaggacaaacttttaccaattttcacatttatagaaaaatattcaactcactttgatttcttcaggggctcagctgaatctagttttcaatggttgcagaacaaaatgaaaatgaaaattttagtatctcaaaatctagtttctattttttttggtgacattaatcaatgatttcaaaataactaaaaacctcagaataaactcaattccatcttaaaaccacacaactttcataaccgaggaatgacgaaaaacaaaataatagaggaggagcatcactactattttcatttttttagccaatcagagcgcaccagaaaacgcccactcgcaccaacctcgtgccacgcgctacagaccacgcccactcgcaccaacctcgcgttgagcgcgtgtcgtcgatttctgtaggggtaaacccacaaaatcatgcttattttacatctactcgctttgtttccaaaacagtctcgagtgacttttttttttgtttttttttctctaaaccgtactaattctaatgcaaaccgaaccaaaatcaattttcatttcaaaaccatgtaaaccaaacagagatcaacatctaactaaccggatttaactagcaatctaattcacacaaatcttttttttttttttttttcctatatccttcacagtcaataaaaagaataagtgggccgttgtgacttcaaaatcccaatagtgaaaaagcccgatttcgtgtctctacagccgtaaggcccgtaacaagcccacgacctctaatttttcaaaaacaatcagaccgttggggttcatttattttctttaattttgtttttatttcttataaaacggctcatcgtcctcaagaagcctcctatatagaagacgcccccactacttagactttttctactacaaacctgagattttagtctgagagaaagagaagagaacactaagatg

SEQ ID NO: 3998 - DNA, 3000 bp, Unknown
  misc_feature (1)..( 3000): cDNA_ID_2156878_gDNA_ID_1620678_Annot_ID_164320 3000 nt of promoter + ATG
agaagttttatataaagtgaattataaaatggaagtttaatcatagtattgactagtaagaagcaatacaatatttaccattttgttttgtatcactaattttttaaagctatttacttaccaatctataactaatttcataaacaacaaatcgaataaaatctgagcaggcgcgtcaataaaatttgaaagttattagtgataaatgataatatagaaaacaatatcttttgcaccgcatccctataataacatcaaacaaatccataatttcataagcaaacaaacctaacaaaatatgacttaactccatcctaattcaaaaccctaaattttcattttactttgtttaaaacttggctaatttttgttcacaaacaaacaaatttcaaaaccatcacaatatgtatgttttatggtttggattacccatccataaatgcaaactcaatgctaattcctagtatcacatgttaattactcttcacacagtatagcacaagcactcttgcaaagttgcaataattcactatggaccatcaattacgaacatcactattacatcaagcaataatgagctctgagcaaagctgtggacaaaagacagagacttttcgttaaacaagataagaacaacaaagatcaagatactcaagataaacgaatcagaaccaaacgacaacgaaataatgttctcaatagactagacagacatatcacatcagatattttttttcaacttttcttacatcgtttaataattaactaattaaatctcttacaatcacatagcaatgtcattacgaatgtgacggaggatgacaggaataacagaatctggtgagctaagctgaggaagatgaccatcagaaggaataacctcgacgacggattcacagccaagattggcgtgaagatactcggagacaacgactggtacagctaagtccttaacactttggagaatgtgacacggaacagtgacaaaaggtaagatctgtctcatgtcactttggaaaatggtctggccgacggagagagctatgtcgggacgcatattgaagagtgttctgctgaattcttgaacggcgatggagtccatgtcgccaccgacggcgagtggagcgaaacctaagcaccacgctttgtagttgcttcggatggcttcgaatagttggtttaagtcttcttgttcgaatccaccttggtaatcaacatcgtttacgtatctataaacgtaccaaaacaatataatttgattatatatgtttcttttgtcagaagaaaattaaaatatataatatactgtgtgagcaccgtttcaacaattttttttaaaaaaagtgtaagtaacacctcagtaaaaccaaataaaaaaaaacaaataaacaaatgggtatttcatgattttttgttcataatttacggatttttattgaaatatataatgaaatgcttcactgattttgagaaataggataattcagacaagaggataaacaaagaggcactttgtcgaaattatgtcagaatgagaaataaatatttcgaaataatagataattgtgtaaatttaaggacttaagatgatttttttttatttaaattgtaatgtttaatagtttttatgaaatcagacaagagaaggaacagagaagcccttttgtctaaactatgtcaggatgagataaaaagcaaaacatatttctatgtacaacttgtgaaaaagttatacctcggagaagcagagatcatgacgattttggagaagagatcaggacggttaagagaagccaagacaccaatcatggcagaaacagagtggccaacaaagatacaagactcaatcttgagatcttccaagattgcaatcaaatcgaaagagtagccttcgagatttgagtaacgatcgaagtcgaaatagtcagggttggtcgtaccggctcccatgttgtcgtagaggacgacgcggtaatcgtcgaccagatgtggaaccaagtgtttccatactgactggtccgtgccgaacccgtgacctaacacgatcgtggcttctcctgaaccaatcaccttcacgttgtgagcttcttctaccacacccatctctctaaagaagattcttctctggttttcttcttggtacctctcttagtcagttcgtggagaaattatgatatttgtgttgttttagagtgttacgtattattctttataaaaaaattcgtatctgtggaagaggaaataaattatttaaaatatcgcgatttacaggtggcaaaaaaaggtgaatggaaccatgtttgttggattgtcaaacatcgctattcgtgataatttgttttttggaatcaagcccaaaatattttggaacatttaatggagtacatgacgtggagttactgacttctgttcaacaataaaattgttacattgggttacaaatacatgaaccaattatttttaattttgtgcatgaatttcaacaatgcattaatgcgaaagaaaattagtttcaatcattcaaagagtggcagcaaatagtcaaaagctgatataattattattttaacaacactagttaaatttcgcatgtatacaacttgcaatgaatatagcatctaaaaacctcataatatttgtttttttctgcttgactttaacttgtcagtacttttcgatcatttagaagttagaagacattaattattcatggaatgccatggtgagtatacgaccacgtattcacatccacttcctcatcattttaagagtcaaaaatatctgtgagaggatcctggcccattaaaattcaaggcccatttagtgtaatatggcttcatgttctctctttcctaagaccgtttttactgttgaccaataaagtctgaactcgtgatgacgtggcgtgaaatcgagagacccacgtgtcatcggcgtgccgttatcctctttccacttccggtctccgttcccacctgagtaaaccatactggtcgtgaa

SEQ ID NO: 3999 - DNA, 3000 bp, Unknown
  misc_feature (1)..( 3000): cDNA_ID_4359769_gDNA_ID_1620678_Annot_ID_164319 3000 nt of promoter + ATG
agactttattgactgaggaaaaatgtggtcaacgcagatacaaggatgccagtagaatatcttaagctgctttctcttcatatgtatagtaagcttacccatccagtgtactcccctcttccaggccatcccagaatctttgtgccaggaccgtcctgctctttttatctttcccataagtttcaacataccatcctccgacatcatgcaaaccacaacgaggctcaaacaaccaaaacctgttttcaaatccatgcaattatggtttcatgtcactgaggtaagaaagatgaaggctacgttagggatcagtatcataagttcagcattccaacaaagatcactgactacttcagcatttcaacaaaggaaactacagaattctgtgttccagatatcaatttattgaattgcattctaacgaagatgaaaacagtgaaaaggctgtccaatcttgttattttatcgagttaaaggtgagccagaactaaaataaaacaaaaataatatttggcttacttgcttggtggtaacttcgctctactgcatctacattcacaaatggaaaccttttccccaattttgtaccagtgcaaatgtctcacctgtagagtgtggatgaagaattttcatacatgcctattccatcaaataactagcggatcatatctctatatgcatcacagaacaattccccgaaaaagtacacgttgtaatttgcgaaaggtacataaaaagaaatgctagatcatataagtcacaaaccagaaatgtcctatgtttcattatcacatgagtcttagcaccattcccatcatagacataacatgaaccttcatctgggattgtcccaagaccacttatagttccaacaagaagtctggcaccactttcatttcccggaggcgattcagtgccatgattagatccttcatctgaattgaggaaaacgtgtataagatcgtgatcaccctcaatttgtttcttttcatgatacccttttgggggaaccctaatggctgtagcaacaactcttccagatacatgcagctgaatatctttatacgcatcagaaacatggtttttacttcttgaagattgtatatgagatatctgaagaccaatcctttcagcagacatcatgtcattgttgcctttctcaactgcttgaccaaggtccgaatccataaacgacgacaaagccaatttctttgagcaagcagaagaaagctcaaggaagttatcaaccaaggaaaccataccaaaaagatcccgtcctgataccaaatgcaaaacctctcgtgtatcatacacagacctttcctcagcttcaaaacaatcaggaagaagctcaacagattcaacatcaggcccaaagtaggccgctcgtatagctgaataaaaatcttcttcaagttcatctaagtaaccagtaccatttgctactctcttctccaatactatatcatgtattgcttctctataccactttaaccattcaactacttccatctcttgactcaatgtcaatcctgttttatacctgtgaatcatataaccttgtcccgagtgcttcttcattaccattctccgagatagcaaatatctatcatagtgtgctctcttttcagaatctgatagaatctgtatcatcaccacaaatcattcatcagacacttctaaagctataactctatcacaaaagcttgaaaagcttgaaattttcgattttgaaactaatcataagagtgaagagtgaagctttcttcattgtacctcataagcagcgagaatctgaacgaatcgtctcgaatttgatggatctttcttggattcgatcagatcaggatgagtctccttggcgagtctgcgaaatgatgctttgatctctgcgattgagctggtttcggagacattcaagatatcgtaagcgttctccaccggaaactcgttccgattggactcagcctcgccgctcagcaaccgagttcttccttgactcgggttaaagagaattcgcgacggttcgaaaccgtaattcagttgaaccggaactaatctactaaaacgccggcgtatcaacccggcgagaatcgtcatttcacgaccagtatggtttactcaggtgggaacggagaccggaagtggaaagaggataacggcacgccgatgacacgtgggtctctcgatttcacgccacgtcatcacgagttcagactttattggtcaacagtaaaaacggtcttaggaaagagagaacatgaagccatattacactaaatgggccttgaattttaatgggccaggatcctctcacagatatttttgactcttaaaatgatgaggaagtggatgtgaatacgtggtcgtatactcaccatggcattccatgaataattaatgtcttctaacttctaaatgatcgaaaagtactgacaagttaaagtcaagcagaaaaaaacaaatattatgaggtttttagatgctatattcattgcaagttgtatacatgcgaaatttaactagtgttgttaaaataataattatatcagcttttgactatttgctgccactctttgaatgattgaaactaattttctttcgcattaatgcattgttgaaattcatgcacaaaattaaaaataattggttcatgtatttgtaacccaatgtaacaattttattgttgaacagaagtcagtaactccacgtcatgtactccattaaatgttccaaaatattttgggcttgattccaaaaaacaaattatcacgaatagcgatgtttgacaatccaacaaacatggttccattcacctttttttgccacctgtaaatcgcgatattttaaataatttatttcctcttccacagatacgaatttttttataaagaataatacgtaacactctaaaacaacacaaatatcataatttctccacgaactgactaagagaggtaccaagaagaaaaccagagaagaatcttctttagagagatg

SEQ ID NO: 4000 - DNA, 3000 bp, Unknown; identical to SEQ ID NO: 3994
  misc_feature (1)..( 3000): cDNA_ID_2156875_gDNA_ID_1620678_Annot_ID_164318 3000 nt of promoter + ATG

SEQ ID NO: 4001 - DNA, 3000 bp, Unknown
  misc_feature (1)..( 3000): cDNA_ID_2156861_gDNA_ID_1620678_Annot_ID_164314 3000 nt of promoter + ATG
agcaaagttacactgagttagcggaaaacttacaggtcttgatggaccttcctcaattgaagcttgttctgtcttcactagattcttatcgggaataatagatttcccttcccttcgctttgatgctagaatctcagacagtaaaatatctgttgtctcgtcgtcttcaggtgagacgtgatgagatgaaactgaagcagatttcaccggtttttcttcagagatgatcgatttctcatcttcgtttttgatagccagcaggggcttttgttgttctgagctggtgtatacatcagcagctccaagtggattcactgtgttagccagagggaatatacttggattttcactcaaaaccttgtctacgcggatcttcaagttacgggcttctgactttgctgcttcaattttcaaaagtatctgttccaagtacgcatcgccttctctaaactcgagaggcggtgtctcttcagagaaagctgtctcatccttggcgctcttattcttcttatctgatgacccaagacagaaaatattttataagatcaaagttttcaaaaggagtaatatcatatcatagttgagattttagaacaccatacctaggttgcgggagttgtcattaagagcaatatcggccaaagatttccgacaatctatacaaagatcagaaacaataagataagaaattattagacaagtaatggtagatgaacattaatcacgaccagaaagacaagaacaccaaactagttccataccataataagagaagagattatggtttgatgcataggatgtaacatcagcggtctcttcaactcgctttctcgttttcctcttcatgagtcgggttttctgagtataacatggaagaggaggtaaagcctttactccaagttcttctgatttgacattttctaactccaacttcttggcttggtaatattcttcaacttctttgtcgtacttctgtgcttggttctgaagttctttgtatttgagttcaatccatttgcaacgccacattaaagtaggctgtacaaacctcctccaatgatcagtcagcttcctttttctgccataaaaaggaacaaaccataataattaccgcataccattcacgatatagagcaattcttctcctgacttccttaaaaggagataaatcaaagacgcagctagctaagtcgtagtaaagtaacacacaaatttaagtcctttcagaatcaatcaaacaacacatagatggaactgatagtgttcaataataagtaacagtaaacaaggctaccaaatccatgaaaatctacaacaccaaattaagctacagacgtttttctcattagtacaggaacccaagtaactcctaaatttcagtcttttaagaatccagcaacatagagatggaactgatagtgttcaattaaaaagtaaaagtacacaagctaccaaaaccatcaaaatctctacaaaaccaaattaagcaagaggacatttttttctcattctgctattggttaaacacacaacaaaccttcatggaaaccattaagataaaagactaaataagaagcgtgaggaaagagcttacctcacccaaagaggaagtgaagtctcattacaaatcatggagtcaacttcttgatcattctcatgttcagaatccgttccaccaaacgaactcgaatatccatcagtcccatcatcacaccctgagacttgaatctcaatgttatcattgcattccaatatatcaacctcgtcctcgtcgaactctgcaacctcttttttaatagaagcatcagcatcaatatcatcaccaccacaaggaagatcctcagtgacatcttcttcaacatgattatgaaaactatggtcctcatagttactagtacaaggcatatcttttggtaattccccaatctccttattgactgaatcatccatatctatcttcgattccttcacctccataccaaaatatcctttttatttcttctcaattaaaaccctagaaaaatccggaatcagtagagtcataaagaactaaacttgaaattgaacaaattttcgaaaactttcatcacgtatccatatgcgtcgaattggaaagagaaagtgaagaagaacacgaatttacacaaaaccctaatgtaaagttcgaagcttgatagtcgatgagatcacaatttcaaatgcaaaacaacaaaaacaaaaaccctaagaaagctttaacagataaaagagataaaaggaataaatacctaatcgacttagctcgccgtttccgacaaggagatggtagtagataagtattttataatcggcggtgagaaacacgacggagaaaagacggagatctcatagccaccattatcgttaggtggtcgaggctttttcttgtgggggagagagagagactgttttatcttacacaagtggggtccattatcctctagagaaggatttctttcccttttgacccaattttttttatttttttcattacatatatttggtcaaaacatttcattacatatagtatttggtaaaaaaaattcatccaggacataaattttgataacacaattcatatatgggatgaaatgggccactgagccataataaatgagatttcttatccaaattcataatctaatgaatataacatttactttatattataaatatattaattatttacttcaatttataaaatatatgtgcaatagataatacccatttatatatctggagaagaaaagattaactaagaaaactaaatcttttgattgacaaacaagattatggttctatgttaattaataaatttatttaatttaaagtaattagtaattttgatacaatttaatggaaaatctacaagtttagccatagaaagttctttctcataactatataaataaacttataaaaaatattttgaaagctaattgagaaagagaaaacattgtgaaaagaagacaagaaaaaatg

SEQ ID NO: 4002 - DNA, 3000 bp, Unknown; identical to SEQ ID NO: 3992
  misc_feature (1)..( 3000): cDNA_ID_2999361_gDNA_ID_1620678_Annot_ID_164313 3000 nt of promoter + ATG

SEQ ID NO: 4003 - DNA, 3000 bp, Unknown; identical to SEQ ID NO: 3991
  misc_feature (1)..( 3000): cDNA_ID_1822669_gDNA_ID_1620678_Annot_ID_164309 3000 nt of promoter + ATG

SEQ ID NO: 4004 - DNA, 3000 bp, Unknown; identical to SEQ ID NO: 3990
  misc_feature (1)..( 3000): cDNA_ID_1838404_gDNA_ID_1620678_Annot_ID_164307 3000 nt of promoter + ATG

SEQ ID NO: 4005 - DNA, 3000 bp, Unknown; identical to SEQ ID NO: 3989
  misc_feature (1)..( 3000): cDNA_ID_1822677_gDNA_ID_1620678_Annot_ID_164306 3000 nt of promoter + ATG

SEQ ID NO: 4006 - DNA, 3000 bp, Unknown
  misc_feature (1)..( 3000): cDNA_ID_4254415_gDNA_ID_1620678_Annot_ID_164304 3000 nt of promoter + ATG
acattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttccaataacccattgttaattatgttacagtcttacaaatatgaatgttcagtgttatcaatcaaacaaaattctaggtgtgaaaaaaaaataaaaaaatctaggtgtggcattgctatgctaaatgtcatataattagctaaaataaataaataataatgattaggtatctaaacgactaatgggcacatgtgatttggccgaaataagattctgttttcgaagtcaacgtctatggagtagttcaagcagattttgcaccacatcatcctctgttacaacccctgaagatccttgaggaagaagaagtcaaatatggaaggtcaaaccctaattttcacattccttttcatatctctttctctcacgtttatcatcggaagaatcaagcgaagacctaaccttcctccgagtccgtcgtgggcgttaccggtgatcggtcacctccgccttctcaagccgccactccaccgagtttttctatccgtctctgagtccctaggcgatgctccgataatctccctccgtctcggcaaccgactcgttttcgttgtctcttcacactcactcgccgaggaatgcttcacaaagaacgacgtcgtactcgcgaaccgcttcaactcccttgcttcaaaacacatctcatatggctgcacaacggttgttacagcttcgtacggcgaccattggagaaatctccgccgtattggcgctgttgagatattctcggctcaccgtctcaatagcttttcatctatccgccgagacgagatccaccggcttatagcttgtctctcacggaactcttcactcgtaagtttgttctttgttctttgttccaattttatgctaattagcaaaatttattataatcagaatccttagtccctagtcaatctctgcttataggtgaatttcagtgaattgtagcaaatatttaacatatgatatacaataaattttgcaggaatttacaaaggttgagatgaaatcaatgttttctaacttaacattcaacaacattataagaatgttggctggaaaatgttactacggagatggtgcagaggatgacccggaggctaaacgcgtgcgggagcttatagcagagggaatgggttgttttggtgctggaaacactgctgattatttaccgatcctgacttggatcacaggttccgagaaacggataaagaagatcgctagtaggcttgatgagttcttgcagggattggtcgatgaaagacgagaagggaaggagaaaaggcagaacacaatggttgatcacttgctttgtctgcaagaaacccaacccgagtactacacggacaacattatcaaaggaatcatgctcgtgagtaacattttaagttcattagtctattgtcacatttggtatgggattaattagttatgtttgtttttttgtgtatgcgtccattgtgttgaagtctcttatactagcggggactgatacatccgcagtaacattggaatggacattgtcagctttgttgaaccatccacagatactaagcaaggcgagagatgaaatcgataataaggttggcctcaacaggcttgtagaggaatcagacctctcacatcttccttatcttcaaaacattgtgtccgagtcgttgcgcttataccctgcgagtcccttgttggttcctcacgtagcatcagaagactgtaaagtagggggttaccatatgccacgtggaacgatgctattgactaatgcatgggcaatacatagggatcctaagatatgggatgatccaacgagcttcaaaccagagaggttcgagaaagaaggggaggctcagaagctattggggtttgggctaggaagaagggcgtgtcctgggtccggtctggctcaacggctagcgagcttgactatcgggtctttgattcaatgttttgagtgggagaggataggagaagaagaggtggatatgactgaaggtggaggaggagtcataatgcccaaagctataccgttggtagccatgtgcaaagcacgccccgttgttggtaagatcctcaacgagtccgcttgagcttagacttttgtactaaatgctaatttgtgttttttgagtaacggttacttttgtactacttttgttattatgtaaaaagaggaaataatttcgaggtgatacatccaaataatatattaatacacttatattttacttttaagaaagaaaatcttgagaagaaatctagaattataatttcgtctgcttttttaaaaggtttttcttaattagagtccaacgttcgaatttgaacttgtgacaatagtacattatcttttatagagcataatttttaaaaataatatatttccttgaccacatgtatatatctccaaaacaatagtaaaaaaaagagagacgaaaagaaagaaagagagagagccccacaaacaaacaaaatg

SEQ ID NO: 4007 - DNA, 3000 bp, Unknown
  misc_feature (1)..( 3000): cDNA_ID_3072305_gDNA_ID_1620678_Annot_ID_164303 3000 nt of promoter + ATG
agagcataatttttaaaaataatatatttccttgaccacatgtatatatctccaaaacaatagtaaaaaaaagagagacgaaaagaaagaaagagagagagccccacaaacaaacaaaatggatttgaaccaaatcttgatcctctcatttctctctctttttaccttagccatattcttgctcacaagatccaaacggaaactaaaccttcctccgtcgccggcgatctccttgccggtgatcggacacctccatctcctcaagccaccgcttcaccgtaccttcctttccctttccaaatccatcggaaatgctccggtcttccatctccgactcggaaatcgcctcgtttatgtcatctcttcacgttccatcgctgaagaatgtttcacaaagaacgatgtcgttctcgcgaaccgccccaagttcaccataagtaagcacctcggctacaacgccacctacttactctcggcatcttacggcgatcattggaggaacctccgccgcatagccgccgtcgagatattctccactcatagactcaattcgtttctgtatattcgtaaggacgagatccgacggctcatttcacatctctctcgtgattccttacacgtatgatctccttcaattctttttatttattatttgttctgtattcattactttatctttggtttgtcaactaacaaatttattatttattcattactcgtgacgactactttcatatagtacatacttttatatttattgtggtgataaattgtccatgtgactagtttatttttttgaagcattgcgtgtatattacgatactagctatttattcacgaaagtctgatcactatattcataaatattacatagtttattcacaaattacaaatgtacagaaaagcttaattttaaatttatagaaaaagatgcagtgtaggttttaattgtcttaagttggttgaataattatttggttcaaaataaacacattgttctaatatgttaaggtggcgaatatggaaatgcacaaatttttacatacttaccaaaactcttatctgtttactaatattgtattcgtactctcagggatttgtggaggtagagatgaaaacattgttaaccaatttggcatccaacaccaccatcagaatgttggccgggaagagatatttcggtgaggacaacgatgacgctaaactcgtgaagaaccttgtgtcggaggcggtgaccagcgccggtgcaggaaaccccattgattatctttccattttacgttgggtctcgagttatgaaaaacgaatcaagaatttgggaaataggtttgatacgtttttgcagaaattagtcgacgaaaaacgtgcggagaaggaaaaaggtgaaactatgatcgatcacttgcttgctctccaagacattcaacctgattactatacggatgtcatcatcaaaggaatcatacttgtaagtatcaatcaataagaaagtttttatatatatatagagagagtttaatgattgaaattttgtttagaccctgataattgcagggacagatacgtcatcagtaacactagaatgggcaatgtcaaatctgttgaaccatccagaaatacttaagaaagcgagaatggaaatcgatgaaaaagtcggtttagaccgattagtagacgaatcggacattgtaaatctctcttatctccaaagcattgtattggaaacactacgtatgtacccggcagtcccactactactacctcatttgtcatcagaagattgtaaagttggaggctacgatataccaagtggaacaatggtattgaccaacgcatgggccatgcatagagatccagaggtatgggaagatcctgagatattcaaaccagaaagatttgaaaaagaaggagaggctgagaagctaatctcatttgggatgggacgaagagcttgtcctggagccgggctagctcatcggctaataaaccaggctcttggaagtttggttcaatgttttgagtgggaaagagttggtgaggattttgtggacatgaccgaagacaaaggagccacattgcccaaagctataccattaagagccatgtgcaaagcacgttctattgttgataaactgatataaatgttttacgttgaaaaatgtattctatttaatgacatgtttttaattatgtgttttggtcttcaattcgtccttcaatcttttgttgtatctttgaatcttgcttaatatcatcgggtcaatgaagctgggcttgctcaccgggttagtgggctggctcttgcgttgttggtccaatgttttattgattgatatattttttaatgtgattgcattatagttaggttaaatatagtgtttttaatgaagttgtaaaatcaataggtcacgttgagtcgttgacccgtattttatacttgacccgtattctccagtaaaacgtgaagaatcgtaaaaaaagaactatcatatagtataaaattcacatcacataaagtcactacagattcgataataaatgcattgagtcttgtgattctatattttctattcatcgcccccaattaagctacgtaataacagggacataaattgtctttttaatagattttttaagtcggcaagtactgtcttttagatatttcggttgtcctatgtagaaggtagatatgtaaagggtagattaaaaaaggaaatttaccttctacatcctatttagtatatttactatactaaaaaaggaaatttacctaactttctcattgaaaattagttattaccttctctttcaaaaagcagatcaaaatctctatccaaccatttccaaaaattcaagtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaaatg

SEQ ID NO: 4008 - DNA, 3000 bp, Unknown
  misc_feature (1)..( 3000): cDNA_ID_4262384_gDNA_ID_1620678_Annot_ID_164302 3000 nt of promoter + ATG
aaagtcacactcacatatatcgttagccggtttagatttggttttcgtaagtatattatggtatattgttggtttcagattgaatttgtttactttattttactttactagaaaatgtacatctctagctttggtttcgtttcaactttcagccaaattttttatatatagaaaataaatttaaaatcagataacttgaattttttttaaaaatttggttagggtttctggttcggttaaaccagctgatttaaggagtgacataagctaaattgactatgagtcggatctcatgtgtttgttttataatattgttagatacaccaaacctaatcatcaatgcttcaaaagttcaaacactttggtgttatttttcttgcacgaccaaaaatagttccttctcacgtgatttttcttgcaaaaaacattgaacaaccaaactttatactactcaaaattcaacatccaaattttagtttttgttaggtagaaataagaaatctatcctatgaaaagacaaaaccattaatttttatttcaactcttgctgctatatgacgttgaattatgataatttttccgtctcaagttcataaacgatttttcaaacagagttgtgatgaaatttatttattttctaaaaaaaaaggaagattgatagttttgaagaatatattattgatggtagccaaataatttaccggaataaagtgtaatatcatctcaaactgttcctttttatagcaaaatcgctcctttttatccgcagttagagtataagacaaagaaaccaaattccagagcatcaggaaactctttcccatattttaaggtgaaatcactattttgaaattattaacttagtttaataaccaattattgaataatacaaacaaagtacttaaaacccggtttaatgttttatttcgattttataaatattggtttggccaaaataatatagtttataagtggcgtaagaccacgccagaataatacaagaagaaaaaatgtttaactatgtatagttcggacgtggtagtccattaataatggaatcaaattctgcattaataaattcattatcaagattccagtcttttgtattccttccaattacatgaaattaatataattcttgaacaaatatctttggacaaaagaatttcaattatttacttaaatctatataaaagcaaatctttaatccattcaaatagcagatatgtatctctagggattaaggtagtatacaactataacatctcaaaagaaccaaattgtgactgcacaatgcaatatcataatttgtatatcgaaaacatgatatgttcacatggttcgtccataaacagtacttatattcatatttgaccactaaatatttcacattaaaaaatcgaaattagaaataattatggatttagttctgcaaactcgattttttttaaaaaagattcgaagatgcaagattgataatgaaataaaattgagggtacatcatacatgtgggggaagtgacgtttaaaaacaaaaaggaaaaagaggaagaagatagatgccaatattgttatcatgacaactatgaagcagagttagagtccgtccgtccatacaagtattttgtgtgagtaccaccgaatttgtctgtctatgttatctcccttctttttctcatgcccacgaaccaacatgacaattatgttttgttcgttttttgaaaaattctagagttttcatttattaattatcgttgagttatgatttagtatgattttggtttaaaaattccacttcttaggactcattgtttgatctttgtgtttcttatttatttctttgcacagtactaaaaatcatgcattagttcttaccattcacaaatcttcaaaacttaattagaaaaagaaaaaaaaaaatcgatcaatacaatgaaaacgttctcctatgcactatgcagaacaagtctcgaggattcgtatggtcaaatttattccgatcaaattattcgcgaaagtgtgagaaacaaatacgtactttatttctcttacctcctcctacgtcacttctacgcattcgtgccctaccttcatcagtactcttccagtttctaaaggttaaaaccgagtcgatgatccacgaccgtagagttaaatcaagtaatcaacttaagtcattgtaataagaaagcctccgctcaaaaaaaattctacaatattagtttgacataaaacttcaaatgatagaaatatgaaatcaaatagttgtagacttgtagtctagtactttcatttggctcatttggcaattgcaaagtttacgtggtgattactaaactccttgtcggtataaatgtttttgatcatgaaaccatataccgaaaatattggtatatatagtcctgcctaactccactaacaaaaagtcaggatttttaaattaccaactacaacttgaattgtcatttggaagattgattcattggaatattgtgtatcttaagccataaacaaatcccataatttaatagtgtgccagaattttgtattcatattttaagcagtaaaaacaaaaacaaaatacatatatatattctcaatcaaactataatactttagatttaaagctattaagaaaaacatttagctagtcaaaaaaaacaattaacacttttcgaaaggtccatttccaaggaagctagagaccgtccttttttactaattcgcctgcaccatccccttgtatcgagggtctaattctacaccttattccattttatattccctaacaatttttttagtttttttttttatattactttaattctaatgaaaactcctatcttccttcctctccatcctttttcatctacctttgaatcttttgacacttgtatataaagctttacttcctcctttgttactccttttctatcaatcaccaaaacacattcattgtcttaaaccctaaacctcaagaaccgaacaaccacaccaaaaa

SEQ ID NO: 4009 - DNA, 3000 bp, Unknown; identical to SEQ ID NO: 3999
  misc_feature (1)..( 3000): cDNA_ID_4359769_gDNA_ID_1620678_Annot_ID_48301 3000 nt of promoter + ATG

SEQ ID NO: 4010 - DNA, 3000 bp, Unknown; identical to SEQ ID NO: 3998
  misc_feature (1)..( 3000): cDNA_ID_1822648_gDNA_ID_1620678_Annot_ID_48302 3000 nt of promoter + ATG

SEQ ID NO: 4011 - DNA, 3000 bp, Unknown; identical to SEQ ID NO: 3997
  misc_feature (1)..( 3000): cDNA_ID_1822644_gDNA_ID_1620678_Annot_ID_48303 3000 nt of promoter + ATG

SEQ ID NO: 4012 - DNA, 3000 bp, Unknown; identical to SEQ ID NO: 3996
  misc_feature (1)..( 3000): cDNA_ID_2156949_gDNA_ID_1620678_Annot_ID_48305 3000 nt of promoter + ATG

SEQ ID NO: 4013 - DNA, 3000 bp, Unknown; identical to SEQ ID NO: 3792
  misc_feature (1)..( 3000): cDNA_ID_1822736_gDNA_ID_1620679_Annot_ID_48307 3000 nt of promoter + ATG

SEQ ID NO: 4014 - DNA, 3000 bp, Unknown
  misc_feature (1)..( 3000): cDNA_ID_1822728_gDNA_ID_1620679_Annot_ID_48310 3000 nt of promoter + ATG
aagtaagttgtcacgatttcgcacataaacgaattctgtcccttttggaccgaaagacaaatctaaagttacttttaaaatcatcagcaacaaggttttccataatcagtgggtaaacaaaaataaaacaaagaatatttcctcttgaaaaaagttcttaaaactgtgtataaaaatttggtttttgctagtgccggcgaaaaatccatatatagcaagttcggcttaaattgttactgcatattcagatctgcataaacagataaaactcttcacatgcaaaaaaggggaaagaaaaaaaaaacaattagcgcggtaaatgatgtataaagatcaaataagtgagacgtttatttttggtaggtgtaagaggaatcaaagttttggacaagaagaagcgtcaaatgacacatgatgtgtttcgactaaacgacatatcacctgggaacaatccttcacatgtgcctttcgatgttaactttatacgaccacatacctccaattacattactacatcacaaataacttcgtattctcagttgtcactattaatcttcactacttatgtgataaatctcccgtgttctacgtactatagtttttaaacttaactgaaagtcttactacgaaatatattattacatccattttagcgaaaaaatgttgtttttatatcaagactagcatttcttcacatacgaattacatatatacatttatgtttatgatccattcaatatttttttttgtttgtatgaaaaggtcgaaacaatgttggtgaaagcattaatttcttagtttgaccgacgataaatgatctacctgtgaattgattcgaacagaagaattttggaattggagcctggtaaaatagtttgggtttttacactttcatgagttactagtaatattttttgttggtcacaaatattatactcctcataaatctaaggacaacaatttttctaatcataaatatttaatactgatttttgaatgattcaagctttaaattactttatcctctaaaatattactcaaaattatgaaaactggttattttttatttaattaaaagtctcctaagaatgtagtattttgaatgaagaaaaatttcttatccaaaaaacctaaatttttaaaaaacaccatagtgtttttgaaatccgtaatctaagacacaccatgaattattagaggagtctctagtagggaccgttttatcttaataattactccagaatttgttgatctgtaatccaaaaaagaaacacaatcaagtggtaattaactgtgttcataatgcttttggagggaagccgcgttttatgattgaaagatgaattctaatcaaacatcattactcttagaattctaatgataattctttaggtcccctcaaagattatgaaattaatatttgtttaacttttttagttgtatacttttcttttacctttcatcaattaagtcaactatcttttctctccctccttggacttttcacgtatttatttgtttcttccacctatttttccgtataagttaagtataataactcctattcattaaattattttccatttcttccaaaaccaaaagtttttacctatgatactatcaaattattgatttttttttttttcattttaacattctactactaacgtgaaataaataaattacagagaaatattccccgttcttttgtcatcattatataaactcaatattcaatttcaactagattcactttattatactcttagatttttatactttacataaacctcgtatagtgtggtaaattcccactactaatgctacatgtatgtctatattaagattattaaaaacataaatctttttaaaaagctacatatatgtgtgagagtctccattatcaacggttcattgtctgctactctgattagcattttcttaaaaaaaagtaattagaaaaagaaaacaaacgaattaaaaaaaagaacaaaaaccctaataaatctctaaaaagtccacacacactaacacactctctctccgtctctcactaaaagcttctcacttacatttctgctttcattcattaatctctgtgtttccttcttttgatctttttggcaagatctctatttttcttccaaaaaaggaaaaataaaaagatcataacttcagaatcaaagtttctctttgttcacattgttctatccatctgcacatttgattcatgtagtgactaatctcacagtctcgttctcaaatttactttatctgcttgattcgtttcgtgaatccaagtaagttttacactttttgtttttgctttttggctttattctattcaagtttcaagtttaaaggatcctcttttactaatgtagaagcatttttttttttttgttgttttggtttctgggctttgttatattgcttattccttgcttggatgatttgtgaaagtgggttaattcttctcatctttaaacttttgatgtgtgtttataattttctcaagatttgtttttttttgtctttctctgttccactgattgctcagcaacagttgctactgtagtttctgtatcgtcttcaaacagttgaatttgtttaggtatatttgtctatagagatgttgagtttaccaatctacagtgtgattgaagtttccccaagtttttatctttaagttactttggagtagcctttctttatgtgcttgaatctcttctctgctcatttgattttgagttgtcagacgtataaagtttagtcttttatcactgtgaaagatagcaacactatctcataatttctgagaagagtgtggagattaacttgtgtagtggtttttaatacaattccaattctgtgaagtgattgttgttgttgctcaatatctgttgtttttcagggatgctaatgttatacattggattttgatactgcagatttagtctgaagagaattaagcttggcgcttctttggtgagaagcaag

SEQ ID NO: 4015 - DNA, 3000 bp, Unknown
  misc_feature (1)..( 3000): cDNA_ID_1822713_gDNA_ID_1620679_Annot_ID_48314 3000 nt of promoter + ATG
atcacaccacacgagccaagaactgccatgcatcccatattctgctcaactatatccaacaaaccattttatatcaaaaagttattactacgtgcgagaaataaatacatttttgaatatatatttacaaacaaacgttacaataaatgtatacctaatgcaaacattacaaggaagatgatggggagaacaagtgaagaagctgtcttggccatttctcttttgttaaaataaatttctagtaaattgaatattgttgatagacttgaaaaacttggggacaaccaaagtagatttatagatttatgggacgaccaaatcatagaaatacagtcatctatcattatatatgtttgaacaaaaattatttgactatcattttataaaaaaaatactattgactgtcatactgaaaaccatagttacgtatatgatttatacttttgggataaggttttcttttttttattatttgactgtacttttatcacaaatattatttgactgcccatattggaaacatgttatggtcaaacgttatttaattagacatgtaaaacttgatgacacatgtaaatcatcttttttaccatgttttaagaaggaagctctcttttaatttcttcttgggacagtttggtttcctcatccatggaaggagagtacgtggtgttcgatatagaacacgaccgttttttggtaaatatatatcaacgaacaattttacttttaaccaagagaaattaaggtaaaactatcagtgacaacatacatacaatttttttaatggttctaactagctagtaactaaatcgaaagattgttctagacttctaggcttctagcaactgaaaactcaattattagcaagaagggaaatatagttaattaggggtaaattgaggtgcatgcaaatgcatggtatcagacaacgttgatcatttgtttgaaaatagaataatgatgtggacatcgtgcatttctggctaagatcacatgaggtttatgtcaagttgctcaatgttcatacaactttctatataatatagagaaaactagagtttactatcttgactcggtctggcgaagaaggttcctccaaactattgacattaaaataacacacatgatgatccaagtggaagaattatgtctactagaaattatataagtatatacattagggtaatcaacttggtctcccttatgcaaaactcggaactaattttcaaaccaacaagtcttgtatgcattttgaattgtcaatatatatgtatgatacatatatcagctaaaaggatctatctgtatgagctaaaagtggataattaatttcgatcgataggaccaaatagcattttttttttgctcatttcaatagtttttttttacattctttccattttaaacttttttcaaatgttgtgtgtgtatatatgtatatggtgctgatccaatcttttaaaatgtatttgaaatatataagaattctaggaaatgtaatatgtttatttatatttacagatcaaataaagcaatcatacggctacttcctggacgggaccaaattggccaacggacttgatgacttggttaaactttgagtaacaaaggataaaactgtcttttaagacctggtttcagattcaaaggaccatatattattaatatatatccaaccaaataaatccaaggtaggccaggacattgcatgggatgagctagttttataaacgtgctactggtagatgcagattttaatctaaagttttatagcataacttttaattattactcccataaatacattattactcagattttaatgtactgattattttaaaaccgttgttaatttacttaaccttgtaattaaaccactatcgtccaaacttatgtgaaaaacacgcgctaatctgaccactagaaacattacacgtcatttctttttattttattttggacaaagacacgtcatatcataaggtttcaataataatgcatatatttttccgccaatgtatatttttttatcaatctctgcctcaaaaatttgcttcctctgtttcgaacccaattgggcatcttcgtcgtcttcttcttcaacattcatcatcgtcatcaatttctctgtagctctttcacaagtatttcttcaatttcatagcgagagagaaataaaagggagaacacagagatcagagagaaattcaaaaacgaatccgtgtgaggacgttttaaaactgccaaagagacgttttacttttacatgcacatagagacatacgtttattttgtgtagctatagctcttaagagtttgaattttctcgagatctttgaccggagcgaaaacgacgaagatatagaaaatctagcgaaacgacgattcggacttgggagactctcttgcgttgtgcttggatctggttccgttgtaaatttgaggttctaaattctttcacattgtttctcgttgattcattttgatttcgattctctcgtattgcttcgtttgggcgatgcgattagttaggaagagatcggaatgtgtttccggtattgtaactttgaatcgaaattgatatataacagtgtcgatttcgttttcctctgatgtttttttctgggaaatctgatgattttccgagaaaatggtttagattccttcaaagcatttctctcgtgaagcattcgttgaaatcgttgactctaattattgcgtggaaacagtgtaacgtttctttcattggcttaaggagctggtttgacttttcctctgtttcgtggatagctagaatttagttgttggactaatcttgaaggaacttatctagaattgaatctttctttgttggtgtattcaatattcattcttgtttctatttttgtaacttctccaggttttgattgaccagaggaagttagctttgttcatctagattaggctattattgaggtgttgttgtggctctgaagcaataaaggatttgatgagatg

SEQ ID NO: 4016 - DNA, 3000 bp, Unknown
  misc_feature (1)..( 3000): cDNA_ID_1822707_gDNA_ID_1620679_Annot_ID_48316 3000 nt of promoter + ATG
gtctataacgactgtttgtgtctgatcccaatttcatgtctttatatgtcttctcctttataggtcgcttttcatttacgctctttcttgtttttagctttcatttctctttttagcttttattttatcattctgttttttttcttttgtccaaactatttttcaaattttttatcaaatccattatatgtgaataaaataaaaaccataaacccaaataattgaatggaacaaacaaactaaaatgtataaattgaaaaataaaacaagcaagaaatattggcgagcatttccatttccgtcatgtctcgttgctgtctataaataattttttctttttaagaaatttgtttcgtccagttctcgcaaaatcccaaattgtggtttgccaacccctaaaaatataacatgattattagtagattgagttcacatgcccaagtttttccaaaagttagcccaaatctaaattacattattaacgacacttgtggtcatgaggaacatcgataaacatagaaggtgtaaccactaaggagtattacatgcaaatgtggtaaccaaaatctgaaggaataataagaggacaattagatcagatccggtggtttaagattcaaataccgaatttgcccttgtgacatgtaaattattactggattaacataaatggagacacacgtaataactattgacaaggaaagtatgtggtattgaccaaacaacacacatacacagacacacttcaaacttaaccatggttactcacacgtgatatgtcctccggttaaatatgttttcattatcattgttaattattattttcttattatcacattcccatatattaaaagattttagtgttatctaaaataatttcagattataatttcagtttcataattccaatcttgaaaattttggttcttatacttgtgtatataattggatattggatttttgtttacgtatggcctagatcaaactcttggtattattaattggaaagctaactcttacgacaaaaaaatacaatgacacatgcggaaatttattgagccttgctacgatcatgtaggattgacatatgtatgtcgtatctctatcttatttggatatatagggtatagtcatatcagagaaattttctaaaatgttttcttaggatccttaaattatattttaaaaggattatctaagtctcctgatttcctatgaattggttcgcaacctacgaaaaaactatgggatcaaaagcaaaaaattctaagtttttttttcaactttggtaaattttaacataaatagttagatgtttatctcccttcattcctttttgaaaccaataattttaatcttcctttcacttaccatttagaaaaacacacgaaactatgttttttgtttttaaaaatatgtgtacctcatatatatgctgcatgtacagcctttatacgtctatatgcagttgtgtatttcatataattatactatacaaatagaacataaaatagaactatagttatttacaacacaatatatatatatatatacagctgtataatgtattttagaatactagtctgggccaatcaaacgggaatataaaaacccgaggtagaattttatttttacatcgtttaaacacaaagaaagatggttagcaacagcaaattgcttacatggttatcaacaaaatatcgtgtttcgtaaacaataagttaaaaataattcaatgaactattgggattatcaaatcaaactgtaaaaattagtttattcaaagaacaattaatggctgagttaattagcttgccttgaattgttaaataattagatgcttctaatcagatttcaaggagatatgtcggaagcaccgacgacacgtgcggatccgtcacgtgcgcgattcaactctttaactcgtatgtcgatatttctttttttaattctcttcttttttcacactccatattgtcgatttttatgcccggaatcaagggtttgacttaccaaattgttaccttcttttaggcttaaaatttattacacttaaaataatccggattaatattttctaaaaaattcactaactagagaagaaataataataaaaaagacatgtgaaagagttaatgaaagttgagaaaaaagagataatattatttttattttatttttagttttgtttttctgcagaagagccaaagctctttccttcatatatacgaacccctttttccattttctttgtgcaaaaagtgtaaccttccttatccgattctgaagcagaaattagctgcagaatcttcagattctctctatacctagattggtttttcacagaatcttcgctattttgttcagatctgccactgtttcaggtttgaactaattttacataaattttctctcctaatctttctctgtttcatctttggttttctcaatcgattcgatatgaatttgatttggtttagcttgattcgatttgatcatcatgtctaactagttctatctaactttgttagtttactgttcttttgtgtggttcttgttcttacttcagaccgatctatgttttttttgctttgtctgcttcacacaacacaatcgtgagcttgctcttatgaaaatctaatctaactaaattttcttaatttgtggtctttttaatttcataatggattaataaactaaatatcctcaaaacgttcttgaagttttataatttgtattttttgttttctccggagatttggtatttgaaatcttcttactatctgaaatgaccctttttgtcggtttttcttgaatctttttatttatttttattttccgggaaaatttcgtttgttaggtaaagttgactgatacaaaggacttgagttgctaaataaaaagcatttgtattgtgcttttgtttggttactctgttctcaaacaaaagctgatacatttgtatttgttgttgcagcaaaaacggtcacaaaaaatatg

SEQ ID NO: 4017 - DNA, 3000 bp, Unknown
  misc_feature (1)..( 3000): cDNA_ID_1822689_gDNA_ID_1620679_Annot_ID_164369 3000 nt of promoter + ATG
ctcatccacatcacagcttccatccaccacaactccatcgatcggtatactttctccagctttaactgaaacaacggtgttgatcccaacctcatcaacatcaacttctagtccagtatccgcgatcactgccttccgtggcgctaagctcatcagtgatgacattactatgcttgcctgaaaacaattgttacttcagaacaatgatcaactgatagaattaatgaaaaccagaactgattttcacatttttgtatgactatgactgtttaaaatcatcaagaaacagaaaccctagattaagtaaccttatgagcagcactagactcaagccaatctgcaactgagaataaaaacacaattgtagcagcttctgtgaaatcctgcatacatagcgttgctatcactgttgaacaaaattaaccaaatcagattcatttacctcatcaaacaaaacataagctgatgctcagggaaaaggatttgtgttttaccagcaattagagtgagagcgttgatgtcaagcctgaaccttgtgactgaagcaacagctttagcaagaatggggaaaactccagccaccacggcaacaatagcgagccattcaagcggactataaaagtatttgaagaaggagagaactagcagtacaccagaaactattgcgaaagggcttggccattgactcttcaagcttgtttctccgtatggtctaacacttgcttctagtcttgcttgattcagagccttgactgtcaagaaatcaattttacacacaacaacaaaaaaaaagggtttaattgactttaagaaaacgtaaacctttgcctcatcaatagaccaatgattcaagacgaaagtcaaaacgtcgattgaaaaataacagtttctgttacttaccgatttgaagtggagaaatcaaaaaagtatcgtggacaacgatgacggttctagaaggaacgatgactgagaattctttaacgccgtccacttgacggagaacgttacctacgatagaaacctccgatgaacagcagattccaacgacgtcgaagtaacttgtctgtaaattcatcttctttgactcttcaccttccgccatcgttgagcttgagatctcggactaaatttcgaggagatacttttacgggatgatgtcggagggaaattaattatttggtttaggcttacattattatttataacatttgaaattttcagtctctataaggaatgttatattaattgctccacgattttttactatttccaaatgtcaatgctgagattggatacgcatttaaattttattttattaaccatgtaatttttgaaagatttacatttatttaatagaaataaatattaataaacaacaattaattagtcaattatagtagattcgattttattattgaaaaaaaacacttcaaaacctatatagttttccagatgttaaagaaaaaacctatatagttgatatattaaaatcttttttagcaaataatatttgagcagatagaatctaacaaattcttctaaatcaaattcagattttgttattaaagaaagagaaaagagcctattgggccataacatgggttcatacaattctcaatcagataacttccgaggccttataatgacttgtaatataaatggcaatttcgtgattaagtgagtatgaaagggtagacatgacaaaacctaactacagtaccgaggtagccaataatttatcttggctggggccatactctgaccgcagtttccattaatttacagaaatacccacgcttgggatatatatgtatatgtaaccataagtgtaacattttattagttttcagtcgttttccaaatttatgaatccatttacatgagacaaaccaaatccttgttggtaggtccatcctttacactattagaactgaatcatttttatttttctttcacaagaatagaatatttgtcgtaagcaaagaaacaaaagtaaggttaaaaattagtaaaacaacaaagggttgcatgtaacacaaggtttagaaggaataaaataaacaaaagttatgttagtaacgtctttagttaaaaaaaaagtttcatagatgaataaaacaaacaaaattgcatgtcccacgcagctataaaataagaaaaaaaaaaattgcatgtcctaacgccacctaataataaataaagtgaaataataagacaaaccaaaacaccattgactcattgagactgatgtcaaaaaatgagaaaaaaccaatcacattgagagttgagattttaaccaatgcaaggacaatggcaaaaccgaaaataaacgtaaaaatcgaggttgataataacataactcataaaatccgtattttcatggtgtcttcttcttcttcttcaccttcttcactcatcactactcacaaatatatttttgaccgttgttcactctcaccttcttcacacgctccacatcttcttctgattgacctttaacacctgaaaggttttgtcttctctctctatcgtccaaaaatctaaacttttctggttttattttatagatttgggtccctcagtttgtttattttacctttatttatgaacaaatgtgcaaagggtttagattttagctccttgaaggctcataacgcataaagttcttggcttcatcgttttctctcttgattaatttggcattgtatatcttatgtctgattgtgtgaaaaaaccacaaatgaaaggagtttagacacaaatcacagtttaagacaaaattatagtcttgtttctttcaaattatgcaaaaaaatcaagaatctgagacataagagaaacgtttatgtctctctcttttaatcaatgctatgttgcttttctcaactgtttcaagcgttattacattactagctaaaaatcttgatgtcttgttcttatttttgcagtttctcctcttgagctttggaattgaagctaagataagaaatttagagagaa

SEQ ID NO: 4018 - DNA, 3000 bp, Unknown
  misc_feature (1)..( 3000): cDNA_ID_1822697_gDNA_ID_1620679_Annot_ID_164365 3000 nt of promoter + ATG
cgaacagataaagataaatttactattctgagaaaaagttccgaagtttcgggaactaatattttaatgtatcaggtggtggaacaaatataagtagaatgacttatcgaaacacaaaagaaggatatctatcattgcaattcatatttcaattttattccctttcccattatacatgctttatatgttagtttatgatatctgtttagtcattagtgtttggctcatttacgttgctttttcactttgatatatatattttaaataaaaggaaagtaaattgttttgttttgttttgagacattggaagattcctccactactcgaaagccttttgaaaagatatagtggaggtgtgctgcataaattattagtagtctttaagatctcaaagggacacatgtatagattatcatctataaaaagaaaaagaaaaaaacaagtaaggcttgaggtttggcaatctttggttgtacaatggtagaaggtgctaatagccattaggaaaggaaagatcatggttcttgtaaaaaaatttggtgtccaaacagttaatgaattttcaacctttatttattcaaccgttgataaataattagtatatagaactattctgacgttatatcgtatgatccatcgtcgcgaaataataattatataatagggaaaattttgtgagaatcgacaacacaaagtgaaaaataaaatgttgaccacaatacttgcaatccgaataatgacattaaacaccaattatatatataatggaatatttgatgggaaatgagttagattctttttttctgattctctagctctctcgtaatatgtttttcattttctgtcaacctttctacttaaaatttttgaggataatgcacacacaaaaagagagagagagaaagaaatggaagaaaaactcaatccatatttcaaagattatgataattatgatcatgattatattgatgacgacgaaacaatgatatatatgaacagtaatgttgttactgtgttacaaatctgcaagctgcattgtggcctataattgaatctggaacacaattacatatttatctttactactagtacatttttttttcttaaaacagtgacatttagaatttaacataatttaacaaagaaaataaaagttctaaaaactaaaatcactaaatcgcaagcagacaacaaaaaattttgatacttttttttgtttaatcaatacacttggagagtaataaactattccaaatgaggaatcacacatggattccattatatgacattgtactgtttattcttccatatgttttgtagtacacctttgttctcgacttctcgcgttactcacctacaagactaaaacctcttccctaaaacaaaccctattcttttcatatttccttctcaataataaaaataaaactttacacaaattaaattcgtgacgtaataaactactcttctctccttgtttccaactcagatgttgcttacaatctcaaatatttttgaaatcatatcatataaaatacatgtgaatgcgcaaatctcttataccaaattcttaaactattttgaagttgtagtctctacaacgatataattacattttggtatgtgattctatcaataacttaccattcatgttgtcagatgaaatatatattagcacatgaattaccaatcaacgagttgcaaaaatatgttacgacttacgactgccaaaaactaattaaatcaacttgatgtatttttaccccctaaacatattaaagcgatacataatctctatagaagtgcttagcgcaacgcaatttcatctttccacacatgtatatccaaaataaaattaggcagtccgacaaataatatcgaatccttcaaggtacaaaactacaaatctccaaaaatattttatgtcaggataaaatcgaattttactttagtttacatacatttaaaaaaaattgaaaaaatagatgggaaggttaagagaataggaatctgaaagaagcagcagcctaccacagttctatatatggaatttacattattaagaataatatattagaggattctttacaaataagataataatatttactgttttttggtcagaacaaatgaaattaaaatttggaaagaatataataatggtaaggattcttaggaaaaaatctaaacccattattaatcattaattccactttctaacacactttcctatataaagcaatggccactctcatcttctttcaccttcaaatacaaatcatcattacataaaaaaaaaaacaatctcttctctcttctggctaattaacaaagcatctaaaccgaacatacccggttcggtcattgttctctgtccatctactagctctgtctctatctccggtatgattccttcttcttcttcttctcttatgtcttcttcacacatatttcatgacggcttcgaaacgtctttctctcttgcattattttcgtgactgttcattttctctcactcgcattagccaatcttgcatttgattttttttttcctcctaacttctgatgctcttgctagctagagaagctcctcaaagaagttttaaaaaaaaaaatattttgcaatgatctatctattaggagatatgatattctctatattctcgtttacgttgtttacgatgctaaagatattcccccatgtaactgtaaaacctttatattgcgatgaatgtagaacgatctcctcaaggagactttcactatctctactctagctcttttttctctctagcctgaaataattgtagagtgaacttcacgacaacgttatcattcatacccatcttcttttacacattttctttaaaacacgttacatgcaccccttaatatcatgttgggaaaataaacatgaaccaagaaatcagattcccacaataaaatctctgtttctgtttttttttttttttttttttgcagaatccttaaacaagaatg

SEQ ID NO: 4019 - DNA, 3000 bp, Unknown
  misc_feature (1)..( 3000): cDNA_ID_2050441_gDNA_ID_1620679_Annot_ID_164364 3000 nt of promoter + ATG
ttacactcatttctacagaattttccaaagcaatgcaggtatgcaacaaatatcaaaagacctcttctcatattcgctacagttcttcataaacaaaactgaagaaatacccagaaaacaaaattcagctaatcgtagagaaagttcaaaaaggctaaacctttacattgacattaacgctctaaatttgcagacttttgaaagaaaacctgggaagctaggcccaaatcgaaaagggtaagagtgttatgaaccgtacgaagagcagagacggtggatttgagttcgttaagcaaatggttttgatctccattgcagccattgttctctgaggaagaagaagaagcttctccatttccagtgaatgaagcaatttggagcgttacgagaaaaagaaacaaaagtagcttaaaaaacgccattattggagactgcaacagaggactttgcacagtacgagagaaagagagagagagcgcgagtcgcgagagagagacagagactaacgcgtaccaagtcaaataaagggtcttactatcttttctataattacatatttgtctctttacttttgataaattctataaacggcccaaataagtttgtatagattttgatgaaaaggtgtcaattgaaaaatatcttatgcaaaacgcctaatttaggcgtatccgaaaagtcctaattagccttaatctgactcttaaaatcttaatgcaactaaaacggaaggatataaacttataatgttaaaatatatgttttaatggtccattgtgtagtatttttccttttacttcacacgtttttgttaagaatttccttcttctttttgccatatatagttgcttgtaaaaaaacaaatcttgactttttcttaaactaattattttgctgtaaatatagatttttaataaataaatgatatttaaaataattgttttcaggcaaaactattatcaatgttagatttatcttattctttttaatcaacgtggctctctgtagttaatcaataattcactgtgtaattgtcaaactgtaaatagaccatttcaatataactaagaaagaaaactttatattttcattagtttccatgtatctcaactcatttagagaaaataatatttacatatttcttactataaaataccaaaatatatctttatattttaatttaaatatatcattttaatgaattttatcttataaattttaacaaatttttcaattgctgtaaagaaagatgacctttaattaactactcactagatagtagaggcggtaaaaaaaccgtaaacgtatatttaatttgttttagtaaaatttaattataaactgtttactaaaatgcaaagtaatcaataatataaacttttcctattttatgttattgtgtcacaatgtttatagctttaaatacgatttattgtactattatatttttaatatatggtaacttaccatattctctcattatactttattgtaccgctatctattatcgtatactcttatttttaaatccgtaagaaaatttgatcgacttagtatcaatttttttataataaaaaagctaaaatcatgtaacttctaatgttcatcaccaataaggcacatagtcttgctaaatacactattttagatttataccatctacattatatgtttctactgcaattctacggcttcaacaaccccattttcatcacttcttattaaaaccacaataatttacgcacgatttgattaaaaagctttaaaaaaaaaagctatatgacattacatgacctatgtagtactaatctattcgacacaaccaataaataatgcattttaattgccccaatccccaactttcttcttcgtgacaagagtagcccacatgattttatgaaagaaaaaaaagtgtagtctaatacaaatttagttacatacgaaatcagtcgaatttaattattgatatataatcatagaaacaaagcttatattctttaacccaatcacaagcatatgacacaggggacctagacagtaatagagtatccaaatcttaaacaattcaccagtcaatattaataatacaataaaactatataataagatagtaataaataagaaataaaaataaataaataaatgaaaaacctagtttttgacgcaataataatagaagcgaaccaaacttggcctcctcttcgcctataaatacgatatagagattagcgtcaaaagagtatgtaaatcgcaaaaacaaccaaacaaggtcttcttcacacactctcatcgtcgtcacttttttttttatataacatagtctcgttctagaccgtcggattatttctattggtcaaatccaacggtcgtgatccaatttgattagaaagagtctcatcgtctctcaaccaccagattctctcgctcgctcgctccctcgtcgtcgtcctctctacgatatcgaccaacataccagatcttcttcgatcccgcctccgtcgccgttgctttcgttattttactcagccgccgtttccaactgtttttaactttttctcgccggagattgagattgggattgagatttctttagggcatttagacgatccgattaattttagagacgaggttttatcgacccccaccgacaccgttagtggtttgttctctcaatctcgatcctttgattgttataataacctaccctccattgatctatcgtctctgattcattggttttgtttgttaattcgtctgattgctatttaaattttacttcttttaaacaattttaggttgcagcgatttaaagatcgttttttttttcgtaattgaatgtgattcgtatttgtttcaatcaaatttgcattacactgtctattgattgtggtttgtgttgggtttaaattatgtctgcagaagctggtgtcgtgagaggggataagtcttttgatttgtgttattgtgggattatacactgtttatgactatacatacgag

SEQ ID NO: 4020 - DNA, 3000 bp, Unknown
  misc_feature (1)..( 3000): cDNA_ID_3072336_gDNA_ID_1620679_Annot_ID_164360 3000 nt of promoter + ATG
ctgatcccaatttcatgtctttatatgtcttctcctttataggtcgcttttcatttacgctctttcttgtttttagctttcatttctctttttagcttttattttatcattctgttttttttcttttgtccaaactatttttcaaattttttatcaaatccattatatgtgaataaaataaaaaccataaacccaaataattgaatggaacaaacaaactaaaatgtataaattgaaaaataaaacaagcaagaaatattggcgagcatttccatttccgtcatgtctcgttgctgtctataaataattttttctttttaagaaatttgtttcgtccagttctcgcaaaatcccaaattgtggtttgccaacccctaaaaatataacatgattattagtagattgagttcacatgcccaagtttttccaaaagttagcccaaatctaaattacattattaacgacacttgtggtcatgaggaacatcgataaacatagaaggtgtaaccactaaggagtattacatgcaaatgtggtaaccaaaatctgaaggaataataagaggacaattagatcagatccggtggtttaagattcaaataccgaatttgcccttgtgacatgtaaattattactggattaacataaatggagacacacgtaataactattgacaaggaaagtatgtggtattgaccaaacaacacacatacacagacacacttcaaacttaaccatggttactcacacgtgatatgtcctccggttaaatatgttttcattatcattgttaattattattttcttattatcacattcccatatattaaaagattttagtgttatctaaaataatttcagattataatttcagtttcataattccaatcttgaaaattttggttcttatacttgtgtatataattggatattggatttttgtttacgtatggcctagatcaaactcttggtattattaattggaaagctaactcttacgacaaaaaaatacaatgacacatgcggaaatttattgagccttgctacgatcatgtaggattgacatatgtatgtcgtatctctatcttatttggatatatagggtatagtcatatcagagaaattttctaaaatgttttcttaggatccttaaattatattttaaaaggattatctaagtctcctgatttcctatgaattggttcgcaacctacgaaaaaactatgggatcaaaagcaaaaaattctaagtttttttttcaactttggtaaattttaacataaatagttagatgtttatctcccttcattcctttttgaaaccaataattttaatcttcctttcacttaccatttagaaaaacacacgaaactatgttttttgtttttaaaaatatgtgtacctcatatatatgctgcatgtacagcctttatacgtctatatgcagttgtgtatttcatataattatactatacaaatagaacataaaatagaactatagttatttacaacacaatatatatatatatatacagctgtataatgtattttagaatactagtctgggccaatcaaacgggaatataaaaacccgaggtagaattttatttttacatcgtttaaacacaaagaaagatggttagcaacagcaaattgcttacatggttatcaacaaaatatcgtgtttcgtaaacaataagttaaaaataattcaatgaactattgggattatcaaatcaaactgtaaaaattagtttattcaaagaacaattaatggctgagttaattagcttgccttgaattgttaaataattagatgcttctaatcagatttcaaggagatatgtcggaagcaccgacgacacgtgcggatccgtcacgtgcgcgattcaactctttaactcgtatgtcgatatttctttttttaattctcttcttttttcacactccatattgtcgatttttatgcccggaatcaagggtttgacttaccaaattgttaccttcttttaggcttaaaatttattacacttaaaataatccggattaatattttctaaaaaattcactaactagagaagaaataataataaaaaagacatgtgaaagagttaatgaaagttgagaaaaaagagataatattatttttattttatttttagttttgtttttctgcagaagagccaaagctctttccttcatatatacgaacccctttttccattttctttgtgcaaaaagtgtaaccttccttatccgattctgaagcagaaattagctgcagaatcttcagattctctctatacctagattggtttttcacagaatcttcgctattttgttcagatctgccactgtttcaggtttgaactaattttacataaattttctctcctaatctttctctgtttcatctttggttttctcaatcgattcgatatgaatttgatttggtttagcttgattcgatttgatcatcatgtctaactagttctatctaactttgttagtttactgttcttttgtgtggttcttgttcttacttcagaccgatctatgttttttttgctttgtctgcttcacacaacacaatcgtgagcttgctcttatgaaaatctaatctaactaaattttcttaatttgtggtctttttaatttcataatggattaataaactaaatatcctcaaaacgttcttgaagttttataatttgtattttttgttttctccggagatttggtatttgaaatcttcttactatctgaaatgaccctttttgtcggtttttcttgaatctttttatttatttttattttccgggaaaatttcgtttgttaggtaaagttgactgatacaaaggacttgagttgctaaataaaaagcatttgtattgtgcttttgtttggttactctgttctcaaacaaaagctgatacatttgtatttgttgttgcagcaaaaacggtcacaaaaaatatgataaatgtgatgaatccaatg

SEQ ID NO: 4021 - DNA, 3000 bp, Unknown; identical to SEQ ID NO: 4015
  misc_feature (1)..( 3000): cDNA_ID_3072311_gDNA_ID_1620679_Annot_ID_164355 3000 nt of promoter + ATG

SEQ ID NO: 4022 - DNA, 3000 bp, Unknown; identical to SEQ ID NO: 4014
  misc_feature (1)..( 3000): cDNA_ID_1822728_gDNA_ID_1620679_Annot_ID_164350 3000 nt of promoter + ATG

SEQ ID NO: 4023 - DNA, 3000 bp, Unknown; identical to SEQ ID NO: 3792
  misc_feature (1)..( 3000): cDNA_ID_1822736_gDNA_ID_1620679_Annot_ID_164346 3000 nt of promoter + ATG

SEQ ID NO: 4024 - DNA, 3000 bp, Unknown; identical to SEQ ID NO: 4019
  misc_feature (1)..( 3000): cDNA_ID_1822701_gDNA_ID_1620679_Annot_ID_48318 3000 nt of promoter + ATG

SEQ ID NO: 4025 - DNA, 3000 bp, Unknown; identical to SEQ ID NO: 4018
  misc_feature (1)..( 3000): cDNA_ID_1822697_gDNA_ID_1620679_Annot_ID_48319 3000 nt of promoter + ATG

SEQ ID NO: 4026 - DNA, 3000 bp, Unknown; identical to SEQ ID NO: 4017
  misc_feature (1)..( 3000): cDNA_ID_1822689_gDNA_ID_1620679_Annot_ID_48321 3000 nt of promoter + ATG

SEQ ID NO: 4027 - DNA, 3000 bp, Unknown
  misc_feature (1)..( 3000): cDNA_ID_1822685_gDNA_ID_1620679_Annot_ID_48323 3000 nt of promoter + ATG
tcaaactgattctctcaccctatttatatgttcaagattttaggtttttttaaagtattatatatatttatttatcgtagggttgttaccatattttcgctggtttcttcgcggataccgccggcaccggaagcatagttgagtccgatgttagcttgtgcctgtgatgctccggcaaatggtggaattgggttattgaaacccgctagttcagctaaaagtaaaaatagttcaactttgttaaatatatgaactattaaataaataataatgagacaagacgcttgaattaatattaatctgataactttgaattttcttttaaaatatatttttattagtattgttgaactccacaacaatgaattttcattccaaatataattatactcttttaataccaaagtatatgtttgttttggatcggattcaagtatactaaaatatatgattaatgtaattaagtttgactgaaattttaggaattcttctcaaagttttggaaatgtttagaattttaagattttggtggtgattttagaaagaaaatataaaatgctgtattttctaaccttgaatacttttttgaaaaaaaaaaaaagaagttcatccatatccaagtgatgttagaaaagaaaatttaaaatgctgtattttctaaagttaaccttcacttctttttttgaaaaaaataaattcatgcatatacagtttaaacattatggacaactgtctttataatttttttctgtaagaacccgatcatggtcggctatatgacaatcgaataacgtaagaaaaaatggattcagctaattaaatcaagaaaaccggattgaaaacttaccgataacgtctggaatattccgaccgttgctaaaccgaccggttggaccttgaaagtaatctataccataaggtaaatagttgaccttggccttggtgttcaaggcattgttgttaccgttgtcgaagacagagtctccaaacacgaagtaacacggcgtttgctgtccatgcaccgctggtgccaccgccgcgactgcaaacacggtggccaaaataatccacaatgccttggactctccctcgaccatttttcgcaaatcgaattatacgaaaaatgaggagagaagaaaaagcttgatgagagaagaagaaaagtgggcttattgtattatatggactagatttgtaagtctgatggttagaggggattttgcttagacaagtagaaaattatgcgactatatataggatgaggcagtgagtgaatcaagggagacttggagaactatataaattgttttgcatgaattaagaggtttttcttttaatattatttatttgaggtggacgtgttggtaatattattattttttgttaagctgaagaattgtcatgtaatttacttatgtttactaaaatatatgttacaaaatacacataggttgtttttttccaaagcatacaaataggtagagaaagctttatatatatatatatatatatatatatatatatatatatatatattatttaaggtggacgtgttggtaatatatatgacggctgtaaaattttatttgtaagaaaaatatgaaaaaggtataattaataaaccatagacaaaatctttcaaaaccaaacaagtgcataacgatcccatgcaaaaagtttggttaagaattaggatatgccagattccaccaaatgcaaatgaaacctaaccatacatgctttcaatgacatcttcaaaatgatccacaaatagtttatcgttctctgcatccactaataatttttccttcactcccaataagatattgtagtgaaattactaacttgaaaatatacttgggctaaaattcaagtttgtaaatgtatcacatattttcttaacaatatgaaatcatcaaaattaaatataatatatcaaaattcgttatagtttatctctcaacatcgtaattgtagtgtatatagatgtttattttgcaacaaagttatacaagtttaccgttgaacaaagatatgtatatacattgtggccgtgtaagatttaaaagaaaaacaaaaagaagttagttaattggttaattagaaaaagggctacaaatgccgtattgagaaggttataccgtatactcaacatatgtttaattatttgactatatacaaattaaatttgaaatccgtgtctaatacggatcaataagtcaatgtctttcattattcggtaaaataataaaaacagatttgttttgaacgagttggccactttctagtaaccataatacgatatgccttttttttgggtcaacttgtaactataaactttgatagacgacttttcatattgtcttattgatgatgtaactagttctttatatttagagatggaccagatgatattacataataggtaatgtagaaacatgtattatcgaaaatatattatatgtaagtccccaaaacaatgataatatgatataataactaaccattatccaattttaacactcaaccatttataatttgttgaccaatgataacacacaagaccttttattgaggtaactgtaataatttcattttttgggggtcaaatgttataagtctaacaagagtgtttcttacaaaaagtctttacagtgttaattatccaaacaccatactaaataaactcaagttgatcacatttttaacatgttaacatctttgtagatatgaaataagagttgacttttgaaaagagtttatcaataacaatgttacttctgaactttcatcacttgtaatggcccaatgggcttttttcaatgaatccattaatagacaaaaaccaaaaaaaaaaaaaaaaagtcgccgtcgatttgtttatcaccgactcaaccaccggtagggtttaaggtttctcatacactctccttctattgccgccgtaataatcaaatcaatcttcttcttctcctctaacccaattttggaacttgaaag

SEQ ID NO: 4028 - DNA, 3000 bp, Unknown
  misc_feature (1)..( 3000): cDNA_ID_1989449_gDNA_ID_1620679_Annot_ID_48324 3000 nt of promoter + ATG
aaactaacaccacaattattgagcacattcaaatgctgtcatttttattactcgtacgtacacatgaataaggtggaaatgtcatatttgggaaaacaccataaaacaatatgtatgtcgttcactttggtctcatataaacgctagccaaatcatacagaggtaatggtaatgtttttttatcgacggcaacgaaagtttatgctaatatgtttataaattacttttattgattaatatgattatctctgtatagttgtggacgtgtgtatataactgaccgtctaattaaagaaaaatttatcacatcacgtacctaaaagacgttcttcattaatccataattgctttagtgtataactaatcatctatttagaagttttttgttttacttttcctattgttaatgtttgaaagattagaatatatttataagaagaaatttataactttttagcaaaaaaaaaaaaaaaaaacttataacttatgaagtctttggtatgtatattaaatttgacctgatcacaagtaatgcacgtatattcacgatttgaggtacgaagcagatgaaaattgtactatttaacaaaattactaaactataccaattaccagacacataaaatctagataaagtggtcctaatttctgagaaagaatattcctgtgttcgttctttctatctctttccttttctgttgttacatttcccacacacaaaaaaaaaaaaaatctatttactgatctatgttaaataaaaatcaaaaggaaattgttttatgatttttattactttatattaatttaattgatgtaataaattattaaattaattcttggaaaattaatcaaattaacttaaatcaaacaaaatttagttaaactaataaacactttaaaataaaaagtttaatttgattaatttagtcagttatttattaaactaataaacactttaaaacaaatttagttaaactaataaacacttcagttaattattaaatatttatgagaattctaaaagattaatccttatgaaacagaggaaatatattttaagatagaaaagagatattaagaaatctcaaattaaaatacaactcatatttgacacccataagcaaaagatattataatactaaactacttatcaaagatatttcagtttattgatatgatcagaatttggtcaatttttctgtcaacaaagattggtctaaattaatgacctaaggaagcgaattaattcattaagaagactttttttctttctcaaaacttatgaaaattaacccacttctaattaatcatcaaaaagcttgaaattatttgtaaacgaagactagaaagagagaggggaaaaaggtatgacaaacagccttaaagttaaaggtaatagtaccttttgtttgttcttctttttttgcaaacaattttttcccttatttaattacgtttataaaccttaattcagattccttaaatacattgttaggactccataattagtaacggcattaggagcataaacaaaaattatgataaaagttttgatattatggaaataaccaaatatcttacctgtaaataaaataaagagatgtgaccaaatttaattgtggatttaattacattatctaacccttgaagaaactcaatgttttttgtgggattgttgtcctaaacctgaggttacatgtaatcaaaacattaatgggatttgaagtaaataaattagatttgcgccaaaaaaacaaaatctccattgattacagtgttttaatatggtcagataaaaccacagaagtggtaacgacataaaaaatcaccaccaaacataaaaccgtaagaaaagtttcgatttttattttctgcgatccaaaggtctagtgatgaattgaatttggtttttgtttttataattgaagaatgaagaaataaacagttgatgggttcttcgcttcttctcttgttgggttagtgataagcacgcctggcttctcatcattccctccaacctttctctctctaaaagacttcaattgttttatcagcttctctctctaaataaagctctcaattcaattctctctctttcacttttttttcctctgcttgcttcttctgttcatctttttgcttcgtcaaaattttgaccaaagttttgtacttttttgttgctgcaatttttgtgattagattggatctgggcttggagctgaatagcggatttgtataaggtaattgcttgaaacgtaccgaattgattcgtttttttgtttctctgagatttttcaatatctgggtcttagagtttggctgatctgattggttctctgagattttcatgtagataagtttgttttaaaagccaaagccttagtttttaattagtgagatagatttatgtagagagcatcaatgatcaatccttgagctttatcttgggttttgttatgttgtttattgaaaaatggtttgttcggtgagtatgatgattatgttcaatggaaatgttcttccttttctctcgaatttctgagttttgctttggtttcatataactttgtttgtttgtctggggaattgtgaaatttacataaccactacttccgatgtaatataaatatcagagcttttctttattgacagagattttttgacttgagatgaatgatgttgacccttgtggattctgagttgatttttgattctttctaattggtttctggtttctatttctattgatcagctgaatccaatcatggtcttttcagtagtgtatgctattggtgaaaatcaatattggtttcttcgccttgcttgtgatgccttgtctgctatcaaaatgtgtcatttgattggtttttgatagaattgatttgcatttgttgattcttgagattttaatcttagttgatgttgtctcataggttattattagtcttctctatcgttgcggcgttcataagtggagaaagtggtaaagactgcttaagt

SEQ ID NO: 4029 - DNA, 1207 bp, Unknown
  misc_feature (1)..( 1207): cDNA_ID_1822798_gDNA_ID_1620680_Annot_ID_48325 3000 nt of promoter + ATG
gaattcattgcctatcaatagccattgataacatactctataaattaaaaatactaagaattcaaaaataaactagcaattaattgtagaactaaaactagttgagtgaatcatacttttgttaataacacataattaagattgaatccgtgtgatatttgaaaacttggttggaatatcaaaattctgcatttctggcagagtactcaactccaacaaaaacaacacatgggtctcagatctctctgctgacactcccatcaattttcgcttattaaaatttatcttcatttagttaaatttgtagtattaataaaagttaacaacattcattaataccgaagattaggaacgaaaagagagacgtggaaggatataagtggtgacagagcagtcaaagacaaccgagacacgatcgaggcgtacagtcaaagcaacacacactgtcatatggtcaaacgtctagctggatcttttgcatgtagtggaccccatacttctttatttacactttttcttttttctttttcgtgccaatctaggaaataaacttactaaaaattgaaaaatatgttcttacagagaaaaaattgttgttattcttctaattaagtgggagtaatactacggatttgtttaagcaaatatgttccatttcaatagtatgaaacgagaaagagtaatgcttttgtttttccatgtatttactcattactgcaattattcttcatagtttctagaatatatagactgtaaagaaaagtgtttataaaaaacgagatttttagatttttgtttgaaaaaatagagaattgtttatagcaatgataatgatgattcaaataaaaggttaatgaagtaattaggccttgaaatgaacgtcgcacgtgaccctaacctgtcctcgtgggtatttgtagtttacttagcagctttttttacttacgtgcgggattttctttgctcatcgtctaaaagaccataatacccccttcatctatttttcttcttaatttactgagataatactttattgtttttgacaacacatcgatttcagtagcaaaaattaaagggaagacccaagagagtgctcttttaagcaacatgatatttcaatggaacacaaaatcaatatgaagatttattatttggtctaaaaatatttaaaaaaaaaacacctcaattttttttttagctaaagatg

SEQ ID NO: 4030 - DNA, 3000 bp, Unknown
  misc_feature (1)..( 3000): cDNA_ID_1822794_gDNA_ID_1620680_Annot_ID_48326 3000 nt of promoter + ATG
agtaatattaatctaacataaacaaccatagttctcttgaattttgaactacgaattttggttttaaaaaacagctgagaatttgaatatcttgagcaatctgcatctgattttgatttctgacatcctgattaaaagtggtttcagatttgattctgaaccgaagaaataggcggcttcttatttatcgttaagtttaatattaaacgttgtattgctctttaagtatctttaaaacctcgtttacttcgtgttattattcaattttgttataacaaacaaattttgatacgttgctctcttcttctttgactaaaaaaacacatgttggtacgtaggttggattttgagagctaattaaatagttaagatgatggaaatagcttatcagcctcggattgattccgagattgaatcactcgtcgagagaatcaatcctccaaggttagtaccttattaatatttttatcattatgttggatattttttttttaataaagtagtattattcttgatattactggttttgtgcgctaattagggtttgtgtagacaacgactctgacccagagtgcacacttattaaggttataaaaagctcttgataatatgctttttaattataagttcatagataatgactaattagccttaattaaacatgtggttgatatatgtaggtagatagcgcgaacaagtacgggatattactggacatggttcaagtgttagccgatcttgatctcgttatctccaaatgttacatctcatctgatggcgaatggttcatggatggtaagtcgtcatcgtcatcatcattcacatgtcatcatggtggaccatatatcacatgacacctgaaatttctctttgttagtgtttcacgtgacagaccaactcgggaataagctcaccgaccgaagccttattctctacattcaacaggtgtgagattaaaatcattagtacaataatcacctaatcatttttaaggaaaatagtataaaattaccaagtaaccgaaaaaatcattaactaagatgaccaactcttataatgtgacagcttcgtttatttatgtttctttttgggtacttttggacgtatctaattagcttcttgagtttacttgtgaaattaatacatttcatttttaatgatttttggtttttacaaattcaggcaatatgttctagtagaacgggaggtataacaaaggagatgcagagtaatctaaaacgggaggtgcaacagcgccacgtgtcaacagaacacacggcctttgagataaccggaatcaatagaccgggtctactatccgaaatatctgccgtactttccgacattggatgtcacgtgacggctgctgttgcatggacccaccacgagcgagcggctatggtgatttatctagaagacgggtttaacggtgggcccattatcgacccaataagaaaggcccaagtaaaggatcatctggatacagtcatggaggcccatcacatagttggcgatgtgtctcatgtcgtcgtgagggtcgtcgaggctaaaggagttccggtcgggtgggctcacactgagcgacgacttcacgagctaatgtacggagaaggagattacgagaattgcttcgactgcgattgtttcggagacaggtgcgcttgaatttatacgaattaatcatcaatggcaaaataaaaatgttgtttagcttcgttcgatacatgtgacaggtgcgatgctttgtggagaggaagatgcgagaggatacacgtgacaatcgaagcatgtaatggctattcaatggtgaatgttaagtgtagagacagaccaaaactacttttcgacacggtgtgtgctttgaaagagttacaattcgttgtgtttcacgccgtcgccggagctaaaggctccactgcagagcaagaatatttcataagaaagaagaacgggggcacgttagaaacggaagggcaaagagagagactaaggcattgtttggttgctgcgatttcgagacgtgcttcacaaggattgaaactcgagattcggacagagaacaagatgggtttgttgtcggatgtgactagagttgtgagagaaaacggtttatcgataacgagagctgagatgtgcacgcaaggtgagattgcggttggctcgttttatgttacggatgtgaatggtggtgagacgggtcctagtgaggttgaagcggttgtacgagaattgggaggagcggttgtgtcagcggttaaaggggttggaatgatgccgaggaggattggttcgacgagtgatagtgtggagcaggacaaagctaagtcgtctattgggagaatgttttggtctaaattagagaggttgtcaacgtctataagatcgttgtgaagtgtttgattagtggtttttgcctctctggttctcgtgattatcgatcgttgtatatatagatgaactaggactatttgcagattcaattgaaattcgtataattattggttttagatgtgatctaatgagataagattctatcaatcaaaaccgttacttatcgtcttaatttgttcgaatgaatcttaatctcacaaaccaaacattataccgtcttaattgaactggaatttgttcggtttttacaaatatgagagaccaaacattatataccgttttattcaagttgtgagagattgtaaattgtagacccaatttcggtttggtttagctattgaatttgacagctggcatggataaagaacaattactttacagtaattaacaagtcaataaaagggcattacgggaaatttaaatattgaaatgaaaatagagagatctttataaaccctaatgtgacggtaaacagtaatacattagaacactctcgaattcgaagaaaatacgtagcaaaacccttatttttgaatttcagacgaattccgatttcttaatcaaaaatccgataagagctttggatttggcggcgaataagaaaacatg

SEQ ID NO: 4031 - DNA, 3000 bp, Unknown
  misc_feature (1)..( 3000): cDNA_ID_1822786_gDNA_ID_1620680_Annot_ID_48329 3000 nt of promoter + ATG
atacaaacacattttctatgcactagtgaaaaagacaaattttatcctaataacaaaccaaacacttgtcttgcattacattagaaaagacttgtgtggtttcaatgaattgtcgacatcttacaaaaatctacatgagcggtgagagagactggacttggacatatgttgctctaacttcttagtgttgatactttttccaaagcttaaagaaatatagacattatttcatagctacaaatatacagtgatttttaagtatgaggacaaaccagagagactttgatcccatatgtttcaagcaacagtggctttgcagcagacattaatgacatcatccagagatggatgatctcccgtgccttcgtcttttcgaccgtacaataatttcttgcctctgaacacaaacgtacctccctgagaagaagacagaacaaatgatcaaaccaaaaataaaagcagatatcttgtcttgtggagaacttaacaagaaagaacctgttgcaacacactgcttctgtcttcaggagtggcttctatggtgtaattttttgttgcttctcgaatctcgctaaatcttgagaagaccttggtctgcaataatcgaggttttctcatgtttcgaggtgaaaatagtgtatacaatgagacggtaacaatgtttgaggtgagtaggttcatacgctagctgggttgaagaaagtgcggcccaaaccgaagtataaaccaagaacatcatatgcctgcatttaagaagagccctctcaaaacttcaatcaccatttcaacataaaagatatcttaaaaacaaggtatatgtttgtttgtgttaccttgcgttcaggatccgcataaagacattccatgggaaaaggtaactaaaacaaggaaacaatctagactcagtatcttggttaaacaataaagctcccataatacaaggacttctctgggaagttggaacttgctattttgatttatgctgcgcctgttggtatttctgattctatccaaaagtacactatataaagccatgaaaatgcgcttgaatggaggatgaaatcaagctaaatcttccctatatctctcaccctcttctcatgttcgagttgcagattttgcaaagaccaagcaattaacaaatcttactaaattgtatcactaaagagcttgagaataatctcacaaaactcaacccaatcttggtctgattttttaattcacaatgacaccaaacatgctcaaaacgcccattagtgatacaactaactaacggttggtcttcgtaaacatgcaatgttaaggtgagaagagggagctagacactcagagatatggagaagactcggtctgatctcatcctcgactcatggctagaaaccagagtactactaaatgcacttatcatcagagaggaaaaccactagagcatagcataacaatcaaaagcaagttcttctcttaaaaagttcaacccaatgaacaagcaaacataacgtacatccaaagaaaacatatccatgagctcagtaagttggtatatatatcgaagaaaatggagaaatcttatacccgagttgcaagtatacgagccttgtcaggagttccaactccaacagctatcaatttaacaccagccgcatcaaatctcggtttagcctctttcaaagcagtagcaagttcccaactttcatataaaaaaaataattcattatcaaaaacgttttacaacaatccttgattttgcaacaattccaagtgtttatgaatgaatcaatttaccagcaaacgcatccgaaatgcctcaagagtacaacggcagcaattccctgtgtccaaaaaaaaacactattcaaacaataatatcccaaaataatgaaaagaattcgttcttcataagcatcctaacatacatctttctgatcccagagatcactgaattgcacgcgttggcctgaagcagtaaagatagagacatcgccgagtatctcaccgatatcttctctgtaatcagtgaaggactcagtggcagctctcgcggaaaccacacgaggcctactaatcggtgaaacggaggaactgtaactggattttaatttggtgacaggaacagaagcaatcgacgatgagaaattcgatggtaactgagacaacatgggtttcgagcacagaggagaaattgtggaacaaataagcggcaatgagctcgaagatcgtagagagagaatcgccattggtgattcagaaaccaaaatcataaactcaatttggcttatggagaagacgagaagaataagaacaagagcatctagaaattaaacacgtggcgaataatggaccgagaatgtatccggcgtcgtttttagtttaaagcccatatttattttgaaagcccaattcaaatccaagtccattaaaacaaaattacgaaaattgctttcgattttctcatccaaattggttcgtcttccccataaactctcactctctagggttttaaccgtcggcgtatccgccatgagaacactgcggagaaatgttacggagaatcgtcttaccatctcccggcgtagaacggagaagaagacctcaccgaataaaacagaaaagtcagtccagatcccagttgatatcatcatcgagatactcctgagattaccggcaaaatctatagcgacatgtcgttgcgtgtcgaaactctggatctccgtaatttgccgtcaagatttcacagagctgttcttgacccgatctttgcatcgaccgcaactcttattctgctgcaaaaaagatggtaacttgttcttcttctcgtctcctcagcttcaaaatccatatgagaactcgtccgccatttctctaaagaatttctccttatgctataaaatttcgcgtcctgtcaatggcttgatctgttttaaacgcaaggaaatgaacgaaacagtgacagtgatatgtaatcccagcactggacataccttaagcttacctaaaccaatg

SEQ ID NO: 4032 - DNA, 3000 bp, Unknown
  misc_feature (1)..( 3000): cDNA_ID_1822772_gDNA_ID_1620680_Annot_ID_48333 3000 nt of promoter + ATG
ttttccctttcatcatatctttaaccagctaaaacaagtttgaagcgaattttgcatatatacagtcccaacttcgtcaattatattgaagttcgttatctttttttttttttttttttttttttttttttttttttgtatgtgtgtgtgtgtgtgtgtgaaatatcgcgattaatagtttaagaaaattcttcatcagaataatagattataatattttcaaagatttacttgttttttgattattttgattttattaaaatcatattgttgagacaatggtattatggtcatgaagaacctcaagtgttttatgtatcaattggcaaatttcagcacaagtgaatttttttcttgattattttctactgtctatacatataaaatagagaatataatataacaactttgagctataattagaatctgttggaaaaaaatgaaaaaatataacaaatatattctatcttgatttttcaaagtatagaatctaaaaaaagctatatgatattaattatccaattatatgattgcatttatgagttgatatgatatcttttggttgtttcataaaacagaatcaagaataagatgatcaataccgaaatatatggcttcatcatcaaatattatttcacatgtgattctccaatgtatcattattaagagttgttatacgaggacccatttttttcgcagcaatcaaatcaatttgagctttttaattaaaatcttcaaaaataatctgagaaaatcacagcgtctcattaattattaaaaaagtacttcaaaaaagtggatatacgattttgaaatgataacgatttcctgacgtcagaaaaaatcctataacaaacattaatgtttttttttggttagttaagagacaataatatgttacatctaccaaagaatattccagttaagttagttaatagttggagtcaaacttaaacgaacaacgtcgcctacaaatctgggggtataagttataaccaacggccaccaacatgggttttgatatcgtccacctgatttttatgttaatataactcaatttgattgattaaatattatgctcttatactaatcattctaggtccaaaactgaatcactcattgcacatcatttttatgatttttattttgaaaatctcatgtttcaagaaatatttgtgcattctactagtagcttattttaaataaagtttcgagtttatataataaacaatatgtttatttctttgatttgtatacattttaaaaaaaaaaacaggatgaagatatatacaactaaagctcaattcaactagtaggaaaattgtattctacaaaaaatttgtgtttatgtttttattatgataaccatccaaactcattatttcacccatgatcaaagtaactatatcaatatatctgcaacaatatctgactcaacatttatttttacataaactgcggaccaacacaattatgctaaactatcatcatttattctattggtattggagatcagtctacgtcagtgaataccgcataattcacatgaaactaactccaaaaccctttaaccaaaaaaaaaaaaaaactaattacaactccggttaacctgtcgataattacaagactgaaaacatcctagtcagtaaaaaacatatttgtatgtatccgatcccaccaaataaataagttgttgtcaatgatagaggaagagaaaacgaaaaaaaattgcggaccaagacatttgggactactagagtttagggagcataaatggtcctatttgacttaccctctaccgtataaataaatgtattttagccgtataaatgtatacatacgtagatgcataggtatacaggattactttagacgatttgatgtcggtatgacattacatttgactcccctagctccacttgtctctgttcatttttcttgtatgtcatttccttgttttccaattttacgtttaccaccctattttattttgttaatattttctaagtcaacgtgttgacacttaattacagaatctgataactaaagttacataaaatgctcacagtttttttcagcaaaatactcacattatacgacatataaaattttagcagtctataaatagtaattatttggcattagtattggacaagaagtagaatataaattaatgttggttcttttttctatccaacttcacacagccaattttgtagctgacatcgtgaatggacgactaaactaatcataagcatagtgattcagtttatacaacaacaacaaaaagttaattacatttgaggtttctttttaaattgctatgtttggtccctaaatgatggtcataataaggacggtccggcggtgacggaaacgcgtaaagactaatcattttagtactattaatttgtagaattattattaaatatgcttgaatcctagaaaacgatcaaataaattttggaaagaagctcaaaatgtgttatttaattttgtccctatgtagagctggtttttttatttttatttaaacataatcctaagatttattgctgtatgtgtgaatgcaataataaatagaaactcaataatagatcattcttattttcaaaaagaaacaagaactactgcaatgttttaattgtttattttgtattaaataatatagcttgttaattattggagatcgcattaaataataaaagaagttgtctcacatgtcttggagaatatttactaaaaactatggtaatgtctggacggtcaaaaaagtctctctagtttctgattctgttgtcacattttatttttgaaattaaatgtcgttagattattattatctatatatatatatatcccaacagacccattgcttctccaaccacatctcactcttcaccaacttaaaccctaattcaagatctcttcttttcgttctctccttcacccacattagtcttctctacgaccaaaatctcttgactttaaaaacagaga

SEQ ID NO: 4033 - DNA, 3000 bp, Unknown
  misc_feature (1)..( 3000): cDNA_ID_1822768_gDNA_ID_1620680_Annot_ID_48334 3000 nt of promoter + ATG
aataggcgataacattataataagttcaataatacaaactttataagagtttattgaatttttgttgggaaaattgaaaaagaagggatggcctacgatgcaaagaccaattcctgtttcctactagtgttgttgaaatctgaatacacattttgtcatgttgattagtgattacccttagcttcaaagttcaaattaactttacactaacttttccataagtaaagatattttattcatgacgatacatattttattctacaaaaacatataaacagtgcattgtacctcaataatttgaagactttatatttttccaagtgctttgacttttaactctttattaaccatcaggagacaagtcaacctttatttccctctagaagcctttggctaatttattaaacttaaaaacgaaccaattaaaagttacaattcataattatttttgtttatgattttttcactattattaataggctattcgcatgtatattcaatcgtatttcacttgttttgcaaggaactaaattataataaacaatacacccaaattgaccaacttatcttacacaaaagattaagagcatacgtttatagaagaaggtccaaaaaattgtgacgccatttaataagaggtatagtgggttttcttgttccttaatctcagctgccgtggaaaataagtgttagtagtaaatttattgaattaaattataatagttagatttgtaacatccctatcaaatctttgattaaaatttgattttgggtccatgggacaggcgtcattaggttcaattttaatactgcatgattattaagtggctacatttataaatgaattaaacaaacccatctatcaattcagtattgtcaccgtgagtttgaaactttgtcattttataagttataatccgttatattttattacaattttttctcttaaggagattaataatagataaaatcgtacctgatccagaaaagttttaatatccataaatttgttagtggtaaattttctccgagggttggcaaaattttgttcaccaaccgtaacggaatttacactcacaaatttcaatatctctaccttcttttcatctcttttggtacatatcattaactcctttccttttcaaaagacaaatgtatattaaatagcaagtgattcaccatccaccaaatgtgatcttctgattagtgatatttctttagacaatttaattgatggatttgaaaggaaaaaaactttgatatatatagtatgaagaagtttctttgtatttatccaagaactgttagttcaatcacttgcgctttgtttacgaatgattaatgacgttaactattcaaatacgatgctactctgttgttgaattcatgcgctttgttttcgtctttgatttttaataaatttacatgttcaatacaaatatcttttttattggtataacaaagaaccatgataagactgatacataaaataagatgttgtcatgttcttatttaactactatatacttatattgatcatgctcaatgggagtttgtgtatataaaaataaatttagaatttttctttgtttttttttttttgggcaaaagaatttttctttgttaattcacacatttccatcaccaaacattcgaagtatttgtctctatctcgacaacatttatatatatttttttcttttttttgaacacgactcgacaacatataatacactcctttgtactgtatactacaaaataaactactaaacaatattgactctataatatataatttatatatacatacaatacaagtctaattcaatcacttttggttcaaattggaaaaacattgaattcttctattattcttgatgaccaagtctatatcacatgtaataaaagtacacataaccggtctttctttcttattcgtaagctgccatgcaagtggggcttcaagctttcgtaaaatctctcatgtattccacattattaatcgaatttaaagtattttgcatgttatttagattagaaatgtcgttttcttaatcacactcctaaactgcggatcagatataatcaccaagattaaataatataaaaatataatcactacttgccaagacatgaatcatgaggaaagttctatagcgtgtactaacatacaataaatcatatttatgcgtatacatttactagaaccataggatcgatgaatcagatgcaactcatgcagtcatattacaatatatatttagatatgttcatcttgatctttcaacttaaaactcgttcatattcatcatttaaaaaaatatatatatgaatgtaaaaaaatggtaatttaaaattagatgagaatggggaacaaattaatcaccaaacaaaaaaaacggaatagagtaaggaagagagaaagagtcaatgagtgggggcggctaagaaaacattataagtttataacttatgagttttatgattaggaaaattataataaaacttgttgtcgaatagtaaaattataagaaaactaagatattatttctcagtcaaattataaatgatattgaatatctagattctgatgtaggagcaaagacaaaggagaaaaacattagtctccccccttctctgtcatttcttaactctactaatattttatcacataatttatcatccaattttccaattccataaagtcactttttgattcaattttattttaattccctatactttattgacatcttccatcacatgaaggactatctcctccagctattatatactctctctctctctcctttattttttctcaattcacatataattttcacctttacacacatttccatgtaagtatatataaacctcacacacgcattatcatacaccatcctcctcattctcttcatcatcaacataagagagagagaagaaaaaaagaattacaattaataagaacaagatcaagaatcaagaatcaagaaaatg

SEQ ID NO: 4034 - DNA, 3000 bp, Unknown
  misc_feature (1)..( 3000): cDNA_ID_1822764_gDNA_ID_1620680_Annot_ID_48335 3000 nt of promoter + ATG
actgcggcaacgaaggtgatattgaatggtttgctacaaactctggattcatttgggatatcgctcccaagttcggtgccttgcttgttttccccgaggttcgttggtgttgttttatttttcctgttggaaattggaaaaagaagaagcaatttgttactgattttagggatttggtatagcataggtattatggagagtctatgccttatggaagcagggaagaagcttacaagaacgctaccactttatcatatctcactactgagcaagctcttgctgattttgctgtttttgtcactgatttgaaacgcaacttgtctgcggaagcttgcccagttgtgttgtttggtggatcatatggtggaagtaagtgagcaacttttgtgttagtggaattctttttaaatgagattgtggagtaattgtgtttttgtgtttgttgttattgatgcaacagtgttagcagcatggatgaggctcaagtatcctcacattgcaataggagctttagcttcctcagctccaattcttcagtttgaagatgttgtacctcctgagacgttctatgacattgcatcaaatgatttcaaggtaatacatacttttgcttcccttagtcgattgactttatcttgtctttctttaatcatatagggaccgtgtttttgtttgtagcgtgagagtagcagctgcttcaataccattaaggactcgtgggatgcaataatagcagagggtcagaaggaaaatggccttctgcagttgacgaaaacttttcacttttgccggtaaacaaataaattggagttagtgtgcgcttgttaagtgtattgattagtaatagttcaatggattgtttctcgatttgcagggtgttgaacagtactgatgacctttcagactggctggactctgcctatagttatttggcaatggtggattatccgtatcctgctgacttcatgatgcctttgcctggacatcccattagagaggtatatttgggaagtaacactttatgagtttatacgaatattgtagaagaaatctgagaatgcattcgctagatcatttggattttcatctttacatcaacgatccggggaggctatgctttaaagatttgcttgttgcgtcaggctattgttcaaccacgtccgttaaagtctttgttcaatgtggtgtatctttctataggtctgcagaaaaattgacggtgctggtagtaatgctagcatcctagatcgcatatatgcagggataagtgtgtactacaactatactggaaatgttgactgcttcaagttggatgatgaccctcatgggttggatggatggaattggcaggtatgaaaaagtcaactgctttgtttatctttcctttttctgataatatttcagtgacgccattattcactttcaccatccgtttacaataggcatgcacggagatggtaatgcccatgtctagcaaccaagaaaacagcatgtttccaggttatggttttaattactcttcatacaaagaggaatgctggaatacattccgagttaatccaagacccaaatgggtcacaacagagttcggtggacatgtaagacatcttttgataaactcaagattctttcaatgctgtgttctgaatctttactatgtctctgtaatgtaaaaggatatagcgaccaccttgaagtcatttggaagtaacatcattttctcaaatggtctgttagatccttggagtggtggcaggtaagaatattgttccctttactcaaatcccaagagctattttacaaaacgaatctcgtaatcgtgacaaatgcttgagtttgactcgtaatatgcagtgttctcaagaacttatctgataccattgttgctctcgtcacaaaagaaggtataactaaaagcctcatcaatctctctcgtaactaatctgttttttttttttttttttttttcatttgcatagacttaaaaacgtttgatcatagtagcagtagtctacattttattgacttgatgaattatttttggtatatctatcttacaacatcatgatcataatcataatcatcatctattctctttgaaactcacaaactaagttgattctggctttttcttctttttttctcaggtgcacatcacttggatctacgaccttcaacaccagaagacccgaaatggcttgtggaccagcgggaagccgagatacggttgattcaaggatggatcgaaacttatcgagtagaaaaagaagctaaggtttctctgttaaaacgttcttggtaagagaacaatgaaaagaatcgtctcagtgtgtaactcggaatctgcaaactttgtattgcgaacacatgctttgaataaatccatgtaactatgtaaactctcaatgatcactaatcttttctactagcttaactttttcgtttttgggtaattatatatgaatacacgcaaacaaaagaagtacagaataagatttatgagtctggctgatacacccaaacacatctgtcaaggatcttaaagaatcatatcttctaaatattaattttcatcacattgtgtttttatggcagaagaaagtatgaaacatttaatggttatgagtagaaaatctaaaatttaattaccatacagtcgtgactcttgagaaaatcggaaattttaattaccatatataatcacctcgtttaaactaaattgaaaattttggtattggccgctaaaaacgaggaggaaaaggcataaaacgccgtcgtttgggcattttgactggtcgaataaaaactcttttgactaaaacgtcgacctaaaaaaagaagagagagactagacctctctacaacgcactgtcacagaactcttctttgttgtgcgagagagaaatagaaaaagtgaagagacaagcaccgtgcttttgatcggagatcggaggaatttaggttcgattctccgtaattgtgatattgggagagactatg

SEQ ID NO: 4035 - DNA, 3000 bp, Unknown
  misc_feature (1)..( 3000): cDNA_ID_1807468_gDNA_ID_1620680_Annot_ID_48336 3000 nt of promoter + ATG
tctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtctggctattatatcatccatctctgtgaaataatctaataaccaattcaagtttccatttcatacttttcttgtactttttttttgtttaaaaacggatgttacttgttggtgataggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccgggtaaaaaacatttttatttcatttagtttgtcaatgccttttggccttttttcttttctttttcaatgtaacattttgctggaaaactattcccttgttcttttgcagagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacaggtatgcatttttttttaatctctagagatgataaccactcttcaattgtttttacatgatctttacgttgtttgtgtatgcagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcaggtatattatatgaccgatacttaccgttaagattctctccactttttgtatttgtttccctctcatttgaaaattttaactgcagatgagtgatgacaatccttacgttatccctgagatggacccaactcttcgaaagcagattcaagaatgtaattggcaagttgttaatgttactacacctgccaactatttccatgttctgcgtcggcaggtaaaatatctatttatcccaagttcgtaaaatgttgttacttaattttcgtattcttcacactcacatgcttgatatcatccatttgcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtataaaaaaaaagatccactttttccgtcattaactaacaaagttcccacattctgaaatttaatactttaaatgtcaatgaatcaggtctactatgagcttgacgaagagcgaaagaagtctgaaacaaaggatgtagccatttgcagagtagagcagctttgcccatttccatatgatctcatccaaagagaactaaagcgatatccaagtaggcgtcgaaaactcaagtttgtgttcaatagttttggttgattatggaattctttgaaacttttgttcttgtgtttaacagatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaaaaaaacacagcttgagaggcttgagcctgtataaaaaagacacaacacaaaaataaaagattcatgagagaatctttggttaccaaagagtgtcactggaaaataaacagatgtttgctagacttacaaatttaagtttattcgatttgtttggtttgttataggatttaatcgagataaaaggaaaaaagatttaaaccgtttggtttagtatgataattcattaatttggttcaactttggattgattttggttcggtttggttttatcagtgactgtatcagcttgaggcagttgcaatcttgtaactggagagaaaaagctatcaaagttaaaagttatg

SEQ ID NO: 4036 - DNA, 3000 bp, Unknown
  misc_feature (1)..( 3000): cDNA_ID_1822760_gDNA_ID_1620680_Annot_ID_48337 3000 nt of promoter + ATG
aaatttgcaaccccaaaaaaattcaccttagttagttttttgcttagtaaatttgtttaaattatagcattcaaatacttttgaggtcttaaacatagagtcatagattggttaagccaccgacagtactattacagctggagagaaaggatgtatccatggagaaaaaggcaaacaatagcattcaaatactctttttcaaaattactaagtaaaagagttattgcttgaaactccacattgattgtgattgatagatcagctttggggaattgagtggccacaaaagaaaaaaacaaggtacattcacatctcttatttgaaagctacatgagtcttatcttaaacgtacagaagaaaaatagtaaaaaggaacttttgtcctcacttactactactactcattactgtactaactcttctctttgtatcacgtttcattacaacattcagatatcagctaattaggatgatggtttgtctaactctatttgttgctggttttgactgcaactgggtctgaacaataagggcagttcccaaacagaacatcaaatgacctgcaagaaattggatcataattgagctttagagcacaaggattgtgtgtgtttggatatgagagcgtgagagattaaggtttccacttactgtcttgttgttgtgatagaccttaaccagtctgtgaggcagaggctatggaaagacttgttgcaactgatgttttcacatgtgtaatctgttcgtgtcccacttctagctccgagctcctcatcttagattaaagtaaatgagaagttagcgaaccatcaaagcaaattactattctgaagcattgctttttcggtttaagaaatcaccggtgggtagaaactgcgcatagcaaatcccacattcaacttgttgttgatcgtcttccacttggagacctagaggctttggaagctcagtacctagaatacattcaaggttctcaggaaatgatctttcatttgacctgtatgattatcattaacccgtcattcctgctttcaacaatccatataactccatgctatataaccaacctctcgaaagagatttaaaatgggagagtagagacaaaataattttaccatcttttgcaatttcttctccataacatatgcaagttgttcatatgcgtagctgaaggcacaggaccaataaaccgggacctgtctaagcacttataactattaaaaaatgtcgacaagtaggttattgagagtgtgtgtttgtctagaaacatactctggtagggatttagggtctttgaagtcgatatgaacaatgatgatacaatcattccctgagaaaaaaatgaaccaagtagagatagataaaagtgaatttcgtcaagacagaaataaaagagtatggagacaaatggaattgaggtaaaggtattaaaccagcatcaatccggcgaatagcagaggcacgagctggttgcttgacatcaacaacacatagagatttatcgatattgtccaagacagaccaaaattcttgaagatagtccaaatgctgttaacaacaaaaacaagctgattagtgattacaaagagagaatgtagcaaagtcttagatctaccttttggaattggtgcattacatccttcaatcttgaacttgttgaccattctagtgtaaacatatatggcacatcctacatcgaagcaaaagttaattcgctacggagaatgaaaaaagcttaaggatttgacattaacaaaccgcagaaacagaaggtggtgaattaggatagtctctgttcagttgaatttctaagttgtgagctcttcccttcttatctctgtacataatcatgatgatggcacaaagctaacatgtcacatgaagatggagctacataggttgcaaagtactaatcacattaagtaagattttgaagacaaccctaaaattatggaacttacagaatgtgaaagctaaaaaacgttaaatctccacctaatctccttattggttcccatccaatttcttctatctaagaaaccaatacaacaatggttcgttgaatatgtgagagcactcgatttcagaagaagggaagggatcgatggttaaccaaacctccgagtaaactttccggtaaaacgaagaagacttggctaattcctcgcatctttcacggcctacacattctccagaaacattcatcatctacgcagatcatcttcaacctctgaaactttctgcatctcgagtaatccgagtgctatgttttgggccgataagcccaatatttgatgaatcttattatggcgcagttaataattaggaacaagtatttgagtgaggacttcgagtgttacgttgggcctaaaagcccaatatttaatgaatcttattgaggcccagtttatataagtattaaaataacaggtatatagttatccttgtagccaaacatggatttttcaaggcggtgcactttcttacttttctttccttctttctctgtctcctagaagccacttcactgggatcgtctccatctttgatccaggttcgtcttcttcgtgaatcttcctgcttaattttttttttcagttactacttttttttggttattgttaattttctctgatggaaattctccgaaattgaaagttgttaaagccaaaatatttgggaattcaaaaacatttcgatgatctgaatgaggtcagatcgctgagaaaatatgggattataggttattttcgttttaaattttctatgttttgtatgtttgcatgatatatatatatatatatatatatatatatatatatataactaagtcgttacttgattagccatttttgacttatctactttctttttatgttgttgagtattttattgtgttgtttaatggatcattttcaggttcagagattaaacaatttgaaaaatcggagactctgggattgtatggttcgttgttactgatagattacttaagctatg

SEQ ID NO: 4037 - DNA, 3000 bp, Unknown
  misc_feature (1)..( 3000): cDNA_ID_2992487_gDNA_ID_1620680_Annot_ID_48338 3000 nt of promoter + ATG
cataggcttttgatactttcatggactcgaaaatttagggtttcagagacgaccacgttaccaccgtcatgaaaccgccagtgaccgtaacatattcacctctcgcatcttcttcttcttcacggagaagcaatcgaagagaatcaatcaactagacaaaaatcggaagaagaaacacaaaccgaggttttagaaacatggcgtctaaggtaatctctgccacaatccgcagaaccctaaccaaaccacacggcactttttcccggtgtcgctacttatcaaccgccgctgctgcgacggaggtgaattacgaggatgaatcgattatgatgaaaggagttcgaatttcaggtagacctctttacttagatatgcaagcgacgactccgattgatcctagagtattcgatgcgatgaatgcttcacagatccatgagtatgggaatcctcactcgcgaacgcatctctacggctgggaagctgagaacgccgtcgagaacgcacgaaaccaggtcgcgaaactgatcgaagcttcaccgaaggagatcgtattcgtgtccggtgcaacggaggcgaacaatatggcggtgaaaggagtgatgcacttttacaaggacacgaagaaacatgtgataactacacagactgagcataagtgtgtgcttgattcgtgtaggcatttgcagcaagaaggatttgaggtaacttatttacctgtgaaaactgatggattggttgatttagagatgttgagagaagctattaggccagacacagggctagtttctattatggctgtgaacaatgagattggtgtggttcaacctatggaggagattggtatgatttgcaaagagcataatgttccgtttcatactgatgctgctcaagctattgggaagatacctgttgatgttaagaagtggaatgttgctttgatgtctatgagtgctcacaagatctatggaccgaaaggtgttggtgctttgtatgtgaggaggaggccgagaatcaggcttgagccgttgatgaatggtggaggtcaggagaggggattgcgtagtggtacgggggctacgcagcagattgttgggttcggggctgcttgtgagttggctatgaaggagatggagtatgatgagaagtggattaaggggttacaggagaggttgctgaatggggttagagagaagcttgatggtgttgtggtgaatggttcaatggatagtcgatatgtagggaatttgaatttgtcgtttgcttatgttgaaggagagagtttgttgatgggattgaaggaagttgcagtgtctagtggaagtgcttgtactagtgcgagtttggagccttcttatgtgttgagagctttgggtgtggatgaagacatggctcacacttcgattaggtttgggattggtaggtttaccacgaaggaagagattgataaagcggtcgagcttacggttaaacaagttgagaagttgagggaaatgagcccgctttatgaaatggttaaagaaggtatcgatatcaagaacattcaatggtctcaacactgattcaacagttccactcaaactgtgcgggacaagagggaatctccagtctgtggtcagccggggtatatgagagccatactgagatgtgagtatgaacgatgatatgatcctgtgttcttactatgttctgttggtaagttatctatctatattgctttctagagagaattgcatgtgagagtttcttgtgtggttttgtaataaaacagaaacaaaggttcatttctggttagattgtgatatcctttgaaattgaatgattaatttttaggtgttgtgagcttagcttttttagctacggtaatggtgaagtttgttttgtttttcttcttatttatgaaaataaaatacaattttatgtgaatattttttttattcctcttttctcactctctaaaaatgtcggcgagtctcactaagatgttgaagtaacaaaacatgaaatgagaaatgaaattaatgttcttaccttcatgttaagttgaagtagatcataattatcccatgtgatttggtaccaaagttttttttttcagatctacgtacactcgagtcgacctttgctatgaactcaaatatgatccaataaaattttatattcttctgtgttttttttttttgtattcaaatttggatagaaacaagtatttagtaggtcgtaggtgccataggtggcccttgggaaacatccaatggatacaaacctcatattataaattctctatgccaaaataattaggaccataggttatgttatgtacctcaaccatcctttgattgagacattaaattccttcacgtttgtaaaccacactttcgtatacattttcttccctaacacttcttggcactgtttcttttattaatttgatttttgaaacatatgtcaaaagaaaagaaaagaatcgaaacatttaattaattaatgtttgtaattgcacgttgtacattcattacttttataaagagactgatcaaatgatgattgataatccttttagtgtatattaggcgtgtcaatggtgtatatattatatagtgtctatatgtcataagaaacgtcataaattttatcaaaggaacaacaatttaagtctgattaatctataattctcatccttacattttcattggcatcaaatttaggtaatttttagaatatagcttaataaatgagtaggccaagaggacggctcgcaattagctgtgtggaaagctaaacgatgtctcctaccgtccacgtcagcgtcttaaatcctcaaatcccattggcaacaaaaaaaacattgtgtatataaatacatgcatacttatcactctctactcacttttacaactaactcataagtaaaacacagacagtttttagatggctaagatatattccccttcttttcccggtactctctgtctttgcatttttactctcttgacgctaatg

SEQ ID NO: 4038 - DNA, 3000 bp, Unknown
  misc_feature (1)..( 3000): cDNA_ID_1822756_gDNA_ID_1620680_Annot_ID_48340 3000 nt of promoter + ATG
catgttcaaagtgggtttcttctaatccaatttgaattttagttcttatattattcccctctaaccctaatcatatgtttctcaaacttttgatttttattcaagattcctcctaatcagttatttcttctttgtatgtagatgtagttgcaacttcagagcttttctcatctgtggtgtcgtagcgtgagagagacggatttgcagtcattgaaactctttggacattacaaagcccaataaagatggacaaatgacaagcccatttttaaattttgtctgactctcgcctatcctacatgaattctacagagacaatgcatcatcccattcggctaggtcaattttcatccctatcttgtttataatctataatcttatagataggttacttacaaaaaaggtctttaatactacttttgatttttcaaaacataatatatttctcaaagtttttgatttttaaaggtttttaactctctttatttttctatttttttcttctataaatattaaattaatatgacgttgtgaaatctaaccggattttggatcctgccatgtaaccatggtcattagcgattccacaaatccaacatgttttttcacatcttcatgtatatttagcattttttttttttttttttttttttaaaaagttttcaactcttttgttttttttaaaggttctataaatactaaattcatatgagattcaatatttagaatataaatactaaactaatacatgtggatacccaatacaaatataaacctaacagtattagttatatactaaactaatatatatatatatatttgtaatacctcaagaacctaaaattaaaataataaatccgaatatacagcggcggatccacgttatgggtgatgggggcaactgccaccagtaaaatataaataatttacgttttttaataatacagagtaagtaaagtaacagaatggtatgaaatgctcccactaaaagcaagaagtatcgggttcaaacccatttaaagacattttgcccccattaaatatttctgctgagtccgcccctgcgaatatactagattttgttttttagtaattcatataaattggatatatttgggataaaagtagccaatgttatagttttcttttaggtaatttgagtattttggttatatttgggtaaagagtagtaaccaatgtatttttgggtaatcggatatttcgattagatttagtatatatggtactctttccgtttcacaatataagttgttttagctaaaagcacgcagattaagaatatttatttttaaaaagtttaaccaatcataaaagacactgcataatagaaataattataaaacattaaaataatatataatagaaatttgaaaacaacttatattgtgaaacaaaaaatttggtccaaaataacttatattatgaaacggaagaagtatattatattctctcatccattttaaaaataaaatttgaggattttaaacaaacttgttccccctttttatggagtacttcttataatagtggctaattataagagtctaaaaacgaatttttatatgaatttagaaaaattaggatggggtttttgggaaagataaaatgttgcctataacagtacatatttaatcagacagaagtgtcttcacggcgacgaagagtgtcttccggcaattgcatactccaacgcaaacaaaaaatgaaaataaagcaaatgtcattcccgttaaataatacgtgaatgtcattcccgttgaatgctaattaaagtagagaagcctcaaaatccgatgagtcatacgtgaatgtggttctagtgtctccccaaatggcttccttccatttaattccgaagttaacttttacacttgccatcaaactttagtaatgaagaaaacattgatacaacaaaactgcgagtgtaaaaagtctcatttcactgttaaattattaattttaagagtagacattaactgcgcctaactgatgactaaagaagagttgatcaaacaaagtctacacattacctaacattctctgttctaactaaatacatccatttaagagacacttaccaacctcctactcaaagctactctaactgttgttcaattaaccatcaacataactgcaggagtaattgattaaacaacaatgaactctgacttcatcaaaaacatcgaaagactctgaagtcaagcatgttgtttttatatgtcaaccgcaaacctatgcattaaacaaccaatagaagccaaaaaaacgtacagaatctaggagaatgcaactatgattatgaaaattcacgcacactaataccactagcttacaattagagagtgaaacgttacaatacgtccacgcaaaatacgtcttattattatgataacgtacattaatattcatgttttctgtttgtgctctgcattttgcttatctgtgctaggtgaaaacaaaaaaaagaagagatttggacattttaacacacgctttgctcgcacttcacttttttcacaatcatactgttattttccttcctcttataatgaaaacttaccgataagcaaatttgtaccaaacgtatgaacgaatgatctttctagattagtcgattttaccatacattaattaaattattaggttcatctacccaactacaaaaaaagggagataacgttggcgttttcaaaaaagagtgaacactaataaaagttttctagattccttttctcaacttttctttaagctaaaagactccaaacaaacacttaagaaagaaactgtcactcaaacttaaacctacttcccatgtgaatcaaaagaaagcaaaaaaaaccagcaaatccgtccatctttaaataacaatctcaaactctttaaacgttactcaacttttttcttcttttcaaaaacccattctatgaacacaatctcacctccttcatcgtgtttcatacctctcttcccaacacgatg

SEQ ID NO: 4039 - DNA, 3000 bp, Unknown; identical to SEQ ID NO: 4038
  misc_feature (1)..( 3000): cDNA_ID_1822756_gDNA_ID_1620680_Annot_ID_164408 3000 nt of promoter + ATG

SEQ ID NO: 4040 - DNA, 3000 bp, Unknown
  misc_feature (1)..( 3000): cDNA_ID_2992487_gDNA_ID_1620680_Annot_ID_164406 3000 nt of promoter + ATG
taaagaaaaaaataaaaatagtattgggcaacttataggcccattatgtatattaacaggccagtttctcataggcttttgatactttcatggactcgaaaatttagggtttcagagacgaccacgttaccaccgtcatgaaaccgccagtgaccgtaacatattcacctctcgcatcttcttcttcttcacggagaagcaatcgaagagaatcaatcaactagacaaaaatcggaagaagaaacacaaaccgaggttttagaaacatggcgtctaaggtaatctctgccacaatccgcagaaccctaaccaaaccacacggcactttttcccggtgtcgctacttatcaaccgccgctgctgcgacggaggtgaattacgaggatgaatcgattatgatgaaaggagttcgaatttcaggtagacctctttacttagatatgcaagcgacgactccgattgatcctagagtattcgatgcgatgaatgcttcacagatccatgagtatgggaatcctcactcgcgaacgcatctctacggctgggaagctgagaacgccgtcgagaacgcacgaaaccaggtcgcgaaactgatcgaagcttcaccgaaggagatcgtattcgtgtccggtgcaacggaggcgaacaatatggcggtgaaaggagtgatgcacttttacaaggacacgaagaaacatgtgataactacacagactgagcataagtgtgtgcttgattcgtgtaggcatttgcagcaagaaggatttgaggtaacttatttacctgtgaaaactgatggattggttgatttagagatgttgagagaagctattaggccagacacagggctagtttctattatggctgtgaacaatgagattggtgtggttcaacctatggaggagattggtatgatttgcaaagagcataatgttccgtttcatactgatgctgctcaagctattgggaagatacctgttgatgttaagaagtggaatgttgctttgatgtctatgagtgctcacaagatctatggaccgaaaggtgttggtgctttgtatgtgaggaggaggccgagaatcaggcttgagccgttgatgaatggtggaggtcaggagaggggattgcgtagtggtacgggggctacgcagcagattgttgggttcggggctgcttgtgagttggctatgaaggagatggagtatgatgagaagtggattaaggggttacaggagaggttgctgaatggggttagagagaagcttgatggtgttgtggtgaatggttcaatggatagtcgatatgtagggaatttgaatttgtcgtttgcttatgttgaaggagagagtttgttgatgggattgaaggaagttgcagtgtctagtggaagtgcttgtactagtgcgagtttggagccttcttatgtgttgagagctttgggtgtggatgaagacatggctcacacttcgattaggtttgggattggtaggtttaccacgaaggaagagattgataaagcggtcgagcttacggttaaacaagttgagaagttgagggaaatgagcccgctttatgaaatggttaaagaaggtatcgatatcaagaacattcaatggtctcaacactgattcaacagttccactcaaactgtgcgggacaagagggaatctccagtctgtggtcagccggggtatatgagagccatactgagatgtgagtatgaacgatgatatgatcctgtgttcttactatgttctgttggtaagttatctatctatattgctttctagagagaattgcatgtgagagtttcttgtgtggttttgtaataaaacagaaacaaaggttcatttctggttagattgtgatatcctttgaaattgaatgattaatttttaggtgttgtgagcttagcttttttagctacggtaatggtgaagtttgttttgtttttcttcttatttatgaaaataaaatacaattttatgtgaatattttttttattcctcttttctcactctctaaaaatgtcggcgagtctcactaagatgttgaagtaacaaaacatgaaatgagaaatgaaattaatgttcttaccttcatgttaagttgaagtagatcataattatcccatgtgatttggtaccaaagttttttttttcagatctacgtacactcgagtcgacctttgctatgaactcaaatatgatccaataaaattttatattcttctgtgttttttttttttgtattcaaatttggatagaaacaagtatttagtaggtcgtaggtgccataggtggcccttgggaaacatccaatggatacaaacctcatattataaattctctatgccaaaataattaggaccataggttatgttatgtacctcaaccatcctttgattgagacattaaattccttcacgtttgtaaaccacactttcgtatacattttcttccctaacacttcttggcactgtttcttttattaatttgatttttgaaacatatgtcaaaagaaaagaaaagaatcgaaacatttaattaattaatgtttgtaattgcacgttgtacattcattacttttataaagagactgatcaaatgatgattgataatccttttagtgtatattaggcgtgtcaatggtgtatatattatatagtgtctatatgtcataagaaacgtcataaattttatcaaaggaacaacaatttaagtctgattaatctataattctcatccttacattttcattggcatcaaatttaggtaatttttagaatatagcttaataaatgagtaggccaagaggacggctcgcaattagctgtgtggaaagctaaacgatgtctcctaccgtccacgtcagcgtcttaaatcctcaaatcccattggcaacaaaaaaaacattgtgtatataaatacatgcatacttatcactctctactcacttttacaactaactcataagtaaaacacagacagtttttagatg

SEQ ID NO: 4041 - DNA, 3000 bp, Unknown
  misc_feature (1)..( 3000): cDNA_ID_2045658_gDNA_ID_1620680_Annot_ID_164405 3000 nt of promoter + ATG
ttagccgaacatggttcccttccacaaccagtgtagcaaaagcaagtgcttctccaagtccccagtcaatgccttctcccgattcaatcatttgagcacgttgttcataaactcttttaactcctctgtgtggcttaaagttctcagggaaggttgagattgcctttcccacattcttcaaaatctctggcttcactctgcaaaagaacaagggaatagttttccagcaaaatgttacattgaaaaagaaaagaaaaaaggccaaaaggcattgacaaactaaatgaaataaaaatgttttttacccggtgtttcgaatcctagaaatctgctccggagacttgaatccagtccagtgacttgccagccagtcacgtttttgtggaatataatctttacttgcctcatattcttcattgaggatagagcttactttcttttgaatcttatcaatatcttcttgggttacctgtccagattgcaagagcttctcctggtagatttgaagtgacgagggatgactgcgtatcacctatcaccaacaagtaacatccgtttttaaacaaaaaaaaagtacaagaaaagtatgaaatggaaacttgaattggttattagattatttcacagagatggatgatataatagccagaccttgtacatttttggttgtgtgaatgacggttcgtctatctcgttatgcccaaagcgacggtagcatactaaatcaacaacaacatcagaatggaacgtctggcgccactcagcagcaagctcacaagcatgcactactgcttcaatgtcatctgcattgacatggaaaattggggcgctcaaagcctttgcaacatcagtgcaatactgtgaagaccttccttccctgggatcggttgtgaaagccacttgattattcaccacaatgtgcactgttccaccggtacagtagttaggaagtgcactaagatggagagtttcatacaccactccttgtccggcaaagctaccatccccatggatcaaaatacccatgttctttgttctgttctcgtctttcgtgtaatattgtttcgctctggttttacctatcacaacaggatctactgcttccaagtgactgggatttgctaccaaagacaagtggagatgtttgcctcctctagttggacgatcataagatgtacccaagtggtatttcacatcacctgttccggtgtaaagcccaacttcatctactggcctagtaccaccgctaaactcgctgaatatttggcgtagaggttttctaacaacattacccaaaacattaagtcgacccctatggggcataccgataactatgttctctaccccgagatctgcagacctatcgaacatctccttcatgccaggaatcaaagattcagcaccttccagtccaaaccttttagccgtggtccacttagtagccaagaaattctcaaactgtgtgctccaggtaagcctatcataaataaccatccgacgctcactattgtactgtcgaggagttggggtctcgatcttgtctctcaaccagttacatttatccctatcagcaatgtgcatgtactcataccctatagtcccacagtaagcttgctcaagcctcgacagtatcgacctcagtgtttgaaccgggcggttctcagagagaaaacccgacatcctccatacacccagaaagaattcccgatcaagatcagcctcagtaaacccataaagacctggcgtgagatcctctggaatctctctcttctctagacctaaaggatcaagcttggccttcatgtggccattaacctggtaagctctaactagcaacaacaaacgcatgctttcttgaatggtttgccccgagataccaggcgatgtagaagcctgacccacaaaattcctaaaaaagttatcccacgactcatcaacactgttgggatcagcctcccaagctctttgtaactcctctagatacacactgcttgttccatctaagaagctatcagttagcttagaaagtgggacaggacgtggaacaggtgcagcagactctgcctttgatttgagtattgtagagtgaaaacatctggtttgacaaggcaaaacccttgttctagtggcatatgaaccacaacgagactgagacagtgtccttcttatggcaagctttgccacagaagaaccgattctaaaccaaaccatagcttaagtaatctatcagtaacaacgaaccatacaatcccagagtctccgatttttcaaattgtttaatctctgaacctgaaaatgatccattaaacaacacaataaaatactcaacaacataaaaagaaagtagataagtcaaaaatggctaatcaagtaacgacttagttatatatatatatatatatatatatatatatatatatatcatgcaaacatacaaaacatagaaaatttaaaacgaaaataacctataatcccatattttctcagcgatctgacctcattcagatcatcgaaatgtttttgaattcccaaatattttggctttaacaactttcaatttcggagaatttccatcagagaaaattaacaataaccaaaaaaaagtagtaactgaaaaaaaaaattaagcaggaagattcacgaagaagacgaacctggatcaaagatggagacgatcccagtgaagtggcttctaggagacagagaaagaaggaaagaaaagtaagaaagtgcaccgccttgaaaaatccatgtttggctacaaggataactatatacctgttattttaatacttatataaactgggcctcaataagattcattaaatattgggcttttaggcccaacgtaacactcgaagtcctcactcaaatacttgttcctaattattaactgcgccataataagattcatcaaatattgggcttatcggcccaaaacatagcactcggattactcgagatgcagaaagtttcagaggttgaagatgatctgcgtag

SEQ ID NO: 4042 - DNA, 3000 bp, Unknown; identical to SEQ ID NO: 4035
  misc_feature (1)..( 3000): cDNA_ID_2050510_gDNA_ID_1620680_Annot_ID_164403 3000 nt of promoter + ATG

SEQ ID NO: 4043 - DNA, 3000 bp, Unknown; identical to SEQ ID NO: 4033
  misc_feature (1)..( 3000): cDNA_ID_1822768_gDNA_ID_1620680_Annot_ID_164399 3000 nt of promoter + ATG

SEQ ID NO: 4044 - DNA, 3000 bp, Unknown; identical to SEQ ID NO: 4032
  misc_feature (1)..( 3000): cDNA_ID_1822772_gDNA_ID_1620680_Annot_ID_164396 3000 nt of promoter + ATG

SEQ ID NO: 4045 - DNA, 3000 bp, Unknown
  misc_feature (1)..( 3000): cDNA_ID_3072382_gDNA_ID_1620680_Annot_ID_164390 3000 nt of promoter + ATG
tgacagaacataactacatttcaaactccaaacttacgaaaacacacaagttttttctggaatctttcaagttttatttgatgtttcggaagaactaaattggggttttatctagtggtagacaaaaaggaaaaagatgagtacattttattgggcaatgtgttaactaataaagtttctagatataggcccatagaaaaaccaacttatataaactgtaagcccataaaggcccaaataaaccctaattttaaatccaccgacacatgtataaatgccaagccgtttcatatacgtctccactctgcaactcaggtaaaagactcttgctcctattatctcatgttccattgtttgttgatttcaatttgaaatattagtttctttcttcttcccttcattccttcaacttttataccattttcctgttatctattgatttgaaagttttaatttttaagaggcggtgatgacaaaaaacatttctcgatgctgaaacttactcgagagaccaaatcactcttgtaatctttcgtgatgcttgtttttatgcgtgtctgagcctaaaccaaaaaatctttcatttatgctttgattatcatagatcccaatttatgcgtttcttttattgcttttcaatttgtaatgcgagttttgctttattttgtccagccatggaagaagcagatcagttatgtttagctgctaaatccggcgacttgaaaaaggttcaaactttaatttactccggcgccgacgttactcactttgataacgacggtttaacgccgttaatgcacgccgctaaaatcggaaacgcagagatagtaacggcgttactcgaatccggagctccatggaacgcattatctccatcaaatctctcagcaggagatttcgccatggaagcaggacatcaagaaactttcgatcttcttctcaaaaccgggatccaatcagagctaatcttaggaacaatcgcaagaaaccaaacaaagaacgaatattctaatcaagaatatcttcaagacagagttagtttcagtgaagacaagttaatggatagtgaaagcaaaggtgtgatgatggcttgggaaaaaccattaatggaagctcacgctaaagctatttgtctcaacggtggtcacattcttaacgttggtttcggtatgggacttgtcgatacagcgattcaacgatacaatccggttaaacacacgatcattgaagctcatcctgaagtttataagcgtatgattgaatctggttggggagagaaagagaatgtgaagattgtttttggaagatggcaagatgttcttgataagcttgatgataattcttttgatgggatcttttttgatacttatggtgagtattatgaagatttaagagagtttcatcagcatcttccgaggctgttgaagcctgatggtgtttattcgtatttcaatgggttttgtggaagcaacgcgttttttcatgttgtgtattgcaatttggtgactttggagattgagaatttagggtttagcactcagttgattccattgccggttaaggattgtcttggggatgaagtttgggaaggtgtcaagcaaaagtattggcagcttgatacttattatctccctgtttgtcagtttagtgactgaagaagttttatgataccagcaattttgcgatattgtaatttttcttactcataaaaagtagattttttatccatttgaaaatagtcatagtcatccaataagaagaaaagaacagtaataagtgtataacataagatcccatagtcatgtgataggaaccaagagccagactaattctgttacaaatatcttaagaaacaaaagtactaattaaaacatgttatgcagaagcttcacgttttctacatggtctaaatatgtgaagactaagtgaccctgaaacgcttccattccttgtattgcaacgctcatcatcgtctttctctcaatattgaagtagtagacgtcgaaaggcactgtttgatagcacggcgacaacataatctcatttgtacgagtcactccaacaaagcgtaaattcagggttccaatcctatgctgccaccaagcgggtaatacgtacgtatgcttcgaccattccttcttttcagcatcttgtagaacccacaactcaatactcttactacgtccatcaacaaagcaatatctttcagaaacaagtgaagctaatttaccattgtagtttataagagttccatcatgcgctgctttaatgaactcttccatgactgtaataaatctaaacttctctgacctaacatcgaagcaaacgataatgtaatcccctgaagacaaattgatcgctggataatacaacacaccattgatgcatatctcagacattccaagaatgtgaggcatggaacattcgatgattctccatgacagttctccagttcctagtgtcagaacttgatgctcatcacttttatatgacaacaataccttgaactgtttctgaatcggttcatacacgaaaaatcttgacggcccaatactcgtcttcattggtttaggtaagcttaaggtatgtccagtgctgggattacatatcactgtcactgtttcgttcatttccttgcgtttaaaacagatcaagccattgacaggacgcgaaattttatagcataaggagaaattctttagagaaatggcggacgagttctcatatggattttgaagctgaggagacgagaagaagaacaagttaccatcttttttgcagcagaataagagttgcggtcgatgcaaagatcgggtcaagaacagctctgtgaaatcttgacggcaaattacggagatccagagtttcgacacgcaacgacatgtcgctatagattttgccggtaatctcaggagtatctcgatgatgatatcaactgggatctggactgacttttctgttttattcggtgaggtcttcttctccgttctacgccgggag

SEQ ID NO: 4046 - DNA, 3000 bp, Unknown; identical to SEQ ID NO: 4031
  misc_feature (1)..( 3000): cDNA_ID_1822786_gDNA_ID_1620680_Annot_ID_164389 3000 nt of promoter + ATG

SEQ ID NO: 4047 - DNA, 3000 bp, Unknown
  misc_feature (1)..( 3000): cDNA_ID_3072369_gDNA_ID_1620680_Annot_ID_164418 3000 nt of promoter + ATG
gcgtctcattcggatgatagtttaaggagtttggaggttgagctaaatgaacttagccggattaaaccgagaaatagtatattaaaccgaactgaagataaaccggagcagcttacccctacttcggcttggagagccgccgagaaattagctaaagtggctattatgaggaagcatttaaatcgagtcagcgatatgcacggcttggaaaacgccagattttaattttaatttccctttttttcgaaaattcgatttcaatgatttttgaatatataatggtacataatttatataaggaggataagcaataatttagtaaggtataaataatagaagtatgattattcagaaaaagacccacataggtgcatgatagcgacaagcagtagccgacgggtgtggccttttgtattgcagagagattgagaccctacattagaaggaattaattggtcttttagcatttttatcttcttcttcctttttgtaatcttcaaaaactccaaattaatgactgaatagttaaaaaaagttgtagatcaaataaatgaagtctgctttttttgtgtactatatagaattaaaagttgaggtatagtggattagagagtgtgcttgtaatgctggacttcaaaatcaaaagttaagtttatattatcatatgccgtttaacttaagaggatctataatatattatatctttccaaatgaatgatcatgattagtcatgtgatcatcattatagcctattttgttatagaaggcaccgggtttgaatgatttgaatagtgcgtggggattgtctttgttggttgttggtgaatggtttggtgggtgcaccgtggtagaaaccaggtcatgcgccgttgcaaagctttcttctcgcttaaattcattcattttatatcattaagacatttactaattatatgtagctagcgccaagttgcaatttgttttgaatgcaatgattttgtatacttttaaaatggatgaaatgattaactattgtcaaaggtccacttctcgatgtgattcactaaaatgatcagtggcagaagaatctcgaactatatatatggtcaaatcataactaaaaaaactaagctattattttttcacaaaaaaaaaaactaagctatcattcatcacgcagttacatattgcatatggacaatgttaatgtcaactaatgaaagggaaagaatctcgaactatatatggtcaaacggtttgacgcaccatacttaaaaaaatactaatcaaggtgcattacattcattgatgttacaattacttgtactaatgaactctgtgaaaatcagaataacccggtataacacactatttggagttataatggctgatccaacttttgggagattttgtcacagttgggctacagtttgtgcaatcggcaactgtaaagcccattgagaattccaaaaataatgtaaaccaattaataaagcatttacctttggcgcctgggacgaaaataagataccgaaaacaacctttactctacaaacataggtccatgtaaaataggcttaggcccaaataatgtaactctaaaacaaatctatgaatctattaatcaccaaagttatcttttacataatgtaatgggttatttaaggagagatttaataatttcgaaaatgtttggtcaactccgaaaaggtgaacgtgttaattaaaaagtcctggtactgcggcagagagagagattagcccatatgacgtggttgtgatgtgtccgaaagctgtcaacattgaaaatcaacggtccagatcagtatactgacacttggctttgtaaatttgttaattttcttctctggtcaaaagtgaaagtgttaattataattaaattttatctagttttcaagtaaccatccatttagtacagccaagattggattatctttaagtttttaagttattctaacagtctttattgatgactttgtatttgcaagagttgcaaccaccaatatcttctattacatatttacatcaaattcagagtatatgtcatccatacaaaataatacattatcgtaataaccacacaaactccgttaatccatttgttttcattggcggtggactattttaaagaagaaaaatatatttatttttttgtcagaaagtaaaatattataatggtgttgaaactgttaacaccattataatatatatataaaatctaagtcaaactactgtggggaaatttgattaggaaaacaaaaaacgtgctttaaaaactatgtttgtacgctgtacggataagatatttggaaacgacacactatatttataatccaaacatattttaaaagaattaccggactgtattagttgaaatgttattggaactgtttcttaattacatatattaaaagtattaccggactgtataatctgtattatttgaaatgttattggaattgtttcttaattacaaacgtgaagacatgaatacgacgacaagtattatacaaagttatccacacccatgtgcacgtaaagtatgcttaataagatttccaaatctatctataatcaacgtaatgtctagtcacctaattatcacaatagtggacaaatagttgcattatctacaaaatcaagattatactctctatatgagtataacgtgagtgtcatcatttaattatagaaaaaacacgattatgcaggctaattaaaacgcgttaattactgagtcaatgaacctataaaaccggcttatgctacccctcccaatctcatcacaaccattagtctctctttcagacaattttggttctttttcttttgtatttatacattcttaatcttctacaaaacaaaagaagaaagacacatttcggtactaacattgttcttcatacctctctttaaattcatatacgtgtatatactttgtttatacgtgtgtttgtgttaattgtgttgtttaatcttaatcccaagttagtagaaatg

SEQ ID NO: 4048 - DNA, 3000 bp, Unknown
  misc_feature (1)..( 3000): cDNA_ID_2050499_gDNA_ID_1620680_Annot_ID_164416 3000 nt of promoter + ATG
atgttctgaacattatatttattaccactcgtaagtcactttccatttgcaggatttacttatacctaatggtgtcagattgagtttgtgtctcttttacaacagtatcgcaccttctacatccaatagacaactaatgaaagctagaatcaatcaaaacagatttacactagaaagaaaaggatgataccacattgaaaaattgatgaatgtatgaacaggatggtaacaatttaacttagaatcgaaattttggtatgaaatcctctgaagtctgaagagttttaggtttagttgaaaattagagtactgtagtagtttgagatcctctagacgaagcagaaggttccatcaaattctatttgtttcgcgggccaacccgcaagcccgatattttatggacatatgtagagttcaagcccgccctgtgatgatgcttattggggcaagctggtgggtttgtgggccgcttgacaaaagaacattaaaaaaagacaaatttgatggacaatcatgattgttgtggttagtatacatacttttgaggatcggatcatgcaatgagtgaattcttcactttaattaaactcatcagattctctcacagtaacaactaacaaacaaaggaaacaaactcatgaaaagccatccaaggaaaaaaggaaatctttatgtgaccgttaagtgtttcttgtcaaatattatgtgaccgttaagtttatcttgtcaaatattatgtgattgtgaccgttgttaattgtgattagcaatttccttgtttcttttgaacctctttgctccccttataaataaatagatgagagacgctctcacgcagtctcaacaacgcttcttctaattcttccttgagagacaaatcaaaactctctctatttctttctttctcatcttcttccttcagagacaaatcaaaactctctctttatacataaactctgtggattccgatcgatgatgatgatccaagtagaagccgacgacgatgatccaagcaaaagccgatgcaacatccgtaagatttcagactgatcggagccgaaattaaagcatatcatcgtttcatagattgaatgataatctccttcaatccacggccgtcgtctaccgtccaaaacaaaatagatttcagttcaccggataatgatctagccaccgagatgctttcaccggagacaacgaggaactaagaggatggcgaaagaaaacacgaagacgctctcgtttgtggtttcaagtttcagaacaagcacgagtcgccgcctgagtatatcacgacttttaggtatattactttactaccctttttcttttttaataaagattatgattttgattttaaaaagaaaaaaaagattttatgtttttccgttctgatttttctgatttaaaactaatcacaaggttttcacaaatatttttttaaataaattgttttaatttttgtttttaatagattttttagtgttaaattttaaatatgtgtaaactattagatacattatcccgtccataatatgaggtctttaagaggtgttttaggtttaatatgttttgcacatataaatttttaacacttattctttttatttaaaattgtttttaaatttgtattttatgcactatttaatttttgttttgatttttaagtaatattttagataaaatgttttattttttaaaatatacataatatttttgtttttaagtgttaaattttaaatatgtgtaaactaattggacacaacatcccgtccatagtatgaggtcttttagaggtgttctaggttcaatatgttttacacatataaatttttaacacttatgtttttatttaaaaattaaattactactattttaaggttttcgattttttaactaatattttagataaaaatattttttatttttaaatatataatatttttgcttttaaatgttaaaatttaaatatgtgtaaactagttggacataacatcttgtccatagtaagaggtacttaagaggtgttctaggttcaataaattttatacatatataaattttaacacttatgattttatttaaaaatatatatattttttttaataccactattttaaggtttttgatttttaaagtaatattttaaatatatattatatttatgtttttaagtattaaaatttaaatactgtatgtgtaaactaattggacataacatcccgtcgatagtatgaggtccttaagaggtgttttaggttcaacatgttttacacataaataaatattgtaacacttatatttttattgatttgttttttaaaaatttgtatatttttaatacacattgtgttctaggttcatagtaaaaggtgattaaaaggtgttctaggttcaacatgttttacacatataaattttaaacacttataattttatttaaacatattttaaaatttatattttataccactattttaaggtttttgattttttaagtaaaattttatatttttaaatatataatattttaaaacaaaaatattaaaatttaaatatatgtaaactagttgaacataatattcggttcatagtatgaggtctttaaacacttaagaaaattaacttactatgttttttttatgtatttttgggttacttttatttaataaattatggggtcttccctctctcgaccaaaaaaaaaaaacattgtaaggtgagttttgagagtaacaataatattggggtatatttttaaaaatattgtagtggtaaataccgaatttccatatagtttctgtgtggcttatatttgtccttttatagggtgcaattttagagtaaagatagtatctaggtttaatgttaaagattctaataatgatggggcgttttcgtgttttctatttatttaagctccatttattattaccggctgttttctattttgtcgttcccggtaaattttgccggcgaagattgaaacttttccaaacg

SEQ ID NO: 4049 - DNA, 3000 bp, Unknown
  misc_feature (1)..( 3000): cDNA_ID_1822752_gDNA_ID_1620680_Annot_ID_164412 3000 nt of promoter + ATG
acttacgagtggtaataaatataatgttcagaacatgtttcctctctaattctctctgttttcccaatatttaaaatacagtttcgcaagtattgaaagtgttttaaaaagtgatcatacatagtaagagtaactcgtagagagagataagttatgggaactgactgtatcaaattagttggaccatgttttatgtccgtgatggtcggactcagaaacagagtggtgatgtgaagatgacatgtttatggtcccattttcacttttattgggtcgtgtttcacctttcaaatgaaccactagaaaattgaagcaacttttttttttcaaaccaaaggaaaaaagatgactttgttaagacctttgtcttggttttttttgcttcatcaagcgtcgctttcgcaacatgttctctctattattacatgatttcaaaacaagcaaaacatatcactgcctaattcttaactttgtgcttcagtctttccataaataatagttaactttcaaattcctaaatgtactaaaatcaactatggttgttgagctttattattcttccgtttaatcttggttcgaaagaaaaaagatatggtataatcattccattcatatacgtattactaatcatagttatctttttggtgagtaaagagatttgaatcaagattgtgtgttggtaataagaatccttatagagatgtgcatttaaggagacagaaaggaacacagcacgagacgatgcggttagagaataaacaaaacaaaaagaaacttggtaatggatacaacgtgattccatcgttaaacaactttgcttttggctttggattcttctctattttaactcttaacccaatgttatctcattatccttcatctcaatctatttttctatttacttaaatttgagttttcaagacactttttaaaaaaatgaaaaagggttagaaatagagaagagagtaagaaagaagtgtaaaatcaaataaacgaatctcattaagcacctacttcccacatctttcttaaagtttcttacataaagctcccttcacacgtgcttaccaaatcagattgtcaataattcttgctcaataatttttcgaaatttatttgaatttatctaataaaaatacattgtttgagtatgatattttgcttaagaaggttgattattctccctatcaaagtctaaaaagaagattacaaaacaattgtatggttaaattcatataaatttgtgactagtattttaatatttacatatatacaaatacttatagatgaaacgagaatgcagaaatgattatagatagatcagtgacagtgaactgtagcaaccggcaaagaaacctcgttagctggacacacgattacgatcatgcccccagtctcctctgtccagacggctgcattaataacaacgagctagagggtgttttcgtcttttcgatacttatcccaaaaccgacaatctctggtttggactcgaaggctgatttggtcaattcatagcaaccgaacgagcagtccattcaagtccaaagagctccttagtggtaaaagatgtaattacgtagatgttccatggtcaagaatgtattcagtcaaaataaatatttgaccaaaactttcggttaatttcctaccaccagcaaaattataactttttctaataattatcaatcattttcaatctcttttaattttctttttcacttttttttattaattaaagtcaattcacactatacaaaaagaaggaagtctaaatatttttttactttcatgttgcttttctaacttttatattttgctcttctcaacagattttgctggtttttgtattagaaatattattatgtttccagaaatgaattttttatatgtcgtctggattcgtatatatatattggaaagtgaaattaattcatttgatttttttctttgatatatcgaccaaatcaaataaatacgaccccattgtggcattgttaatgcaaaaaggcacaagtacaaaaaaaacataataattcactattttatttacagacacatgggcccaattcatacggcccaattaccataaacctctcttttaaagagtgggttccacagtggtaaactttttgactatccattggaatgattgcatctggaccgttcatctacattaattattgggttttttcgctttaaagcatcaattaacttattacgtataggattagattaccaataacgatctttttagcttttgtcgttttccgataaaaccatacgattaagaatatgacctcttgtatcttttgagggattttagttaatctttctacatttattttgttggatgctcatacaattatcctgtgtctctcaaaataaaacaaaaattactctatttattagtacattacacatgattatttagaaaatgtatattgtggtcatatgaaatgagaaattaaaggaaatttgtcaatacttgagaacatcaccattcaaatgtttcaagaacaacatgactccaaaacaaaataaatgaacctttccctaataatagtatattctccatcgtacaaagttctaaataatacaatattcatttcgtcaaagcatatgatgtgttggaatcagaattatctgcaaatgtttgaatttcaaatgttagtatcaggctatttttactgttttatcaaatatcgtttcttctgcaatctatcacttgattgttttatcaaatcagcactagtattattgattttgtaatttgtgtttgtctacctccaattactttttagtgttatgattagtaatgtaataaaatcacaaatctgacgtggcacctatatacaattccaaaaacaagtggaacgaatataaaacaaattcacaccttcctcatcttcttcttcgtcttcacttaccttctctctacactcacaccatctcacaaccctaatctctcccacacaagagagatagagagaaacaatg

SEQ ID NO: 4050 - DNA, 3000 bp, Unknown
  misc_feature (1)..( 3000): cDNA_ID_3072397_gDNA_ID_1620680_Annot_ID_164381 3000 nt of promoter + ATG
acaaattcatttacttttttgttctgttccgagatttcaaggttcactatcgattctgaaactcttggaacaatccagattcttggttagcaggtggggaagcattaatcatgtatttatgatacactgctccattattattacgagagagttgaaagtttcctttttgactcgtttttaaaggcaaggaagaagaaagactttgtttttaaaatgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatgaaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataaaagactgatcaagttttcacctttcgggtcaaaatcacacaacggatctgccccatcttgttgatgtatatagaaatgaagaagctcaaggagtatgagagtaagaaacgagtttcgatgtgttgaattctattttgcaatgttatttgaataataatagttaagtagaagtaaactgtataaatctttttgttgtggttggttcattattcagtagaagaatagattgaagaaaggaatcatttttttggcctcttgtaagttactagctgtttgtgagtcataataattggagaaattattgatctatgaatcgttttatttgacactcttataacccttagtgattcttgatagaacagtaggattagaaaacagatatgggtgggtttcagatttgtggaggggaataaaagtcttattttttgaacatgcattggtctgatttgtatgcactgtgtaaatgaatgaacaattgaaaagaaaggatgatttgacttatgaatcgtttcaacagttcactgtttgtttatctctgttttttatttaattggctatgagaatctgaacatatctcttggaaacattgtatcagtgagtgtgatgtcactgatgtgagagctcttgtctggaaataaaatctaaacacagttaccaaatctggaaaacaatttgtctcaagttagaaaaaataaaatataaataatttcccgaataggagctatcttaagatgggccttagttgaactatatgggctattatccaggtccagtaatattttgacagtcaatacaaaatgtcgtctttggctctaaattggattaagctattaagtaagataaagattacaatatttaaattagatattgatttagacggagatttcattatctatctctcaagtttgatttgcttctgctgtaacaaaaagatcacgatcgcaacttgtgtgtatgtgtgtgtgagagagagattcagatatggcttggttagctagatccatagcgaactcactcaagctcgatgaggaagatgaagatgatgataagcatctgaatcaacagccgtcggaatctgtatcggattcacagtctccacgaggcgttaaggaagacattagcgaacttaccaagaccttgagaacccaattttggggtgtagcttcgttcctctcgcaaccttcttcatctccggatcttcaggagagaaatcaaactcccgatcatccggaggaagatgaggatctaatcgctgggattaagaacgatttcgctgagattggtgggagattcaggactgggatttcgaaactatctgggaacttacctgtgtctgagttcacaaagatcgcttcgaatttcttacaattgagttcagaagatgtggatccgaaagattacgacgtaatcggagttacagaggaattagttgcgtttgtgaaggatcttgcg

SEQ ID NO: 4051 - DNA, 3000 bp, Unknown; identical to SEQ ID NO: 4049
  misc_feature (1)..( 3000): cDNA_ID_1822752_gDNA_ID_1620680_Annot_ID_48341 3000 nt of promoter + ATG

SEQ ID NO: 4052 - DNA, 3000 bp, Unknown; identical to SEQ ID NO: 4047
  misc_feature (1)..( 3000): cDNA_ID_1822744_gDNA_ID_1620680_Annot_ID_48343 3000 nt of promoter + ATG

SEQ ID NO: 4053 - DNA, 3000 bp, Unknown
  misc_feature (1)..( 3000): cDNA_ID_1822740_gDNA_ID_1620680_Annot_ID_48344 3000 nt of promoter + ATG
tacaacaaattaacatgtaaataaaatcgaaattaaactgatttcaattcatgtttgatcactcgtcttctctgattcaaaatgtcttaatgattcaatgtggtgaactggtgatattgcagctgcagctccgagagcaatggagaaatcgaagatgagagcttaaaagatggaacatgacaaagctttctaactatacaaaatatgtgcgatcttttggtggtgtttttaaatttcaaaacatcaatatctttagtttctgaatttttaaaatgaagtaagtaagactacgaatgtaaggaaatgaagaagaattaaaaatgatctatttttgttgtttgtttgttgctttagtcagtaaactggtcgttgttttatgttttgtgtttgatttggatgtgtggttgacttctacctttgagatattatttgatgtaacgtttttgttattctcttctttgcttcttctcgagaagagaagatagacaatccggttttacgatttggctttctatcattgaacatggaggttcttcttctgcatttgcaaaacaatcttaaatattaatcagtacttaaatctttgaggtggattgttaaattctaacacatttgaatgcggaagtggtaaacctacgtttttctcaatgtctatgactctattctaaatggaatatcaagattaatcagaaagaaaaaaaaatctttttataactgtcataactaaactgtgctaccaaatcattgccaccaacggatctttaaaccaacttgaataattcacctgaagaaccaaaagctacaagacaaatcaaagataaataaaagtaatttcgccgggaaaaggttttgatatcattatttcactttttaaccttccatgaaactttgtttaccttagcaagcatgggctgcgtacaaactcatgataactatatagtacaatccccaaacgaagatatcataaatttcaacgaatcagttttagatttagtgaataactatagtttaatagtatcgaataatatcgtttgagagaaaaatagtcaaagatacatgaacataaattcccatatactaatttcccatttctcattcaaggaacgtttattatttttctgttcctgaaggtggaagcatagtgcgcctctttgggtttggcaatggtggtttgcttatttgttttatgaaaattatttttgtgatatcatttattgttcatttttaataattccgttagcgttgacaaaacaatatgattaaaccccacctaaaatgaaatgttatattcaactgtccaatttttcaaagaggcgttaattaatcaattccaaggcatatattcgatcaagataattaaagactcatatagtactctcatagtttaagagaacctacgggtcgaatttaaatcactcttgttactttaaaactttaatccaaataatgtagtatatatctgtgattcttgtagctagcttcacgtgaacttaatagtatacacataaacaacaatcattggtcgtgaatctcatttaattcgtttcgctttgatgcacttattcgaatgggacatactatatacatccatataagttgataaactatatagtaatattcaatgtttttaaaattaaatatatgaaatagacttagggaatgacatgtcgaatttgtctccaaaagatatgaattgaattatgcttctcagtaatggaacgtggcaatacctttatcactcatctatatatggttgttccccaaaattatttcttcatcaaacgagaaaaataagattgtaaatgtaaatgatttgatcatctcaatgttgcattcaagaatagtatctataatatttagttataagcattaggtattaggtcaattatattcaactgagtctacgaatcgaattgcatattgcgtaaaaattcaaataaaagaagctagataaatgaatatacgtacgattacgagaatgaatgtgtgtttcttcgatttggtagaccttcaacaaacccaccgaattgatggtatccatagatttcttatcagttatcagtcatgggagagatttacgatctcatatatatggacaaaatatatcgtatcagcattattattgatttattgtttagttaagttcttttttttttggtttttcctttttttctttgaaaggtttgattagcagttttgtccggacagaccaagtatatatatacaataattgtgattgtgttaggacattcaaaatcttccatacagttttcgaattaagttggtatacaagtttttcaaatgttaaatcaaatccaactaaactagatttgttaaggatacataggatcatctctctttaatatcataatattcctctatctcctttatggaacattctatatttgtacaaccctagtgtagcctcctctgtacttgtatatatacttgtgtaaagctattcgtataatataagtcattacattcttaacatggtatcaagagcctaataagaacattgttggttgtaaatgggtatttaaaaacaaatttctccctaatggttctcttggcaggtgcaaatcaaggtttgtggcaaaagggtataatcaacaacttggccgtgattatacagacactttcagtcctgtgatcaagtcgaccaccttacgtcttgttcttgatgttgcggtaacccgatcgtggccaatccgacaattagacgtcaacaacgcctttcttcaaggcaccttgaaagaagaagtttacatggagcaacctcctgggtttattgatcccgacaatccatcattcgtttgtcgactacgtaaagcgatttacgggttaaaacaggctccgcgtgcttggtatacggaattgaagacttatctcctcaccttgggatttcaaaactcgttggctgacacttctctgtttattctgcaacgtggcaaataatttgtctatctattggtgtatgtcgacgatatactaatcatg

SEQ ID NO: 4054 - DNA, 3000 bp, Unknown
  misc_feature (1)..( 3000): cDNA_ID_1822825_gDNA_ID_1620681_Annot_ID_48346 3000 nt of promoter + ATG
atgtgatgcggatatatcaactaagctggctaagatttgtattgaagaaggcattgattttgatcaaggggcagttgatttcattgcttctaaatctgatggttcacttcgggatgctgagataatgcttgatcagttaagtttgctcggtaaaagaataacaacatctttggcctacaagcttgtaagtttacacttctttcttcatatttgtcttggaaacattagatagtttagaagtgaaagatcaacatttctttgattctgcagattggggttgtttctgatgatgaattgcttgatctgcttgatcttgccatgtcttctgatacttcaaacacggttataagggcgagggaacttatgagatccaaaatagatccaatgcagcttatttcacagctagctaatgtcattatggacatcattgctggaaactctcaagaaagtagttcagcaaccagacttcggtttcttacaaggcatacatgtaagcaccccagtgatgattactttgaatatcagcttcaaattaaaacctgatctcactctttatcatatactgttctactatatatagctgaagaagaaatgcagaaattgagaaatgcattgaagatactatctgatgctgagaaacacttgagagcatcgaaaaaccagacaacttggctcactgtggcacttttgcaacttagtaacaccgactcatcatcttttgcaacagatgaaaatggaagaaaccaaataaacaaaggtcctaattcataaattctcgtttcctttatttcatgcttctttttcgtgttgtcttggttactaactatatataacttacccttggtcatgtatctagacgttgagctctccagcacatcatcaggttgtcctggtgatgttattaaatcagatgccgagaagggtcaagagagaaactgtaatgaaacagttgaatctgtgtggaaaacggttacagatttgtgttgttctgattcactaaagagatttctgtggaaacgaggaaggttgacttcacttactgttgacaaaggtaacttatatttcccaaagatggtctgaaagttttactttggcttgtgtctcagataagtaaatgcatattcttttttcttttcaggtgtggcaatagctgagttagaattctacacacctcaacatgtagcaagagccgagaaatcatggaaattgattgcagactcgttccaatctgtgttaggatgcaacgttgagatccaaatgaatcttgttatctctgcgtgttctccaccaaagagtgctaaagcagcagcaagtcttttctttggacttttcagttgttctcgtagaatgcttcacaagtcgtatttgactacaagaaccgactctgactgcgcatctgaaaagcctgcagttacaaattctctgagaagttgccaaggaaatgtcttgagggctcgaagtgttcgttcttcagccaatgcatcatcgcgtatgagctgttccagtgatcaaggcgatgcaacttctgctatgtgtactccacacattcctccgggtgaaaaaaggtaaaacatggttcatatttattcatttcaaaagtaagttgttttgtgatttggctagctactcaagtatactctgcctctgactttgtgcaggccagaagatgacactgatgtgttgtgttggaagaagactcccctaggcaaggtaaacatctcgactatgcctaagaattcggtttcagatctctgtctgtacctttttggtgtttctaatttgtgatgatgatacatgtcttatagggtcagagcgagacacagaacagcaagagctcacggcttatcggccgagtccttccctgcagcactgcagctaattaagggagctcgatgagggtaatacccattttgtggaagtggaaccaataggttttagcaaacccattgtttaggacaatgtgacacaaaaatgtatagttgcaaaatgtgtttcaagaccatattttagattagcatatactaatcactcctttaacagacctgaattttactgtctttggacccttttattgactgagctcattatgttttcacaaattatctcattcattaaaacgaatcagaataaagtgaatacattagtcttcaacttttttgttacaaaaagtggataatgtttaattttttcaataaactgatttgaaattagaaacataatttggataaggttttagtaatttgggataagatattgacagagagatatttataaattatctggtttcactattttggtaggaaaactccaaaattaaatccataaccctaatcgatatctctcttggacaggccagcacatgtaacgagcaatcgtgaccgttgagacagtaacacgtggcaacagtccttatgatgagacctttgatgagaatcagcagcctccatttctgtaagctttttgttcctcccaaaattcccaaatccatcttcttctccaaacaatcttctctcaaacattactactattttccaggatagcttacgcagcttcagactcgggttcttcttttcgatctagcctccgtcctctttcttcttaccacggatctcgcctgctctttttccgtacgacggtctgctttgtggatagtttggctgacgacgaggcgatttgaacattaacagttactggtacttggagtttcaaacatttctccgatgttttggttttggcatttagtcacgggaatgattaattgattgattgctgtagaaatatgtgaagaatgacacgtagaagaatttgatgaaaccttgggatgcataggcttctgtattatggattggtgattttagatctccatttatgtcgtttcacatcagtgtcttgtggttttagctatatgctgttttggttttaggttgatatttattgtatggtatgtgtttgttaaaggaatgatttgatgatgtttcactgttagggtaattgccaagg

SEQ ID NO: 4055 - DNA, 3000 bp, Unknown
  misc_feature (1)..( 3000): cDNA_ID_1822821_gDNA_ID_1620681_Annot_ID_48347 3000 nt of promoter + ATG
acggtggagcggaaggatctcagcagcctcaccttattctagccaacaagctcttcctcctcactcatccagatgttccagacatcgagaaagtccagctcaagtctgaggttttggatttcatcagatcccatggttaagcagctccttttctctaatcagtgagaattagcttaatatttcttcgagattttatgttcctgatgtttcgttggtgtttttatttattttaggtatggctcctttgtacgaaaccctaattgcctcttcggtgctggatttggatcaaagcttgttagagtctatgcgggccgctaatgaagaggagcttaagaagctcgacgagaagtaagtttccttcagtttctcacttttatttggcagtgctttgaaattcgaattctcgtattagtattttgggttagattgatgtagggggactgtagcattctgggtctcaaattggattcagaattgtgtttgcaaaagtccactatgaattttgggaatctccatgttcctgtggtagctgatgtagcatgatgtcttagtattcttagggagataaccattacctaaccattggtttctgagtccatcttggcctccgctttaactttgtagaaacttctgaaccagtatgttatcagccaaagttctcttacatattcttttctttcacttttttcaggattgcagatgcagaagaaaatttgggtgaaagtgaagttcgtgaagctcatcttgctaaggctctgtatttcatcaggattagtgataaggtatgtggcatatcaaagttgatagttatggtaacttccgtggatcgtggccattaaatttttgttttgtaatcctaggagaaagctttggagcagctaaaactcactgaagggaaaactgttgctgttggacaaaaaatggacgtggtgttttatacgttacaacttgcttttttctatatggactttgatctggtatcaaagagcattgacaaagcaaaaaagtaaatgtcaatttggctgtattttgactactcttcatggatagtgcaactgaaatccttgaattaacactttccgttttcccttgccagattgtttgaagagggtggtgactgggagaggaagaaccggctaaaggtctatgaaggtttgtactgcatgtccaccagaaattttaagaaggctgccagcttattcctggattctatatcaaccttcacaacatatgaaatttttccatatgagaccttcatattctacaccgtcctgacaagcatcataactttggacagagtttcccttaagcaaaaggtatttctcaatggctcagtcttccacttagagttgtctaaacttagataaaaactttttagtatgtcgacttattaaaatgatgtatatccatgtaatttgttgaaattcttatcaagtgctactaatttgacaggtcgttgatgcacctgagatcttaaccgtgcttgggaagattccattcctttctgagtttctgaactccttgtatgagtgccagtacaaggcgtttttctcagcatttggtaagttcattacaaggaccagaggtcatacatccgaatgcatgttgcttggcttttgtctgtatgtttactaacttcattgtcggcttatgttctcagctggaatggcggtgcagataaagtatgaccgttacttgtacccgcatttccggttctacatgagggaagtcagaacagtggtgtactctcagtttttggaatcttacaaaagtgtgacagttgaagcaatggcaaaggcctttggcgtttctgtcgatttcatagaccagtaagcacaataatgaacgctcttttgtatatttatgtttgccacctctctttagaagcatacaaaaaaacgataatacaaacttaaatctgacttgaaatgtatttttttttttatccagggagttgtcgcgcttcattgctgctgggaagcttcactgtaagatagacaaggttgcaggtgttttggagacaaaccgtcctgatgcaaagaatgcactttaccaggcaacaatcaagcaaggggatttcttgctaaaccgaatccagaagctgtctcgtgtgatcgatctgtgagcatgctacatgtttctgtttcactctttcgtcaagctttgcaacttggaaactccgaacggtagaatcttaaggtctgagaaacgatatgaactttggattttgagatgaatggctgtagtttctttcatcaactctagttggtttgtcagtggtgaatttcccaagaacaaagagcaagtttaatctccaatgttcattttattcttcctcgcatatggcttttgaatctgttgttttcatcgcatctatctagtatctaagagaaaacgaccaccatacctcttacaaaataaagcttttgtttcacaaggtgtattagttgaccatatagatataccaagaaaaatgcattagtacacttcataatctgaatggttagaattgaacacaaattagatacatctaaaggacagtccttggttgaacttgtgagagatacatacacagtagttggtaacttggtattttgcagattcttcttccacggacgtctgtttagtgaattaggtgagattcttcaccatcacacttataggatttacaatttgtttcttactgtttagtaagttccttttttcctaaattttttgatatggtctggggttagtaacaagaccatcattgtaaactactttaagatttgaggagattagtaccttatcttctattgcctgcctaattataaccagtgactcacagtgagtgtgacataagacaaacggattttgtttcctttacaatttaacgaaacagtaattaacactctcgaatggattcgtagagagcagcaaactccactctgacgccatacataaacaattcttaactttatcctctcatccttatcactcttcctcaaaacttcgaaaatg

SEQ ID NO: 4056 - DNA, 3000 bp, Unknown
  misc_feature (1)..( 3000): cDNA_ID_1822814_gDNA_ID_1620681_Annot_ID_48349 3000 nt of promoter + ATG
tggcatatcttgaaggtagatgtatatcttcctctgagcttgatcacatggcttattagatgcattgtgaactgattttcatgtgtcgtacgtaagcataaattttaatttagtactaggtgatgaaatgatctggatatttttcatttggctcataccatatacttcttatgaaggttattgtccgtcaagatctgctgtaactaagtttcgagctgaagctatatgcgtcgaattcatgaagcaatggaatgtgggagtatatttttcactgaggtacgtgagtaatatcatagatgactgtcgacttgccaattttttttttggtcgggactgtcggcttaccattagattagtggtttctcagcttctctaactcaaaaatacataatttcaggtttcaggagatagctggagccttggattctgctcttacttctccttctctggttttcattcaggattcagataaagagagttcgctcaacttaattctcagacagagtgatactcttttggagtgcttacgatcgtgctggaaagaagatgttcttgttttctcggctgctgataaatttcttcgcttgaccttgcagcttctttcgaggtttgtaaaatttgactgtaatattatccacgtttactagtttcaattctaattttgattatgtgttaatggcatgtagatatagcttttgggtgtcatctgcgttgaataatagaaagagtaatgccagcccgagtcctggatgtgaatgggctgtttcagcaactgcagaagactttgtatatgtaagttacttgtttctgagatcctcttattttggacattttgggatttctgcaatttcgtgtttactaaatcagctgcagttatgttctgtgggatagcttaatctccattatgattagaatagcaagtaaaaaatgctgtggaaattaagtaaactcggaagatctgctataaatacatgaaatcagatcacatagaccatatggttgatcgtttgattttttgggattatttacatgtttccttcctggcaggttatacatgatgtaaattgtctagtctcagaagtttgcggcgattaccttggacatatatcacagtatttatcttcaagctccactgaagttcttgatgtggtgaggatcagcatagaacagggtggggtatcattagagaaagtcctacctttacttaccaagacaataattgacgtcattgttgataaatctgttgaggtaaacctttgaaaaagcattagatccgttctttaatttgtaaacttcaagatttgcttgactgccttggtgagcacctgcagaaacaatgtttcttagaatttgctgtatagctgaattaggttagagttattctccaagtctgacacatatttaactctgtaacggtaaatgctttatctcctataggacctaaggcagctcagggggataaccgctacatttaggatgactaataagccactgcctgttaggcactcaccatatgtcgttgggctattgcgtcctgtaaaggtattaattcagcttttggttgcgattttaaaaatattttatagttgcttgaccgatggattctgaagtgtggattattgctccttctcttttataacaggcttttttggagggagataaggctagaaactacttgacccaaaaaacaaaggaggagttactgcatggcagtgtcagtgaaattaccaggcggtattatgaattagctgctgatgttgttagcgtggtaagtactctgttataaacactttttgaggatttgaattgacaatataaccccagtagccaaaacaaaaaccagaatcattctttctatccctaaagatcgttttcaattttttttattttttttttactataaagatgcagagatggtgagtaatttatgtgtagtgaaaggcggtagagaatctagatatattgattgtattatgttacaggcaagaaaaacacagtcatcgcttcagaaattgcgtcaaaatgcacagagacgaggaggtgcagcatcaggtgtttctgatcaaaatgtatctgaaacagacaagatgtgtatgcagttgttccttgatattcaggtaagaccttcttcatgatgattcattgtgtgatttataaattttctctgcaaatttttgtttacaagcaagtaacataatcggataatatcttaccaggagtatggccgaaacgtttctgctttggggctgaaaccggcggatattccggagtactgttccttctggcaatgcgttgcacctgcggataggcaaaactcaattagtgtttgaggacgctcgcttccatacatacatcattgtggtatcatatatctgataataagaaatcgctgcttcttcttttctatagcttgtgtttgtttgctttaacagtgaagataagaggaagagagttttgttgaagagagagtgtttttttttttccgccgaagttgcattatgtgaggtctgagtttagtgccagctttggccatttaatcttttatgtaggactatttcatcttcagtatataacacgcaccaaagggaatgaaacttttaactcttaatttcttttgttttctcgtatataactgaaccaaagaaactatcaattgtctaaacataccaaaccgacatttaaccggtttcgaattctaaatcattggggaattgagagagatatacattgtttaacggtgtataatctgtcgaaatctgctcttagtttgttgggtttaaatatggaaacgtttttcatatttgaagaaagaaaaatcaatgagaaataacaaaaaaacgatatcgccgtcgtaatagagaaaaaaaaaaaagagtgtcgaaaccctagaggacgtggacactgttggcattcttaaaagagccacaaaccccattgtcgaacgaacacaaaaccaaaccgcagacaaagaaacaaattcgcagacaatagtcgaaaatg

SEQ ID NO: 4057 - DNA, 3000 bp, Unknown
  misc_feature (1)..( 3000): cDNA_ID_1822810_gDNA_ID_1620681_Annot_ID_48350 3000 nt of promoter + ATG
ttatctgttttaaaacaggggatttacagaagttttaagaacgattccgtaattgcatctcaattcaggtgttgcgacgacgtggtctaggatgtgaaggacttgagacgacgtggtctaggatgtgcctgaaggatctcacacttcaaagagacagtatgttttccctttgttcggtctaatgacaatggaatgcttttctaaagagttgactttgcctttctgctttaggtgtagaaaagatcattggatgggcttttggtaaccatataagcaaaaatcctgatactgatccagctaaggttactttgtctcgagagaggtaattggcagcttgtccctgtgcattactgctcttaaatatctgtctcggtgtattgagtgcgaactttggatccttgcagcatagaatttggaataggactcttacagaatgatctaaaaggttctacgagctcaaagaaggttagcaaatttcctttattaactttattaacttcctttggaattgaattgttgtttacttattttcattatggcaatggctcctattatgtaagaactgttaattttctctgtggctttcaggacattgtggtagaaaatgtgtttgagaagaggcttctaagtgatgtaattctgcccagtgacattgatgttacatttgatgacattggggcacttgagaaagtcaaagatatcttaaaggaactggttatgcttcctttacaacggcctgaacttttctgcaagggggaattaacaaaggtggttctcttctctgcattatgtttcagaaaactcccataattttttgaggtcctgcctcggatttatcacagatgtatgaaggaaataccttttatttgcgagactagctgctaatttggctttcctcaataattcttctctcctaaaatttggtagttaacgttatgcattggtggcttcttaatcagtccgctcttgttcgtctttatgcagccttgtaaaggaattcttttatttggacctcctggaactggaaagaccatgcttgcaaaagcagtggcaaaggaagctgatgcgaacttcatcaacatctcaatgtcaagcatcacatctaaggtaactgaatactctatgaaaagttctaccgatttacacacgggatctttttttcaaacttgtgttcttcttaatactgcagtggtttggtgagggtgagaagtatgtcaaagctgtcttttctttggccagtaaaatgtcccctagcgttatctttgtggacgaggtaatttttctggttaattccttgcgaatttgcttgtaatcagagcactgacagtcttacaatgttattactgttttgtaggtggacagcatgctaggccgaagagaacacccacgtgaacatgaagcctcgcggaagattaaaaatgagttcatgatgcattgggacggtcttacgactcaggaaagggaacgtgttctggtccttgcagccacaaatcggccttttgaccttgatgaggctgttattagacggttgccccgtaggtaaattataaatcgcttccttggactaagctttttttgttaaattgacatgacagttataggttgtgaaaattttgtggtattgacttctgcaggttgatggtgggactaccagatacttcaaatagagcatttatattaaaggttatacttgcaaaagaagacttgtcccctgatttggatattggtgagattgctagtatgactaatggatattctggaagtgatcttaaggtaaattcctagtaattccttaaacctttgttgtggtctgccaaaagtgatagagaaaggcaaagtaattaatgctcatattattttctcttttggtgctctcagaatctatgtgttactgctgcccaccgtccaatcaaggagatattggagaaggaaaaaagagtaaattttctttgtacagagccaagaaaactttacgttgcgtaaacttgtctatagaacaaatgtttatgatgggatattatatggtaggagcgagatgctgctctggctcaaggcaaagttcctccacctctaagtggaagttctgatctccgagctttaaacgtggaggatttcagagacgcacataagtgggtaagattcgcttatgctgtttttcttttctttttttcttttttcatatcgttttgggcttagtaaactgtaaccattgtcattggtgttgaatcaggtgtctgcgagcgtctcatcagagtctgcgactatgacagcgcttcaacaatggaacaaactccacggggaaggtggatccggaaagcagcaatcattcagcttctacacgtaggagtaggattgaatatattttagaaaccgtaactgaaatttggtcttaaaaagagctcctggttgcaagcagaatgcgttgtatataattttttcaggtgaatagaataaaacaataagtgaaataggttgaattagacgttttgtatcatatagctgcgtaattttgatacttgtttgaaattgaaccttacaacagttaatacaaaatgtttactctgcaactttttccatctatcgacctatctttgcatgatccggtttagttggttggtagaaaatatttgcagtctaatcttgccgaaccaaagattgcaagatctctcctccaccttgacttttgattacggttaagcttgttacttaacaccgtgcttagctggattatttaaggggttttccacaatagcacataactttttgggcattttatctgacttttcaaataaacaatgcatcgtatattaaccaattttgacttttacccagggtcgaccaaaccaatttatttaatcctccggtttggtaagattgatcaggcactggacacttttgccgtcacgcagttcatctctctaactcggattcggcaagcagtccacacagttgtataagtgaagcatttcccacgcagaggaagcagcgaagcgaaaaatg

SEQ ID NO: 4058 - DNA, 3000 bp, Unknown; identical to SEQ ID NO: 4057
  misc_feature (1)..( 3000): cDNA_ID_3072449_gDNA_ID_1620681_Annot_ID_164445 3000 nt of promoter + ATG

SEQ ID NO: 4059 - DNA, 3000 bp, Unknown; identical to SEQ ID NO: 4055
  misc_feature (1)..( 3000): cDNA_ID_2164564_gDNA_ID_1620681_Annot_ID_164442 3000 nt of promoter + ATG

SEQ ID NO: 4060 - DNA, 3000 bp, Unknown; identical to SEQ ID NO: 4054
  misc_feature (1)..( 3000): cDNA_ID_2164560_gDNA_ID_1620681_Annot_ID_164440 3000 nt of promoter + ATG

SEQ ID NO: 4061 - DNA, 3000 bp, Unknown
  misc_feature (1)..( 3000): cDNA_ID_2164556_gDNA_ID_1620681_Annot_ID_164439 3000 nt of promoter + ATG
tttgtcaatatcttttgctttatcgataagaaacttcaaagcaaacaatcaagttcgacatagaactctgttcaaggaagataattactttactttgatctcggcggtcatatagtgtgttccatgaacggacaaattcttcctcttccccaaaattttccaaaggttatttttggctatttacgggttgtcacaaattaaaaaggaaatgtgcaaatatttattattattctttgacttgagggttaggatactcaatatttacaacaacccctattcaaaacacagataaataaatatgaaagtgaataacatttaattgatggagtagtaggaatcaatcaaggagagagctagggccgctcatatcaacaagtcttcaccttcactccactccaccaacaagatttgatctataagataaatgtgataacgacaacgaagatttgagtaattgtagcacatgcatcccaaaactgattattgttgatgatgaagggtaaagtaggcaactctatcatgcgacgtatcctttttcttttgtttattctttttcctgtccgtaaagttcgccgagaattcgaaaaataagtaatcttatgctatccaaccatatatcatacgtggcacatttcatgctatcctctctactcattgattgaatgaacgtaattttggtgacatggaacttagaaggattccaatgtcaataaaccctatatactctgaagcaaaacataaaaactttgtttacatctccttttgaaaggtgtttaaagatttcttgatgtcatttgaaatagaactttagttccaacagtttcgaaacggtgagaaaggggatgaattattagttctaatccgcgaaagaactttctaactagagaggaatcatccctaggcatccaataaacgtaactagtaattaacggggttgaatcttcttctcatgagtccaacacttttctgccatcttgatttatatacaagaatattgttttcatttaaggtattttgggtttaccagtgcgctttcgggttacattcaaatctttgtcaccacacggacacttctctctctaatagaagaataacctacacatggccgcatattatggtttagttaatagactcgaaaacgggtcagtaggttcagctcattataacacttggccctggtgctataaaagttctatttggacctaaaattagattattatttttttgtttgcgcaaaaatattactatagattttgttcatttgcaccttggacacttgtcaagaacaggatatgctagtaacaacctaaaactaaaacctactaatagttgataaattggacaaaacaattcatcaaaaaatttccttactccacccataaagtttgatttaagaattcttcagtgcaccagcccttaattggtgtagttggaatttatcaaaagcatccttaaaatcgtactccaactacaccaagcatccttaatattgacaaaggatcttcttccatgaatgaaaaccagccctttactatctctaaccacccaagccgcaccagctagattgtttctctttgaccacgaaaaccccacattacacttaagccactgataattggtgtagttggagtacgattttccataaatattatcgtaagactctttgaataggagttcaatttgcgttgcatactaatgtgattaaatgatcaaattggtattattgtcggttgtatactctcgtaagatttgatgcatgtagagccctggtttttgggtcgaaaataaattggctcacactctatcatgctttagttttattacttttttcttatgatttcctcatttctcttctcgtctcgatttgtatagtttcttaacaataaaaatgtatatttcaacaataaaataaaattagttttccttccaaaccaaaaccattagcgattcacacttctctaaatactttttgatgcttttgtaacgtccataccaatataacatggaaaaactaaaatttgactcgaaaaactaacatggttcaatagacacactagtctaatcacaatttgaaagaggatatcagacatgcaaattgaaggatttttttttgtgggggtctggtcaaggagatgagactcaataactcatgttgaattccaaacaacaaataattgttgcatctagaattccaaataagaaataattgagatagttgaatcagaatatgttggtagaatgaacgaacacgtgagtagagtccccaaacgtggcagagaagcggaccacacgaagtcctgtttttattatttgttgccataaagaaatccaaacttgaaactgaaaccgtcgaacgaatcttaaatgaagcgaagaaggaacaccaaatagtagtcttaactctttctctctctctctctctcttactggttgggctctctgtccaaagactccacctttctctgcaaaaatctctgccctcctactctaacatgtctccccttctcctctgtcccttatctctctctattcactcaaacaacaacgaccctttttctatttttacctctcaccataataacttcccttatttaccactttaccaactacttcttcttcttcttcttcttcttctttcgacaagggattttagggtttaggattctccgcattgtacgccactctgttcaatacaccttggtattccccaatctttgacgttttgtattttcagtttgtcgtttccttatcttaaaccttatttaaatcgttcccaagttttttttgttttgtccatagcttatctgggtctctgttttttgagctctgtgattgttaaatttaataacttttctctcatatgtctctgtgttaccacattttcattgtttatcactaattgcttacattcattattaggtaagtgatgatgagtgttgaatcttgaagttttaggagatagagagaaaggtttaggattgttttgatctgttttggaaa

SEQ ID NO: 4062 - DNA, 3000 bp, Unknown
  misc_feature (1)..( 3000): cDNA_ID_3071510_gDNA_ID_1620681_Annot_ID_164438 3000 nt of promoter + ATG
aaaacacatatgttggtttagaaaaacttcaagttgcatttcttcttttagccaatcgcactatcttccgtgaaaaggtaaataatatatagctttatgacaatttcacaaaaatggttcgttagttttgacttagcattaagatttttttccagaaatctaagtattggtaaaataattctatatctactactaggtcaaaatacaattctatattatttaaaaaattgtaactgaggtaattgatcaaattaccaaaatgatgaaagagctagttaagaatttaacaatgtacaagttttagtgaaatggtcaaaactaaatatccattcttttggcccgttagcatcattaaaccaaccactcaatggagacatggaagatcaaaattcgtcaaccctagcgctttgtttctctacaaggatcaagtatggaacaacaacaaccacaagaaatcgaaatgtgctaaggtcgcatgagttcgctaggaataagtctataacatttcgttttgtcaacaaaataagattttagtatatatattatttacaattttaccagacttccattgtcaacaaatgacattattgttgttgtcgaagaaaaaacaaaggtgacactatttgctgttttactttttatttcatgaggacggaggacccatttttttaatttagtttaaaagagcaaccgtatcagttgattacggagtccagcagagaaaagcatgctcaactgtcaaaaacaacctaacaattagggaatcccgtaaaaccggcaaatcacgagggcagcattacattacattacattacatgtcccacaaatcactttccctcccatgcttttccacttccacctatcattaccaacacctattacctaaaggactttaagccagagagttttcaaatcccgtaccgtgattggtgcactatgaagtggaaaggaatacgatgaaaaacaaactgttttctcaatacattttcaccgacaccaatcatgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaaatg

SEQ ID NO: 4063 - DNA, 3000 bp, Unknown
  misc_feature (1)..( 3000): cDNA_ID_1808608_gDNA_ID_1620681_Annot_ID_164436 3000 nt of promoter + ATG
acattgggagatgtatgcgattggtggaagtgctaatcctacaatcaatagtcaagggaacagatttttggcacccaatatcagatttagcaaagaagtgactaagcatgaggacgcgcctgagagcgagtggaagagatggaattggagatcttccggagatttgttgctaaacggtgcgttttttactccgtctggtggtgcagcctcgtctagctatgcaaaggcttcgagccttggggctaaaccgtcttctctagttggaccattgacgtctacttctggtgcactgaattgccgtaaaggttcccgttgctgattgtggcttagtggtcacacttaagtttttaccccattattatataggaaaaggcaattaaagccaccaattaagggggattaagtagtgtagtaagactttcttaatcccttgatttactcttttttttgtttgtttattcgggtaaaattgaaggagaatacaacctctggctagctgctctctaggacccttcttaaggattctctgttttaaggaatctttaaattaggttaaagtgtgggaacaagtgcagatgtgttgatcttgatattaatataaatatgattttgtgtctttatcttttactagtattattttcttatgagcattgcaatgcaaagacatagattagtcacaaaaattagtttgaagtataaatttgcgtacacacatgatggagaggttagttaaaagtgtgcccatttggcaagtcaataatggctctttgattttccaaataaaatgactttttattcggaagtttgtaatgttatgtaaaatggtaacttttgggtcaaagatgttggagccagtcaatgtttgaccaactgccgcgacttttttttcctctggccaatgcatcgattccggtaaattaaaagaaaaattacccttaaaaataggaaaagaaaatcctaggcatgacaatgagagaagagaaaagtgaagttgatagattttgaatagaaaaaagaaatactaaaattttcaaaagaaagataattggagcagtcaataccacagtagctctacttttgatgggtttgtctcatattcgtgttttgactactgtccactgattatgggatttatttaaaatttgaaagtaactaattaaacaactaaccaactttctttgtggccatgtgcacattttcttttgttaaagatggccatgtgcaacatgataatacatctaggaacgaaaggaagaagaaaactttgaaagtaacaagtggtcgcaactaatgatgtgatgtagttggtgtgattagtatgtggctggtttgatttggtcagtcagtgagtattaaatgttagtttgccaagaaagattttttttttttttggtcatactgtatatagcataaaactaggtagagaatttccttgttatgaaaaaaaaaatctttacatttgagttattggggaacgaaagaaattcctatggagcaagaaggtttaagtggccatgttatgagttgtgtgcggtcacgtgtactggtcagttaatttagttgtaacaatcgattatatttgttctattattctttatatttcagtgatgccgtaacagtaagaaattatagttaactgaaaccaacaaaaagattcagaattactggtgttattcaattatggagttaaagttaattctttaaactttagatttgttttctgatattgcttttaagaatatgtttgtatgaatttcaaaatctctgcaatatatcttggattttgattctaatgatttactcatgaaactccaaagaggtttcatttcaaatcaattaatatacaaagattttacaagacttttagttttgaacaacattggattttaatgaaatatttaaaatcttaattgaataacaccaaactttaaaatctattaagcatgatttacaaatatgagttccaataacactagattttaaagctggatttagaatcattagttgaataacattggattagtgttggatttcaattctattaaaattcattaacgaataacacccccttaaagttaactctttcaaaaccgatcataacgcacacaagcctccaccgaaatgtttgacaccataatattttactaccgagttcgcaaggctaatatgtatttccttttgtaatttttctctttattcgtattcgagaataagtggattgttcttccgaaagttagatagatcattatgaggttgttcttagagagctagaaaactcaaaacaagtttatcaagtcgatcaactctttgataaactcaacaaatagttatcattgctcattataagattgaaaatgagactttgtattgtggaaaataaaatgcttacctcaagtgaaattttaaagtttatgctatgatgtttgtgatttcgcaattatatgatttaatgatattaaataatcaaataaataataattcattaaaattcacatatggtttaaataggtctaaatgagtttatatgggtcaaaataattttgatggttctaaatgggcttcaaatttaagtgggtttatatttacatgagtgtgtgtgtttacatgtagaggggcttacccaaattaacatccaaattaacatagagtaatttccaaaatgaagtaagattaacattcaaattgtgactagaactttgatttgagttatatagactttgtgtattatttttttataatataaacttcgttttgataagtttatataaaccttgttttcgtaagagattgtgaaattttctttgcagagggacatggttattttttgtctttggttcttgtaatgagattttaactatggtaaatctaagagcccatttgaagatgatgtctcggccctccttatccttatctcgcccaccgttctaaaacccttcccttcctcttcttttctcttctccttccacttccacttcttctatctctcacaattcagcaatg

SEQ ID NO: 4064 - DNA, 3000 bp, Unknown
  misc_feature (1)..( 3000): cDNA_ID_1450335_gDNA_ID_1620681_Annot_ID_164435 3000 nt of promoter + ATG
aatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacaggtaccctactcttcctcatatatggttatgctaatgcagtcaacatgattttgtgatgtatctcttaatcgacctttcattgtctcttgatttacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatgatctcttattcatagtttaattcctaattgttggagtttcattccctcaatcgcatcgggggatacgacacatttctgggacatgccttgtcggtgacctttagatattagcaactacgaggtttaccccaaaatcggctgagaatgaaaggcttctatagcaaagcacaagttggtcgaggcctaagggaagaagactagaaaggtggtgtcatatggtgagttagtctctgccagtctagaggttcctaaagaagaggattgggatcttcattgtgttcgtaaagggatccactattttaatctcttgattggccactctctaatccaacacttaaacaaaccacacatgaaaaataagtctaaatttaaagcttattaatatggcttacttatttggcttaagaggcctaaactcatgtgatgtatcctagaaaaattatagatatacaaaattatgtatatcacctacgtctagctgaaatcttacccaccaatgccaataaaaagtttgccggagagaatacaagaaattcgtgtacaaatatacacgctccctctttatctttctttcccttgttagctaagaacaaatgataaaaagcttacaccttttatgaaatgctctctcactctcttaccctttcacccatgcccggttcttagtactgggagtgctatggcacatgacccactatgtttttttgtaaagaaaaaatcatttatattctagctccagcttacagtcctgaacttaattgatatgactcgttgaattcactaatctgaatgaaagactcttcttcgagttctgtttgtagcaagtatgtataactccaagccaaatatgaaatcatggtttcacattattagagggtacgtaatacaaactgagacaagcaaaacatgtaatgtaacaatcaaattctaaaacatatagaattagattcaactgatgatggcagagtgaaatatgcatttaaaagacaaaacaataagcaaaaagtctcgatcgtgctcgttgagtcgctttatcaaaatatggaaatgcaacatttgttgggatacacgagattaaatggtccatatattcatgcatgtgtagcaaacagcgtaagaaataatagacgcaatatataaaaccaattaaaaagagaggaaacaaagtgtatgagaatagagcgacactgatgattcattttctaggccagatcttgtcttggaactctcttatcgcccaaccttagccttagcttctcgaccagtcattccaataatttccacacttgtctctttgcttacctctattaattatttttggatccatcgttcaacgttttataaataaaataacattatttaattttcattattgtcactatcattctgcaaaaaagtgtaaaaatgtactaatatttttcttaaacaaaatgataagaatgaagtcgtccaaaatgtgttttaacctattttagtaaacctggacaaaactgacgaaaaaaaaaaaagtaattggacaaaacaaaaatagtcatttaaaaaaattatatatcatgatatagagctacctaatgcagatacttagaaaactaagattcattattctctgataaagaaaataatcacccacgaaactactcaattataaaaaaactagtccattattaattggaatatacttaagtgtagtttttgttaacataaatggaggtgtatatatagttggtgccggcaagaaaagatggaggaaggattgtatcggtcccctaccccatgatcccgccagtaaattctttctagggcacccaaccatccacgtgtatccctcaaaccctacaacctgtaaatgtaaatccattacattacattgtatcttatttaatactgtacttacccaaaaagtttcttttaaattcaatcttaaatcatgttatagcaaacaaatctagctacacaccaacttgtggtttttagaatcttttaacttgtaatggacttttatgatgatatccatgtgaatcacacatgcatgctatgatttatcatgtgtagtaatatagtatgagaggccaatcacataaactcttaaatacaatgatattggacatgttatgttttgcatttcaaacaaaacaaagaaagaagaaatgtcgttttttgtttgtataaatccaggaataatggttttggtttttagacgcaatagagacagtatcaccattttcgttctggacaaacaaataaaattaaaattttgatacattaaaatatggttagaacttagaaaacaaatttatttaggttcataggccagtgagtctctctctctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaagatg

SEQ ID NO: 4065 - DNA, 3000 bp, Unknown
  misc_feature (1)..( 3000): cDNA_ID_2995209_gDNA_ID_1620681_Annot_ID_164434 3000 nt of promoter + ATG
cttcttctttgaaacctccagcgacttcctcgtagttctctcacttatacacttactaatacagagtaacagagagagacagagtggactcttcttagagtaagatgggaggtgtgacttcttcaatggcggcgaagttggcgttttttcctccgaatccgccgtcgtacaagctggtcagagatgaaacaacggagctttttctaatgagcccttttccccatcgagaaaatgtcgacattttgcggctgcccacgcgccgaggcaccgaaatcgtggccatgtacatcagatacccaatggccgtcaccacccttctctactctcatggaaatgctgccgacatcggtcagatgtatgagctcttcatcgagctcagtattcacctccgcgtcaatttgatggggttagtaaatctcccagatcagatttttctttctatatttagctcaggatcttgctcagaaagtcctcgccttttttggttttgctctgttttctggatttgtgcaagtagatttgaagcttctagatgcagaattttggtcttagtgttagagagaagtggactttattaagctgtggatttgtgattcacaaagcttttgaaagtttaagttgcagactcataaaatcttggatttttgctggaagagtttgtctttagggtttgtctgaatcaggatctctactgatcctttatcaaagagacaaaaagtagttttgaggttgagatgtttgagtttgattgttgacacttgacaacaagtggtcttgggcaaacattaccatttctagaaattcaagatctgttattgtttctgtttctaaaggcaagtactgaatacccaaaatgtagttctttgatgtaacaactttttggctcattcaggtataacttgggattctgggatagattggtttctcaaattagtacgctatttttttctgtcgtatcttcaagtgaacctgaaattagtagaatttacttctgtaaggttatgatttccatcttatgacattggaaaatcctctaaatatgttgtggtgtttataggtatgactattcagggtatggccaatcatcagggaaggtgagtaaccacagatcctaaagctctcttagttctgagattcaaatgttggtccatttacactgtgaacaactgaacataaatctccattttgttgcagcccacagaacaaaacacttatgctgatatcgaggctgcttacaaatgtctggaagagaattatggggctaagcaggagaacattattctctatggtcaatctgttggtagtggtccaaccgtggacctagctgctcgtttgcctcgactaagagcttccattcttcatagtccaattctttctgggcttagagttatgtatcccgttaagcgaacttattggtttgacatatacaaggtgaacataatacccttttgatttctctacatgatgttgctgataaacattcctccttcttgacaccgttttgtttgatcttcttcagaacattgacaaaattacgctggtgaggtgtcctgtcctcgtgattcatgtaagtttccgtgatcaaagattattgattggaagaattgaagttaataaagttgaacagatttgcaagatccgttcattcttgtatgaatccttgtctaataatcctcagtgttagcttaaaggtgaaagcttttcgatttgcagggaacagcggatgatgtggttgacttctctcatgggaagcagctttgggaactctgccaagagaaatatgaaccgctatggctcaaaggtggaaaccattgtgatcttgaactctttcccgaatacataggccatctcaagaagtttgtgagcgctgtggagaaatctgcatcgaaaagaaacagttctttctcaagaagaagcatggaagggtgtgaacaacctcctcgtcatagtgtagatgctccaaggaagagtaaggacggacgagaaaaaccgaggaaaagcatagacagactaaggttccagggatacaagttgagccacatagagaaaccggagaagctgaaggttccatttgaagaaatggagaggtcaaggagaagcgtggacatatacagagataagtctcagccgatggagagagcacgtaagagtgtggattggttggacagaagtcgagctaccgaatgaaaatggagggtttgatgtcaaaagattgtatttgagtgtcgttcaatttattggggtatgtgtttgtattgtagtttgtatgccaagttaaaatacaacaggaagatagatttaaacaaagtatgataacttgtctgactgtttcccacacgacacttttgactggtttttagtttatttgacaagattcgtgtgctgtcgtcttgctgttgttgttgttcatgtgcaaacttgaagtgtaatagcctgcaaacagaatctccgatctaggaaccaactaacaataatcaacaaaaactctcgatccaacctagcacagaagcttgcactcgatttgctatagtgggtggaagttgtattgtacttgtatttgtaagaactaagaaggatccatagttttttgatcaaaaagaaaaaggaaaaagaaggatcaataggcttgatgattactgattatgtagatgggtatttttattggctttcttaggcccaaacaagggatctttatgggcttttattacattggtactgtcagagtcggataagactccgaccgaattttctaaccaaagtgagtctggttcgaaaagactgcttcaatgaagccaaaactatccaataactcgaaattgactactcttttcttttgtctctgttgttgattcgcaaaggcgaagattatccatcttctcagttactcctactggaaccaaaagctcagaaccttaaaacatggagtctctatctcttcccgttctaaatcctctgttagcttctggttctaatctttttagaaaccagcactcgaggatg

SEQ ID NO: 4066 - DNA, 3000 bp, Unknown
  misc_feature (1)..( 3000): cDNA_ID_1023143_gDNA_ID_1620681_Annot_ID_164453 3000 nt of promoter + ATG
atcaatggcgtccatgtcccttcttttttttttttttttttgtgtgtttcgtttttattatttgttctgaatgaaaaacaaattgtgagtcttcggaaaaattacggcaaagaagatatatagaaaaagagagagagagggaacgtcacatggatattgaagaaccaatcacagaccgatcctccacggagttgtgccatgtcagcaaagtcaaaactatagtgggctcgcgttgctttttttgaccaaagcccattttaaacggctatggcactaggcactagctgagtaacattcccttcttgatcttggataacatcaggttttggtgagttttaaaatgattttaaaattttagtgatttcaaatgaatgaatatatagaaattgatatgatttttaaaagctttttgagattttcaatcaaaaccatagatctataacatgtacacacctttgtgttttgagtcaaaatattcctatatacacctaaccatttaaaagacaagtcaagatcaagtacaccagaataaccttgagagacgtgtacatctataaccaagaataccagatatcattggacttttaacattcatggattgtatacatagaatttgtccttttaacacaaaatcattaattctaaaagatgtggttgaatacactcctctcccttgacattggtacaatataacatttggaaattgtaacacacatcacctagctcctcaattgaaaaagttgtatagctttctttggttctcaaaggacaaacacaaactcatattaatgtctcaagtagtagtaagttggaaagtgatgaacaaaatatacattacttgcaatttattccatagattcaaaggtaggagcataccaaccaagctgatcgatgagcttcttcaacctctcttcttgtcccttggagtctccaaaagcagtggtgaaaggatacacaaaggtaaccttagtggccatacacctgtaagcaaccacatcttgcttcaccaaaaactccatcacatctctgctaaatcctcctccttctacctctgcctccacatacctccctgcaaatgcaattgtgtgtgatctttcctcaaatccttggtgggaatcatttaaaaatccaattgtggtgagaaataatttaccatagggagtatcttcaagaaccacaaacttggggttcttctgggtgctcattattgcttctttcagtttctgcgttgaacaaataatcagaaacgatgctaaattgatgaagataggaggaaatatacctcaatgggatcctgtgtatcggtttctgggatcgtcaatggaaaagagaaggaagatgaggttggattcgtcgatacacatcctgggttcgtggaagggcaaggcctaattttgctacaaaaaaaagagagtaataaagattagctttgtttagagagcagaaatcagagtgagaagaggaacaaacccattgagaagaccggtctggacgaacttggattgggtgaaaggagtggtgagtggctgagaagaggagagagaaggaatggctaaggcaggggaaaaggaagttagagagatagcaagagcaaaagagattagttttggtaaaagagagattggaggagaagtagaagagagttcttgttcttgttttgggctttgcaatgagcacaacaacttggtgcttctcggccgtggcgggaggatgagttgcaaactggcgaccaaactcatgtttgtagtttatggttactctcttctcctccaaatattattaatatataagtgtctcaaaacgctttactgaaatgaaaattaattaaaattgttttttttttttattgtatgtttgaacttttaaattttagttgactacaaattccataatgtcccgatataaaatgtgagatgtgttcttgtttgaccacaataaaaacactatgagattggtagaaaattatcaagaaatagagtttcacccaataccaatagcgtttcacctagttttcatcatcctattacaaaaattcgatggtaaattacaagcggcaaagttcaatgtaactaatgatacaccgatacacgtaacatgttcattgaatgtttcattaaaccaacaaaaaactattgactcatgccactagaaaaattaccaccgaattaaattaaagagagcgagaggcaaatgaaacgatagaaaataagacgttcaatggtcttgagagaattaaatatgtttctttatattcaccagtgtttgaacatttgcagaattgtgcagagaaaggactaaaggagaatgaacaacattttattggacaaggaaactctattttcacgatttcgcaggtatgtctttttataatattacttatttcataatattttgatatagatgattactcaaacaaaagaggtgaaaactcttgtaaattttcagtatttaacctgcaaaacagatactacttttttacttgatttatcaaaccaaagttaagacttacaaaagcaccggtgacaatccgacattgttgccatgcaaagactcaaaccaatttgaccgtcgacgcttttttagtatttcaaaaatatttttatcaattcatgaattatgattattgccaaacatcgattcagtggagactaggtttatgaattatgaccgtagaacatatgaaaactgtgtaaaactattgtataatttatgtattaaattttgtattaatcaactgatatgcggtcggaccggatccaaccggcgatcgaaacataccatttatattttttctttttctattttactagaaataaaataaatagaaacctccgttgcttttttggcaaacactgtgagagagttgaccaaaatcgacccagtgggaggactaggtttatcgaaagctccagttttcatagataaatccagtaaaattatacacgcaaattctagtttcttagagcaaagctttgttgaattgatagcttgaatttggga

SEQ ID NO: 4067 - DNA, 3000 bp, Unknown; identical to SEQ ID NO: 3126
  misc_feature (1)..( 3000): cDNA_ID_4262337_gDNA_ID_1620681_Annot_ID_164451 3000 nt of promoter + ATG

SEQ ID NO: 4068 - DNA, 3000 bp, Unknown
  misc_feature (1)..( 3000): cDNA_ID_1822802_gDNA_ID_1620681_Annot_ID_48352 3000 nt of promoter + ATG
tcctgttggtcctcaggtgaaatcgtagaagcaagatcttctactttcaggggagaatgtcgggccatatattgaaacatgatctgcaagatggattgtaaatgcttgagtcaatttcataagcatgattctcccaaaattcgtatgccatatgcaaggagagagagtaccgaccttggaatagctatcagcaaaggctcgggctcgatttgatacaccgatatattgcaaatccgccttctcaaatctaccatccacacatttcagccctccatcgccaatggcaaagcgaataagacttcctgaagacagccctgactgtaatatccaacatggcacgaaccacacatttagcaaattaacacagtgcgaaatcatctttacaatctgttattatgggtacatggagtctataacaaacagagcagtactaagctagagggctctgttggtcctagaaagaactcaaagaagctattactaagcaatatcactaacttacgagtacatagagtctataacaaacatagacacagtatagatactaccactgagtatgaagcaaccagtgatattatacagtaacattcataaaacagaggatacaagatctgtccactttctaatataatcatcattcatcataagaaatatagatatgttcttcaattttcaatttttccaaatgctgatcatataatcttggtttaaaggctgatcaggatatataaaccactccattatattctgaacagacctgttttacaaaatctgcatttaagcaactgaatggtacaggtggatcatcagatgttacaagttttccttcttcttgcaactccaagacaatctgtttttacaagatacagagagaatatatgttaagactttgtaaatgggagtgtaatactaaacactttgtatgaaaaaccatgagctgtaaaagtctgtcaaaatccacttacatgttgttggtttggaacttctccattgttatcagtatcgatgacatactgactacagctctcatccttccatatcaacaccagaggagtatttccagtatgataatgtgcatgtctgcaataattacatgaactttagtgggaaagagtcaaagaaaaatactagaccaatgagatattgatatcatgatactaccactgagtatgaagcaaccagtgatattataaagtaacattcataaaacagagaatacaagatctgtcctcgttctaatataatcatcattcatcataaccaatggttttgatacgaaattgttaagtctgaagaacttttttaacgaaaggttccccggttatcgaccctactgcccaaactaaaaccctataccatcataaccaaatgcattccctaatatcccttcaaaccattcagctctaaactaacgacttaaggtcctttgctgagatggcaaaactacaactaactacataactcctaggctagttgcaataatcctgcactagaaaacaactgattcgctactccaaaccttaaggcacccaaactttttgcaagtgcagacagcaggagaaggaaagatgggaatcacagtaaacttaaaggcaccttacaagtaggcgagatgaaatgatgcacttacttgttataaaataacaatccatccctgacataaggtaatgatcctgtataagctgagtgaagtccgctttggtcgcagttgtaaaaaggaactacactgaacctgaacttgtggtagacggaaggcggatcacaagcaccggtctcagcaagtttcgattgcaaccaaaagaacctgaactctgatgtgcattcataaagcgagtaacctctccaacaaaccatatcaatcacatagtatgtttgatccgactgcataaaaaaacagtaacaaatcacctcttagtaagatcaaaactgagggtaaacccgataaatcagtgaaaatgaagaatcttttacctcgtgaaagatacagtctagtatagagtacgagtttgcagggccagaagcgccttttttcctcgcaccaccaggtaatgcagaagggaaaagatgcaaagtggacccatttcgtactctactaacagttgttccatcagatgaaactacaaaacatcttttcccagctggtcttgctaacacatacctaaaaaaccaaccaattctcataatcagccatttatgaaggaagagaagcagcaacaacggattaagaatgagaaagaagcagtaccaatcttggcttaaattatcagggacgtcgatcatccattcaggtaacattagctgctttgcgaaccacttgcgtgcctcaggtcctctgagcctcgaagcttgacgaacgtcaaagctactcgattccgattcggttcctacaagctcaggcacggcttcagatagtatctctgggtcgacatcgggagaggaggattggagcgagattaaggaagaggcgaggtttcgggctcgctgctgagcatcactgcgatgctgagtctgacgaataagagaaagctctcggcgtttctgttgatcggagataggtcgtcgcttgaaaggacggcgaatttcatgaggcgccatttttggaagaagagttcgagcaactacgttctattggtcggacccttaaggactggttcgacctaaaaacgctctgagagactctagctttggaatttggatggttgtgcggttcaaaattaaaaccaggtgtgggtaaaactgaaccggatcggtttggttttggttgttaagtacaaaattcgattcctaataatactaaacggtttggtttaggtatggttcattaatcaaagtttctctataattttttcccaccgagaaaggcctatatatacaccaatttacataagctctctcatttcttgttacgttctctcaaaattcatctctcgcattgattcttcaactctcaaagaatcgcaaatcttgctcttgaaataatcggaagaaagaagagtcatg

SEQ ID NO: 4069 - DNA, 3000 bp, Unknown
  misc_feature (1)..( 3000): cDNA_ID_1823766_gDNA_ID_1620682_Annot_ID_48355 3000 nt of promoter + ATG
gcggcttcggatccgaattacaggttcgttagaggtggtgagagaagaagctggacggctctcagaatgaattcgccggaaattgggtttggcgcagcagaaaagaacggtggctgttgaagcaatcgccatggctgagatttttctccaatttccaattcccaagttctggtttaattttaaaccggtttgctgttgaaccgtcttttatcattttcacaaacaaaattaaactaatcggtttattaacaaattctggtttttctaattacttcccatctttgaagttgaagagaaaaatataaagacaaaatggagattagtacattaaaaatctcaaattctgtattgaattatttatattacaagaagaattttccaattatttgtagtacatatatatatgtataatcaaaatgtggagtgaaacaaaatcaaaatgttaaaatgtgttactcttttccttagaccagatcaaaacgagagtgaaccccatcaatgacattaccaccgtctgcaaaacaaaacaaaaatctctataatcatcatcaataaaagattatgctatgtcaaaaggatatgagacttacagatatagcaggaggaatccccacaagaggatcttgaaagaacttagtagcaagcgctagagccaaaaggctactctgcattcctgatatattcacaaacacatttctcttctcaaatctttaaaccaaattgtactttcttgataagattttccaataccataaagagttagtaccagtttcataggacaatgttctttgcatggctttagcgtctggagcgtttctaaagacagaaccggtaaggaagtatccagcgaggaaagctgagagatgaaacattgttactagtaacaatatggtggctccaaatggagacatgaccgagtttatgttcaatgcgagtggtgctccaacgcagcaagctgtgtcgagaaccgatagaatcgggagaaatggtcggattgcatttgatacttttgggaacaacctgtaaaagaagaaacaaaaaggagataaaaatggttatacttagagaaacaacttgtggttatttctagttgtaggcttgtagctatatctctcacttgtttagtagcaatcctgcagcgattggtgcgattacaacctgaagaatgctggatatcattccttttacatcaacgggtagtttcttcccaatgagcaggagtgatagcatcggtgtgacaagaaccgcagtagcggttgatagagatgtcatgacgatgctaagaggtgccaatgctggatcagttaggaatgtcgcatagtttgacaactgagctccactaacacatgataccaacatgattccagcacctgagagattgagaaagattggttaatgtgagagataggttaagagtcttgaatgatgagagacagggagcttttaccaattggagttgggagttggaaaagagaaacagcagctaggccaaagatgaaacctaggacaggctttacgagatattgtccaacataaccgaggaggatagcttttggtcttttgaaagcttcaagaaagtctttctcgtttgaattgataccaaccgcaaacatcaaaaaacctaaagcgggcacaaagtacctaaaataacaggagagtaaagaagagctttttagcaaacctcatgtctacaattcaaagtcttagatcaatttgaccttgttccaatgggaagaacctcgacgtaaaccaagtgaaagaaggaggatagataagagctaatattgtactcgccaacactacatgaggaagaattgagtttgctttcttcattctatccactatagaaggcttctcaataacctgcaagccacttactagattcatgttggttctcggaagtaacataaaattcttaacaactgaaatcatcagcaaacgaagaacaaagtagcaaaactgtgatccagggatgatttttagctaatcagattcaaaagtaggataattaacaagtcttcaatagtgcaaaatcacattttgacattaaagatgacacattttgagaagactattcaaacccaacataacatagaatggaaaaggaaagatcccatagcgcacaccttgaatggatcagctccaggatccaaacccatctccgagaaattatcagatgcatatctacgccacaaattcctcgatccgccaactgtgtatatagtaggttgaagaaaaccatgagagaagaaagtgtaaattttgcaggtacccaacaagcataaacgcctgaggatcgatgagagtaagatgaacaaaccttgagagattgggtcgatgcgaagtggagaactcagagaagtgttcgagaagatgttgggcgggaaaacttgaatccgttgactgcgataaacagctcgtggtagaagacgaagtgttgactttaggtgcagggtctctattggagttgtgatcacgctcattttttttctttggactttgtgatctttcagattcttcagaagaagtggcgaaactctgagagttctgggaaatggaagaaagagggagagattcagagaatctgggacccgagaatctgtcgcatcatcaacctaacaaaacccgacccgacccagttagagtttaagtttctggaaatggcccactgggctttaagataatgtatatttcaaattatgattttcttattttaaaactgatatttggaatataatgtgttgtgtagtgagaaagacgcaattaatatacttaagttagggtaataaaaaaatcggtacaagactacaaagcaaagacacaaatcaaggagaaaacttccacaaattgtctctctttctttcctacacaccaatttgttttgtgattctttcgattgcattcttctttttcgaattcccgatcactggattttcccgtttaaccggaaaatccagtggattagattttacccagtgttatctttttggattggattcg

SEQ ID NO: 4070 - DNA, 3000 bp, Unknown
  misc_feature (1)..( 3000): cDNA_ID_1809214_gDNA_ID_1620682_Annot_ID_48358 3000 nt of promoter + ATG
gaaaccatattcgaaggtaaaatcttacttggtgcatttgacagtgttggttttgccgccgctggagattgacagaattgttccaaagaaggaggtgttttccgttccacaattcggacaaggaccctgtgaaacaagaaacattcataaaaaggctctttgatgtttttcttttgcaatcttgagtaatggtaatggttcttaccttcaagatcaagaagtccttgatgatcaatttggtgattgataaagccagatatacaatcacaggcacagcagcgaaccaagtgaatatgaaactgtatggttctggaagctccatgatgtatgtgatctcaaaacctgtaatgtcgtccaggaagaaaaagctgcaagtacagaattgaatgaataaacaaagacgaaatatgggtttcatatgatttggatgtttgaatagaaaactcggtatagagactcacagtccgagagcaacaacggttgctggaacattcaacaataacattttgaaataatctacagcgagatcactatacacctacatttgaggaagttcataaagactgaaaattagtatctatctataatctaatattaacaatgaatcttatgttctatttacctttttactacggagactgcatcttggaccctcgctcacaatgtcgctaccatcaatctacatggatacagaaagaatcataaacttgaagcttaaaccaatcttataagggtatgtctattttcactgaagcataaaaagtgaatggaaacctttagtttgagtttgagcttatcatattcttcatcattcaagattggatttccagaaacataagccatggaagcttccaagaatctttgttcatcggaacctgtgtttcatattaccaataaaagatttaggactttgcaccaaagaaaccaaaacaaagaaatgaaatttagtcccatagttgatgattacttagcatcacaacactgcttccttcccacattaactcttctttaaggttatcaaactcttcattagacatgatcgctttgccatcataatagaaagactgtaatcaaaagacaaaagcaattctcaggctcttgaagattagatatatatcatgttttggcaactataaaaaaaatggtttattgtagcgtttacttgcaacgcttggagaaactcttgttccatttcaccaattgttttcttctcagccttgttgatgctacaatagggcaaaacattgctatcgacgttgtctcctcctactggaccttaaggaagacaaaaagactgtaattgagaacttcatagcaaatctaaagttgataccttacttatgcaacctaatagttacacaacttctgacattgcaaaactttagtacagagttaaccactaaatagtcaacaaagtccaatacaaacaaatatactataccaaagttatagccattgaatcaatcaaacccttcaaagaattgaactttaacaggattcgagtctggatactacaagttagtgacttaaaaacataaattttcagagctagagacgttgaattaaaataatatatcctaaatttcaaaaggctcaaactttggaaacccaattgtgaacaaattcgaatccaaatggctttgtaaacagaaaactaaggcggagtgttcgaaatcgagactaaagtggccaaatcaagacctgattgctctgttgtggctttagcaggcaacaagaagactcttcttctcaaagaaatcgattttccagggctgagctgagtccattgagtcctcgaagacggcgacggaggagaaggagagaaagaagaggaaggtttgcgagaaacggcggagaaaagtcgaggacttgtcaaactaaacaacatcttgctacccattttcccttagagatagaaaagggagctcctttttttcctctgtttttttcagtaagtatgaacctgtggttgaagatgtgtttactgtgagcttctcaggtttcttctgatttttttttttttttttttttttggttttattataaatttggagggaagaaattaggagataagagaagtgtggagataaattcctaggcagatttctcttattttttccttcctctcatcctcataatcagaatatccacgtcagcattaaatatccggttttcttaaacaaaacaaaaacttaaaatagagaaaagacataattttaggctttgattatacaataaaaaaaatactgtgagatgagtaagaagatttttttttcgaaacatggtgattttttaaaaaaatttgacatgtagtatgtgtagttgaattcagctgataatatactttagtacaaaccattaaaataaaaatgagttccaaattttaaaaaacaaacaagataaataatttagttttccaaaagaattattgatccacatacaattgtctatttgaaattgaaaaccagtcaaattgtttttttagtaattgatttccaaactacaaaaagaaaatgtggttagtagaagaactagtagaggtgaacacgtggagacacgcttaaagcacgcgacgaagaacacgttgatagcgattatgggtttaattctattgggccttttctgggagtctagacccaagcccatatagtagtaatctttttgaccaatcagtcaacccaaccatcctctcccgttgaccgtgaagtgagtcacgcacttacctcacaacaatagcactaaccaccggtagctctacaatgtctcttagttcggtaacaaactcttctaactaaaagtatagtaaaaactttgctatataagaaagagtctttgcacatttcatttacttgcaaccaattacaaaaaagagtgtaagaagaaaaacaaaacaaatccattttttttattactctgttttttcccctgtttttaagtttatttacttcttactctgttttctgctctgttttagctttaaacagaagactaaagaagatg

SEQ ID NO: 4071 - DNA, 3000 bp, Unknown
  misc_feature (1)..( 3000): cDNA_ID_2990417_gDNA_ID_1620682_Annot_ID_48359 3000 nt of promoter + ATG
catacaagttatttaaaaaattccaaacaaaaaaaagaattgcatatgtaccttttccgaggaaataaaatttgtgataagtttagttcgcatatctatttatattgctttgaacgtgaaaggtatacagccaattaatcataccaaattaaaccaaattttcaagaacatgaacaatgtacagtaccaaattactaacaaattttcaaccattttgatacttgcgttttttctgtagattattatttggataattatactaaaaatataatttatcatgttggatgtggtagatggttgtttacttgtttagacaggagagaagaaggagattgagccataccattaagtagtggagttaagcccaaatatataattgggttaaaaaggccataccattagtaaacaatcgattccgaagttgatccataccaatagcacacaatcaatttggccataccatttgttgagttcagtgactgctttgaaagaaggcacactaatgctttcgtagatacaaaagttaactaattcaggggaatcaaagtttggtttgcatgtagtttgtttgggttttatttttatattttattttagaactttgtttctttaaattaaagtttgcttgttaagctccgcaatattcactataaaaggcacaaacacatcaaattcatgagaaagacacaaacacattataaaagaaactcgcacatagagtttcaaaaataagagtaaacacagaaacttaatcatttttctcggataccaattcctcttgttccttcccaaacaacttatgctcaatatgttgagcaaaagtccgtggaggaaacttagccggagactcaacactcaccatctccggcaacggcttaagaacaatcttatcctttgggggttcacaaaacacagcccaagaaatcctaaccttctccttattcaccaacccacgatgaagtatactcttatacttcccattactaagaatctccaaagtatccccaatgtgcatcacaatcgaatcaggaacacattttgcagtgacccatttgccctcgtagaaaagctgcaaacccggaaccatgttgtgtagaatgaaagttaaagcgcttacatcggtgtgagcttccacaccgagtgctagctcaggctgaggacattttggatagtaatttatcttcatttgtagaagaagctcttctaaaccaccaacttctttctctagacggtcaggctctaaacctagaccgacagagagagccttgaagactttagtcgctagcaaacgaagacacttcgcgtactcactcgttgcttctctacaatcatcgaaaaacgttaataaaagattctaaaaccaaaacaagattttgttttctttagtaaaacaattcaaagcttacatgtaatcacttggtgtcttaggccaaattgatagatctctcttctcttcaggatacgcaagatgaaagaagtaatcttcccattccaattgtccactcgcgttgttagccaatttacttccatagccttgaatctttccagtggcttgatcgtttgcatacttctccttctcttccacagacaaactgaaaaactcttctccggctttcttgacacgctccattagatcagctggtattccatggttgatcaaatgcatcactccccaatccaaagatgcctttttcagctcctcaatacaattctcacggatcttttcatcgtctgactcgatgttctttagatcgattgtgggaacttgaggaccgtcttctttcttctcttctaggaaaacatcgttgatgctctcgagctcttcttttggacgaatatattcttttggaatcgatatgattccgctttttgctagactctcaactctttcaaccgcaaccatcttctttagtcttctgtttaaagctaaaacagagcagaaaacagagtaagaagtaaataaacttaaaaacaggggaaaaaacagagtaataaaaaaaatggatttgttttgtttttcttcttacactcttttttgtaattggttgcaagtaaatgaaatgtgcaaagactctttcttatatagcaaagtttttactatacttttagttagaagagtttgttaccgaactaagagacattgtagagctaccggtggttagtgctattgttgtgaggtaagtgcgtgactcacttcacggtcaacgggagaggatggttgggttgactgattggtcaaaaagattactactatatgggcttgggtctagactcccagaaaaggcccaatagaattaaacccataatcgctatcaacgtgttcttcgtcgcgtgctttaagcgtgtctccacgtgttcacctctactagttcttctactaaccacattttctttttgtagtttggaaatcaattactaaaaaaacaatttgactggttttcaatttcaaatagacaattgtatgtggatcaataattcttttggaaaactaaattatttatcttgtttgttttttaaaatttggaactcatttttattttaatggtttgtactaaagtatattatcagctgaattcaactacacatactacatgtcaaatttttttaaaaaatcaccatgtttcgaaaaaaaaatcttcttactcatctcacagtattttttttattgtataatcaaagcctaaaattatgtcttttctctattttaagtttttgttttgtttaagaaaaccggatatttaatgctgacgtggatattctgattatgaggatgagaggaaggaaaaaataagagaaatctgcctaggaatttatctccacacttctcttatctcctaatttcttccctccaaatttataataaaaccaaaaaaaaaaaaaaaaaaaaaaatcagaagaaacctgagaagctcacagtaaacacatcttcaaccacaggttcatacttactgaaaaaaacagaggaaaaaaaggagctcccttttctatctctaagggaaa

SEQ ID NO: 4072 - DNA, 3000 bp, Unknown
  misc_feature (1)..( 3000): cDNA_ID_1822914_gDNA_ID_1620682_Annot_ID_48361 3000 nt of promoter + ATG
tagcacgccaatgtctctctcttttttagtctaaaaattgattacaatttttttttatgaattttaattaacacagaaagtgtaatcatgatcatcatcttcccatgcctctatcatcattgatccaattttctcctccactactgaacctattaattgcttttacgttgatttaaaaattttaaaacctctacgttagaacggtcatatgcttatttaacaattagatcatgtcttctataaaggtaaaagagaaatctgacaaatgaagtgtaagtgtttataatgtttgtgtcccaaaacacacatcccccacaaaagtaaaaacaccatcaaaactttctttctttcctcttatcttcacttcctcttgtaaaccctagattctcttgttcctcttatggattcattctctttttgtatcatcatcatgatacttctcttatcattccaccaatctaagtctcaattgattcaatctacacatcttcttgatctcatgatcagagattacaccattagaaactttaagctcaatttcaacacaggcgtcactcagaaaatctatctcccttctaatttctctggtatcgatattgacacggtcaagttaaggtgtgggagtttgagaagatatggcgcaaaaattggagagtttcacatcggttcaggccttacggtggagccatgtccggagagagtcatgctaattagacaaaactttggttcgaattggtcttcaatctactctactggttataacttatccggttacaattacaagctcgtgtcaccggttcttggtttgttggcttataatgctaaccctgacggtgtggccaggaacccttacgaggttaatgttgtaggtaccgatcaaaacccaatcttaatcgatttcttgatcaacaaggcaactaataacactagccctaaccctacgaagaagaactcgtcagtcttgtgtgcgtgttttacaagcaacagtaacacaacgtttagcgagcaagtctcgccgtatgtgtgtaaaggtacaagacaagggcattacgctctcgtgatgaagacagaagctcaaaaagatgatcatgaaggtggtggtagtagtggtggagtggtggcatcatcgacggaggtgaatggtggcaacggaggaggaaagttgagccgttggaaagtggcggtggggagtgtgatagggtcagggattggagcaattctgctgggaatgttagtggtggcgatgttggtgaaggggaagaagaaagcaatgagagaagaaatggagagaagagcttatgaagaagaagctcttcaggtgtcaatggtgggtcatgttagagctcctactgctcctggaactagaactcttcctagaatttccgatgataggtataataaaaacactcatttgaatagtaattatccataattatcatttgttttctgatttttcttctttttgtgttaattgagtatcttaagataaatagttttgtagaaatagtttcaatggcttcaaaatgaaatttcatccatttttttttagtttttggttaaacggctataatcgttagttttctttttactaaaagtaaagacttttacagaatggagaattttctcttttttattttctataaaatggtcagtgaaattatgcaaaaaaatttaaaaaaatcagagagtccccccaactttcatactgtaagctttatttttttcttttcattttgatttattaatctctttttccaactttttaattaaatgtatatttctgatttagtgaagaaaatatacttttatcagtattgtgactagttaacagaattttccacctacacatcaacaagcatcttctccagtaagctattgttaatgcgaagtacggaaatataaacaaatcaccaccttcattgcaacttgcaatcaatttttactcattttagtaaggttttgtttttctttttctttcagttttttgtgatttagtttaagaaaaaataaaataaaatatagatataatttgatcaatttcttatagttgacagaaaaaaaatcttataactattgtcttttgttatatttgattggattattttttgaatatttttttggtaaattttcttttatatctttgatatttaagttttggtttatactttgtatctcaattctgtaagatatgaaactaagatttttttttttctaagattttagactttagcttattaagaaaattaaaattaatttcttataactgtataagtgtatttttctaaaatttcattgaaccatttttgactagtatatatctttttggaaaaatttctagaacatctttattatttaagtttttaggtctgtacttttgtgtctcacaattctcttagatatgaaattaaaaaaccaattaaatacaaatcagatctaatttttaatatataaaatcagcatgttttggcttgatttgtccatagatctataacatttatcaactatttttatatattgtcaacgcctgccatctaagattcttctacaagatcactagagtgttttaactgcttttagtaaaaaatgccaaaaacagacattaatccataactatttaggcccatcttcaagcccattaaaccttttcctcttaatccaacgattaagattgaatcagaagcttaaacctcacggtcctcacctgaatcacaccgcttaacttcacatgtcgttttctgtttttccttagatttcccgggaaaaaggaaataattaaaaaaaattggcaaaaaggtaaaaaagttaagttaaaaaaaccaaactacaataaaaaggacaaagagatgtttcaacaacacttcaacaaaaaagccttttgttcaatctgaagaaaaaaaaagagtcaacaaaaaaaaaaaaccaatggaagaagaagatcctacagcaagcaatgtgataacgaattcgaattcttcatctatgagaaacctatcgccggcg

SEQ ID NO: 4073 - DNA, 3000 bp, Unknown
  misc_feature (1)..( 3000): cDNA_ID_1808716_gDNA_ID_1620682_Annot_ID_48362 3000 nt of promoter + ATG
aaaccgggaaagtaaactgtttgaagttacacagtttacctcatcaaagaccttggcgtatagggacaaggcaatgggagcgctgtaaataccagcacatccgcaggatgattcttttctactccgttcatgtggagcactatctgtgccgaggaagaacttcttgcttccactagttacagctttgacaatggcttctcctgtacaatgaagtaaaagcaatgatcttccgaaagctgctgaaaaaatgaaatattaatgttcaaaaggaaagtgaagaacatactatgtatttctcttttgagaacgggaagacagtagttgtgaggttgtaatccaccttggaaaagggcgttcctgttgagaaggagatgttgtggtgtgactgttgcacccacagaccctataatcaacaaaatgttatgagctatgcagattaacaaaaaccaaaagacaagaaatgaaaataagatagtaacaaaaccttctttgcaagattcaacaaaattcacagcatccatggttgtgatgtgttccatcactactttcagctgcggaaggcgttggattagaggctgcagaactgtctcaatgaagattttctcgcggtcaaagacatcgatactcggatctgtgacctccccatgaacctaatcaaaacattcctcagacaagacaaagacaaaaatacaagtctatgtggtgtatgatttatttaccagcaaaggcatgttttgtttgaccatctcttctagtaccggtaagcattttccaaagagatccgtgacaccatcttgagagttggttgttgctccggcagggtacagcttcaccgcataaaccacaccactttcccctaataacaagatcatatatgcataaactgaacattagcaagtagaatctcaatcagaaagatgaaaatgtatctgattagtttgcaacaagatggagaaagcacaggtacttacttgcaagcctgatctcttcaggtagagttttgtcagtcaaataaagtgtcataagtggatcaaagctactctcagatggcaaagctttcatgataaatttccggtaaataatggcagctgcagtggaggtgacaggaggcttcagattcggcatcacaatcgctctcttaaaattactcgcactgcacataattacatacaccattaaccatcatgtacagcacaagcatcaacgccagcacaagattgtgattgaggaattcatacataacaaacaatggttccacaagaaacaccaatagcaaacaaaaaagtggctgcaaaacaaagtaaagcaaggaaagaaaagaaagattgcaggatgtttataagacctgtggggaacaacagcatgaagaagatcaccgtcacggagatgaagatgccaatcatcaggttgagtgattgtgagctccattcttactgctctcgtcttcactttctcagaagatctgtcaaacttcaacttctgagatccaaatccctacataaagaataaaatagttgactttaacagacgcataggaggaattaaataaaattaaaactggatcacgtggattgaactaaacaagaataagactcaaagagtggtggaggtagagtacatacactataaggagagaccaaagtctttatcatctgaaagctgctcaaggctttgcaagaattcacctgttccaaagcaaatgacaagtagactcagattctataacatgaccttaaaaaattgactctgttctaaagtattagcaggcactaaaactattcaatcatcatcaaaagatttcgcattcctttggttcaatgtttctccaaacgaaatttagtatccagattaatcaaatttctatacacacaaatgggtatcagcaaaatccaaagaaatcaaattatccaaacaataaaccacaaaatggcgaaactggtaaacacctagaaaccaaaatcgaaaacttgaacttgtttaggtaagcaatacgaacctggataaacgaaatgcacaacagggatgcttacaacacaaacaaaacgaaccccaaaaagagtgatttgaggaagagattgaaggagaaagaagaagaaaaaacagtactcgtgttttgttgtttacaagatacgacgtcgcttaacgtaaaagaagaagaaaaaaataaaagctctgtaacaggccagcccaattttagcccgatatttttaatggacctggacctgatcacaaatttcagccctttttaacatccttatggatcaacatgggactctctgactcctccggttccatcaatacctgcgtttgttgtccttgttcacgacgattcaagcgaagaagcctctcgagtttcacaggtctaataactaaaccgagtaatcgagtcgaatgacattaaattgaaccgaaactaaaccgtattgctttaggttcgactgacaactacagtacgtgagttaggttcggttagagccgaatctgtgtctctttgtcgcaacgagatggctaaagttatccaaaaagacggttagagccagttgttagccccaccatgacgacacatggggaagctcatgcaaagattagagaacacgtggcactctctcgtgttcagaaaaattccaaaagagtgttcagatttgggcacggaagtgtgaaacgtgaagcaacaatcccttttaaacacaagaaccaactcaatacgcatcacaaagaaccctaaattcctggaagatctcaaaaggaaaattcaaaaccaaagcttcaagcaatcatcaagcaaaggaaaagctcaaattttgggtcttttatatatttatttcttaaagttacaatctttttgattgtggtttcagtgtacgaacacgcaagaactcgcgtgaaaaaattgtatccaagcttcgtgaaaggagtctctctgtatttagtggcgttttgttctgttgttatttctgaaatattgaagcttttgatttgggtttcaagagagcagagatg

SEQ ID NO: 4074 - DNA, 3000 bp, Unknown
  misc_feature (1)..( 3000): cDNA_ID_3072509_gDNA_ID_1620682_Annot_ID_48363 3000 nt of promoter + ATG
tggtgatgattctcatgaatatcttcatatttctaaactattcttatttgggatattagtataactttaaattggtgatgattctcatgaatgttttgatatattaaaatatatatgttcattaaacaacaatttattcatctttatgtttgcattgcagtagtactataccagtctgtcacctttaatattagctaatctgtaagaaatttacattttgatcttgtggatgagatacaatacaagtatacaactatgataaagacttcagagtagacacaaaataccatttgaaactttaaaatctgtatttaacctacaaataatcattattttcctataccacattatgtacaccaaaccaaaccaatatttagatccaccaaaaggaaagtcctgccatttccttttcactttgtacaaactaccaaaagaaaaacttgtaatttgatatttagtcactagagtttctccggatttggagtagcaattccctcagtctgagtcccagagtaaccatttacaccttcattactaagactatgagaccatggaatcgagctaacggttggaaaacaacaactacactcgtccgcacaccgagcctcgggaagagtctcagtcttgtgaccatcaggcgaaacagcttcccaaagcggaccccaacactcgactttgttgaactcattgacattagaatggaaatagacccaaacaagagcttcttgtagctcaggatagttgttcaacaagttcccatctccatgcacaaaagccttcaacacctgtatatatcaaaacaataaacattttgttttacatgaaaccaataaaaagtttcttatgaatttgggaacttaccacaggtagttctttgcaaaagatgaaatatcgaaactttgcaaagagatctaaaaggaaatggccaccgcttatgtgacaatgaacgtgaagcgacattttccctttcactttcttccattctgccacaacttcatcccggtatagcctatttgcccatccttgcaactataaaaaacatttctatacatatcagcctctaaagtgttaagagattctggtgaatatagacacatacataggttaaaacaatcatacataagcctctaatatttgctccaaataatcaaatacataaacattctactcctataaacagagccatgtagatatgttaagaccagagagagaggtgtttttacctgagagttgtttatggattgagaaatagctaaggttagtttagctgtaatgtcactgtgagtgagtgtgtaagtcctagggagcgttgaaggatgcttcttctcatcaacccctaagaagagtactttcaatttggatgattcgaaaatcgccggtccaaacaaccttgcaacctgcaccgatcccaaaagtttcaagttccatcaataaagacagaggcatagatatatccataactgagacacataaaacaaagatatgtcaaaatgattaagagaacaaatccttacgggaacaatcgattggttcttcttcttggatcttctattgttgaagaagagtgagctgctgctgctactgttactccgtttgtctgaataagctggtttcagcttcgttggtaacaacataatcgccgacaaactacacatctctgctctcttgaaacccaaatcaaaagcttcaatatttcagaaataacaacagaacaaaacgccactaaatacagagagactcctttcacgaagcttggatacaattttttcacgcgagttcttgcgtgttcgtacactgaaaccacaatcaaaaagattgtaactttaagaaataaatatataaaagacccaaaatttgagcttttcctttgcttgatgattgcttgaagctttggttttgaattttccttttgagatcttccaggaatttagggttctttgtgatgcgtattgagttggttcttgtgtttaaaagggattgttgcttcacgtttcacacttccgtgcccaaatctgaacactcttttggaatttttctgaacacgagagagtgccacgtgttctctaatctttgcatgagcttccccatgtgtcgtcatggtggggctaacaactggctctaaccgtctttttggataactttagccatctcgttgcgacaaagagacacagattcggctctaaccgaacctaactcacgtactgtagttgtcagtcgaacctaaagcaatacggtttagtttcggttcaatttaatgtcattcgactcgattactcggtttagttattagacctgtgaaactcgagaggcttcttcgcttgaatcgtcgtgaacaaggacaacaaacgcaggtattgatggaaccggaggagtcagagagtcccatgttgatccataaggatgttaaaaagggctgaaatttgtgatcaggtccaggtccattaaaaatatcgggctaaaattgggctggcctgttacagagcttttatttttttcttcttcttttacgttaagcgacgtcgtatcttgtaaacaacaaaacacgagtactgttttttcttcttctttctccttcaatctcttcctcaaatcactctttttggggttcgttttgtttgtgttgtaagcatccctgttgtgcatttcgtttatccaggttcgtattgcttacctaaacaagttcaagttttcgattttggtttctaggtgtttaccagtttcgccattttgtggtttattgtttggataatttgatttctttggattttgctgatacccatttgtgtgtatagaaatttgattaatctggatactaaatttcgtttggagaaacattgaaccaaaggaatgcgaaatcttttgatgatgattgaatagttttagtgcctgctaatactttagaacagagtcaattttttaaggtcatgttatagaatctgagtctacttgtcatttgctttggaacaggtgaattcttgcaaagccttgagcagctttcag

SEQ ID NO: 4075 - DNA, 3000 bp, Unknown
  misc_feature (1)..( 3000): cDNA_ID_1822903_gDNA_ID_1620682_Annot_ID_48365 3000 nt of promoter + ATG
acgaacgaatctaatccccaatttcacaatgtatcatcatcatcaacaccaaaagagctaaaagatctcaagatactaacacatacatttccctaatttcgttcgctaatcgaagttcacaaaccatagcgagagtaaaatcgggaggagaatagaagatgtacgtacaaatggcgatgagaggacatggtccattcttatcctggagaatgatattgcacctttgtccacgatacaaaatcttcttcgtcttgtaaaagatttcgtccggaggaggacgagagttatcgatcgccattaaagaagaaggttcacgacgatgagaatcgcttgttgagatctaaccgtctgcgaaatcggagaagacacactttgctgaaatttctcaagaagtgtgtcaaggaagcaagaaaagtgagcatgggactggcttttataagcagcattgagtgacgagaaacaaaattgattttgacgaaaccgtaattagtatggttttagtaaaccgggtttgttatgacggtcaaagctggtcccgtattggtggctctattcaagcgtgtaaataaaattcaacatttgacccttatgttacgcctacccttatgtaggcgaatctttcaactgttagtgaataaaaactctaatcatggattttagagaccaatcaaatatttatcagcggagctcatgtaccataatattataatagaataaaacttttatgacatatataaacggtaatagtaaattagttaaaacgttatgctaaagatcatataacatcgaaaaagcagtatagcaagatcgtttgaagttttatctataagaaaagatcgatggaattattttaagattttagttcagatgtttcacgcagaatttatttgtattgggtagtgacttcacaaatagcataaaggaaccagcttacgtaagagaatattttggtttgaattttcaaattacatataggtagaaatattcaaatatatgaagacgaccattgatagattttggatattagataattggatgtaaataactactccttttaggctaacctacacttgctttttcgtcaactatgggaagatgttatagtatatcattacattgattctcacgtaggtttttttttctatatttttgtagggaaatgcaaattaacaaagcattttagtacgttcatttagtgaaagggatgtggtcctctcctagcgtgcgacacctgttccaagatatgtaagaataaacaaatgttattgtaacgtattattgtgaaaagcatccaatagtggataaccacttgcttatgccaaagattataagatatttaaatcgaggaaacgaataaagtaaaaaagctagaaggtggtggttataaattacaagaaacgtatcaaacaagaggcgaagatgacatatattgacatgtgaaattgaaaacatatacaagtacgtgttactgttttatttgtgcgaaggtcgttgttataataaatttttattgtacggacgggttatttatcacacgattaaagttctcttcttttatttatcgcataaagttctgcttcttctgtggaaaatataaaacgagttttgtttcaacttcttctctaaatcaagagactattataagaagtaaaacagcaattgttaatattgtatctcctgatcagatatatatagacttaaatatgcacataagtgactgaaataaatttgtatccatttttgtgtcgaagtcttttaatttcttaaaatagataacaagatcggatggtgcacgtttgaagagaagcgaagatcggacggtgtgtcctaactacttattttgtccgatatgagctggcaacggacaaggatgcttgatgtcctcaggtggcactagtgaaacccactttgacggacaccggatctgtaggttgtcggttaatatggacacgtgccaagatctcccccattacctacataatatatatctccttcacttaattatgtttaagatgtaagtttgcatttactccaacaatataaattaattaacccatacctagactagatataccaaaaatatcatgtaaaattaagaaaaatatgatacgaatatatatatatatatatatattttttcttacgattgtacaaagttagataaattatgggtttattggttataggcttttagagtaacatataatattttaaaaaaaaactgattatgcaattaaattcgaaaacgaaataatatatagcatgattcttttccttgtcacacttcattatagattattcttcccccgtcaacaattattgcacttacatattttattactattatagattggccttgaatttgcattagaatttttaccaaaagaagaaagaaattacgtaatgcaatttctaaaaataaaagtgatgtactactaggcaggtctaggtttatatagactatccgtagccataagagaaaatggcaaatttaatatataatgcaaaaaagaataaggctatgatgtcaaattatcaatcaaaaacacttagtttttttctttctttctttctctcccctccttcatcataaatctagggctttccaagaatctctatcacaccctcttcccaaaatctcgcctatttttcctctctccactcacttatagaagatagattatacacatagagagacacatcaatccaaagctcatacttacaaatagggtaaatctcgaattccatcttctgtttgtggttgatccatattctatttacagagaaaaataaattcaaatccatatcttcttttatgttcttggtcacttttgtagttggagtatgtctcttcttttatgttcttgatctgaaccattatccatatatatagttctaatttctggttactattcgttttatttggttgaataaatacttgtctcttgtgtgattttacacagaatatttatataaagaataaactagaagtaaaggatg

SEQ ID NO: 4076 - DNA, 3000 bp, Unknown; identical to SEQ ID NO: 4069
  misc_feature (1)..( 3000): cDNA_ID_2051015_gDNA_ID_1620682_Annot_ID_164478 3000 nt of promoter + ATG

SEQ ID NO: 4077 - DNA, 3000 bp, Unknown
  misc_feature (1)..( 3000): cDNA_ID_1822899_gDNA_ID_1620682_Annot_ID_48366 3000 nt of promoter + ATG
atgaatctacttattacggtgaaaattggacccgattagcccctctagtcgaatcggatccaaaaattgatcagtgcaaatcgttttttcacaagtaaataaacaaaaaagggacatacctagagctagagaactcatagagtttggatcttggagagaagataaccaaagcaacttcagcatcacaaaggaccgataattcgaaggctttcttcaagagtccatttcttctcttcgaaaacgtcacttgcctgcttgttgcgttctctatcctcttcatctccgttttgcccctcaccatcctttacttctagtttattctttatataaatattctgtgtaaaatcacacaagagacaagtatttattcaaccaaataaaacgaatagtaaccagaaattagaactatatatatggataatggttcagatcaagaacataaaagaagagacatactccaactacaaaagtgaccaagaacataaaagaagatatggatttgaatttatttttctctgtaaatagaatatggatcaaccacaaacagaagatggaattcgagatttaccctatttgtaagtatgagctttggattgatgtgtctctctatgtgtataatctatcttctataagtgagtggagagaggaaaaataggcgagattttgggaagagggtgtgatagagattcttggaaagccctagatttatgatgaaggaggggagagaaagaaagaaagaaaaaaactaagtgtttttgattgataatttgacatcatagccttattcttttttgcattatatattaaatttgccattttctcttatggctacggatagtctatataaacctagacctgcctagtagtacatcacttttatttttagaaattgcattacgtaatttctttcttcttttggtaaaaattctaatgcaaattcaaggccaatctataatagtaataaaatatgtaagtgcaataattgttgacgggggaagaataatctataatgaagtgtgacaaggaaaagaatcatgctatatattatttcgttttcgaatttaattgcataatcagtttttttttaaaatattatatgttactctaaaagcctataaccaataaacccataatttatctaactttgtacaatcgtaagaaaaaatatatatatatatatatatattcgtatcatatttttcttaattttacatgatatttttggtatatctagtctaggtatgggttaattaatttatattgttggagtaaatgcaaacttacatcttaaacataattaagtgaaggagatatatattatgtaggtaatgggggagatcttggcacgtgtccatattaaccgacaacctacagatccggtgtccgtcaaagtgggtttcactagtgccacctgaggacatcaagcatccttgtccgttgccagctcatatcggacaaaataagtagttaggacacaccgtccgatcttcgcttctcttcaaacgtgcaccatccgatcttgttatctattttaagaaattaaaagacttcgacacaaaaatggatacaaatttatttcagtcacttatgtgcatatttaagtctatatatatctgatcaggagatacaatattaacaattgctgttttacttcttataatagtctcttgatttagagaagaagttgaaacaaaactcgttttatattttccacagaagaagcagaactttatgcgataaataaaagaagagaactttaatcgtgtgataaataacccgtccgtacaataaaaatttattataacaacgaccttcgcacaaataaaacagtaacacgtacttgtatatgttttcaatttcacatgtcaatatatgtcatcttcgcctcttgtttgatacgtttcttgtaatttataaccaccaccttctagcttttttactttattcgtttcctcgatttaaatatcttataatctttggcataagcaagtggttatccactattggatgcttttcacaataatacgttacaataacatttgtttattcttacatatcttggaacaggtgtcgcacgctaggagaggaccacatccctttcactaaatgaacgtactaaaatgctttgttaatttgcatttccctacaaaaatatagaaaaaaaaacctacgtgagaatcaatgtaatgatatactataacatcttcccatagttgacgaaaaagcaagtgtaggttagcctaaaaggagtagttatttacatccaattatctaatatccaaaatctatcaatggtcgtcttcatatatttgaatatttctacctatatgtaatttgaaaattcaaaccaaaatattctcttacgtaagctggttcctttatgctatttgtgaagtcactacccaatacaaataaattctgcgtgaaacatctgaactaaaatcttaaaataattccatcgatcttttcttatagataaaacttcaaacgatcttgctatactgctttttcgatgttatatgatctttagcataacgttttaactaatttactattaccgtttatatatgtcataaaagttttattctattataatattatggtacatgagctccgctgataaatatttgattggtctctaaaatccatgattagagtttttattcactaacagttgaaagattcgcctacataagggtaggcgtaacataagggtcaaatgttgaattttatttacacgcttgaatagagccaccaatacgggaccagctttgaccgtcataacaaacccggtttactaaaaccatactaattacggtttcgtcaaaatcaattttgtttctcgtcactcaatgctgcttataaaagccagtcccatgctcacttttcttgcttccttgacacacttcttgagaaatttcagcaaagtgtgtcttctccgatttcgcagacggttagatctcaacaagcgattctcatcgtcgtgaaccttcttcttta

SEQ ID NO: 4078 - DNA, 3000 bp, Unknown
  misc_feature (1)..( 3000): cDNA_ID_1822895_gDNA_ID_1620682_Annot_ID_48367 3000 nt of promoter + ATG
tagatgtgtgattgtgataagtgtaaagaacattaatgattaaagtgtaatgtaaacacaagaatgagaaagatattgaccaagtccaaggcgcgtcgccctcgaggttctacgtctacgtgcatgaaaaatgccatccactttcatcaacatatatagccccatttgacataaacaaatagaactttctgttattagagattgtatctcaatcatcgtttcctggttattcatatttaaatgtattattaatacggtaaacgagcataaatttgactgcgtgttgtaactaaatttgaatcactcagatatcataaacaaatgggacaagaaagagagaaaaattagggcaagcacttttatcttcttctccggtggacccttttagtggccattggtcaataaacatctggccgtttaaaattcataaaccaatattgatttttttttataacaacacttaatagcaacatattttacaattctcattacgactactactcaaatcgaaataatatatgtaagacccataaaatagagaagtcaactctgtttaatcatcaacgtaagtgagcctataatattcttttcatacattattgttatttatttattttgattgattgactaatgactactattcaatattcacaacgaaattgaagtctaaaacaaaattgattcaactattgaagagaagcaaaatttggtatgagttccctttcctcctaaaaacaacaacttttcttttgattgaccattcatttatattacaacaacaatactttttttaaggacccaaatattcacttttttaatctcattgacttcatatgtccacacaactcacaagtcttaccttttctccagacaaaacacagaggaataggagagagagagagaggtagagaaaaagatgaattcacacttcatacaagaagcttcagaagcttgcttcaatggctgctgttcatcaccattctcatcccattccatgtctgagaaaccagaagagctcgagttctcagtaaccacaacaggaacttctttcctgaccagaaacaccaaattcaccagccaagaatctctccctcgtctccgtacatctttctacgatctcatcacagcttttccagattacttgcagacgaatcaagccgatcatctccgttctacagagtaccaaaacctctcatcatcctctcacgtctttggtcaacaacaacccttgttctcttactctcagtttcgagaaatatccgaatcagaatccgatttgaatcattctctcttaaccttgtcttgcaagcaagtaagctctggtaaagaactgttatcattcgaagaagaatctcggtttcagtcaaggataaggaaaagaatcacgagttttatgaatctcgaagaatctgaatatcacatgattctaactcaagaccgttcctctgctttcaagattgtagcagaactttactctttcaaaacaaatcccaatcttctcacagtgtacaactacgaagacgaagcagttgaagaaatgatcagaatctcagagaaaaagggtataaaaccccaatcagccgagttttcatggccgagcactgagattctatcggagaaactgaagaggagaatcactagaagtaagagaagaggtaaaagaggactctttgtgtttccacttcaatctctggtcacaggagcttcgtattcttactcatggatgagtttagctcgcgaaagcgaatggcacgtgttgcttgatacctctgctttaggttctaaagacatggaaactttagggctttctctgttccaaccagatttcctcatctgttcttttacagaggttttaggtcaagatgatccttctggtttcggttgcttgttcgttaagaaatctagctctacagctttgtcagaggaaccaacgaatccggagaatctcacggcagtaaaagcagagccatcttggaaatggaaaacagagtatcaagcaggatataacgagattacccctgtggaccacgaggaccacaaggcagcttctacttctagctctgagatagttgaaatcgaatcatcggttaaacaagataaagcaatgattgagtttcaaggattagatcacgcagattctctaggactaatactaatcagtagaaggtcaaagtcgttgactttatggttactacgagccttgaggactctgcaacatccaggctatcatcaaacagagatgcctctggtcaaactctacggaccaaagacaaaaccaagccgaggaccgtcgatttctttcaacattttcgattggcaaggcgaaaaagtcgatcctttgatggtggagaggcttgcagagagggaaaagattggtttacgatgcgcttatttgcataagtttaggattggaaacaagagaagaagtgatgaagctgtgagcttgagattgtcagtggtgactgttaggttaggagggtttatgacgaattttgaggatgtttttaaggtttgggagtttgtgtcgaggtttttggatgctgattttgttgagaaagagaagtggagaatgaaagctcttgacaaaaacaaatgattggtgttaatttgtgaaccatataatctcaatccgcattggttcagttttttttaccattttcggattttgattcggtttagttcggttagttttacattgtggttcgattttaggcagtagctaaattattctttgctgtaaacctgcttaaacaaaaacgggcctttttcaaaaacataatgggcttttaaaatcatacacgagcccagtggataccgcgaaagaacatctctagagggtttaggattcttcactacgattctgcaaatggtaactacagtctacaagtaaagtgtgaatcaacgaatgagattttgaaattagaagtgactgaaactgtgtaagacctagaaaatgtgcatcttcaattagcgggaactctcaaaatttcgaaatcaatg

SEQ ID NO: 4079 - DNA, 3000 bp, Unknown
  misc_feature (1)..( 3000): cDNA_ID_2993682_gDNA_ID_1620682_Annot_ID_48370 3000 nt of promoter + ATG
aaactgaatttggcatcaagaggtgtagtatcacatattgaagaagatagacaagtttgaatattagcttcacgaaaaagaaaagaaaaaagatagatataagtattatgcaaagttattaaataattttgtttctttttcaatatttttcaatctttcttttctaaatgtaaaacataagtaaatgtttttacatgatttgtctcctttcctagtatagaatctaatctacaatctgaagaagatggtatggcctagtatccctttttggttttggcatacctgaagcgtaatgtcatgtggtgtaatgctttactctaattacccttactctactcttttgttttacaacttagatgactctctagttagataatctaatcttgtaagtggtaaaagtgtgtgtcaaactttgaaagtggatgttcttccactgttgtatcgtttacaactgctgtttttaattaaaagggtaatacttatgagaaaaaaaaagaatctaatctacataatcgtgtgttgctagctcgtccatttactaattgtctgatgggaatatagatgaaaccgaggttatggcatgggatttcacgggagacgtattcttctttcttcacattatttgtcggattgagcatgtgttatgacatgagtaaacgaatcagagcatcttcaagacaattagggtgtgtcactttgaagattttccagacgttcaaatatgatttagaccatacgactaattttattaattttggtcaaaacaaatagaaagatttagtgaaccgtgtctcatgaaagatttgcggttttaataaacgatctttatagcgagcccaacgctctatggtgtggaagctcataacttatgcttgagtttttctcaagttcttaagaagaccaatattgatttatatatcaaaatgaattctataataaatgttttattctctaaaaagtattttcattttgtttttggtccattcatttttgaaaaataatcgtttcaagcatatatacctttctaatcccaacaaatatagacatcaattcatgaccatatggtccatgagtttcttactttcttgttgtcatgtcgtcattcttagacatctcttttattttattataagtggcagaaaagaaagaagaacatctctggttactactcttttttttttttttttacaatttataagaattatatgtgccattggttttcacgtggtcggtcttgtatgcaccagggtgcatgaatgggaaacgtggtcccgtgcggcacgggccgtgcctccattatggcattatgtaaaactaaggatgatgatctataaacctcaaaaatcaagttctcttgtgcatgcaacaagtgtcaaatactttatgtgattttcacacgaactttcctgtccatataaagtagtacgaaatacaagagcaaaactaattatagagcaaaacatacatgtatggcattaatttcacaaccctgaagacatatatgcatatgtgtgtttgagttgatttacattttctcaagaattcacacgtataatattggatttgaattcgaaaaatgatgtgatcaaacgcgtctgacagaataaaatgtgatacaattaacttctctggctcgtataacaacggtcctactccaattaatgtagttactggccagtggtgccgaggtacataattaaataaattcatatatgtaaactatttggtttcataaaccacctttgaaagattttagtgggtcctcaattataaagtttagttgaaaatctcttatttctaaattaggcgagaaaataatacaataatacaacagttttagtaaagtatctcacacagtagcccctattatatcatcacgtggacaatttgctaacgtgaccatccaatgagtaaaacatatcatcactctatacgttcgctttcggctttccaataaatttaggggacctaataagactgtcggaaaccatttgtgttatgtagaactataattaagcatatgtgatatgtttggaagtatacaatagtcagtgtgtaaaaactagttgtaatgatatttttgcagagaccaaaacaatttcgaaccaaactgaactagactttttattacatttgtttacgcaaagaaattaacggtattaaattaaaagaagaaaaataaacaaaatcgtttttaattactgttggtaacttttagtcgatgactttttgtaaactaatgtaattaatgaacagtattaaattaatttaatttttaagtttgaaagttgctatattgtaacacaaaaaatctgaaatggagtcgaggagaataaaaaagattctggaatcaggagattgattcctttctctcccacttttgattttagaaaaatggtgattagctatctgctcatatccatctccgaaaaaattggtgcttctcatttcaaaaccacattatccgctttgactcaccaccaaatcaaccaacgattaccatttttcgaatccaatctttcaaaatgtatttcttctagtgttacggcgatttctgggaatgatcatttaccattttttccgactgaatcgatcggagaattccaatcctatatataccgagcttttgcggttttcgaaggtgcgatttcgaagtttcgtactatttcttatatatcctcaacgtaattgattgacattagtatgattaatgatatgattagtgattgaatcagttcttatttatatatgatatgaaaataactattgtttgatcgctataagatttgttttttggtttattgagcagttcagagatattttgacagttgacaaagtttaggtagggcctgtgtgagtgtgaagatgcaagaagatttttgttggcatttaagaattgtgaggaaatatcaatagcacttatatatgttagtgtgtgttgttgatgatttttttcaaaagtggtgaactttcatattactggtgaatcaaatagttgga

SEQ ID NO: 4080 - DNA, 3000 bp, Unknown
  misc_feature (1)..( 3000): cDNA_ID_1822875_gDNA_ID_1620682_Annot_ID_48372 3000 nt of promoter + ATG
aaacaaatataaataacatgataaaaaaattataatttacgtatttcagagattttatatttatatttttagaaatgattagggtttccaagtcaaattttcgatcaattttctaagttacaacttactgttactttgtatatgaacgaaagagaattgatttccttttggactaaaattgttgtcaagtgtttattatgttttgattatgttttatttatgtgaaatttcagagtattttttcattgtatcttgaatatcaaatatcattaacaaattatgtgaaaattaatttacgtcgacttaaaattaggttaaggtaatcttgacaaggaaaaagggcaaggttatcgaggaatctaatagtgttttggttaaaattaacaaatttttttcattaacacaattgtgttcctaattctcatcacactgtctataacgtattttcctataatcagtattaccgcatatacttaatggttgttcatccatatgcattctagaaacaatatcttcatatgatcaaagtaattaaacaacaatatcttgtgagacaaaagatgtcatatagtcaaaaatgttcaaaaatctataatatccttggcatagaatgaatcaaccccataaagatcctaagtaataggaggaatcctaatagtctaatttattcattctcatgcatgtaactttaactaaacaaacctttgtgtcctgtcgcttgataacttctgtttatatgagattaaccattatccgataagctaagagtaaataaagtactctatactattcaatagcttaatttaatacacttaacgtctatatatgtatatagaacctgtcgtgggatctaagacagtaagacatcaatcatcgtattatcttataaaaaaattacttaaatgctcgtgcttcatttggtatatcttttaagtcttaagtttgcaaacattgaaacaatcatctgtgtggatgctatttggtttggaatatatttaacataaacccaaaaaaggcttacatgccttttgaatcatttgataggattctaatgactttctttagtcttaagccgagttcttaagggcaaaaattcgtttatagattattgtcttgagaacaaaaaaaatccataaccaactttttgtacttcatatcaatgattttgaaagaactctgtaatattcatatcaaatgatatgcataggaacatgaaggaattgtcagacttgttagtcttatggaaagcggcatggtggaaattggaagacattttatcgtttaaatacaattggtttttcaataagtaataaatatcagatactggtgacaaaaaaggtcaaaacatttttaccatattttatttcgttgtattaaattgtgttggtagtaattgggaaaagataagataaaatgacaaaaagaaagctccaaaacactcaaaacaaaccattaatcaataatcatgcagaaaaataaagcacaacataagatgggcttggtcaatggatgagtcttgccaataaaagagataacgttcttttgcctagcaaggctaataatatagagcccaattttgatagctagcccaacagatatcttccactaatttcagcgttataatcaatcattttttgtagtgatcgaacctgttaaagatctagaactgaaagtagtattacttaaataataaaaattacattattcgatttcaaatagcaaatttatttcttttgaaaagtacaattaaatctgaaagacgtgcacacgtggtggtagtgttaatgatgattaggcaaaatctgcatggaagccgcaagaatctctcgtccactttcttatttacaaggtcaactcgaggtctttattccccccgttttgaacccataaacaaagctaactgtttcttatttgtaaacttttagtttttcattttgcagtttatcttaaatttatgacaccattattgacattttatgtggagaccaaaactgtgttttttaaataaaaaaaaaaatcttttcaaacacagcattcaatgatgcacattcaaatccaacatgatttactcggcttcttctctgtcggtttaatttttgaaattccatattgatgatttaaaaagaatatctatgacctaaaaaaaaaaaaactagaactagaaggcataaaaaggtgaaagccgtgagttattattatgaagtaactattaggcaatcatacctttagtcccttggtactaactcgggtttgaaaaagcatctactagttaagaaagcatattgaaaattttgaaatgcatgtgattcttaattaatatttgtcttgttaatacctttatgttgcatgtatttcaataattttgtaattattagacttgtgaaaacattttccccatacggaacacctcataccaaatcgataatgtgtgttatctcaaggatagtaatcaatcatttggattctatttaatctttatgaaactcataataactgatcctcttgtcacgtcgctaccacaccttcttcttcttttttgtctatattttgtattttacttataaacattgatacaattataactttaatttcctatagcttgtatatagtatatatcaatttaactttctcattacttcatttttgttgttgttgtgtatatttattatttagtaatagtctatcctcgcaaattttaaaaattcaataggagtatatgacctctgtcacctattcaaaatccatcgaacctccgaataaaataataattaacaaacgtaattcaaatccaaaagattaaggaactaaatataatatgatcactaattattacagccatatagaaccttcttcttcctaactcttcttatatacgtactaaacgtaacactctctctatatctctatctctcaatatatctcacacatcagacatcactcatatctttagattcacattaatgcttttcaactaaatcctcttcgtttgattctccgatg

SEQ ID NO: 4081 - DNA, 3000 bp, Unknown
  misc_feature (1)..( 3000): cDNA_ID_1822867_gDNA_ID_1620682_Annot_ID_48374 3000 nt of promoter + ATG
tgaagatattattgatcaaaactgatttattttgtctggtacgagtaacttctagaaacaattcataacagagagaactaattatacatacctcctttttgcactccgtcaaagtcatcgcattgtaatcaccatcgaagtaaaccttaatagcaacatcctggtccaaatagattggactagttagttatccatgtgcaactaatactagaatcatccttattttatcttaaattacagaaaactcaccgatccattccaaactccacgatgaaccgcagcaaatgaacctgtgagaaaatgtaacgcatcagaaatacttgtaatctgatttaaacagcaatgacacagatctgaattgaatttgcatatctaaaacgtgaaaacgagtgtaagactttggtaaatgaaatacacctcttccgacctcctccccaagttgtagatcttcccatcgtatctcacatgacgaatcagtaactaatctattattcctttggttgacaggactttgttgcctaccgctgttgactcctagaattggcaagggatcaacactaagacgagtattccaagcatcttctatctcaccatttaggtccgacatttttgttccccgcatgccagacaccaaaccactctctagtcctctgggaggtttactttgtcccaggttcccaatatactgaaagcgatctccattatgtatcaaaccctcagctccatttccatagacatctgaaattctaacttcagccctttttggttttccattgccattgtctctgaaagccgtgcaggtaactgcattagaagccttagaactacctccactgccacatgctgacttattgataccgtttcttaagataggctcattatcttcggttccttggctgccagtaatcttcctttgcagcttccccaaaaacttatccgcctacactagtgtatatgcagatttagcttataacatgagacaataatcgttctaagaaatgtcaatgagaagtgtcttgtttaaggagccaacgaagacttaccagtgagccatacttctcgaaagttgtggaggcaacaaccggaacattttcatctcggctcctcgaattatgatttccattgaaggaatcatctccatttctctgtggtagaagcttcgacgccttcttggtttgtgcagaaaacagcaaaacaaacaatcattcatgttgcacacgaattattatataaaaaaaagtactgagaaacttcgaacattcatgatgtgagatctaccaggtttgaagcaacagctgatgaatattgtgggacaactggaacctgtgatgctgcagcgatctgaggcctcgggaggtgccactgatgttttctcaagtttgattcatgtctattattactacgagcttgttgttgatgctcattacttagtggatgcatcctattgaaaagggttgcatcgctcgagacagtaacaacaccaaccagctcaccgttttcatacacagggcttttagtcaccaaagccataaatagttcaccagttttcttctgaaacggaaactgaccagtccaagtctctccacggcacaccctattcctgataccagtaagggaattacggtattcttcggttacaagcacatcaatagttctgtagccaacaacttcctcagcataccaatggtacagattctcagcagaacgactcctgaataataataaaagaatctctccactcagaaacaaatagtaaatgtccacttgcatatacaatgaatcgctatatataactttgtttaactacttaaacacacaattcaatgaaacagtacttagaagaactataagctcctgatctacaaacaccatagatgaagaagaagaacttatcaagctcaccagaatgtaatttctccagacgcagctgatgttacatgaatcgcgtgtcccattgaatccatcaaagtccgatacgcactatcagcgaaatagaatcctgaaacagctctctcccaagtcgccgtcggattatcccaggaatccgccgcctccgcttccacctctacctcagcctctttctccgtgtccgtctccaatcccgtcgccgattccttaccggttcgactctcctcctgaagcaataagtcatcaacatcctcccttagtctcgcttgactcgtctccatcctctgacaccactccaccaaaacctggtagagactcgattccgagttgtttccggccatcgtaatcgccggtgactctgtttgagcagtcgcatcaagatccgactctgatgaaaattcacaaattaaaaatataatttaaaacgttggcattccctcattgtttattatttttcagctgcttcttaaatcactcgtgacgccataattaacaaaccccagctattataaacactacgacgcattagcttacgccacgtgtgtttgttactaataggatgctgccacttgtagaattgccgatgtaattgaaggttgaagaagattgagagataatagacgaatttgtcacgatttaaaagtggtgattgacgaaattaacctcaatataatacccattcttgttgccgccattgccaaatgggcctgagtttgatggtgtttttatacctccaacggtatttgtcaagaagaaaataaaatacacgtctcttcaatgttcacattcacattcctctaaaagtaatgtgcccaataaactcaaagttcaagttgattgaagaacaataacaataaattatagttgaatttaaatgtaatcaattattagtagtatacttcaaatcattgtagaataatactctccataaggtttcttagaggaagcaaagtttaattggagtcacaaagctagttttgtttcaatttatctaaagatttactttgtttctgggacacaaactgaaagccaacccttttttttggacaaaaacgacaattcttatattacaaacggccgaaagagaacatg

SEQ ID NO: 4082 - DNA, 3000 bp, Unknown
  misc_feature (1)..( 3000): cDNA_ID_1822863_gDNA_ID_1620682_Annot_ID_48375 3000 nt of promoter + ATG
atcagggtcatcgtcatcatcatcatcatcatcctcagacagtgagctaggtgctgcgaatctacacatataaaaacaatttcttgggacattgtctaggaaacacagaagacaaactgatagactacaaaacagaacaaactaaccttccatttgaggctcgggaaccctgctgtactggaatagaaaccatttcagaagcttctctttctgaggatgaagccttccaaccttcactgcgcaacacttctcgctcagctgactgcactgtgacagattttgttacgtcatcaccagtctccattttggaggcctcaatagcagctcgaataatttgttcttctatatcattgtaatgttgcatattattttctgcagaaccaacaggtacagcatgcctactttgtccggttggagcagactgattatcatcatcacttacttcatctataatgaccgcctcttgggcagctggaccgtgagcttgagctgtctcggtcacatcctcaatagtaggagcatcattagattgacctgatggcccattgctgtctttaacctctataggtatctccctggcctcccttggatgactaacaaatgggggacgcgacataacaggatcattatcaaatagacttctcccaaagtttggatcacgaagcgggaacgggtccgttgttctagcttcagagaggactggagtcacaccatcatctatatccattgcatcatatgaattttgatctccatgagtaaagtatgcattcacagctctattgaggttcccacgatactcctgcaataatgatagcatgtaagttttggcaaacacgaggaacaccagccacacacaaaaaaaaaacttacaagttataatgatgctgagacaatagaataatgactaaaagataagaatgcacaaaggacacaataaaaagttctctaaacccaaactaaaattgtacacaagatgagttctgaaaaaaaattcattgacttcaataactaacttaaaccccacatgaatatctctaaaataccaaaaatccagaccaaaatccaaaaaagaacaaaacttttcacaactaatttcacaatgagcaggtataaactcgtttagatatcaatgaacaattaacaaaaccaataagcatgagaattctgtaagaagtccacataaaaactcaatcagataatcggataaactaaaattcaacacaattaactccaattgcgacctaaacgcatcaagatgagcttaacaacgatataacaaaagcgtagaggagatataattcgatgatccaacgaacaaccacttgagcgattcgagaaacttccaaaaatacttcaatcaaaaacaaaataacatctaaacaatagaaggaagacggaaaaaacccagggaagtgtaattgaatcacctcgagcttacgaacggcgacggcattggaagagccggtgatggtcatgaaggtgtcaatagcttcctgagtaggtgtcgccattagaaaagagaaagcttgagagaagtttttcgtcggagatttgtgtttggagctggagtgaaggaggaggcaagaattaatatatgttgtaaatcacaaaaattgcagtgaagaaaggaattggatcggtgactcttaagatttttaaagccttttttagggtctttcttcttttccattttttttaattctccttttttatttggtgtggattttcttaaactttattttctttattctttttgtatattttcggtgatattcaagatattattttcagagaacttgagataatatatggagtgtcctaatctgaataactaaataaataattattcagttgaaattggattttttttttcagagtctttatattttataaactggaattcgagtcaaattcagagtggattaaacttatctttttagtttttactagccaagaactttttgacctttttttttaacatgatattaattgttatagtgtatatacattaaaagttagataatttttaatgtacaaaaaaaaagttacataatttattttttttcacaccaattacatattttatttgtcaatttgacagtaaatatggaaataagccttaaaatgtaaaggcttttcggtccaacaacgaaaaaccaaaaccaaacccaaaactaaaatatccaaagatatcctcactttatgatcatcccaatcttccctctatatagtgcctttaaaggagctgtcatgttctctttcggccgtttgtaatataagaattgtcgtttttgtccaaaaaaaagggttggctttcagtttgtgtcccagaaacaaagtaaatctttagataaattgaaacaaaactagctttgtgactccaattaaactttgcttcctctaagaaaccttatggagagtattattctacaatgatttgaagtatactactaataattgattacatttaaattcaactataatttattgttattgttcttcaatcaacttgaactttgagtttattgggcacattacttttagaggaatgtgaatgtgaacattgaagagacgtgtattttattttcttcttgacaaataccgttggaggtataaaaacaccatcaaactcaggcccatttggcaatggcggcaacaagaatgggtattatattgaggttaatttcgtcaatcaccacttttaaatcgtgacaaattcgtctattatctctcaatcttcttcaaccttcaattacatcggcaattctacaagtggcagcatcctattagtaacaaacacacgtggcgtaagctaatgcgtcgtagtgtttataatagctggggtttgttaattatggcgtcacgagtgatttaagaagcagctgaaaaataataaacaatgagggaatgccaacgttttaaattatatttttaatttgtgaattttcatcagagtcggatcttgatgcgactgctcaaacagagtcaccggcgattacg

SEQ ID NO: 4083 - DNA, 3000 bp, Unknown
  misc_feature (1)..( 3000): cDNA_ID_1822859_gDNA_ID_1620682_Annot_ID_48376 3000 nt of promoter + ATG
agcatcttgaaattgacgcagtcacaaaagcataattaaaaaaaaaaggatacaaagatgggtctattataccgagtatgtattgtgcatgcatgtgacgtgggtgaagggaacttctcttatagaagtattgaaaaaggagaaattttgggggattgaaaatatttgtctgtttgtctggttaggtcagaacaaatcacatcgagctgcatagtaatatttcgtttacaacacatggttgtgacctctagacaaataaactttttaacagttttcgctgttttgccttgcatgtatttcgtagtatttcaatttatatgtaactatatttcaattgaaacatctttaccatattattttcttttttgatgccaatttctttaccatgtgtttgctcttgtgttatttatgtgtgattgattgattgaccgtgtcgattacccaagcggaatcttgtaaagggatactccgtcaccgtaatacagtgacagcatatttaatttaaaataatataaagtcattgtaggatggaaaagtaatttctatgatattttcttccgaacattataaaatttattttgtcagaagtagagcagattaaagtttcgaagatggatactttcacttttttcttgtaagatattgattaggtatgattgaggctcatgatacgaaataatgtcagtgttgaactactaatttgttatgcttgaaatgcttttttataggtcagtaggtttttttattttatttttaggcatatttattctggtttagtttagttagttggtttctaaattttccttacgactaaaaaatctaatcccaaaaccaaacgaaaacaagaaataataaatcgaacaatatttttaataacaaatagaatatatatatatatatatatatatattatatcaaattattccaagatagagtttttcagttcattcctagttcctactcatatattcttaatttctattatctcaagattttatcttgtcctcatatctacgaattgtatgaaagggtttaataaccataatctattgcattgtcctatctacgtacaccataatcgcttgtgttggtggatctatagtaatctaaacaattttttatttccatggcgtgaaagtttgagccaacaactaacgatattaatcgtacaaatgagtttcatatttttttttgcaatctcatttcaaaaagtgaaaccaaaatttggatgcttctaattaaccataagattttttattaggtgcacctaatcttgttaataaattataatcttctttgattagttatgctcctatccagatttcatgcttcaactctatgattgatcaacttgcattattactgtaccataaatactttgccaacgaatgttagttgtgggggaaacaacaattccgctggtaattttgactgaattaaaaaattagagatagaatgcaaggagacacgtacgaacgagttcatacacgagaagcagttgaccagagtcaacaaacctgtaaaaagctaaagaaccaccgtccactcgcagtctactatatacgactaactaagattcatgcaggctcaagtttttgtacttgtatgacacgtggctagatcgtaacggccgtttagactgatgtctcttcgtctctccgagtctttgtcctgtctttttctcattgcatgagacataccgaagattccagtggattaattgtcggtccatttcttttttcctttttactactgacttcgagttagattctctaaagtagtacacgtgaaccataggattcgtttatgattacataaaacctttgttagtagtgtttgttcatttcttaattctggttatacatttgaaacatatgcaaatttatcactcgacttattaatcctaagttcgtaactaagttctttttggttaattagcttatatacttctcaagatttctgattctgacttatgctataaagtatatcttcgataagttgagtcgcatctctctcctcggaaaatattcttgtattttggacaaatttctcgtgtattgttttgatatttttgtggtcatgttgttttgtgaattagtatataagtagataaactacgtagttttcattcgtacaactatataaccaatcgtattcgacgaaataaatagtcagaaaatattctatttgttatgcaataatatctcactatacagtccaaaatattaacctccatataaatctgatagtaacaacaaacaattttttctctttgtcctataacatacataatacatttatgtttgaaagacaagagaagaacaaaaacaagaacccacaaatgtcaaaatagtgaaagaattggattccgacttcgatttcccattacacaaaacgacgtagcaacggacggcgctagctattacgttaagagacgaaaaacggagtagggaccaacaaaaaaacgtgatcatggatggattattaacgatagacattggattacggcgatggacccataaaactgacgtcatccgttatggggtccgtagtgtggtcctctaaaaagtattgacgctttttgtcatctctctgttctttaggactcgtcacaaattttacttcctcagattcacatgaccaaatcatgtaaccattttccaaataaaatctttacatttagatttagattcagaggaattgaattagcctcatcataatgtatgatactacatactacactagtgacacggaaattacacgacgaaaataaacaatgtgaagaataacgaaatttcccgggaaaagagagatagagagtgagacacacgcgcgagtgatgcgtgtggtagtaaatagaacactgtttgatgatactgctgcgactacttaactcttattacaaagctctctttttgttgtctctctcttgctctctctgcaaaactccggcgagaagagaacgttgtcgtttcattcgtatcaaagtcttcatcagca

SEQ ID NO: 4084 - DNA, 3000 bp, Unknown; identical to SEQ ID NO: 3550
  misc_feature (1)..( 3000): cDNA_ID_1822829_gDNA_ID_1620682_Annot_ID_164517 3000 nt of promoter + ATG

SEQ ID NO: 4085 - DNA, 3000 bp, Unknown; identical to SEQ ID NO: 3549
  misc_feature (1)..( 3000): cDNA_ID_1822833_gDNA_ID_1620682_Annot_ID_164516 3000 nt of promoter + ATG

SEQ ID NO: 4086 - DNA, 3000 bp, Unknown
  misc_feature (1)..( 3000): cDNA_ID_3072480_gDNA_ID_1620682_Annot_ID_164511 3000 nt of promoter + ATG
tgattttcattctttcggctgttgaatatgccccggccctcactcttgtagtacaatctttttatcggtacacactgagttacgtcactgtcgatgtcaatatccattatggtggttttaaatcatgagaaagaatcgaggttaatatcagtcgattagtatgaaaatcgaactgatttacaaagataaaagattggaattaaaaaaggctcttgatctattttctagcttgttttctagaaagaagtgaccctggtctatacgacctccttagtcaatccatgcaaatcataacgtccccatctcgatgtctaccaatttaacgtttcctttttaatttgttagatatgcccgttttattttgacttgctcaaactgtatagggccatcacgagctaaactgatgtgacttgggcctggtgagagtcatgaagctccggaatgttgtagctcgatgttacctatataagctttctttatgggccttgaataggccgagttcaaatgtgagaatccaacaccaacagccacttagaacaacttttcaagattgtgtatcatctacctcttcggccatattaagaatatgtgtagttgggcttcggtgagacttatgagttgggcttgccatgacaatcccagatgttacttttctcttaatccctaggaagaaaatcttttggtaacttcaaatcattataagcgcaaatagctagctactatgtctgatgcatttagttactttgtgctgaggattggggtctttaatgtgaaatcgaaagtttagggtttctcgtggatattagaaaacgttaaggttggaatataaaggaaaagattaactgaaagagtctgcatagcacactccagcttaattccgtatcgttttaggatttctgacttcactctttgacggctatatattaatgtgattttccattatgtcaaatgttaattattattttttagataagttttcgtgaaagttgaaacggtgtgacttgtgagtgacgaatgtataggaagaaactgtggaggtgggttccgtttaaggctttggtggtgtggagattagaagtcatggccgccatttttgagtcacgcacgtgtccacctaccttaccttcttataacttattcattcatgtgttcgataaaatatatttgatattaatttaaacatacaacatagaagtgcacaattacaagagttttttttgtttttctatttttgtcgctacaagagtttttagtttttacttacgttacgtatatgcaaacgcaagcaattctgcatctatttgtttttcaatggcagccataattgatatcaaataaataaattactaatgccacatgtttttttagcacagcttcataattcataggagtatcgatatgtaacacaataatggatcttgtagtaaaatttgaatagagtcaattaaaaaaaaaaaaaaagatagagtcaatctgtgcgatataatgaaattagaacgaagctcgaattttaagattttaaattataacaaaactcaaatgtgttataacattcaaaaaaaaaaaaaaaaaaaaacttaacacaataattagtttttctcattttgagaaaaccaaattctcgaaagtatgtgaaaaataccatggaatttgaaggattttgtagattaccaaatagtaaacaaaatttctaaacttgttttactatgattttgtcacgaatacaaaatcaaactcagatagagaaattaggtgatatatagccataattgtgtttactactaaaaatacagttatttctaaaaataaggtaaatgaccaccatggtaccatactattccatgaacaatatagacaaatagccttccattgttataattgggatattgtcaaatccatcccgtatctatatatattattatacacaagtagaacttttgatggtgattcattatctaccattcacatgtttttgtatcattaaattgttgattataaaagcaggatttgattccacctactaagaagtaggaaatataaaaacataacgccaattttcgttcatcagaaccaagatttttttgtcgacacaatcaaaccaaatagataatgatactgttttttatagtagtatatatatttcttttcctatagagtattttatctgaggtcatgtggttggttagtgacacacttttcattattttacgttctaaattaaatatcgtaaagttaaacctcgtttaaagtatactataaagaatagaaatatcattaattcattatacacactataaagttaacctttgtttaaactactaataaactggttatttaaaaaactattagggttaaatttgtgagaaatggaaaagtaagaggcaaaaaacgaaagaatcttttattacaatgattattaattttatcaactttcttttatagacagctcagctccactgatcggctcatgctccactgatcaactttctttcatttttttatcagtttctcatttctctctcagtcgcatataaatttgaaacgccgattcgtttttgctctttaagctttcttcttgatttcgacggtgtctctcaatctccgtcaagcttgacgaatttcaggtgtgatttgcttctcttcttcttcgctttctggacttgtggattttggtttttgattgatttgttctgcttttttttttttggttgaatcttcgctttttctcatgatttttttttggctgttgcatgattttggttttgttagagtcgaatttttgcagatttttgctttgatttgatttttgttgttgttgttgtttctggtttggtgatacacgaattttgatttgttcttccagatgatagttcaattctgtggtagctgctgattctaattatgtgatatatgttattagaattgagaaaaatgcagttatttgtgatttctcatagcttatgatgaattgttataattgcaggagctatatataccatg

SEQ ID NO: 4087 - DNA, 3000 bp, Unknown; identical to SEQ ID NO: 4083
  misc_feature (1)..( 3000): cDNA_ID_3072490_gDNA_ID_1620682_Annot_ID_164505 3000 nt of promoter + ATG

SEQ ID NO: 4088 - DNA, 3000 bp, Unknown; identical to SEQ ID NO: 4082
  misc_feature (1)..( 3000): cDNA_ID_1822863_gDNA_ID_1620682_Annot_ID_164504 3000 nt of promoter + ATG

SEQ ID NO: 4089 - DNA, 3000 bp, Unknown
  misc_feature (1)..( 3000): cDNA_ID_2993682_gDNA_ID_1620682_Annot_ID_164496 3000 nt of promoter + ATG
tatccctttttggttttggcatacctgaagcgtaatgtcatgtggtgtaatgctttactctaattacccttactctactcttttgttttacaacttagatgactctctagttagataatctaatcttgtaagtggtaaaagtgtgtgtcaaactttgaaagtggatgttcttccactgttgtatcgtttacaactgctgtttttaattaaaagggtaatacttatgagaaaaaaaaagaatctaatctacataatcgtgtgttgctagctcgtccatttactaattgtctgatgggaatatagatgaaaccgaggttatggcatgggatttcacgggagacgtattcttctttcttcacattatttgtcggattgagcatgtgttatgacatgagtaaacgaatcagagcatcttcaagacaattagggtgtgtcactttgaagattttccagacgttcaaatatgatttagaccatacgactaattttattaattttggtcaaaacaaatagaaagatttagtgaaccgtgtctcatgaaagatttgcggttttaataaacgatctttatagcgagcccaacgctctatggtgtggaagctcataacttatgcttgagtttttctcaagttcttaagaagaccaatattgatttatatatcaaaatgaattctataataaatgttttattctctaaaaagtattttcattttgtttttggtccattcatttttgaaaaataatcgtttcaagcatatatacctttctaatcccaacaaatatagacatcaattcatgaccatatggtccatgagtttcttactttcttgttgtcatgtcgtcattcttagacatctcttttattttattataagtggcagaaaagaaagaagaacatctctggttactactcttttttttttttttttacaatttataagaattatatgtgccattggttttcacgtggtcggtcttgtatgcaccagggtgcatgaatgggaaacgtggtcccgtgcggcacgggccgtgcctccattatggcattatgtaaaactaaggatgatgatctataaacctcaaaaatcaagttctcttgtgcatgcaacaagtgtcaaatactttatgtgattttcacacgaactttcctgtccatataaagtagtacgaaatacaagagcaaaactaattatagagcaaaacatacatgtatggcattaatttcacaaccctgaagacatatatgcatatgtgtgtttgagttgatttacattttctcaagaattcacacgtataatattggatttgaattcgaaaaatgatgtgatcaaacgcgtctgacagaataaaatgtgatacaattaacttctctggctcgtataacaacggtcctactccaattaatgtagttactggccagtggtgccgaggtacataattaaataaattcatatatgtaaactatttggtttcataaaccacctttgaaagattttagtgggtcctcaattataaagtttagttgaaaatctcttatttctaaattaggcgagaaaataatacaataatacaacagttttagtaaagtatctcacacagtagcccctattatatcatcacgtggacaatttgctaacgtgaccatccaatgagtaaaacatatcatcactctatacgttcgctttcggctttccaataaatttaggggacctaataagactgtcggaaaccatttgtgttatgtagaactataattaagcatatgtgatatgtttggaagtatacaatagtcagtgtgtaaaaactagttgtaatgatatttttgcagagaccaaaacaatttcgaaccaaactgaactagactttttattacatttgtttacgcaaagaaattaacggtattaaattaaaagaagaaaaataaacaaaatcgtttttaattactgttggtaacttttagtcgatgactttttgtaaactaatgtaattaatgaacagtattaaattaatttaatttttaagtttgaaagttgctatattgtaacacaaaaaatctgaaatggagtcgaggagaataaaaaagattctggaatcaggagattgattcctttctctcccacttttgattttagaaaaatggtgattagctatctgctcatatccatctccgaaaaaattggtgcttctcatttcaaaaccacattatccgctttgactcaccaccaaatcaaccaacgattaccatttttcgaatccaatctttcaaaatgtatttcttctagtgttacggcgatttctgggaatgatcatttaccattttttccgactgaatcgatcggagaattccaatcctatatataccgagcttttgcggttttcgaaggtgcgatttcgaagtttcgtactatttcttatatatcctcaacgtaattgattgacattagtatgattaatgatatgattagtgattgaatcagttcttatttatatatgatatgaaaataactattgtttgatcgctataagatttgttttttggtttattgagcagttcagagatattttgacagttgacaaagtttaggtagggcctgtgtgagtgtgaagatgcaagaagatttttgttggcatttaagaattgtgaggaaatatcaatagcacttatatatgttagtgtgtgttgttgatgatttttttcaaaagtggtgaactttcatattactggtgaatcaaatagttggaatggcagatagtagaggaatcatgattataaatgttgttccactattagaccacactgtgctgaatgtattcctttcttgctttgttctttctctaggcacaaggttttgtctgctgaaactgggatgttgaagttattctgctaaccattcttagtgctgtcaagctttggactgtcttcaagagttctaaggactacaggaacctcgagctatgggctctgataaaaattctgctcgttttctacataacctcaag

SEQ ID NO: 4090 - DNA, 3000 bp, Unknown; identical to SEQ ID NO: 4074
  misc_feature (1)..( 3000): cDNA_ID_3072509_gDNA_ID_1620682_Annot_ID_164489 3000 nt of promoter + ATG

SEQ ID NO: 4091 - DNA, 3000 bp, Unknown; identical to SEQ ID NO: 4073
  misc_feature (1)..( 3000): cDNA_ID_1808716_gDNA_ID_1620682_Annot_ID_164487 3000 nt of promoter + ATG

SEQ ID NO: 4092 - DNA, 3000 bp, Unknown; identical to SEQ ID NO: 4071
  misc_feature (1)..( 3000): cDNA_ID_3091511_gDNA_ID_1620682_Annot_ID_164483 3000 nt of promoter + ATG

SEQ ID NO: 4093 - DNA, 3000 bp, Unknown; identical to SEQ ID NO: 4070
  misc_feature (1)..( 3000): cDNA_ID_1809214_gDNA_ID_1620682_Annot_ID_164482 3000 nt of promoter + ATG

SEQ ID NO: 4094 - DNA, 3000 bp, Unknown
  misc_feature (1)..( 3000): cDNA_ID_1822847_gDNA_ID_1620682_Annot_ID_48379 3000 nt of promoter + ATG
aattgaaaaccatgggatcttcttgaattatatctaatctcataatattcttcatgctgcagcaattcttggctggaaaacttccctgtctccctggtgaactgccttcatataatgattgggaaaaccatctgacaacaatattcccagaggttaatcatctgcctcaagagtctttcaatcagcctatgactttcatttccctgtcttatgttgaagtctgacaacgttccataacactaggttcggttgaagagatacttggagatgagaggtgctgatggaggtccctggaggaggctgtgtgccctgccagctttctgggtaactacatctattagcacatatatatttcgtgcttaatgagaatgtttcaaaaagtattgactgttgttttgattttatctacaaatttcaggtgggtttattatatgatgatgatagtctccaagctatcctggatctgacagctgactggactccagcagagagagagatgctaaggaacaaagtaataacaagacgcaccacatttacattttcttattccacagttagaaaacatcttgtaataaactaatacttgatttccaacaggtcccagttactggcttaaagactccttttagggatggtttgttaaagcatgtcgctgaagatgtcctgaaactcgcaaaggtgtgtttgtatgaaccctcttagaaacttcgagccagctttctatcccgtctggtccagcttctaactattggacttattttctctttgtttctcaggatggtttagagcgcagaggctacaaggaagccggtttcttgaacgcagtcgatgaagtggtcagaacaggtaaatgaagtttcctaatgcataattgaattccacaccgacattttgtttgataacctggtggtgaaatttggttttgaaatgacaggagttacgcctgcggagaagctcttggagatgtacaatggagaatggggacaaagcgtagatcccgtgttcgaagagctgctgtactaagaaaatgggacgtgaacaaaaggtgtctataaacctttgggtgtgagtttatgctatctgaagaattcgagtctccggaataaggatttttttttttgttgtaatcggattttaaaaactgattttgttttagaaattcgaagcattgaaaagcagaagaaaaattgtatgtactaaacgatttcggtgtgggaaatcgtttgggagggtgtgtttggatcttgaataaattacccatttttcttgtcacaaatttgtctacatttaacgaaataactcaaaactgatttcaaggcaaaggcgacggatgggataatctaggctgtgtagtggaaagttttgatgtttagtaatttggcaatgtatgtttttttctaaatgggagagcatcttcgatgtagacatttacgagcttttcctttaataggttttggctagtgaagaacactgctttcataattgaatccaccagactccgcgtaaactaaactgattacaacacgatgatcctggccgtcggtaattatcgtaaaacaagaagatagtggcacttaggtgacaggataatatgtaaaccctaccaaggcgtccctacaaaatgatgagtgatgactgatgagagtgagaaaaaccgagtctccacagtccacacactgccttacctaattaatatacccacctttcattcatgtatgttacgtcaacgtttttatgtccgttaaaactgtaatctacataagagatcataatttttaaaatctccatgtatttcgttgatactttaatttggcacgtttctagtttttgagatcaaatgtttttaatctgcttctagtcttatttttcctaaaccttaaactgtaaaccaattgctttttcacataaccttgcttgttttcaattttaaaatttaagtccaatatttgaaacaacctaacaaatgtcgtctatggcaaccaaaaaaaaataaaaaatcaaaacaatttgctaaaaaggaaattgattaaaattgatttctttcatttaaattggaatttaatatattaggtaaacatgtaaacgcaatcgcaatttttatgagagacttcgggccggttcgtttaagtgtcgctgcgactataactagcgactggctttaaaaacgactgagttttgtttgtttttattgttttttttttaagttcgaatatgtcgtatagatctgtaaaataattcaaatgtggctttgtcccatagattggttttgattatgcaatcatctatcacaacagtggaacattatgcaatcatttattgtctatcaaattaattatggttatgaaatatgaaggatcttacatcttaaaaagtgttaattatgatcgcatgccatttagattctttcaaaaattcagtttgaaagtggaaagcgcgccaaaatttgcagaaatcaaaaatccgttaaaaaacgttaccaaaaaaatattttaaaacgggccaaaatatttcaaatgtggattccatagattggttttgattatgcaatcatgtattacaacagtgggttgaaatcacttctcctacctgatcattagcttcaaaagtgccttggctacagtaataggatttttcatgtatatgaaaatattagttcaaatgggagacaatcttttgaattggtatagaggttgtcaggttgatcaatgattcaggggaagagtgatgacaaatactaagaaatgatccaggaggttgtcatccgttttcctattaatagaattggataaaaacttatttgacttctaaatatttattaggttgaacattttctcagatatactatgaaaacagtcaaacaaaggatagtcaaatttgcatccgtgcaaaatatttattgtgtagaaaattagaaagcaactctttaattagtttcttcactagcctaaatatatttccccttctcactgtttctacttttgattgatttacttataaatg

SEQ ID NO: 4095 - DNA, 3000 bp, Unknown; identical to SEQ ID NO: 4086
  misc_feature (1)..( 3000): cDNA_ID_1822843_gDNA_ID_1620682_Annot_ID_48380 3000 nt of promoter + ATG

SEQ ID NO: 4096 - DNA, 3000 bp, Unknown; identical to SEQ ID NO: 3549
  misc_feature (1)..( 3000): cDNA_ID_1822833_gDNA_ID_1620682_Annot_ID_48383 3000 nt of promoter + ATG

SEQ ID NO: 4097 - DNA, 3000 bp, Unknown; identical to SEQ ID NO: 3550
  misc_feature (1)..( 3000): cDNA_ID_1822829_gDNA_ID_1620682_Annot_ID_48384 3000 nt of promoter + ATG

SEQ ID NO: 4098 - DNA, 3000 bp, Unknown
  misc_feature (1)..( 3000): cDNA_ID_1822984_gDNA_ID_1620683_Annot_ID_48388 3000 nt of promoter + ATG
acaaagcaacaataccaattctagaacctattcgttagtgagatcattccaagtaagtgcatatgctaaggacatatatttcagagaaacagcttcaagactcattgtgcagtaaggcgatactagactctctaaactaatacaacaatattttacataatagaaactccaaatcgcttcaatttggccttagacaactaactaaaaaggcatacaaacagaagttaattcaagaatgatataaaaacatacctttttccatttggcaatcagactgcgatctgcatagccctggtccaagcagaattcatagagctctttagatatttcttcccttcggtaataaaggtcatatacataccgactcctctgatgagaaactttgaagattggccataaagtttcacactttctcttaccatcatgtgaatcagtctcagctgcacaaggaacacgatagttagagcaaaatcacgggaaaaagaaacaagcaaaagcatatgttattgagatataacaaaatctttatatgaaactaaccttctctcatcttggcatcaagctctcgaagagtaggctcgatcaactcccatccttctgggtacttgactcggttagttttaacctttggcattttctacacaacgcaaattcacaacgttaaacaaaggaacaaattaagcaaaatgggatactttcaccaaaacgagagattctaagactttcatagttccaaagagattctcaattaagcaattgaaacaacaagcaaggacgcttccggaaaattagggtttctgcgtcaaggctacatccaatacaacgcagagggttgatccaaacataaatccagaacagtctagataaagtttcagtaatagaaggtgaacaattagggtttatcaatctctgtgttttgggatagaaggggaaaatttagggttaagaaccgaaacaaaaggagggtgccgaagcaagattggtatgagacagaaattgaagaagcttacctttggacaggacgagggaagttggagaaggagagatcgcggcgcaggacaaaggaagaagaaccaacgtcgtcgaagaagcctctttagggttgtgttcggaaatcggtataacgagtggtttatcttgggccgctcttacgaataaaaatattcttttactgttatctttaaattggataagacattttaaaaaaattacataaaagtttttctgatgacgaagtttagcacaattttcaggaatcctgtagtgattttgtatttccattttgaatagaagacggatgcttacaaactacaaagtttagtagaacgtggaagtaacaaaacctataggattcaacttggcataaatgcaaatagaaaatccccaaaatattggaactttataacatcaaacatctttagctttcgacattgtctgcaactaagcaattatttggcaagacggaataaacagcttcaagaaaaagaccagtgcaaccttagtctgctactgcatatgggcagtgactgatacattgagaaaccaaaagcatataaaaaagaaggaaaaatcaagaagctgcttattcctttttgccgattccattcgacatgttgtagattcctgttccctgtatttagccaaacgtttcttccatagttagatgatgaacaaagttaaagaaagctgaagcaatattgatgtaagtaacaagttctaaagggtgacattcaacttcaaaccattgtgaacagacacaatcagcaaggaaatgaacaaaccattagtaaaataaggaagaacagacacaaagacaaaacaggatggcgagaacgaatacatggttttgaaaaatcagcaaggaaatgaacttacaatcatgtagagagaacttgcagccaaggcaataggaatagcaacagaagtgatcttgtccattggtcctttcaagtaagtgtgcctttggatgctctggaacaatctctgtttctccagaagcttctctcgtggcctaaatggagtttcagtcaacatgatctgcaattccatagccacacaataaccattatcgttcaagtcatttatatagaagaacatactgattagacaaaccatttgaccaatatatgagataacaacacattttataaacaataacatactgataaaacaaaccatttgataaagtatacgtagtattcaaatcaagacactaaattgacagcgattacattcaaattattcttgttttctgtcgttcatcaaaagggcaatgataaagccacataatcagggctggatctgagtgactgcaaaatatccaattaggatttctacatcgcagagatcaaatcaacgcaattaaaaaactttacggtgaaatcccgattaaattaggtcaaatttcaacaatctaacggaaacaaattaggtttatcattctctgaaatttgagattgacacaaaccttttaaaaaatggacaaaattaacgattaccaacgaaagaacccgattgatgcgaaatcaaaatcgatctacgaggaaaaatctcagaagcttacctgagagaaattaatcgacgagataaggaattttgagagggagagataatcgcagcgtaggtcgatgacgaagaacaacaaaatacaaaaggcgatgaactagtcttcttagggttgggtttatcgaatgttatcaattgggccgggccgaattagatccagggtaaacctattaattccagttatataccaaaccggaacgtaccgtctttaaaatttcaattttgtgttctgaaccggccgttcttcttaacctgttgcgttcttcttcgcctcctctctccctttgcatcgtctccgtctctttctcttatttttttcccgtttaaatctcaaagagaacccagaagcttggtataaaagaggcgggaaatttctcacgtgtgttgcaatagaaagcaaaacccctagtttttttctgggcgaagaagaagatg

SEQ ID NO: 4099 - DNA, 3000 bp, Unknown
  misc_feature (1)..( 3000): cDNA_ID_1822980_gDNA_ID_1620683_Annot_ID_48390 3000 nt of promoter + ATG
ttgacgcagaaaccctaattttccggaagcgtccttgcttgttgtttcaattgcttaattgagaatctctttggaactatgaaagtcttagaatctctcgttttggtgaaagtatcccattttgcttaatttgttcctttgtttaacgttgtgaatttgcgttgtgtagaaaatgccaaaggttaaaactaaccgagtcaagtacccagaaggatgggagttgatcgagcctactcttcgagagcttgatgccaagatgagagaaggttagtttcatataaagattttgttatatctcaataacatatgcttttgcttgtttctttttcccgtgattttgctctaactatcgtgttccttgtgcagctgagactgattcacatgatggtaagagaaagtgtgaaactttatggccaatcttcaaagtttctcatcagaggagtcggtatgtatatgacctttattaccgaagggaagaaatatctaaagagctctatgaattctgcttggaccagggctatgcagatcgcagtctgattgccaaatggaaaaaggtatgtttttatatcattcttgaattaacttctgtttgtatgcctttttagttagttgtctaaggccaaattgaagcgatttggagtttctattatgtaaaatattgttgtattagtttagagagtctagtatcgccttactgcacaatgagtcttgaagctgtttctctgaaatatatgtccttagcatatgcacttacttggaatgatctcactaacgaataggttctagaattggtattgttgctttgtttggtgaagaaataagatttctggtaattatacttcgaacaaagtgcattgcctccacgatttgccaaattttggatagttctaacttctaaccatactcccacatcttaatgatggtcactcatgaatcgtttattaacaaactcctccctgtcaattctgttgcatcttctctttgtaggttatactatccagacatatacctagatttcacttttgttttctttcattgaactaagattttgtcatttatacgtgtctctatactttgtgttaagtaactctaaaaactctctgttttgtgttttgcagtcgggatacgaacgtttatgctgcttgcgctgcatacagccaagagaccacaactatggaacaacatgtgtatgccgtgttcccaaacacttgcgtgaagagaaagtggtcgaatgcgttcactgcggctgtcaaggatgcgcgagtggcgattaaattcaacatagctttattcgctatctctgactgtttgttacaatcttgtcacttgttaaatctggattatgtattattccataaaggctaaaaaccctgactaaaaatctccttgctcttacttatcaactctgggtggtattgcaaataaaaagaacgttccggtttggtatatagttgaaacttgaaagtagaaagacgtttcccggtttggtatcttactgaattaaaagagtgttttactattcccaaaagtgtcaatttctctaaattcgtgagatttgcagcaagtttatcatgacgccgtgagttatgttttggtcaaccggtgatagaacaagatattattgaagcagaaataattattaattcttgtatttatctagacgaaacttgattgcttgatccaaggaaattgttttgacttcaaaattgtattggttctcactacagttgacctgcccctatgtttccatgtggaacaagattcttcgtcttggtcatatggattagtattatttatttctaatcttatcgtgtaatgcatgtatgatgtatgttctaaacaagatgtccaccaaggtccaaaacgagaagagatgcccattacgctcgctctagatgctttgtgaaactcgatggactttcttctctttaaactcacataacatacatacatgatccaaaatccatgatcgttctttttttttttgggttcatttttcatggtttattggaagcacaaaagaaaccaaaaataggatcacagttcttggacatcgtttaatacaaaactagaggaagtaaacattaaaaaaaaaacttgaaaaattaggggaggctaaatcattttcttgacgcgcttgtaataggaggagcaattgtggtaagtggttggtgtgaattagaacccaattatcaactaagtcgagttttgtttaaaaccaataaatttcatatacaagtttgaaactgaacatataactttttctttatatatcataattttgagtataacggatataacattttacttaaatgagaaagtactattgaattatccagaagacgtgatccgatggaaaaattcgtatcacacatgatcttttctttttatggcacaccagattttgtttacatttataattcgatttcatctttttcttagaaaaaatggtcaaagaatgcagctggtgaccaactagtgaccatacaacaagaacaaaatctcatggactctatttaaggtttccataatttaatttaccgtatcacatttccagctaattacacaaaaccgtcgataaataattgtttatagaaagaaataaatacaagaaaaacgtcaaaggatagctactataagtaaggcagactttaggaacccaaaattctgttattaatttacaaaaactaaagagtttttcacttttcagtttctcttcttaccattcactctaaaaaaacagagtctttataaaaccgatctcagattctgaatctgaatcagaatctggatcaacataattttctaacaaaaaaaatggcttcgggtggtggtgacgatgggcttcgtcggcgaggctgttcatgcacaaaagacgatttcttaccggaagaatcgttccaaagcatggggaattacctaaaagcccttaaagaaacaccgagtcggttcatggatcgtattatgactcggtcactagactccgacgagattaacgag

SEQ ID NO: 4100 - DNA, 3000 bp, Unknown
  misc_feature (1)..( 3000): cDNA_ID_1822977_gDNA_ID_1620683_Annot_ID_48391 3000 nt of promoter + ATG
tttttgtcccatgttttgggagtcactagtggttatgagtcctttttttatatatcagttgcataattcacctcaatacaacgaccaataaaatattctgttgatgtacaaagagtcaaccatacgatatgcttttagtaatacttctaaactcaacattaattaaaaatgtagttattgtcttacttgtaaattatttaggttaaaaccaaaaaaaaaaaaactatttaggtttaaaatgtgtaaatgaataagatcagcttctttattacaaaaattactatagaacaaatattgaattttcaactctcgtagcgtgacggaatctctggggtcaactagttgacatctgacttatgagggtcgttcacactatctagtatcaatctactatttatcctccgtttttttccttttaaatttgatagtagctacaatactatcaaatcacaaattaaacaatcgaatgatttgattattatcttagagttgcaaaatatttgttgccatttattagattgttagctacttttaaaattgtatttaaaactttgtaatttcacaattttagtcatggggtctacctagaagacttttacatacagacaaagaaattaagctaaacagatgattacttacgtcaatgaccttatatacgtaagtcccaactatataagtcaagcttgtaaattgcctttattgacagttcaaaagtaaattaatttaatatagtattactactcaaaaatatatttttcattttcgaaataacttgtagtgaaatcccactagagattatgtttgggtcctagaaagtagaaagtggagtcattttcaaaattattttttacttccaagttgtttcgaactcaaattgaatattatcgtaaatagaaactcaaacgcatacattacttcgcccacaattatttgtaaaaacattatgtaatttctttcatatttactatttaatttacataaccattgagtcaatgtttaggcggttcttttgcctacttaagagtggagctcggcgacttcatggccttcatcgccgcgggaaacataatcctcgaatacgttgtcggtggagctgccgtggctcgatcgtggacctcttacttcgccactctcttaaaccataaacctgaagacttccgcatcatagttcacaaactcggcgaagactatagccacttagatccaatagccgtcggcgtttgcgccatcatttgtgttttagctgtcgttggcacaaaaggctcctcaagattcaattacattgcttctataatccacatggtcgtgattctctttgttatcatcgccggatttactaaagccgatgtgaaaaactacagcgatttcactccttacggcgttagaggagtgtttaaatccgccgcggttcttttctttgcctatattggatttgatgcggtttcaacgatggctgaggagacaaagaatccagggagagatattcctattggtcttgttggatcgatggtggttactacggtttgttattgtctcatggcggttacgttgtgtcttatgcagccgtatcaacagattgatccggacgcgccattctcggttgcgttttctgccgttggatgggattgggctaagtacattgtcgcctttggggctcttaaaggtatgccaaagattttggccttcattatttatttgcgtttgcgtttacatttagtatagtctaaaatctatactaatctttgaaatgtttaggtatgacgacggttttgttagttggggccattggtcaagctaggtacatgacacacatagcccgagcccatatgatgcctccatggctagctcaagtcaacgcaaagaccggaacaccaattaacgcgaccgtggtaatgcttgccgcgacagctctcatagcattcttcacaaaactgaaaattttagccgatctcttgtctgtttccacacttttcatcttcatgttcgttgctgtggctcttctcgttagaagatattacgtcaccggagaaacatcgacccgtgaccgtaacaagtttttagtgttcttaggtttgattcttgcgtcctctaccgcgactgctgtttattgggctttggaagaagaaggttggattgggtattgcattacggttcctatatggtttctgtctacggttgccatgaagtttcttgtaccgcaagctagggctccgaaaatttggggtgttcctttggttccgtggttgccttctgcttccatcgctattaatatcttccttcttggttccatcgatacaaaatcgttcgttaggtttgcaatctggacaggtattctgctcatatattacgtcttgtttgggttgcacgcaacgtatgatacagctaaggcgacgttgaaggagaagcaggcattgcagaaagctgaggaaggtggtgttgttgctgataattcttgttctgcaacttaagctcactagttggttttaatatattgttaaagtgtttggctttggattcgggtttattaatagttgtcagattcttcgtttggttaattagtgttctgatctcaagaattgtaatgtctttggtttgtttagattttcaatatgttaatagattttcttcacatttgcatcaaacatgataattaaggtctggtttaatccttctcaagtaaaatagatgtgtgacaaaagtatgtcgtatttgaaaccaaaaatcaacttattcgagttaccaacgttttaatttatgaattcacaagatacttttttccatttaatttgtttatgagtaagttgattaatttgtgggttaggcccatcatgaagtaaacctattaacctagtattgtttgcggggaaagttagggcaatttgtggatttcttatttaagacagaacaaagaagaaaacaaactctgtatttttttctccatcgccagtaaaccctgcgttctctctcgctcgcttgtgtgtgatagagagggagagaaga

SEQ ID NO: 4101 - DNA, 3000 bp, Unknown
  misc_feature (1)..( 3000): cDNA_ID_1822967_gDNA_ID_1620683_Annot_ID_48394 3000 nt of promoter + ATG
aagtcagtggattcatctgtaattaataaccaggtaaataatgtatctcttactgtttgagcttgcaatagaaatgttccttattctctgcattaggccggtttacatttttccattacatttttggggtacaggagcttaagtttgacgctgacagtgcaacgtacttcctggactcctttcccaagaactttgacattggaaaatatacttttgtatttaaggtattgcacttctttggttttactacacccaagacttcatataaatgtatgatgacaacatgataagcttcgttttctgcagattgtgctggatgaatcagcacatgagaaagtatacataactgaagctcaaacaaaagtgcctatagctgccacaggagctattagcattgaaaatgcagaaattgctgtacttgacagtgacattggaagcgttgaatctcagaaaaagtatgtcacctgtattgttgatgaacaacttccttttttgcttattttgattgattgctaattgcttaaccatttttcttaggaaacttgtaccattattgcttacaatatatatttcaaactttttgttgttgtgcttagtgtcttctttttgtttattggttctctctgtaacatttgtaggctagatttaactaaagatggagcggtatcattatcagcaaaccaccttcaaaagctacgcctgtcattccagttaactactccacttggcaatgcgtttaagccacaccaggtttgttcattcttgatttttcgcttcatcaatggttatattctgttctattcactttcttgacttgcttacttccatgcaggcatttttcaagctgaaacatgagtcacaggtcgagcatatctttctcgtgaaaacttctggaaagaagtctgaattagttctagttaagttccttcaacttcatttaaaattgcttttgcaaaaaaagtttaatgatcaagtttggtgaaattaatgacgtcctaaatacaatattaatggttaatgttattttcttaccttcaggattttcttggattggttgagaagctctactacctctctggtaaatatgagatacagctaaccattggagatgcttctatggtaagtactttactttcaggtccaatgcagttgatgatttatgtcttctgagatttgaacagtgttattttcctttctcttttcccaggagaactctttactgagtaatattggtcacattgaactagacctaccagagcgtccagagaaggcgactcgtcctcctctacagtctactgagccttactcaagatatgggccaaaagctgaaatatcacacatattcaggattcctgaaaagcttccagcaaagcagctctcactagttttcttgggtgttatcgttctcccattcatcggtttcctgattggggtcagtctccctttgcttgtaaatagtatccgaaaaacatcatcacatttctttcactactcatatatattttttatgtttcagcttacgcggttgggagtgaacataaagagcttcccatcgtcgactggatctgcaatatccgctttacttttccactgcggaattggagctgttttgcttctatatgtgctattctggttgaaggcaagttttcataaccgattattgtttgtttgatctacagttgaatcattgcatcaaatcacaatttctttgttttgtttgtttgcattctacagttgaatcattgcatcaaatcacaatttctttgttttgtttgtttgcattctacagttggatctattcacgactctcaaggcactttctttgttgggagtgtttctgttgttcgtgggacacagaacactatctcaacttgcatcagcatcaaacaagttgaaatctgcttgaagaagaagaactcactatgaaggatctttttttggtttatgcgtattttcagttttgtagtattgcttatagattatggtgatagacaaattcaaaagaagttcagagtttacatactctctcagtttagtcttaaaaagtaatcaagagtctctttccttagcttttttgttgaaccaaatcaactaagataatgattagctcatgattagatcacatgagtttcttaattattcacactttatgagtgtttgtggaaagttaaaaggtctaacaaaattttgaaataggctggccataaaatcgaaatgaaattttatatataaaatcaaaccgaatttcattctagtcaaaatagaaataaatgctgataaaaatgtagaaattactttgggtagaaacgagtcaacgaaggaaatgtatttggtatttgacccttaacatggcaatggcaacgttacaacttttttttttttttttttttcttgcatcgttacaacttcacaaaactttacagttgattggaaaattaaattttagaagaaaaagcacgtagttgtcttttcagacaattatttgttcatcttgaatttgtgtcccaagaacatatctctctctctctctctcctcaccttggtaagaacgtccaatccaatctataaatctccttgatggaatttccgtacatattacttgttcctttctgatctcttcttcatcggttttatgtttcatcgagtttgaatatttctttgtaagtcttttcctgtcggttatgttttcgtcgttgaaatggtttcaggaattaacaaagatcagatttttggcctttttttctcttctaaatttgaatttcgattttgggaacacgaatcgatgatgctgatgatctacaaatgggtattgaaaacgatttgttcatggttattctgcggtcgtggtttccccaaaaaagtttggtttttaaatttgcaaagcagagtttgatctctcatttaacaataccatgttctaaccatattgtgcgtgatgggtgatttctttggtctgtgaaggattctctgtttgatgattgctagttctttagaagagca

SEQ ID NO: 4102 - DNA, 3000 bp, Unknown
  misc_feature (1)..( 3000): cDNA_ID_1822925_gDNA_ID_1620683_Annot_ID_164552 3000 nt of promoter + ATG
taactccaaaacagagcatcttgaagtaaaatgccaaagcttgattcaacaaaccatttcgaacaaaactgctgataatcgaattccatggcctgatgctactacgccttaaatctagtctgtaaaacattttaccacaatctgaaaagctaccacacattgcatacatccccaagatcctctcatcggtatagctatcaccggaaatgctgtttacgattagaaaggcgtgaacttgcttaccttgtcgaagaagatttgggttagagcaagcttgtagaagtaaactaagtcgacgagggatagtttcttcgagaaatcgagacgaatttctcaatggaagggattttttgtacggagcgattgctggcgcgaagcgcttagcgactgaggagatactcatagtctttttggtgaaatagagaaatgagaagcaaacattcaaagattagttgatctcttcaccggggactcactaagtcagcgagttgccgacgacggcgacggagaagtaaccgggaaaatggcgcggggaattagggcagacgaagactacaaacacacgtgcaaaacataaacatgggcctctttgagtatttaggcccaatttaagtaaaatcgctgccacatcaaaccaagcttggtttaagtattggttgttttcggttagtctattttctttttgattcggttttgaaccttgtttcaccatggtggagatctccaatataattttttacttaattttcataattcgtattttatgagaatggaattcaatatagtgtagaagtattaaaataaaccaatgagcttccacgaatagatccatttagtttgtctaaagtaaacaatgttagcttaaaccctgaaatagatggaaagttttgttgtaacttgtaagacactagattaaaaatgtacaattttgattttcaacagagttatttaatactattggacaatctatagtgaaattaaagctagaaatgttttattcaaattcaattcgttattttgtagtttcaatgaaagagttgatccattttataattcaccctaatactttggtgttgtcatttataaatgaaactgaattaagaactgtacgaatagactttatgttgttgtttgctaaatcaccatgcaaacaaagctaacgcatactcaagaaattgccattacttggtgaaaacgtgaaacataaattcagattcacgaatttgagtctaaagtactcaagaacaaaaaccaagaataataatttacaagaaaaatgcagaaattaaaatgcttaaccaagcttggcaagaacttcgttcaaagcagagactgtctcagcatagtacttctcagcctgcgaaggactcttcttcttcgccgcataatccagctgccggagaatcaatcataaacaaactttcgatcagacaaacaagaaacattacaaaatcttgatagatggtgatcgaagttagatgagaaacttacattgtcgatggtatcgaagagcttggtggtgagatccttgagtgacttcttctcatccttgggtttggaggaaatgattgtgttaagatcataacgaagataagaagccttggaacgaagatcgttttgaacatatggccaagctttcctgtcgatcaatggcttcacatttatgatatcctttgcagattctttggctctagctgcagcttctgttggtggcaatggctgtaagtaaaacctgtctttcaatgccaatgcaaagtctcttgcttggtctgagttatctgtcccagctgctcaccaaacaaaacaaattgttgtcacctcataaaacataaaacaatgtgtaagtgttatatatctaccgtcgtatgtcatatagagatcgagttaagtgtgtttataccagaaaaatcgatataagaactaactcgaacacatgtttgcttgcttattatgaactctaacccaaatccgaatgaaacattcatacacatgcttgattattatggagtctcttatattcttatacaaaaacatccacatttaaagactacattttatggttttttcatctacataacttaaatcacgtttaaattcctaatctcattaacaatgagaatgaatatcatattggaagattagtttgttagttaacttacgaaggccaccggaaggagctggaggagggccaactttgatcgaaatagcatcggcgaggacagcctgaacaaacgagccaccagctaaaccagcagcaacaagcccaatcacggaccggcgagaagtctcctcactctgctgagctctgacgacaagtctagacctttgagccaccgccactcttccagagccattcagacggctggagccattgatctttaagcttccttcaagaaccgccggagatgcaccgtgtaatccacccatcgaagccattttgtttttctttctcaagacgaaaattgaagccgatgattattggttatgcttatatgattggttggtttcattctccgacacagagcgccttatctgtactttagataacttggatatggttgtagccactcatataaaaccacgtgtcatttttgtccgccttaaagccacgtggcaagattatttaaacatttgggccgaattgtaggcccaaagttagcccatatgtttaaatactttattgattgataacgttatgataattccagaagtccgccacatctaatttcaaaatcgttcgaatttcgaaactacaggctcctgcttcagtcacacacttacacacacacaaaaatccccaaattaggaaaaagtaagaatcctagtttctcgacttcgattgagaaggttttcgatttgattctctaagatcttgagaatcaatcggagattttattgtcggtaacccgaatttagggagaagactaccattttgggatttttatgcacttgacgagcgaaaggagaagaaatttgtagcaattttgagtctcggagatg

SEQ ID NO: 4103 - DNA, 3000 bp, Unknown
  misc_feature (1)..( 3000): cDNA_ID_1822947_gDNA_ID_1620683_Annot_ID_164546 3000 nt of promoter + ATG
aatattctgcattagctgcgccgcggaatgatttttttatgaaacaaacctttttattgttatatatccaaacaatcatcattttttagtagttgttgtcagattttttcaatagaaaatgggatttagaccaactgatgattttggtcggtttttgtcgggagaaataatcgaaaaccattaaccaactcatggttccgaaaaaaaaaacccatcaaccaactcattagaagacataagttgcttttcaaaacaatatataaacattatactacgagtctgcgaacgtttatatctgaaaactttcaaacaattaacacgcctatacataactggaatcaaactaaccattttacatttacaatatcttagttatatctcttttttttttgtccaaaagagattatgtatcataacttttttcatatgtgtgttcaattaagaatttttgaataacctttaccaaaaaaaaagaaaagaattttctcaaataaaattttagtttactcagaacctctaaaaacaagctaggtacgatctagaaacatatagtacacactatttgtgtataatacataactacagtactatatggtgagaaaagaaaggaagagtcacgagaaaactgtctgtttggcaaatgagggataatggaagggaagaagaagtactcggacatgccaggctagctagctatatataaatacacacgtatataaattatcttgtgatcagtgtgtactaatgtgtgctggaatctgtacacattcttatatgtacatatgtatttgcatgcatgtggttgtcttacacatctttatgcattgtttcagcttctgtgcgtgtttgtgtatgtgtgaccacataccgttgttacttttcatagttggcgttctcttgataagtcactgttagtgtggcaatttgacaataaaatctaaaatgttattaattataacaccccaattcaatatatatatatatacacatataagaaaatgtatgtggaaagttcaaactataatccatgagataatagaaatatagatccgaattttattatggttttacagtgatctaatatattgtagacaaaaatggtttagaaaacacttgaatgcaaatgcctaaaaaggctaaaacacatgcatcaccgatcattttgctaaaatttcagttgaaaataagatgcaatactttatttttaaaaaataaaattagagatgaattttttttgtattaattttttttaataacttttgatccttaatctctttgaaaaaaacaaaacaaaacaaaacatgtataatccctttattaccgtctggtatttatatattagactgaccggattgtggtatagtcttccaaatgtccaatactttctagaccgagctaatccaaccggatgataaagtgaatagagttcatcattcaaatgtcaaatgaactatagtctatatacatagatgcatgcatataaagagtatccaaaaagagaaataatatagaagactcaaaattggaaaaagggtcccatgttcctaacaggtaggagatatctctatcatagagaaacaatggatcgtacacgtacacgtacatctcctctcaacctgattcatacccatttttccttctctactcgtccttgatttagtctcttgggacccttctccattatatctcacatgtctctcaaacttcctgccatttcacctccttacatgtcaatttgcttcgatcaccttaattatattatgggcatgttataatgttcttatcttctaatttgtttcacagctcaacaatggagaaatttgcttcggaatcagaggcattagcatatatgttggcagaggttcttgcagaaaaatctggacaaaattcaagtttcttcaaagaaaactgtgtgagaaatacatgttatctaaggatgaaccgatatccaccttgtcccaaaccatcggaggtgtacggattaatgccacacacggacagtgatttcctcacaatcttgtatcaagatcaagtcggaggactccaacttatcaaagacaatagatggatcgctgttaaacctaatcctaaagctctcattatcaatattggtgacttatttcaggtaattgagcttttattatgtcattctaccattaccattatatcattatccggagcttacaaattagtttggtattttatgttttgatatggtttggaaggatttaaacaatttgttcatacgcatgcatgatcaataattaaaaatgtggatttcttataaagataacatctaaggcaatgtattaaaaatgtctttaaattactagattgtacttatatatgtgtttggttaggcatggagcaatggcatgtacaaaagtgttgaacaccgtgtgatgacgaacccaaaggtggagagattctcaacggcttattttatgtgtccatcatacgacgccgttatagagtgttcaagtgatcgtcctgcttatagaaatttcagcttcagagaattcagacaacaagttcaagaagatgttaagaagtttggttttaaagttggccttcctaggttccttaatcacgtctactaatttatacacccaaatttttatttttcctttataatttattttaggttttatgatttatttgaattgtttttggtttgattttttccatataatttatttttcatgtttttccttaagaaatatattgttcctcattatcaaatttaattaaaatcgattagaaaaccaattttaagttacagaggaaaaaactgaactttattaattttgaattgtacattgcaaaaaaaaaaaaaaaactcaatccgataaaaagagaaaaaaaaactaatgaaaaatatttggcatttggttttattttatgttataaaaaaatgtcagaagatattagacgaagggtcacgataaataattagaaacaaaaagaattaaaaaaaaaaaaaaaaaaaagaataaagaa

SEQ ID NO: 4104 - DNA, 3000 bp, Unknown
  misc_feature (1)..( 3000): cDNA_ID_1822951_gDNA_ID_1620683_Annot_ID_164545 3000 nt of
ataacgatgtttctgaaataccctttagcttctcagtcacagccgtcgtcgaggaggtggagcttcctgtgattgacgtcagccgtttgattgatggagccgaggaggagagagagaaatgtaaggaagcgattgcgagagcttcgagggagtggggattttttcaagtgataaaccatggaatatcaatggatgtgttggagaagatgagacaagagcaaattagggtctttagagagccttttgacaagaaaagtaagtcggagaaattttccgccgggagttaccggtggggaacgccgtcagccacttctatccggcagctttcttggtcagaagcttttcatgttcccatgacagatatttctgacaacaaggactttactactctcaggtacacaaatattgttatcaattacatttttttagaattaatttacttattaaacttaattatttgaaaaaatatgtggagaattatcccaataacaagatgtaaattaaaatacaactttacctttcttttggttaagttaccttctaaacaactagtgttttgaggattagtaagtaaattttaatgacatatataatgatacaactatagtattaattaatatcaagtttttgactataagtaacactatttgcaaagaaaattaattaattagtcaaagattagacatgggagacaaacacagtttttaattcagtatatggtggttttgaagcatataatagagtgttgtcatttatatttaattaataatagttttggatattttagaaatttaatcctagaaaataaagttgttgggcattgggtcaaagatttattccccatatctcatgcgtttctatgttttccatttttaatactatttttgaatacgtctaattttgggatagcaagttggcatgtgaaatacaatgaataaataaacaatattaagacttttcaaacaaaaataaaatattatgtatttggaaaatatataagaaataaatcttaacgtagattttttttgtttgttaaagaacaatcttaagatagttaattaaactctagctaactttttttaagatacctctaatgttgttatttattctttgattcttcgtattcgtaggaacttcgtcaacttcaaattctttaacatgctagaaaatataatggacttcttagaattaatattctgcattagctgcgccgcggaatgatttttttatgaaacaaacctttttattgttatatatccaaacaatcatcattttttagtagttgttgtcagattttttcaatagaaaatgggatttagaccaactgatgattttggtcggtttttgtcgggagaaataatcgaaaaccattaaccaactcatggttccgaaaaaaaaaacccatcaaccaactcattagaagacataagttgcttttcaaaacaatatataaacattatactacgagtctgcgaacgtttatatctgaaaactttcaaacaattaacacgcctatacataactggaatcaaactaaccattttacatttacaatatcttagttatatctcttttttttttgtccaaaagagattatgtatcataacttttttcatatgtgtgttcaattaagaatttttgaataacctttaccaaaaaaaaagaaaagaattttctcaaataaaattttagtttactcagaacctctaaaaacaagctaggtacgatctagaaacatatagtacacactatttgtgtataatacataactacagtactatatggtgagaaaagaaaggaagagtcacgagaaaactgtctgtttggcaaatgagggataatggaagggaagaagaagtactcggacatgccaggctagctagctatatataaatacacacgtatataaattatcttgtgatcagtgtgtactaatgtgtgctggaatctgtacacattcttatatgtacatatgtatttgcatgcatgtggttgtcttacacatctttatgcattgtttcagcttctgtgcgtgtttgtgtatgtgtgaccacataccgttgttacttttcatagttggcgttctcttgataagtcactgttagtgtggcaatttgacaataaaatctaaaatgttattaattataacaccccaattcaatatatatatatatacacatataagaaaatgtatgtggaaagttcaaactataatccatgagataatagaaatatagatccgaattttattatggttttacagtgatctaatatattgtagacaaaaatggtttagaaaacacttgaatgcaaatgcctaaaaaggctaaaacacatgcatcaccgatcattttgctaaaatttcagttgaaaataagatgcaatactttatttttaaaaaataaaattagagatgaattttttttgtattaattttttttaataacttttgatccttaatctctttgaaaaaaacaaaacaaaacaaaacatgtataatccctttattaccgtctggtatttatatattagactgaccggattgtggtatagtcttccaaatgtccaatactttctagaccgagctaatccaaccggatgataaagtgaatagagttcatcattcaaatgtcaaatgaactatagtctatatacatagatgcatgcatataaagagtatccaaaaagagaaataatatagaagactcaaaattggaaaaagggtcccatgttcctaacaggtaggagatatctctatcatagagaaacaatggatcgtacacgtacacgtacatctcctctcaacctgattcatacccatttttccttctctactcgtccttgatttagtctcttgggacccttctccattatatctcacatgtctctcaaacttcctgccatttcacctccttacatgtcaatttgcttcgatcaccttaattatattatgggcatgttataatgttcttatcttctaatttgtttcacagctcaaca

SEQ ID NO: 4105 - DNA, 3000 bp, Unknown
  misc_feature (1)..( 3000): cDNA_ID_3072550_gDNA_ID_1620683_Annot_ID_164544 3000 nt of promoter + ATG
aataaatgaaagaaaaaagaaacataacattattaattggaggcctactggagaagtcgcgagatcgaaacaggatggcccactattgagtattgactctctagagttgtcaattgaaataagttttttttttttcctttttggtgtcgacaaaaccaattaaaataatttcaagtggtccttctcaaaattttgggtaatttgactatgttagaaaattaaaattaatacaacatttgcattaaaaaggaaatgcggcagtttgaactacaatttgcagtatttataaaactaagaaaattttgtaattcgttgattcattgtatatatatactatatagtcttgttcagtcaaacaaaaagtttattcgttgacaaaaaagaagtgatctaaagattctgattagttatatatgttactgttgaaatagttaatttcttggattaagtttattattagatttatatagtattagctcaagatttgtagataatataagtttgagttaattcatataatatatgaactcagctaagctagctcatgagatttttaacaaaaaaaaaaaaagctagctcatgagatatacactaataaattgagtttaggtgagcgaatttggtcattctaacacccttctcttgaagcaatgtataattacacagaatagtgtttgtgaagtagctctatacgtcatactacacgtattatagaaaaaaactcacaaaaagatattgtaggattaagataaagcgagagaaagaacccagaaaaactaaagtcatataaagtaattatactgaatatgatctgtggactaatcggcaaagtgccttcctaggcttagctagttaaatcatcactttcttgaatcactattttctttagttatccacgtctaagaaaaaagcgtcggtaatcccttaggcacgtttccttttgggaatggatgcaagcagcaaattgctcaaagatctttatttatttttatgacaggaagattctgcataaaaacctgaaatgattttcaaagtctataaaatttctaatattattaccatttaaaagtatatgttagactcaagttgccaaaaaaaaaaaaaaaaaaaaacgttaaagacataaaatatgagaatgaagtgttgttggtgctaaataaataggaaacaaaaaaaaaaaaaaacgagttgaggaaatgcatgcattggaataaatattcattggatgataacttcaatattatatttttggtagagttttaaaagtatatttcattataacaatttaaataattttttaaacatatgcatgacggatgttttccctatatatatatatatatatatatatatatatatatatatatattctttttaataactaattcatacgtataagaaaaaaaaacaagtgaaacatattccatattgtgtcacaactcacaacatttggagctgagccagacttaacatgttgatgttccgttcacgatcttatctcttttaccttcttttcgtgaagttgaaaacaaagcaacattttttttttgttaaggaacaaagcaacatttggataaaatgttactagcaaagcaatatttataagaattctgtaacgctttgagttatccattaccattagtaaatttacacttattttagtagagaattacaatgggtcggtatgcatcctatctttatcaaagttaatgcaattaaatttgattttttttagtattaccaccatgtttgtataattcgaagtactacgtacatgcatgcattcactgcatttgtcaaagacacagacgcaaaaaaaaaaaatgtaaacggtttcaacttttgaatgttgtttggtttcgggtttgtatatatatatatatagatgggttactatttactaaatatggtaaaaagctcatgctttcgttggtgtacaacaaataataaactaattacctcagtgaaataatacacatataatataaataaataattatgtaaacatcgacagtgcatataatgagaaagcaaagtaaaagtcgtcgtggttctttttcttggaccccaagcttctcttgcttccataagttctcttattttactaccgcttttaaactaatacgtaccaaacaatgcaacataatgtttcttttattattgggtcttatccagcgaaggaaaaggtactgattagtctgattattaataattgattacaataataaagctaaatatatactgtatattattatagtagtaataacagtacaacatagaagcaagtgaaaaacatgagaaacgaaggacggtgtccagacaagcaaatattcaaacctttgaaaatgaaacaacatcatgttctccaagacagccccaacttaatttattctaataataccaaattcattaatccccattatcgtatcttgtccaccatagatatacaaatatacacattacccatatcgcatttttctaaaatctttttgtatttaatttctacatctgttacaaatatttgacaggtgaattttgatcttagagaatcaaataaaaaaataacattacgatcttaagagtacaaatactttgattagtaaactatcccatttccaactactaattagttgctactcttatttttaacccccccatatacttatttagacgttgcaaaagaatgtgatgaatatacaaatgatgactactcattaaattgtactcccaattaatggtgagtaattaacaatgtcgatgggcggcaaacaatatattttttctttcaaatatttgttttttttttaattgtcaacatggtatgctaaaaatcaaaatgttaacaaattgcactcgtatgtaaatgcatatgcatataggtggacgtgtatataaatgtaagaaatgtgtctctcctcacaacacgtattttgataaccttcacttcccataattctctctaactcatcactctttttcttcttctgcatagatcttctc

SEQ ID NO: 4106 - DNA, 3000 bp, Unknown
  misc_feature (1)..( 3000): cDNA_ID_3072552_gDNA_ID_1620683_Annot_ID_164543 3000 nt of promoter + ATG
aaggcgaagaaggcattcaagaaggcgatattatgacagttcaagcttggatcactctgaaacgtcccaatggactcataggcgctattcctcactcaccttactttcctttccacaaagaggaaaacttttgggttcttcttgcggattcaaaccatgtctggttctttcagaaggttaaattcatggatgaagctggagctatagccgctgcatcaaacactattactgaaacaatggaacctttaggagcaagcgtcaaggaaacaaatgatgcagttaaagaagctgttgagaaggttaaaagtgggtcaagattggtaatggggagactcttagcacctggagaaggtacttataacttgacttgcttctgcctaagcgatacttggatcggttgtgaccaaaagacatcactgaaagtcgaggttttgaaaagaacccgtgatgtggagggtgagaatgcagaagaaggattagaggaagaggatgatgagattgaagaggaggattacgaaagcgaatacagtgaggacgaggaagataagaagagagggtcaaagaagaaagtaaacaaggaatcgagttctgaagagtcaggatcagatgaagagtaaaagaacaaaaagtagttaacgttgatctgaaattattgtctgaaattatacaataatttttgttttcagagcttacacagtcgtactaaaagattttacagtatttaatctttttgctgagtttaatactctttttagttgactcttcaaatctataccttgttttgactcttaagctcagatagttcaaaacttttctggtcatgttttcgtcagaaacccaagctcagccccagaaagcttctttgaagaaccttggccgtctatctattttccttatagatgattcaacggtagatacgatctcaaaagctcatgaagagtccaaatgatcaagactgggttctctagaagtaatctgtccttgacttccacccaaaagttctttttcatcttcttcctcttcactgagatcctcaccatcttcttcttcactctcaatctcattgtcaatcttatcttcgtcgctgcttaaaccaccttcaccttcgcttagctcattcagctgctttgccttgaccttaacacgtcttcctttgatgtatctaaactcccactgtggtggaggatatttcttcatcagtttctcgtacttatccttcatctctagtttcacaaacacttttccaaccatagacacaatcgcaacattcggtttcactccaagctcctccatgtcagcaaagacctaagaaaacactcaatagtttcatacatcaacttctctgatagaatctctgccagttgcaaatacttagtaagaaagattttttaagtgtacctcgaagagcttttggtgcatatctctcttgtaatatatagagatcattttgttgaagaactttctaggagttccttctaaatgttccatgaacaatttgttccacaattcctcagcttcgtcaaggcgattatcttctgctaaagcatttagtaatgagaagtaagttcccattgttcttccttggcctttactcagcatccattttgtcacctaacaaaatccataaacattattctacattcatctaactaaaaaaagaaacacagctcttactgcttaataaacaagcatacctgaataatcttcttccattctttttcatcttcaagtataactaatgccttcttaactataacaagagggaactctaattcccaagcaatgaaggaatcaagcgctccataaacttcttctttaacattcgacaatccttttatctgcagattaacaatactcactaactctaaaagagattgcagaacacaaaaacatatgaagagagcattacacaagcaatcattttggcagctttagagatagttccaatcctcttccttgttttccatacacgaggagaccgaggtcttggacctctcgccgcacaaacctgaaagattattgaattcgaagacaacatgtgaaattttgaaaccaagagactgtcgaaatgtttagttaaagaaggtataagaaacataaatacgaaccacaacattgttaggctttttggtgaagagcttagttgatgattcccttgtttgaagaagaagataaggtaatgaatatctcaagcttagcatcctgaaaaaaatcaattcagagaagaagaagaagaagaagaagaagaagaagaacccagaaatcttaaagctttctccttttcagccactagagatatctagtgaattcaatttacaattgtgtaagttttctagagaatcgaaacacatattgttcaacttacctgtgctttcttcttcttcgttctcactctgtctgataatttgcgcttctctgtgtcctccaagttccctctgatgtctgattctcatccaaaacatacgaaatgcgtttatggaagtaacggataaggcccattaactagtaaagttaaataggcccattaactagtaaagttaaataggcccattaacctgaaaattttgacccgtcgtctgtattcttcatctctttcctcttcgccatcgattctctgagctggaaacgaattctctctctctcagcttatagatacccaaattaaggtaattttactcttcttcgtgattcttcttcgattaggttttggtttgaatctcgaatcgatgattttcgaactgatttgctcttgaaaatcatgtggttctgctccatgttaaattgagatccgaaattttagaatattagaatgacttgtgaaatgttagtatgatacaaaaaccatatctttccttcttttgcttcttcaacataagggtcttttgcttagttttgctgtaaattccttatgggtttttagcagagaaataaaagatctgatttttaacatccattacaagcgattcagattttgcttttttcttgcagaagaagtgaaag

SEQ ID NO: 4107 - DNA, 3000 bp, Unknown
  misc_feature (1)..( 3000): cDNA_ID_3072555_gDNA_ID_1620683_Annot_ID_164540 3000 nt of promoter + ATG
atcgcacgacaatgctcttatagaagatagcatcatcaacattgcagatggtaaagtgaagcaagaggttcaaatcaagcttcagaatgttgaatctggtgaactagaactagaaatggagtggctacctcttgagcaataaataatcaactatataatagggtcattatatataaccaaacaaattttattactgtattcattattttaacattcccccttggttcttgtttgacaaatttttgaaactttgatctcattgaaaactttctttcgtactttgttgttgtaatgttcttttggcagattagatatttgtataactcatatgattatatgttttgactcatgttcttcaaaagatttcatttgaaacctaagataagacgcttataggttactaaatcaggtttcaaacccaatctcaacatttcatcatgggatctcatagctttcttcatctccttcacacgacacaacccttgaatcataattgtaaaactcttgctgttcactgaatttatctctttcatgtactcaaacactacaactgcttcttccaccatctctttttgcctcatcataagccgatcaagaaccgcgttataagcattcacatctaaacttcctttcattttctttatcttttcatgtagtaccagtgctttctctagtttcccgcttctgcagtaacgttccatcaacaatccacatgcaaaagaatcgaaataaacctccatttccataaccgaatcaagaagcttctctgcggatttccatcttcttttcctacacatagatgctaaaacttctgatagcttgtgtgtacaaggaacaaaaccgcgctttataacatctacaagcaattcctcttcttcctctgagctattatcatctctgcaaagggcatttgcgaattcgatatagcaactctcatcaagtacagtaatacctttccgacaaatcattcgatatacatcaacagcttcttttgttctcttctttcttgacagtgcttttaacatacaaccgtatgtcgaatcccacaatctcactgtttcaccattgcaggctttacggaaaagcatctcagaggcaaacgttttccccatatcgcaaagtctttcaatgattttatcattcacagccgaatcacctaaagtaacaaactttttctccaccatcaaacagagaaccttatcaatgaactcagcatctcctaatctacatgcatcatctaatacgcaaccgtaagaacaaaaactcaactctagtttcttgtcatccatctcatgaattaaactaaacacagcatcaaactctccatttctgctataacattccacaagattagtgtaaatcttgcagctttcaacacctgtttccatcaatttaaaaacactcttggatctcccttgttcgcataaaatctgagcaatcaaatcccaagtcaactcatcagagacaatcccgtttcgaaccatggcactatacaaacacaaagccactctaaactggttttctttaaccagagaaccaagaagagagttataagcactttgagaaggtgaaagtctcaatcttctcataaaaccaaacacttccaaaccattatgatgactaccctttaaggcataatactcaagcactaagctaagcgagacagacagtgaaacttcaccttcaaaccaccgatgcatttctccaacaactaaagacacagaattggtttcaaccagaggacgcaagagcatttctgctcgttccaagagacctgattcagcagcaacttcaattactcgacaatgagacttaagatccggctcgaaccgaagatgggttttggcaaaatcgaagaaatcaagagtggttttagggcattttcgagtttcacggaggatctggaggaatacaggtgaagtaagtgttgaccttgggagcttggatttaacatattggagatgagtgatccagttacgacgttgtaagagaattgaagatatttctgtggctactcggaacagagtctgttgggttttccaatcggaagcagaggatgttgatggagtcgctgaagtcgagaatcgtttgaagaatccaacacttgtgtggataagaaccatttaggtgcttcaccaattcaaaaatctgtcctcttttttctaacaaaccccaaaatcgattcttcaaccaaaattcatcctcaaagcccaaagggtttaaggaaagttgatcaagaacaacaaaagatgaaaacttgcctgaatcttagcattgacgttcagagtgtgagttatcctctgcaggtcagtgcacagaggctcagctgcgcaagcgcttcattacccggagatcttctgcctaattcagtcaacgtcattactcaatttatcttaacagtatccaaaacgcggcgtatatgtctcattatcatcgttacgtgtcgtcttttcattcgctgtaatgattcatcaccttctcttcttcataaacctcacttcttcttcttcttcttcttcttcttcttcttcttcttcttcagtttcgcaattcgattcctaaagtcagcagttttgtttcttcagtttcttctcaaaccgatacttgatcaaggtaaaatatttcttgcttctctctcgttttgaatggtatgcaatcgaaatccaattttttcctgaattttcctttcattcgtacgttgttctttgtaaattagacaaatttttgtcttctcttgatctccttcacgtttgttctgatgtgattttaaatcgatttgtaaatcaaaatttacttctgattaatcatgttaggcctgaaatttgaaaaaatgtgaggcaaactttaatctcaatgtctgataatgcaagcataacagagcaattttgttttatgtagaatctctgattgaaagggctctttaaaataagaagaagggtctaaaagatggcagaatcagaagagaatagcgttttgtttcccattttcattttgacaatg

SEQ ID NO: 4108 - DNA, 3000 bp, Unknown
  misc_feature (1)..( 3000): cDNA_ID_1822963_gDNA_ID_1620683_Annot_ID_164539 3000 nt of promoter + ATG
ctcgatgtcttgaacatcggtttctgacaaactcacaacctctctgagcagtttagaacgttctgccaagctcagttcttgaaacttttggaatgatttaacctgcaacgctatcgatttagcgatagattcattgaaatgagggagttgcaagaaaggagcaatgtcttctgaagatgacttccttgcactaagaggaacagcctgcaatcaaacaactataattaggctgaaaaatcttttttttttttggcaaatgtaaagttggaaacatcttaatacctgaacaatgcattgagatagctccattactccaagtgcaggacgtaaccatccacgcccttgttcattgcggggtataacggccatctgtaagaaactcacaatatcatatagtttcgcgttgaaatttccctatgcttaagcttgaaacctttttcacatcttatgtaaaattaggagattcaagtcatcatcaactttgtaataacctttattttatgcaaaaaaaataaagactatataagaccttaatcaaatcttcaagcaggcgaggtgcaaactctagcacatgcctgaaatcacgttgcagagtcggagacaggactgatgattcacgagttaactgtttctgtatcaaaagctcagtctgttgcagagaaaaatgaacgggaaaaaaagttagcactttcaagattctatccaatacttttgtgttactcatgtattaaaaaaacaccaaccttgatagttgcaggatgctttttccaaaacttagcttcctcttgcttcaacttcttaggatccaaatttagctcgcttttgacagacataaagagtttctgcagagattcatcatcggatttacgaactgaaatctctgcgtattcagctgctctgatgaaaatatccataactttgcttggagttaaagagggttgcaataactcgaaatatgcttgacgagtttgaagcttaacgtgattcccagtatactttgatgatctccagagatagattgaagcgatcactagtggcaaaagaatacataaaccaactgtacacaacaataatatcccaccagattctccattcatgtttaaaataaattgaggaagagcaattcccattgtataaccctgcatcaatcacatttacaaatatttcaattatcatttggagacggcaaagcccataatatgctacaaaaacatgagaatatggcctcaattgtttcaaacactcctttagatttgcatttgaaattgcgagcacaatttacaaagaagtctcaattttcatttgaggaaaaaacactattctaacatgtaagtgtaaaaacaaacaaacaatggaggttatatagtcattacctgtctaccatccggatgaccgtacttctcaaagttttcgcgggataacggatcagtcaaagcttggtaagctttagctatggactccacaaaatatttattggcctctgtaccattacaatacacaaataagcaatactaagaacacataacaatgtatcaaaagggaggaaataaacgattatcaaggaagaggaccaggaagcatttcgacctggatcaggatttttatcaggatggtattgaatagagagtcttctatatgctttcttgatttctgaatctgaagcaccaggttccaaaccgagtataccgaatggctcaaagagttgactctataatatttacccaagataatgaataagcaaatgaagcaatcttggactaagcttgaagagataattattagttattacctcacggctcatgttcttagtatgataaatcaagaagatcattacaatccaaagtaggacaactgtcaagttgctacaagaagtgaagctagagatctgcagaagacaaaatcaaacaagttcaagaggtaagaacatcatacagttaaatcaatcattattcggaaagagttagtgtgggggaaaaagaaaaactaacactttgagaaatggatctcttgtacttccctgaacgatcacactcaagacattgacaatgtatactccgttgtttcttagaaaaagcgcggcttagcttcacaaatgtataaggaaccaatggaattgccatcattgtcaaaatgaaaatgggaaacaaaacgctattctcttctgattctgccatcttttagacccttcttcttattttaaagagccctttcaatcagagattctacataaaacaaaattgctctgttatgcttgcattatcagacattgagattaaagtttgcctcacattttttcaaatttcaggcctaacatgattaatcagaagtaaattttgatttacaaatcgatttaaaatcacatcagaacaaacgtgaaggagatcaagagaagacaaaaatttgtctaatttacaaagaacaacgtacgaatgaaaggaaaattcaggaaaaaattggatttcgattgcataccattcaaaacgagagagaagcaagaaatattttaccttgatcaagtatcggtttgagaagaaactgaagaaacaaaactgctgactttaggaatcgaattgcgaaactgaagaagaagaagaagaagaagaagaagaagaagaagaagaagtgaggtttatgaagaagagaaggtgatgaatcattacagcgaatgaaaagacgacacgtaacgatgataatgagacatatacgccgcgttttggatactgttaagataaattgagtaatgacgttgactgaattaggcagaagatctccgggtaatgaagcgcttgcgcagctgagcctctgtgcactgacctgcagaggataactcacactctgaacgtcaatgctaagattcaggcaagttttcatcttttgttgttcttgatcaactttccttaaaccctttgggctttgaggatgaattttggttgaagaatcgattttggggtttgttagaaaaaagaggacagatttttgaattggtgaagcacctaaatg

SEQ ID NO: 4109 - DNA, 3000 bp, Unknown
  misc_feature (1)..( 3000): cDNA_ID_3072567_gDNA_ID_1620683_Annot_ID_164534 3000 nt of promoter + ATG
ctcataccaatcttgcttcggcaccctccttttgtttcggttcttaaccctaaattttccccttctatcccaaaacacagagattgataaaccctaattgttcaccttctattactgaaactttatctagactgttctggatttatgtttggatcaaccctctgcgttgtattggatgtagccttgacgcagaaaccctaattttccggaagcgtccttgcttgttgtttcaattgcttaattgagaatctctttggaactatgaaagtcttagaatctctcgttttggtgaaagtatcccattttgcttaatttgttcctttgtttaacgttgtgaatttgcgttgtgtagaaaatgccaaaggttaaaactaaccgagtcaagtacccagaaggatgggagttgatcgagcctactcttcgagagcttgatgccaagatgagagaaggttagtttcatataaagattttgttatatctcaataacatatgcttttgcttgtttctttttcccgtgattttgctctaactatcgtgttccttgtgcagctgagactgattcacatgatggtaagagaaagtgtgaaactttatggccaatcttcaaagtttctcatcagaggagtcggtatgtatatgacctttattaccgaagggaagaaatatctaaagagctctatgaattctgcttggaccagggctatgcagatcgcagtctgattgccaaatggaaaaaggtatgtttttatatcattcttgaattaacttctgtttgtatgcctttttagttagttgtctaaggccaaattgaagcgatttggagtttctattatgtaaaatattgttgtattagtttagagagtctagtatcgccttactgcacaatgagtcttgaagctgtttctctgaaatatatgtccttagcatatgcacttacttggaatgatctcactaacgaataggttctagaattggtattgttgctttgtttggtgaagaaataagatttctggtaattatacttcgaacaaagtgcattgcctccacgatttgccaaattttggatagttctaacttctaaccatactcccacatcttaatgatggtcactcatgaatcgtttattaacaaactcctccctgtcaattctgttgcatcttctctttgtaggttatactatccagacatatacctagatttcacttttgttttctttcattgaactaagattttgtcatttatacgtgtctctatactttgtgttaagtaactctaaaaactctctgttttgtgttttgcagtcgggatacgaacgtttatgctgcttgcgctgcatacagccaagagaccacaactatggaacaacatgtgtatgccgtgttcccaaacacttgcgtgaagagaaagtggtcgaatgcgttcactgcggctgtcaaggatgcgcgagtggcgattaaattcaacatagctttattcgctatctctgactgtttgttacaatcttgtcacttgttaaatctggattatgtattattccataaaggctaaaaaccctgactaaaaatctccttgctcttacttatcaactctgggtggtattgcaaataaaaagaacgttccggtttggtatatagttgaaacttgaaagtagaaagacgtttcccggtttggtatcttactgaattaaaagagtgttttactattcccaaaagtgtcaatttctctaaattcgtgagatttgcagcaagtttatcatgacgccgtgagttatgttttggtcaaccggtgatagaacaagatattattgaagcagaaataattattaattcttgtatttatctagacgaaacttgattgcttgatccaaggaaattgttttgacttcaaaattgtattggttctcactacagttgacctgcccctatgtttccatgtggaacaagattcttcgtcttggtcatatggattagtattatttatttctaatcttatcgtgtaatgcatgtatgatgtatgttctaaacaagatgtccaccaaggtccaaaacgagaagagatgcccattacgctcgctctagatgctttgtgaaactcgatggactttcttctctttaaactcacataacatacatacatgatccaaaatccatgatcgttctttttttttttgggttcatttttcatggtttattggaagcacaaaagaaaccaaaaataggatcacagttcttggacatcgtttaatacaaaactagaggaagtaaacattaaaaaaaaaacttgaaaaattaggggaggctaaatcattttcttgacgcgcttgtaataggaggagcaattgtggtaagtggttggtgtgaattagaacccaattatcaactaagtcgagttttgtttaaaaccaataaatttcatatacaagtttgaaactgaacatataactttttctttatatatcataattttgagtataacggatataacattttacttaaatgagaaagtactattgaattatccagaagacgtgatccgatggaaaaattcgtatcacacatgatcttttctttttatggcacaccagattttgtttacatttataattcgatttcatctttttcttagaaaaaatggtcaaagaatgcagctggtgaccaactagtgaccatacaacaagaacaaaatctcatggactctatttaaggtttccataatttaatttaccgtatcacatttccagctaattacacaaaaccgtcgataaataattgtttatagaaagaaataaatacaagaaaaacgtcaaaggatagctactataagtaaggcagactttaggaacccaaaattctgttattaatttacaaaaactaaagagtttttcacttttcagtttctcttcttaccattcactctaaaaaaacagagtctttataaaaccgatctcagattctgaatctgaatcagaatctggatcaacataattttctaacaaaaaaa

SEQ ID NO: 4110 - DNA, 3000 bp, Unknown
  misc_feature (1)..( 3000): cDNA_ID_1444629_gDNA_ID_1620683_Annot_ID_164553 3000 nt of promoter + ATG
aagtaggataggctattacagttgcttcatgtcgtcctccatcgtctggtaacaagggacgcactcggcagaagacacgtatatttccttttaattcctgaatttacagcttctcttagctcagatcaagacagccacatatataagggaaaaaaaaatagtttcttacaagaatagtgttatgaagcttcttccgcaataactctccctcacacagttgatgctccatgtctgcaagccggtcttgtagttcgcacagtagatgcttctgctcctcaaactctgtcctagtaagagatactgatgcatctgccatctgtattcacagttataaatatctatcaaattagctatttgaaatcaagagcatctgaaggtcatgtacatcattaacttccgagataaaattgatcctcctggtaccttttgcctttcattggcgattgctaattgctgctctaacatatttaaacgctccttctgcaacgaacatgtctcctgcagggtaaaactaaatatgagacaggaatgcgaaaaatgcacaactttgaactgacatccaatactaaaacaaaaaaagtactaacctccaacgatcctgattttgctgtcaagatgtctagctcttgcgatgactttccgacattctcctggtacttcctgatctcctcagacagcttctgtgactgtacaacttggcgatcacggtcatcccggacttgttggagctcattccgaagattagtaacttccgaaagcaatgaatccttctgttttatagcgtcatcttgcaacaccttgatcacaaaaaaaggaagaggaacaagttaagaagaaatgagaccaattaaagttagcacgcgacagtaaggccagtggtagagaagaaaaacttactctgcttgaagatagttgatcctgcagcgacttgctgtgtcccctaagtgtactaagattctccaggatgcttgacttctctttttcagcacgtgtgagtgcagctcgaactgtttcaagatcagtctgaagtttgctgttatattgttgcaaacttgtgttgtactcttgcagccttttgtacatatcctcaagtgacgtcacctataaacacaaaacaatttccatattaactaacagatcatgtggaactaacacgagaaacagaaatgaaacacctaagaaaacaccagaagacatatgttatataccttctgcttggcagccattttctcttccttaactttatcaagttcttctccgagagaagcctgcactttttcagctgcaactctagcttctttttctcttctatgacattcaatggcgtcctagtgttcaataagtaagaggaaagcaaagtcaagtaatgaatttcattaaaagaaaacattcacaattagaaaaaccaggcaccaaaacccttgcctgtgtactagactcctcctttgcaagcttttcatgtagtgacactacattctcttccaactttgagatagtggcctgtagctcttcctcttttgtcctagcctccaactctataagagtcaaaaagttagggactaccaccaaatgagtgaataacttgtttcatgtaaaaaaatcgcaagaagaaaataacctttgtggttgtatttttgttctgaagattccaaagaaaccttcaaattttccttctcttggacatgggtttcatcagcttgttggaaccattttacacaaaccttcagcctcttgataatatccgtcatttgctcaatcttagcctgcagggacagagacaaaaaaaaactccttctgagtgaaaccataaatgaaaacatctacaatgcttagagcacagagcaagtgtaactcaatcaatataccttagtatcaaactttccagcttttgctctctcactgagcaacgccaatatttcatcttttgtaaagtcaactttaccacattcttcaatgctccctacatcgctgttcatcgtgacatcttgtttattcacagccgaaaaagcttgtcttctcccagtacctccttgcgtttccactttccttcgcttgtcaaatgaaatgccaccgagaccctcctttttctgaaattgaatcaaaagccacagatttttcatcagtttcataacaaaaccaatatccagctacaagaaatgtagaatcccagaacccacgaccactctaaattctattgataacacccatcagagtaagaaatgcaaagccgatgaagataacaccttaataaattcatctggtaagctcacaaacaaaacccaaaatgcgaaattaataattcgaccagtcctagggtttttctcaaacccatcctccagaacactcaaaagtgacgacgaaatgtagtggaaaagcatgaaaaagggagcttacggcgtttggactgcgaggaggacgattctggttgcgagaagccatctccgagactcaaaattgctacaaatttcttctcctttcgctcgtcaagtgcataaaaatcccaaaatggtagtcttctccctaaattcgggttaccgacaataaaatctccgattgattctcaagatcttagagaatcaaatcgaaaaccttctcaatcgaagtcgagaaactaggattcttactttttcctaatttggggatttttgtgtgtgtgtaagtgtgtgactgaagcaggagcctgtagtttcgaaattcgaacgattttgaaattagatgtggcggacttctggaattatcataacgttatcaatcaataaagtatttaaacatatgggctaactttgggcctacaattcggcccaaatgtttaaataatcttgccacgtggctttaaggcggacaaaaatgacacgtggttttatatgagtggctacaaccatatccaagttatctaaagtacagataaggcgctctgtgtcggagaatgaaaccaaccaatcatataagcataaccaataatcatcggcttcaattttcgtcttgagaaagaaaaacaaa

SEQ ID NO: 4111 - DNA, 3000 bp, Unknown; identical to SEQ ID NO: 4098
  misc_feature (1)..( 3000): cDNA_ID_1822984_gDNA_ID_1620683_Annot_ID_164532 3000 nt of promoter + ATG

SEQ ID NO: 4112 - DNA, 3000 bp, Unknown; identical to SEQ ID NO: 4108
  misc_feature (1)..( 3000): cDNA_ID_1822963_gDNA_ID_1620683_Annot_ID_48395 3000 nt of promoter + ATG

SEQ ID NO: 4113 - DNA, 3000 bp, Unknown; identical to SEQ ID NO: 4107
  misc_feature (1)..( 3000): cDNA_ID_1822959_gDNA_ID_1620683_Annot_ID_48396 3000 nt of promoter + ATG

SEQ ID NO: 4114 - DNA, 3000 bp, Unknown; identical to SEQ ID NO: 4105
  misc_feature (1)..( 3000): cDNA_ID_1822951_gDNA_ID_1620683_Annot_ID_48398 3000 nt of promoter + ATG

SEQ ID NO: 4115 - DNA, 3000 bp, Unknown; identical to SEQ ID NO: 4103
  misc_feature (1)..( 3000): cDNA_ID_1822947_gDNA_ID_1620683_Annot_ID_48399 3000 nt of promoter + ATG

SEQ ID NO: 4116 - DNA, 3000 bp, Unknown; identical to SEQ ID NO: 4102
  misc_feature (1)..( 3000): cDNA_ID_1822925_gDNA_ID_1620683_Annot_ID_48405 3000 nt of promoter + ATG

SEQ ID NO: 4117 - DNA, 3000 bp, Unknown; identical to SEQ ID NO: 4110
  misc_feature (1)..( 3000): cDNA_ID_1444629_gDNA_ID_1620683_Annot_ID_48406 3000 nt of promoter + ATG

SEQ ID NO: 4118 - DNA, 3000 bp, Unknown
  misc_feature (1)..( 3000): cDNA_ID_1025683_gDNA_ID_1620685_Annot_ID_48435 3000 nt of promoter + ATG
tcaagcttcttcatgttgtgttctttgttgctaaatcttaacaaatagccacatatatttttatcttgttgagtatattaattatgaagattgttggcaaagaaaacttaatatactttctatgagagtaaaacaaaacacaaatttttgaagctcaaagagactatttgtttagactataagtcatgaaatatggagttttgtttatggtttcttgtggtgtcatgtttctaattctaagccatgttgaaggtaacttgtttccttattttgtgttatcaactgttttgtatatatattttcatagtcttaacattttatttttgtggttgataacacaacagaggttgaagccatgaagaagtttgggtgcaacactacacacccttttcctggaaaatgtggaaataatggaaagagttcttgggtaagtgacatgaaaaagcttccaagcgcaccaaaaaatcgtgatatacgttgcgaatgttctgaccgtccaagtttagctaggggtatgcctggcgagcgtgtatgtagatgtgattatgattgttaagtcttataatatttccataactaatagaacatgacgtgctttaaaataaaataaaaaagtttttgccaaagtagattgcttgttattctaaaatacatatgattgtgagttaatagctctccattctacaaaaaaatgttcattttaatgtgacttttttctaatatacccttaatccaaacctatttttctttgaattttagtcattattgtataattaatcacttattatatatataaaggacatatttgtattatttagtggctttattaatttgtgagaggtgtcaaaatgatattttttttgtaaaagtggagtacaagcactttgtttctcttatgagataacgtatgtggccaatgacagtatcaaaacatgtaaacatcatttattatgaacgaattacacatctgattaagtctcttatagaagtcaaatcaacctaattggattcagtatatatacatatgatggaatatatagcgagagtcaaagagatagaagaaagctttgtagataggagaagctcagacacattgtgacatgatgagtaaacaagagactaacctaacaaacaatttaaacaaaaaaagaaatcttaaattacggaaattaaggaatatgtagaaattgagatgataatgttatgtaagcaaagtacgcagcttttttgttttcaaatctcgtgatggcttgtgttttatttccttaccattgttaagttgttttagttagaagcagggtttggccttatgacgaggaaaagtatttgtacacgctcagaaaaaatatcaactagttttttaatacatttgaaaaaaaactaatggtacaaaaaaggttattaccgaatcatatcacattttgaatcctttatggattaccgatgaaaaattcaataatccgtcgattttttttttagcgtcacgagaacaatggcttatctttagtaaactactaactaccattgagtttttaatggaattaagtgggttgtaagcagtcgtccattgatttgttctccatgcatagggttagaaaatcatataaaaaatttgggagactaatttattcgataaaattttaattttagtattcatattaaaactaatacttttaaactttttataaatttttatatattattaatattcaaatttttataaatcatggaactataggatccaattttagtaacatcataaacttatacaaaaaatttgtacgttgttgtaaaaaaagtggtacaaaaaaaaaaaaaaaatgagagttgccaaggtggtacctatggtaaagggttaccaatcaaacactagtgtttgttttatcgttttcaatatattaacacagaaaaataattataaaagctacattaggatttataagggatttaaaatccctcaagtatcggcagatttatttgataaccttcaattatattattaataagaaaaccttaactaagatttaagtgattaaaaattttaagtactagtcggtctatttaaaacttctaaactattaaccgaaaacacactcgtctatagtatcgtcaaaattctaaacatctgttatcaaataattattattatattttgatttataaaaaatgatgtgtatattttttagacataagaaaatgtcgtgtttgttttataatagcattaaagcgtgatacaatagattgcaaaactgaaacgattaaccaatataattaagatatcgcatcatagtgcgtaaaaaatgaaaataagtcatttatagtattactaatactgtattagtaactaaatgagtttgaaataaaataaatgcacgataatagatgatgggttttttacacgtttttggaattttaaatcgagattagcaattttaatatttttatgttttacgtatggtacagggttaccaatcaaacttcaaacactagtgtttgtcttatcgttttctatatattaacacagaaaattaattatcaaaactaccttagtatttataatgcaaattctttttttttggtttagggatttagattatcctataattgttctaatttattatacgagtccaaatccttaaaagtttaaaatgcaaatggttgacacttaaaaagtcttttttaggggattttctccttttgtttttgtaataatttgcattttcaattttggtataatgaatttgtattttcaatttgaaaatttaataaaataagttatcctttactattttaatgaatacaaaaatttataaaattaaaattaaaagaaaaaatgaaatgatttttaaaagagttgtttttaagattaaaaccaaaaacaaaacctagagacgacctatatataagctttagggttttcttctctctgtacccttaaactccgttaccctaaacctcaagccgtcgtctccaaagttccccctcagagacgaaaaaatg

SEQ ID NO: 4119 - DNA, 3000 bp, Unknown
  misc_feature (1)..( 3000): cDNA_ID_1817398_gDNA_ID_1620685_Annot_ID_164585 3000 nt of promoter + ATG
ttttcatactccacgtaaaagagatatgttcgaggcatacatcaaatattataatcaatcatcgtgctaacttatactacaacaaaatattaatataaatttactatccaatcttacgaattcgtgcaaaaatcatctaatttttttgccacaatggcaagaaactattaaattttgatgacgtggacacgcacatgtaaaaaacgtggatgtcaagtcataatgttaacaaactgttttttttttcatttccttcaattctggtttttgttttttaaaagttgtgtataaacataaataaatatatatatttatttatatatttccaatggattctccaaaactcttatactcactttcagcatattcttccatcgtgaaaccttaccaaaaaactaatattaaatttctatggtcgtgagtatgcttaaaatgtacctactatttatgtgtagtggtttataaaatctaatattattggaaacattttaaccattgaatttttgatgacttaaatttttttttagataatttaattcgttaaaaatgtaaagatccaaataacatggtgttaagtgtccctactaaaaaattaaaagtggtgttaagtgagacttaacaacaaatcatacaaatttcagaattcacctaaaatcattaaagtcatccaaaaactcattaaaactcaaactgatttaaaatataagattaaatgttttattctatatcacttagaaaactgaaaataaaataaaattgtttgttaacactatgatgtatcattcacgtcgtttcacacatggtctacattatctattatagtttcttgccaccatgacaagaaatgtataattttgcacaaaatcataaatttagatggtaaattttaattaacgatttgttcacgtatgaattagtattcatacttatattttaattgaacttgtcgctttagttgaggtaagaaaatactataatagtaatgaaatctcaccaaataacaatcaaaaatttatttcaatcacataagatcttgtcaaaatccaccaaatcatcatgcgtgtttttcaacatctctccaaatcttctaaaaattactaatccaatacaccgcctaactaatgtatttggtaataactcttgatatgtacaactaatttacgtgttctccaccataggttatatctgttaactagttacgtacgtcgaccaaaaacatattactttatcgtggttttatcgttgaattattcactttcatgttgggatatcaagatttgaatctttcaatcatgattttaattatagttgtcaaatgtcatatcaaaaatatctattttcttatagtttttaactgattagtatgagtttcgatttggaatatttcagatatgaacatacaactaaggaacaaaatattgatattagtttcctatatctttttatttattttaaatacaatagcagatcacatgtatatattttaactcaatagttacgtcgaccaaaaacatataactttaaatatcgtggtttcattgttgatttattcactttcaggttgggacatcggaatttgaatttttcaatacgaattttaaacatagttaaatattttcttatagttcttacttcttaacgattagtatgagtttagatttggaatattttaaatatgaacatatagttaaggaacgaaaggcgatcacatgtttgtagttcacctaagtattgtagttataatctcatccagtacctggagcagttgagctaatctttagattaagcttgggcaaaaaatccggactaaaatacttgaaccgaaaccgatccaaaaaatcggtttgggacgagtacggatattacctatttactttattgagtcttgaattgtcgtacccgtgagtatagggtaaaatccaacccgaacctgatactcgaacatgtatccgcttacccgaaattacatatacttattcatagatttatatatataaaatcttattttatatttaatatttgaactaaatacatttatatccaaatatctaaaaataattaccaaaaactaaatacatttgtaaatacttaagactaaatatttttatacgcaagatacttataagttttttggatattgggacaaaatttcggttatgtgggtaaaattcagatatttgggtaaaatattcaggtatttagataaaattttagatatttggctataaaatacctgaatctcaaagatacccatttttttggtatttagcggttctaaaattatatatccgaaccgacccgaaccccattggatccaaaccgaaacaaaacagaaattttagatttatcttattgggtcctaaacttttctacccaaaaaattcttatccgatcgaattttacccgaatattccgacccacatacctgaatgcccaaccgtactttagggaattacatccgatgcacaaaagaactaacaattttgtactatcattaacaccacccatttgcaactccgaaagacgatcacatattgtagatttaaaatgcaatcttaatcacattttcactaaaagttttccttaacgtatttggtgggcatgatttaacagctcaatttggcaggtcaacgaatcaaccgtgctttaaacgttgtaatgtttttcaacttaagataagactcgaaatcaattaaaaaaacaaacaaaaatcatagtcattgtttttctttgttaattcatatacactcatacaaaacattgacaacttatctattgtttaatctaaataatacaattatgtacaagtgttactttagtaatactgccgtccatataacggcacaaaacggagaatgacgtcaccattgttgatgtcacacctccatgtaacttctgttataaacgcattaaacgttacacttgtgtatattatatagatctctgtccctttatatttcatcttttgacattacaaaattacattaccaaacacattaa

SEQ ID NO: 4120 - DNA, 3000 bp, Unknown
  misc_feature (1)..( 3000): cDNA_ID_4254981_gDNA_ID_1620685_Annot_ID_164581 3000 nt of promoter + ATG
cgaatgcatgcattgacgtttcagatgactgtgtcttttcgataacttaatgaaattgattttttcacaagataatttctaaacctaaacaaatctatcatttttgaattttcgtttaacattaaactcacatctaattacttcacaatacttaatggggttgaccgatatcaagtgttgtttcgaatttctaacttgtgtttatgttttttttttctgtttttaaagtttcagtcattggccaattgtgtttcttccgttgatcagtttgttttcatctcaaataatcaagcctatggcaaggtaatattcaaatctttcatttctacaaagaaaatcagagtattatcaatacatatatccgtttctcaataaatatcatttcacataattaataaagtatataaaaaatatctcgtaaaaagcaattattcttggtattgtatttattatttttatatttgtttagaattggattggaattatgtattttctatggaaattcatattgaaatctaaacaatactagtcattttaaaacagaaaaataatttgaaaggagtagtagcaattaagattgccagtgcactggttattggtattagttaaatattttagaccaccgaccgcatttaaagaagtagttaatatgtataagacaaaataagaaacaattattgaaaacaaaaacaaaaaagaaaagaccattaactctagattcacattgtgacatggtatttaatgaaaagaccattaactctagaccgcgttattgaagatataaggtaaaactacaaaaaatataacaaattgaaggagcctttaaataattaggcaaatgttatatcttgcgttcctgcctccgggcatgatgtgctaaacatttgtctaccaactcttgctttcacttgcattgataaaccaaatacgaccaatttaaacacatgaacctcaaccttaatgttggcctaagagtctcctaattgaatgatccaagattgaagtaatcaaaaaaggcagtacacctatttcaatgacaaggcatttgtatgaaattggttagtatattttttttctagacgagaatatttaaaaacgtaacgtacgcaatatgacgtcaaaagaaacaacgcagcatttatgaaacgatattgtattgttgtgcttggttaaccaagtgacattaatacattaattcgtttttatgtacgtttataagatttcgtttttaaacgcaccaaaaatatataaaaccatctttgcaatgaaggaactgcttactacactgctcgcttgtccaacaaaggttttttaattgatctttcgggaaacttatgattccaatggcggttttatcgaatggtcaccggattttgttgaattcatcatattttgtcaaaacaaaattcagatcttagaaaaatttataacattgatttgtaaaaagtgtataagatagtcctttgggattaccttatcgttcaatggaccataaaaatagctcgtttaggttccattactttccatcggagtaaatacattagtccaaataattcgttttcgtaaatatataagcctaaataattgtgtccaccaatttgtatgttggtgtgttttcacttgcacactggtaaactaaagacaaccaattctaacgcatggatattggggtcgtttagctaagggacaaaatttgataaataatgaacttagagacaattagtttttctatctttgtaaaaagacaaataaagtaaataaatagatatgaagttgaaaaagttcaaaaaaaaaacagcctcagcttttgccttgcgtgatagaacgagttcacggacatgcaacgagcaagagcgagttgacatgcatttaataacggctagactaacttaatcgcacacagatattaacaaattgtctgcttgtataatattgaccttttagtgctttatatatgtgttttcacgtgtacacattctagaatcgtataatatctgtttgtatgttaaaacttctccaatctgaaaaaaaaaacaataattaatagtctagccgttactaatatgcatgttaactcgttcttttttgttgtatgtgtattatttcacatgacaagctttaacctttaaaatgcactcaactcgttccttgcacaaaaagtcaattgaatatacgtattgtcccatacgcaaggcaaaaaagcagagataattattatttttttaaatattttccaacgtcaaatctattttttttgtcaatataccttaaaaagaaaaaaaactaattgtctctaagttaattatttattaaattttgtctcttaacttaacgacccagaaagcctccttggttcaatggttgatcaagggttcattaatacttatatactaagaggtttggagtttgaatcccagctactgcaatttattaatagatttgcagattaattgaggcaagtgtgcaggagatctacaacgatgtacaattatagccgttcgccaggattatacgcagagaagatatttttggtatccatcaagcgcatggagaagaagaatgaggtgtcgtatatcgtggatctaataagggaaagaaattatgcataataaaattgtctatgtaacaactctcgtaatctgtaatagaaaaaaaaaaactaaacgacctagatattcatgcgttaaaattggttgtttttttagttatcaatggaaaacacaccacatcagaattggtggacttgggctaatatatttatgaaaacaaatagtttggggctaatgtattatctaatgggctaattaataaaacttaaacgaactatttctaaggcccattaaacgatagggtaagcccaaatcactatcttacgcccctctttatattcatcgccactgaaactgagaaaagggttagtttcgctgcgctgtttcaagggttttcgtttttatcttttcctccgaagaagaagataagaggttgaagaagaagaagatg

SEQ ID NO: 4121 - DNA, 3000 bp, Unknown; identical to SEQ ID NO: 4118
  misc_feature (1)..( 3000): cDNA_ID_1025683_gDNA_ID_1620685_Annot_ID_164574 3000 nt of

SEQ ID NO: 4122 - DNA, 3000 bp, Unknown; identical to SEQ ID NO: 3725
  misc_feature (1)..( 3000): cDNA_ID_2050676_gDNA_ID_1620685_Annot_ID_164564 3000 nt of promoter + ATG

SEQ ID NO: 4123 - DNA, 3000 bp, Unknown
  misc_feature (1)..( 3000): cDNA_ID_1823072_gDNA_ID_1620685_Annot_ID_48436 3000 nt of promoter + ATG
ctatgatgcgatatcttaattatattggttaatcgtttcagttttgcaatctattgtatcacgctttaatgctattataaaacaaacacgacattttcttatgtctaaaaaatatacacatcattttttataaatcaaaatataataataattatttgataacagatgtttagaattttgacgatactatagacgagtgtgttttcggttaatagtttagaagttttaaatagaccgactagtacttaaaatttttaatcacttaaatcttagttaaggttttcttattaataatataattgaaggttatcaaataaatctgccgatacttgagggattttaaatcccttataaatcctaatgtagcttttataattatttttctgtgttaatatattgaaaacgataaaacaaacactagtgtttgattggtaaccctttaccataggtaccaccttggcaactctcattttttttttttttttgtaccactttttttacaacaacgtacaaattttttgtataagtttatgatgttactaaaattggatcctatagttccatgatttataaaaatttgaatattaataatatataaaaatttataaaaagtttaaaagtattagttttaatatgaatactaaaattaaaattttatcgaataaattagtctcccaaattttttatatgattttctaaccctatgcatggagaacaaatcaatggacgactgcttacaacccacttaattccattaaaaactcaatggtagttagtagtttactaaagataagccattgttctcgtgacgctaaaaaaaaaatcgacggattattgaatttttcatcggtaatccataaaggattcaaaatgtgatatgattcggtaataaccttttttgtaccattagttttttttcaaatgtattaaaaaactagttgatattttttctgagcgtgtacaaatacttttcctcgtcataaggccaaaccctgcttctaactaaaacaacttaacaatggtaaggaaataaaacacaagccatcacgagatttgaaaacaaaaaagctgcgtactttgcttacataacattatcatctcaatttctacatattccttaatttccgtaatttaagatttctttttttgtttaaattgtttgttaggttagtctcttgtttactcatcatgtcacaatgtgtctgagcttctcctatctacaaagctttcttctatctctttgactctcgctatatattccatcatatgtatatatactgaatccaattaggttgatttgacttctataagagacttaatcagatgtgtaattcgttcataataaatgatgtttacatgttttgatactgtcattggccacatacgttatctcataagagaaacaaagtgcttgtactccacttttacaaaaaaaatatcattttgacacctctcacaaattaataaagccactaaataatacaaatatgtcctttatatatataataagtgattaattatacaataatgactaaaattcaaagaaaaataggtttggattaagggtatattagaaaaaagtcacattaaaatgaacatttttttgtagaatggagagctattaactcacaatcatatgtattttagaataacaagcaatctactttggcaaaaacttttttattttattttaaagcacgtcatgttctattagttatggaaatattataagacttaacaatcataatcacatctacatacacgctcgccaggcatacccctagctaaacttggacggtcagaacattcgcaacgtatatcacgattttttggtgcgcttggaagctttttcatgtcacttacccaagaactctttccattatttccacattttccaggaaaagggtgtgtagtgttgcacccaaacttcttcatggcttcaacctctgttgtgttatcaaccacaaaaataaaatgttaagactatgaaaatatatatacaaaacagttgataacacaaaataaggaaacaagttaccttcaacatggcttagaattagaaacatgacaccacaagaaaccataaacaaaactccatatttcatgacttatagtctaaacaaatagtctctttgagcttcaaaaatttgtgttttgttttactctcatagaaagtatattaagttttctttgccaacaatcttcataattaatatactcaacaagataaaaatatatgtggctatttgttaagatttagcaacaaagaacacaacatgaagaagcttgaggaagaagaaatgccaactcagcaaaggggacacgtcaacagcaggaccacaagacaaagaaggagccgttagcgccaaccagggttatgagtcgcacgactaaagcattcttgtcttggtttggtaaagttgcacgcgggttaagcccaatccaaattggtggaaggtgacaaatttggaggcagcttggagacagctgtagaggagcttgtagaggcaaaccaagaaggatccagaagggaacctaggttaaaacctctaagtccatttaagctgaaggtggtgcttagagacagagttagaaacgtagagacattcattagagagtaaacttgtagtgagtgttcttagggaaacaatgagtgagagagagtgaatcatattggttctgtaaggggctgagagggtgagagatctctttgtaaaactcaaaggttatagtggattccgggaaagatttcccggcccagacgtagcaccgttggtgtgaactgggttaacaatctgtttgtgtgctctgtgttgttatgtttcactttcagtcacaagtcttcttatctcaaagttctgttcttgttcgatttcaagtttcttagacatcaagtcttgaaacccttagtctgtatttggtctaaacactacaaagtggtatcagaacgaaggttctttgtattggcggttcagtaaggttcttacaaacaaagaagcc

SEQ ID NO: 4124 - DNA, 3000 bp, Unknown; identical to SEQ ID NO: 4120
  misc_feature (1)..( 3000): cDNA_ID_4254981_gDNA_ID_1620685_Annot_ID_48438 3000 nt of promoter + ATG

SEQ ID NO: 4125 - DNA, 3000 bp, Unknown; identical to SEQ ID NO: 4119
  misc_feature (1)..( 3000): cDNA_ID_1817398_gDNA_ID_1620685_Annot_ID_48440 3000 nt of promoter + ATG

SEQ ID NO: 4126 - DNA, 3000 bp, Unknown
  misc_feature (1)..( 3000): cDNA_ID_1817405_gDNA_ID_1620685_Annot_ID_48442 3000 nt of promoter + ATG
gaggctgtgaatcaggagaggattttaactcctctcactgcaacaaaaagctcataggagccaagtacttcatcaatgcttttcttgcgacacacgaaagcttcaactccagtgagtcacttgacttcatttctccgagaggctacaatggtcatggaacacacgtggcaaccatagcgggcggttcatacgtgcctaatacaagctacaagggcttagctggagggactgtgagaggtggggcaccacgtgctcgcatagcagtgtacaagacttgttggtatcttgatttagacatagcggcttgctcatccgctgacatcttgaaagcaatggacgaggcaatccatgatggtgttgatgttctctctctttctctaggctttgaacctctgtatccagaaaccgatgttcgagatgggatagctactggtgcattccatgcagtcttaaagggtattacagttgtttgtgccgctggtaatgcgggtcctgcggctcagactgttggtaacacggctccttggattttgacagtggctgcaactactttagaccggtcctttgttacacctatgacacttgggaacaataaagtgatattggtaacaacaagatatatacaccataatgttttcacaacataatgtttaatgatctgtgtcttattgtgagtttggtaactgtattacagggtcaagcaatatacacaggtacagaagttggctttactagcttggtttatccagagaatccagggaacagcaatgaaagtttttctgggtaatatcgaatcttgaactataagaagaagattgatacactatattcacccttgttcttgtaatgcagtacatgtgagcgtcttctcatcaactctaaccgtacaatggcagggaaagtcgtgttatgtttcacagaatcaccttacagtatttctgtaacaagggctgcacattatgtgaagagagcgggtggtctcggtgttatcatcgcaggacaaccaggaaacgttctcagaccatgtctagatgatttcccttgtgttgctgttgactacgagctagggacctatatacttttttacatacgttccaatgggtatgaaaacatagactaacatcttcaccacttagacaagtaagaaaataagaaacatgttgttttatggtagatcacctgttgtgaagatacaaccttctaggacacttattggacaaccagttggtacaaaggtagcaagtttttcatcaagagggcctaatccaatttcagcagcgatcctcaaagttagtcaaaatctttacatgttctgttttgatcagactcaagaaattatcttgccttagaagttatcaatcatatgaatgcagccggatatagcagcaccgggagtgagcatattagcggctacaaccactaatacaactttcaacgaccgagggttcattttcttgtcagggacatcaatggcgactcctactatttcaggaattgttgcacttctcaaagctctgcatcctgattggtctcctgctgccattagatcagctattgtcactacaggtgcttatcttcttcattcaatatagattagacaaatcaagaacatactgatcttgataatcgtttttactctgtgtagcttggagaacagatccatttggagagcagatatttgcagaagggtcacctaggaagccagctgatccattcgactatggtggaggccttgtgaatccagagaaagctacaaaaccaggtcttgtatatgacttgggactcgaagactatgttctctacatgtgttctgttggttacaacgagacttcaatctctcagcttgtcggtaaaggaactgtctgttcgtatcccaaaccatctgttcttgatttcaacttgccttctatcacaattccaaatctcaaagaagaagtcactcttcccagaaccctcactaacgttggaccacttgagtcggtctatagagtagcggtggagccaccgttgggcacccaagtgaccgtgacgccggaaacgctagtgttcaactcaacgaccaaaagggtctcttttaaagtcagtgtctcgaccacacacaaaatcaacacaggttactactttggaagcttgacttggagtgactctctgcataatgtcaccattcctctctctgtgagaactcaacttctgccctactactacgatgagaattgaacaaacaaataaacaaacactaaccatttgtgacttatgatgagtttgtactgatgaaagcatatacattgataaacccaatcataaacaaatacaaaagtatgtgatgatgatgattgagtgaaaagtagctagctcgtaaataatcacatctttccgaaaaggaatatcaatatttttccatgtatcaacaataaagaaattagtttagtgttcataatctgaccatttctaatccagacaggttcacttctctaagatacttctttagtcttcttatttcataacacaacttttaatctctggtagagaactattcagagtagcttgatatttaccatccaatattaattagtagaagaactattcagagttaatatttaaaattcgagattaagagtaatttagccaagaaaatattctagtgttcttaacctaattagttttattctcagtagagaattattcaaagtttcttaatatttttaaattcaatatttgaattacttttaacttagatacaactctagtgttgttatgttgatcacttctaatctcattagagaactattcacagctgcttaatattgaaaatccaatgtttaaaataatatagattttcaatttgaactatgtcaaggatgaaacattgaatctcaaaaacaaagcaaccgacatggttgtagaaagagtcctcgaacgttagaccttatataaagcctttgcttcattgacaatcttaaacatcgaaacatttatctctttcttctttcaaacgagaaa

SEQ ID NO: 4127 - DNA, 3000 bp, Unknown
  misc_feature (1)..( 3000): cDNA_ID_1817409_gDNA_ID_1620685_Annot_ID_48443 3000 nt of promoter + ATG
gtagaaaactatttagagttgccttattatatagaactagatgattacccgcgctacgccgaggttttttcggattttttgtattatttaatttaaatttaatttttatttatctaatcattcactcatgcaataaacaattacttttagtattaaaaatatttttttctaacaacattctcaacaatgcatcatacatataattcataaacaacgtttgtcttaaaccaatttaagagagggtagtgttggattctagaaacctaagaatttgatgatagagctccttacgtatgcttcagcctcagtgatttattatataaatgtcataagagaatataaatatcaatttaagagaataacttattcaaatcattaagtaattcacgactattatacattcatactttgagtttggattacaaaaaaaaaatcttcgagtatgagaaaactattaaaataattttattgaaaaatcatataaataaaaataaatttagtaatagtataattaaatatgtaaaataaaattaaataagaaatatatcattaacctataaattagaagttgaagagcttacattaattatttaatagacacatgtcaaatgctaaagtgatgatgtgtcaatcatacggagagagttgaccaactttcatatatatgattcagtattacaagaaattaaaccaagaaactactttaatgttaacaattcagaattaatacttaaaattcaatgtatgcagtaatttggccaataaactattctagtgttccgaatttgatcatttttaatctcaatattgaactatatagctttaatgtatttttgttaaaaattaaaaaaaaacttttaaatttgataaacccaatcagaaacagaaacaaaaacagaaaatattgatgatgataattgagtcaaaagtagctggtaaatttatcacatctttcccaaaagggaaatctatataacttcaatatacaaactataaagtaatttagcaaagaaactagtttaatgtcataatctgaccaattattatttaggtagttacgtttatagtcatttcttcaagatacttctctagttttcttatgtcttatcacgaattgtaatctctgatagagaattattcagagttgcttaacatttaccatcgaatattaattagaagaattttaggcaagactactcatagttaatatttaaattcaatatagcacacctattgtttctactatgttgagtaattttttcaaataaataacagaacattttttttgagaaaatttcatagaaaatctaaaatattaccacacaatacataaacaatatttttaaataaaagtttataaatttgacgtttcttatataaaaaaatgaatttgaagaacatatagacatggtacttgtagtaacgaaagtgtggtttgattaaatcagatttaatctatttttatttatatcatgtattgtgaaatgattctcccatgaattaatgttgtattttataagctagggatcagtttttaatataattattttagtaggttgtgataaaaaaaaattgtgtatattattttaattatattatatgtggtagatttgttacttgttagtattgctgaggcggatggaatctcggttagatgggttcgatttcgatttccaacctaaacattgctaaacatttttcttttatttaggtaaatgaaggtcaaatatggcatttctaaaccaagcaataaccacagtctaagttgaccaaaaataataaaaagttaaatgtctctagcgatgtcgtttggttgagaattgtattcttctcctctctctcgtcgtgacgcttagggatttggttcttctgcttcttagcattataaattaatttagcaagaaaaactacttatgtgttcttaatctgaccaattctaatctattgtaggtatgaagtcattttcccatgatatttctctattctttcttaacattcgtatttatctatgaactatttaaagttgccttattatatagaactcagtattacaagaaatttagccaagaaactaatttaatattaattattcaaaattaatacttaaaattcagtgtatggagtaagttagctaataaactattctagtgttctgaatttgatcattttttatctcaatatcgaactatatagctttaatgtatttttggtgaaaattaaaaaacaaacttttaaacttgataaacccaatcagaaacagaaacaaaaacaaaaactattaatgatgatgattgagtcaaaagtagctggtaaataatcacatctttcccaaaagggaaatcaatataacttcaatgtaaacattatttgagctctaattaattcggatgacaaaaaaaaaaaaattagcaaagaaactagtttattagtgttcataatctaaccaattctagcctaggtaggttatgtttatagtcatttctccaagatacttctctagtcttcttgtaatctctgatagagaattattcagagttgcttaatatttaccattcaatattaattagaagaattattaagactactcaaagttaataattaaattcaatgtttgaagtaatttagccaaacaaatattatagtgttcttaacctaatcagttttattctcggtagagaattattcaaagttgcttactatttttaaattagtgcttgaattaatttaacttacatacaactatagtgttcttattttgatcagttctaatcttattagagaacaactcaaagctgcttaatattgaaaatccaatgtttgaaataattatagattttttaatttgaattatgtcaagattgaaacattgactctcaaaaacaaagcaacccacatggttgtagaaagagtcctcgaacgttagaccttatataaagcctttgcttcattgacaatcttaaacatcgaaacatttatctctttatcatttcaagagggaaa

SEQ ID NO: 4128 - DNA, 3000 bp, Unknown
  misc_feature (1)..( 3000): cDNA_ID_2993783_gDNA_ID_1620685_Annot_ID_48444 3000 nt of promoter + ATG
atttcatttcccctagagaccttgatggtcatggcacacatgtttccaccattgcgggtggttctttcgtgcccaatataagctacaagggcttagctggagggactgtcagaggcggggcacctcgtgctcatatagcaatgtacaaggcttgttggtatctggatgatgatgacacaacgacttgttcatctgctgacatcttgaaagctatggacgaggctatgcatgatggtgttgatgttctgtcaatctctttaggctccagcgttcctctatatggtgaaactgatattcgcgatgggataactactggagcgttccatgcagtcttaaagggtatcactgttgtttgttccggtggtaactctggcccagattctcttaccgtgacaaacacagctccttggatcatcacagtggctgcaactactctggaccggtcctttgccacacctcttacacttgggaataataaagtgatattggtaacaacaagatatacgctctttattaattgttctactcagtactcagattacatctgtgtcttattgtgagtctgttcactatattgcagggtcaagcaatgtacacaggtccaggacttggcttcactagcttggtttatcctgagaatccagggaatagcaacgaaagtttttctgggtaatttttatatttctagtttcttgatgttcatcaaatcttgcaatgtgaagaagatcaattctctgacatcaccatggttcctgtaatgcagtacttgtgaggagcttttattcaattctaatcgtacaatggaggggaaagttgtgttgtgtttcacaacatcaccttacggcggtgctgtattaagcgctgcgcgttatgtgaagagagcaggtggtcttggcgtaatcatcgcaagacacccgggttacgctatccagccatgtctagatgatttcccttgtgttgctgttgactgggagcttgggactgatatacttctctacacacggtccagtgggtatgaaaatatatcttcaccactcaggattttaaggaaatatatctgagactaagtttcacacttgtggtttacagatcgcctgtggtgaagatacaaccttctaaaacacttgtaggacaaccagttggtacaaaagtggcaacgttctcatcaagagggcctaattcgatcgcccctgcgattctcaaagtacagaatccttgctttgtcttttcttttcagacccattaaatgatcttgcctaaggttttatcaatcatatgaatgcagccggatatagcagcaccgggagtgagcatattggcagctacaaccaacaccactttcagcgaccaagggttcattatgttgtctggaacatcaatggcagctcctgcaatttcaggagttgctgcacttctcaaagctctgcaccgtgattggtctcctgctgccattagatcagccattgtcactacaggttcttatcttctcatcaaatgtaactaggacaaaacaagaacatactaatctctataagcgtcttttactctggctgcagcttggaaaacagatccatttggagagcagatatttgctgaagggtcacctccgaagctagctgatccgttcgactatggtggaggccttgtaaatccagagaaatctgcaaatccaggtcttgtatatgacatgggcctcgaagactatgttctctacatgtgctctgttggttacaacgagacatcaatctctcagcttatcggtaaaacaacagtctgttcaaatccgaaaccatctgttcttgatttcaacttgccttccatcacaatcccaaacctcaaagacgaagtgactatcacaagaactgtcactaacgttggacctctcaactcagtctatagagtaacggtcgagccacctttgggttttcaagtgactgtgacaccggagacgctagtattcaactctacgaccaaaaaagtctattttaaagttaaagtctcaaccacacacaaaaccaatacaggttactactttggaagcttgacatggagtgactctctgcacaatgtcaccattcctttgtctgtgaggacgcaaatcctgcagaactattatgatgaaaattaaacttataaaaatgactaaccatttgtgtgcttatacttatctacttatattctatacatgtatgtattgaactccttgactctttgtaaactttaattaaagaagggaaaattcccaaatattatctcagttgcctcaacatttgctaagaaacttataatttgacaaagctcggagattgtcgcagagactttttctgaaatcaactttgaccaaacttttaacacaagagatttgttctgttttctatagagccaaagaatcagcatggagcttgccaagtaaagctctaaacttagctaaagaatctttcttttctttggtcaaaactcatactgattccagctttattacacttcaagtttaatttttttttggtcagaaatagcaaaacaagcttgtatgagcatgaacacttgagtttattatggtctaggagagtcaacccaatccttttgcagcatattacaaagtaaatctctcgattggtctgtggattgatgtgtttgttccatccattgcttgctatgtttaccattaattgttgatataagtcataatctattgatcggtgtgtttgctccatcatttgtaataaactagagtttagttgaataatcaacagagtttgatatattcttcagattaatatgtgtggattttatattctgacgatgatgaaaatttggagattcaaacaagcaaaattcagaacaattccaaggaatagaaacattcttggtcaaactctgcttgagtagacatctatataaatgcttaagcttctcgatattagactccaaaatatacattacatctctttctttgtggcttgagattgaaaaatggttaaccctttttttcttggaatg

SEQ ID NO: 4129 - DNA, 263 bp, Unknown
  misc_feature (1)..( 263): cDNA_ID_1823138_gDNA_ID_1620686_Annot_ID_48445 3000 nt of promoter + ATG
gcaatcgtcggaaagttttggactttacaccaacgccaaagcgagttcttgtttctctgtttgcttctctaggaccaatcagtttccatttacagatgcgtactattcacctgtcagagctctgagatttgtctttttgcatctctctgaatatttctcttttctcagatccattgacctcatccacatacataaagtttaggtatttttaaaagggttcaattctggggtttaccggaatttcatcatctttgaagaccatg

SEQ ID NO: 4130 - DNA, 3000 bp, Unknown
  misc_feature (1)..( 3000): cDNA_ID_1823131_gDNA_ID_1620686_Annot_ID_48447 3000 nt of promoter + ATG
ttatgaaaacattattaggatatatcagttttatgaaaaaaggttttccaattgttaatcccaataataaatcatttaaaaaaatttagaaagaaaatgctgagttagaaacaaaaggaaaaggaagcacaaatggagtaaaaatgtatgaaaataaaaagataagataatgaaattttgggattagatagagatgatggagggagaaagttttgagaagcagcaagaaaggaaaggtgtcactgttgtacttggtacctctatcttaccctaatcgctggaccaacttgtctcttaataaaagtggtttttgtgtctaatctgactttgcttactctctaatcactctatctctctcagtgctaatcaagataatcataccttttttagctgttaccacttttctagtaaaggaaattgtagttacttcaattatataaatttcaatagaaaacccatcaaacttaactagttgggaacatgcatggtaggatacttattttgtctaatgctttgtattttacttatattttacggtttattacatatggatacaatattttataattcaaatcaatgatggatagtattaatatttataacaagttcatatacacattcatgtacagttatggtgttatcacacaaccgaactgagtagtttattgacttgtaatagtgtcgctactttacctttttccaaaaataatgcatgtgtgaggagttgtcgacgatgatgaaaaaatgacttatgatattcttacgaaataaatctcactaaaatttgaggtttttttttttttttttgtcgtaaaatttgaggtattaacccaacatatttggatgatgcaaataaaaactttgaaagtaacaacgttaaatagcataagacattcgttttttcactaagcaaaacagtcgtgttgtacaatttaaggtaacaaaaccgtaaaaactgaaacacatatcaagagattatttgacattttcgaactgtgttacgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttcccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaa

SEQ ID NO: 4131 - DNA, 3000 bp, Unknown
  misc_feature (1)..( 3000): cDNA_ID_2150159_gDNA_ID_1620686_Annot_ID_164604 3000 nt of promoter + ATG
atatacacattcatgtacagttatggtgttatcacacaaccgaactgagtagtttattgacttgtaatagtgtcgctactttacctttttccaaaaataatgcatgtgtgaggagttgtcgacgatgatgaaaaaatgacttatgatattcttacgaaataaatctcactaaaatttgaggtttttttttttttttttgtcgtaaaatttgaggtattaacccaacatatttggatgatgcaaataaaaactttgaaagtaacaacgttaaatagcataagacattcgttttttcactaagcaaaacagtcgtgttgtacaatttaaggtaacaaaaccgtaaaaactgaaacacatatcaagagattatttgacattttcgaactgtgttacgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttcccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaaatggcggatgttcttatgaatctgtggaacttatctacttgtctgttttcatttcatggttttgagtgtcggtagatcgaaactacaactgtcacttaccgattcactagtgagctcactaccactagatttagttttttgtctgcattagatttgcttccactcccaggtttgatttgcgtttctccgatttgtttacttagatcgattcagtaatcacaagttaggttttttctttctgttttttttttttcctgtgtggatatttgctctcgttgatcctgtggtgtaggcagaaaatgttgattagatgatttgaaaaaacctgacttatagggattatcttcggatccatatacaccattatgagtagactatgtatatgtattggataaacaagtgcttctatgttcaacactataaaaatgtagcttcaatattcgtcactgacaatgctgattgatgtatagctcatttcagaaacactagaaaaagctctgatttaagtgaatgctattttaggtatactctacaatacggttttattagtggtgtgctaattccttttctgtctcttctatattttgttgatttgtagtttactatact

SEQ ID NO: 4132 - DNA, 3000 bp, Unknown
  misc_feature (1)..( 3000): cDNA_ID_1808734_gDNA_ID_1620686_Annot_ID_48448 3000 nt of promoter + ATG
aatgagataatttaaactcaccgacgcggtttcgtcttttcttcaagtgaaaaagtgaaaaccgatgttaaggatcatgcattcaaaagagatgtatagaaatataccggatatgttgtatccatagttcacgtagattcataactactatataagttgttaaggatcaatcatgatatctgactagatcaatcacatatcaatcactccacgatatcttcttctatttatgtaaagtagattatgtaattagatctatcacatatattcctccttttgtactcaataaagattctctctttgaatataaacatttataaaaatctttttttttacaatatgtaacagtttattttattaaagtttttggttatttattatcattaaatttaataattcacatagattcatatctatataagtctcatcttaaaataatactaaaatttattttgtttacttacaattacgataggaatcaaacgaaaagatcatttttacatgaaaaaaaaactgtaaataacgtgaagaagagaagaaatataaaatcaacgtaataatgatcgagtgtttttaacaataccctttgttggaaggtgtttaaacttttgttttctttcttttgaattcttttcaagattctattaaatcatgtggatgtatatatgtgcttcagttcagagacagactttgtactaaatcaaggtaaaatatgtaattatgcggcataatatgccttacttgcttgtaagttataacatatggattccttttgtgcttaaatgcatatgtttgcttgtcatatgaggcatattactacacttccttgctaatcttttttgagtttccttaattctctttcatgttcattgtgcttttgtcctgtcatgtattagctagctatgtgttcttgttattcattcttgctaaaattacgaacacaatttagtaagaagcgttgttgctctttcttccaattcccggcagcttacttccaaactctccctttttggctaatggaatctctacgatcaaattgcaaaactctcatcaatgtgagcgacccggagaaccaaattgatttctttccaagtagatcaaacatattagaccatagtaacaaatgattgacataatgttcaatctttcagagcataaactgtttcggatgctgcaacagagaaaggcgtttagttgtggaagtcgatgagccatcaaagggactcaaaatccaaggaaagatagtgaagaaagatagtgcttcatcagatgacttctggagcacaagtacgtgtgatatggaccacaatataacgattcagtcccaatcttcaaacccgccttttgatccccaatgcagcacaagcaactctaccgaatttgtaaaccatggtaacttttgaatgttctaacttctaaggcctaggttgttttggatgccaaaaacttatgttatgaagcaagcagtatttattactcattcagttattctatacactaaaagatacactactacttattcatttccttccataaaaggacttattttgtggaaccacacgagacaacaatggcgtgaatgcttaaccagacaacaatgtctagttccagaacctgcaataaggtgacaaccacaaacagttacgaatattgaacgaactatttttatgtttatataggattggtctactgaattcgtcaatgttaaaatgaaactttgaattcatatgatttcagctggaactcgacgtatgatagcttattgagcacaaacaagctttttcctcaaccaatacctcttaaggtgatttgatttggttaattagttgttttctgctaatcataactcttaattttaattaacttacagcagaagattctttatcccccttagaacattttcatatcaggatttgaatctagtatatatcattgttgctaggaaagttttttttaaattgatgatgatattggtacaggagatggtgcatttccttgttgatgtttgggaggaagaaggcttgtacatatgattcattaaaaaaatatttttatactatataaagaaagcagaaaaacacagtttaattgcttttttcaagttccatatcatttttagtgtatatttattgcccttttataaatgaaattaggaaatttggatcaccttatggtcaatttctttatttttttagttataccacatttatactactgatgatgaaaatcgattttttgtatcgtgaacacttattaactggttttatcttgaataataaaacttccatagttattccgttattgttaggtcattgtaaaaaatcatcagcaattagtcattaaatatactatcaaagcttgtcagtcatttctcatcaattctagcaaaattattcgatatatccaaatccaaatgtcttggtttggtcatgactcatgaccgtggaaataagttcaagaatgcaaaaagtaacttatttgtgggacagaatcaaattctttgatccagttacttacgtctttccgtagccaatcaaattgaaatattttctttaggggtattcgattatggtggtcctgaagcctataacaattgttttccgataagatttgatatatataaataagggaacaatccccaaaaatgatatctagttaagatagtcgtagaatttacagaaaaggctacttatgtttttggcctgataatgcaaatactttcaaaatgttttatttgctaactagcttttagtttcgttctcgtatctaaagttagagattaacttactattcttgtattacgataacgttttgaatgaacatgtaatgatgcaagggtgtaaccaaaaatgataaaactttggggtcaatttgataatattgactaatagtgtggggcttgacaagaaccggaaactccatgatatttttgcagtctaaatatcttttcatctctcttctcttcctccactgaaatattccccacaagaactaacaatg

SEQ ID NO: 4133 - DNA, 3000 bp, Unknown
  misc_feature (1)..( 3000): cDNA_ID_1823127_gDNA_ID_1620686_Annot_ID_48449 3000 nt of promoter + ATG
catctgaagaagctcttgtaatcggtttagcaacacgaggagtagcagcagagacggttcgagccgtggttaccacccttggaacagacggtttctgggcggcgcgtaggttaaggtccagtgaagacgcgcttctcattatcattgttagttcttgtggggaatatttcagtggaggaagagaagagagatgaaaagatatttagactgcaaaaatatcatggagtttccggttcttgtcaagccccacactattagtcaatattatcaaattgaccccaaagttttatcatttttggttacacccttgcatcattacatgttcattcaaaacgttatcgtaatacaagaatagtaagttaatctctaactttagatacgagaacgaaactaaaagctagttagcaaataaaacattttgaaagtatttgcattatcaggccaaaaacataagtagccttttctgtaaattctacgactatcttaactagatatcatttttggggattgttcccttatttatatatatcaaatcttatcggaaaacaattgttataggcttcaggaccaccataatcgaatacccctaaagaaaatatttcaatttgattggctacggaaagacgtaagtaactggatcaaagaatttgattctgtcccacaaataagttactttttgcattcttgaacttatttccacggtcatgagtcatgaccaaaccaagacatttggatttggatatatcgaataattttgctagaattgatgagaaatgactgacaagctttgatagtatatttaatgactaattgctgatgattttttacaatgacctaacaataacggaataactatggaagttttattattcaagataaaaccagttaataagtgttcacgatacaaaaaatcgattttcatcatcagtagtataaatgtggtataactaaaaaaataaagaaattgaccataaggtgatccaaatttcctaatttcatttataaaagggcaataaatatacactaaaaatgatatggaacttgaaaaaagcaattaaactgtgtttttctgctttctttatatagtataaaaatatttttttaatgaatcatatgtacaagccttcttcctcccaaacatcaacaaggaaatgcaccatctcctgtaccaatatcatcatcaatttaaaaaaaactttcctagcaacaatgatatatactagattcaaatcctgatatgaaaatgttctaagggggataaagaatcttctgctgtaagttaattaaaattaagagttatgattagcagaaaacaactaattaaccaaatcaaatcaccttaagaggtattggttgaggaaaaagcttgtttgtgctcaataagctatcatacgtcgagttccagctgaaatcatatgaattcaaagtttcattttaacattgacgaattcagtagaccaatcctatataaacataaaaatagttcgttcaatattcgtaactgtttgtggttgtcaccttattgcaggttctggaactagacattgttgtctggttaagcattcacgccattgttgtctcgtgtggttccacaaaataagtccttttatggaaggaaatgaataagtagtagtgtatcttttagtgtatagaataactgaatgagtaataaatactgcttgcttcataacataagtttttggcatccaaaacaacctaggccttagaagttagaacattcaaaagttaccatggtttacaaattcggtagagttgcttgtgctgcattggggatcaaaaggcgggtttgaagattgggactgaatcgttatattgtggtccatatcacacgtacttgtgctccagaagtcatctgatgaagcactatctttcttcactatctttccttggattttgagtccctttgatggctcatcgacttccacaactaaacgcctttctctgttgcagcatccgaaacagtttatgctctgaaagattgaacattatgtcaatcatttgttactatggtctaatatgtttgatctacttggaaagaaatcaatttggttctccgggtcgctcacattgatgagagttttgcaatttgatcgtagagattccattagccaaaaagggagagtttggaagtaagctgccgggaattggaagaaagagcaacaacgcttcttactaaattgtgttcgtaattttagcaagaatgaataacaagaacacatagctagctaatacatgacaggacaaaagcacaatgaacatgaaagagaattaaggaaactcaaaaaagattagcaaggaagtgtagtaatatgcctcatatgacaagcaaacatatgcatttaagcacaaaaggaatccatatgttataacttacaagcaagtaaggcatattatgccgcataattacatattttaccttgatttagtacaaagtctgtctctgaactgaagcacatatatacatccacatgatttaatagaatcttgaaaagaattcaaaagaaagaaaacaaaagtttaaacaccttccaacaaagggtattgttaaaaacactcgatcattattacgttgattttatatttcttctcttcttcacgttatttacagtttttttttcatgtaaaaatgatcttttcgtttgattcctatcgtaattgtaagtaaacaaaataaattttagtattattttaagatgagacttatatagatatgaatctatgtgaattattaaatttaatgataataaataaccaaaaactttaataaaataaactgttacatattgtaaaaaaaaagatttttataaatgtttatattcaaagagagaatctttattgagtacaaaaggaggaatatatgtgatagatctaattacataatctactttacataaatagaagaagatatcgtggagtgattgatatgtgattgatctagtcagatatcatgattgatccttaacaacttatatagtagtt

SEQ ID NO: 4134 - DNA, 3000 bp, Unknown
  misc_feature (1)..( 3000): cDNA_ID_1823108_gDNA_ID_1620686_Annot_ID_48455 3000 nt of promoter + ATG
aaaaagaagctgaatcacttcaccagggcaaaaggaaaggaccagatttgcttgaaaacagagggctgagaagtaatggaatttcagatgctgcatcagaacagatttctgataggcaacctgatattgtcgatgatcatcctagtaaatctaggtctagtttcttttctctctacgcctcatttattggttatttctctcttattcaatatgaagtcagtcttattttaaagttaatgtgcaggagccggagcttgagtcctaagaggacagtgagtaagagcacgagtgttagtcctcggaggagtcagagtaagagcccgagttcaagtcctagatggaatgggggcagaagtcctgctaaaggtagccgccaagtgaagaacttgacaaacagtagaagagaaagcccagggagtgaggaaaagggcaggcatgtcagaaggagccctaccaaaagtgttagtagaagtccggtgcgggtgaaaaaggaaagagatattagtagaagtccttcaaagagtttaagcagaagtccactgaggagccccaaaagggtcatcagcagaagtccagtgagaggtaggattgccagaagccctagccggagtcctgtaagatctgcatctcgtggaagccttgggaggggcccactaagaagatcgtcaagaagatcacctagcagaagtccagttcgatcttctagaagaagcctgagccggagtcctattcaattatctagaagaagtctgagccggagtcccactcgattgtctaggagaagcctaagccggagtcccattcgatcacctaggaagagtgtgagcaggagtccagtccgatcatctaggaagagtgtgagcagaagtccggttcgttcatccaggagacgtatcagcaggagtccagtccgatcatctaggaagagtgtgagcaggagtcctattcgattgtccagaagaagtatcagcaggagtcctattcgattgtccaggagaagtatcagcaggagtcctgttagaggaagaagaagaattagcagaagtccagttccggcaaggagaaggagtgtgcggcctagatctcctcctcctgaccgcagaagaagtttgtcaagaagtgcttctcctaatgggcgcataaggagagggagaggatttagccaaagattctcatacgcccgtcgatacagaactagtccatctcctgatcgatctccttatcgctttagtgataggagtgaccgtgacaggtgaatagcccacacataatataactccccctttctgttacacactctcgtactgaaccgtcttttttataacgtcttctctgtagatttagaagtcgcagaaggttctcgccaagtcggttcagaagcccactaagaggaagaacacctccaaggtacttatcctctttagtacattgtttcagctgattctttacatctaaaagtttcatgaatatggaactaaaattggtgatccaaaagaattattcttgatttcacaactcgaaagtatgctcaggtatagaagaagaagccgctcagtatcgcctggtctctgttatcgcaaccggcggtacagccgcagccctatccgtagccgatctccaccttacagaaagagaaggtcaccatccgctagccacagcctgagtccatcgaggtcaagatcaagatcaaagtcatattcaaaatctcccattgggacggggaaagcaagatcagtgtcaagatcaccatccaaggcaaggtctccatcgaagtcggattcgacatcctcggataatagcccaggtgggaaaaagggattagtagcctatgattaatgaataatgattacccttaagttaagtgtttgttctttttactgagaagagatggtaaagagagtaagtagtttacttctgtaaaacataagcattgtcttttgcgtatgtttgtttgattatgctccaagattgttaaaaatttctgttgatgtttgccgacattttttctttgttgccatttgccgacaaatgttaacttccattattcgttgcggagttggttttggtccaataattaaactttcataaaattaagcataactaaatgtgacgtttgtcaccaaactttagaacaacgacatcgtaatttatttatttggataatcaatataatttacgatttcttcctacatatatatcatatcactataccaccgtcattatcactatcactaaatataaaaatgttaaaatgatttcttaatggaattttttttgttaaaagtttattgacacaaaaaatgaattaaaactcagaaatctgtatactgaattaaaacttgtaaatataacaacaaaatgggattaaaaaaagaagtggcatccatttaaaaattatttgcgaattcgcccgtaacttcttaagctaacaattagaacctaatcaacactagttattttgagtccaccgacaggtgatagcaaataaaaaagaacaggctggtaccagagccaacaacaacgtggcttcttcttttttttttttaatataatcaaacaatcatactttgtcctatctctttcttgcaataagattttgccacgtcacatactaagaagctggcgcgtctagtggggaagccagaacggctcactttaaaaagtagagagatgataacttgagccgaatagagccgagctgagctaaaacggtgggagaggaagaggctactactaccgtcaccatctccggtaaaataatgtacttgtcatttaaaaattaagaaaaaacacatcactctgcgataaaataggcaaaagcagatttgaagaagaagcagcttgagatatcaaatagagagagagagtgacagaggagtgtgtgaacatccttttttagtagatttgggttttcgagatgccgtattgaatcggctacgaatttcccaattttgaattttgtgaatctctctctttctctgtgtgtcggtggctgcgatg

SEQ ID NO: 4135 - DNA, 3000 bp, Unknown
  misc_feature (1)..( 3000): cDNA_ID_1823104_gDNA_ID_1620686_Annot_ID_48456 3000 nt of promoter + ATG
ttttcttcctcattgctttcctgatctctgcagctttatcccactcttctttctctgcatagatgttatacatctgaacgtaagaacctgacagttccggtttcatttccattgcaagctcagccacttttgctcccattttcacattcccgtgcagcctacaagacccgagcatgctctgaagcatcgactctcctggtcctccaggaacctcactcataagctcttctgcttctttcaatctcccagctcggccaagcatatcaaccatacatgagtaatgctcatgagacggctcaagattgtagacttcgatcatcatgttgaaaatctcatagcccttgtctaccattccttttctattacaagctgttaacacagagagaaaagtgactaggtctggtgctacgttttctttaatcatcttgtggaacaagttcatcacggtttcaaaatcaccgtggcttgaataggctgatattatcgatgtccaaacaaattggttcttttgagacatctcgttaaagactttctcagattcatcaatgttcccacgcttggcgtacatatcaagaagcgcgcttgaaacaacaggacaactattcaaacccaatttcagtaaatgagcatggcaacgctgaccttgctttacagatatatcctctgcaaaagctattgcattcaagacacttccgaaagtgtattcattcggcattgtttctgctgctgcggataagaacatcttgagagcttcatgagagaatccattttgtgcaaatccagatatcatagcattccaggatataatctcccggaaagttatatcctcaaaagccttcttggcatcttccagagcctcaaacttggcatacaatgtgatgaaactgttgcctacagatggttctgaaacaaagcctgtcttgatgcatagcccatgaattttaagcccttctttgatttgctcattgcacttcacggcattgattaatccaacaaaagtgacctcgttagggtaaactccatcaaaccgcatattaaggaagatggacacagcatcgtctttattcgaggaaatcattgttgtccaagagacaacattccgctcactcatttggtgaaacactgatttcacagcttccaaaaccccacacttggagtaccttgacatcaaaatattaccaacttctaaaagtgattcataacctctttttatgcacaaaccatgaatttgcctggccagcttcaagtcagtttcgtgacaacaggtagtaatcacgctagtaaaagacacgtgatcaagctccacaccttctcgcatcatgtccctaaagataaccactgcttcaaacccgaaagtgccttcttgagaaagtcctgacaataaagagttccatgaaatcatatccttaaacgacatttcatcaaaaactctccgagctcctctgaaacttccagaccgcgaatacattgtaataaacgagtttccaacgacaagatcagactccagtccggttttcaccacagttgactgcaactgcaatcctaaaagaaatccttcagagcccacacagaagctaagagcagtggaataagtgaatgcgtcaaaaactactccagcagatttcatcctaacaacaaaattcagagcaatttgattgtcatcaaacccagagagtatagtgttccaagaaacaacatcaggatcaaccagattctcaaatatgcacaaagcattgtcaaagcgaccggctttacggtacatacccattactgcgtttgaaacacaaacaaaggaagtgaacccagaagttgtggaaaacccgtggatttggcagccgcgtttcaagtctccacgacatgctttaagcgcaagacaaagagtaacttcgtccatatgacgaccaaaataacccagctggagattttccttgaagatcgaaagagctcgtgccggagaatttctccgtaaggattcactgattgaatggttaatggaagttgtcgcatttctttgggaacttccatcgaacagcttgtgagcaattctataaggagagtaaaatctctgaaaaagaaatgattttgagcgattacagtgtagatagttcagaagggtcatgagaagcaaactagtcggattctaattcgacaacaagtgtacttatatcggagaagaagagaggttttagcttctgagggaaatggtgatgaacagagagagagagattttcagagcaaaagagagttttgagggtaaacttgtaaataacgattgagttagagggcaatacggagaagctggtgttttgttcctttttaagcttccgctaggtttttctcctgctcagtcgtttttattctgtggctctgcgtgcgtattctcaggtaaaactctagcgattttccgacctgaatcttctttgtttctcttcagatgattgcactctcttgctggattttgatgttgaagcatcattttccactaatatgtacacttcactgatatgatcgttttagtgtatttgatggcctaagaattttcgtgaatttatttaccgtgaaacgtctaggtctatgctagtgctgagaagttgtgggcatgagattctatagaaattgtaagtttggatggatttgcttgacgattaatctccgtacacattgtttatttgatctttgtacattgttgagctcataaaaatctcatttttgcaacgacattgtcattaattgatgggtctagaagttttatagtttggaaggtcattattagacactgactgttgggtggtttaccagtttgcagctactgtgaagtatcctgtagtgtgggttttagttcttcagtgctctaataatttatgtctccgaagcgctattcttcaggactatttagatttctgagtctcctttgtgttttctgtgcattctctggatttttcaggtcataatttctggagatccacaggtcataatttctgaagctatacctaaaacatg

SEQ ID NO: 4136 - DNA, 3000 bp, Unknown
  misc_feature (1)..( 3000): cDNA_ID_1807922_gDNA_ID_1620686_Annot_ID_48458 3000 nt of promoter + ATG
tatatcctggaatgctatgatatctggatttgcacaaaatggattctctcatgaagctctcaagatgttcttatccgcagcagcagaaacaatgccgaatgaatacactttcggaagtgtcttgaatgcaatagcttttgcagaggatatatctgtaaagcaaggtcagcgttgccatgctcatttactgaaattgggtttgaatagttgtcctgttgtttcaagcgcgcttcttgatatgtacgccaagcgtgggaacattgatgaatctgagaaagtctttaacgagatgtctcaaaagaaccaatttgtttggacatcgataatatcagcctattcaagccacggtgattttgaaaccgtgatgaacttgttccacaagatgattaaagaaaacgtagcaccagacctagtcacttttctctctgtgttaacagcttgtaatagaaaaggaatggtagacaagggctatgagattttcaacatgatgatcgaagtctacaatcttgagccgtctcatgagcattactcatgtatggttgatatgcttggccgagctgggagattgaaagaagcagaagagcttatgagtgaggttcctggaggaccaggagagtcgatgcttcagagcatgctcgggtcttgtaggctgcacgggaatgtgaaaatgggagcaaaagtggctgagcttgcaatggaaatgaaaccggaactgtcaggttcttacgttcagatgtataacatctatgcagagaaagaagagtgggataaagctgcagagatcaggaaagcaatgaggaagaaaaacgtaagtaaagaagctggattcagttggatcgatgttggtgacactgaagggtctttaacgatgcaaggtttctcttcaggggataagtctcatccaaaatctgatgagatttatagaatggtggaaattattggattggagatgaatttggaggggaaagttgcagtttaggactcttactcaaagttctaaagagttgtagttatagatcaaaaattagaaatgttagctatagatttacatgaactcactgagtgtatgattacttttatttttgcacctacatacgtgcacattgattttgtaaggaccatggtaaaccggtaaagcatggttctctgattttgaccttattgaccggttcgattgattaatccaacgctacgatcaaaatagacgactctaacttttctaggtcaaccgtaaaatatatatactttaatttctacaaatagtatcttgaaactattaaactatttattaggttcgaatttggttggtattattcccaatccaaaggctaaaatcaaaaaaaaaaaaaaaagtcaaaataacaatggattttaactacaaaaagtttcaagtttatgggccatttcaagtttgaaacttttgttgttttttctatctaacgaactcaaaaagagaatatgatggctttaaggtatgagtttggtgttgtactcttactcacgtctctttacatttatcattgtataacaaaataagattttaatagtaactttgaaatgattcttaagcaacttaaaaagcgagagaagagaatgtttacgtcgtcgataacctcataatgcggattattcttcctaacacgttaccctctacgtaccccacttgataagccagtttacactttcccttccaatttactttttctaataaaatacttttgtcttccgtcgtcaaacaaacaaatgtatgacttaataagttctatcaaaatgaacgttcatatactcagctgattataattgacgcaacttaaaaaaaacagaatgaagactcatatattgtaacatggcttgtatcaactataaataatatttgtctagaataaagactccgatggtggttgaaacttcaaactaaaccacccaggacacagcttaacgtatcattataaattaaagataggatagtaccatactagttagtaatttgactatttattaactacacaaatttttaacagatttagaacttgagtgttatacatattgaaagtacctgtaacttgattttatcaaatcagattttaagtacttattaaaggctgaagcatatgaaaatataaatcaatttatatatgacttgttgaagcttttaaattaaggagcgtatcaaaaaacttaaaacacacaattaacgcgcgtgtccacgctctaagcaaagcgagtgaaacatattaatttacacaatcgaaccgtcattaatgttatgggttgtctcctatttctggtttaaaagagatattaacttaaatcccacgtcaccaaatattaaaaataaaataaaaataaacaaattatataaatttcttaacgcacaatttgttgttttccataattccatttacccgaaaccctaatccccaatttctctttcaagttttcgatcacgatctctggaaaattaagagagaaattcaaaaacttcgggagttcaaagtctcattcagacattccagaaggtgatctcttgtttcagtttttctccctttttgttgattgtttcaatattggtgttttatccttcgatctctatgaaagttgtttcaattggatcgagattcttcgctgtttattgattttacgatacccttttcaatcgtttggaagtttttttggtttgtcctaattcgaattattcttgctgtctgaagaatctgtttggaagtaaatttggattaatcttgcttagcttgtatctcctgtgattgatcgcgattacgttggttcttctttctgtttacgcataattttactgattcatctaaattttgttgcggctttcttatgatctgtgttccagagtttgtggattattacatcaaactatatgtttttagagttgtttgttttattaagaatgtatgatcttctgctttggatgtttgctcacatatggatatttctcttttgcaggtattctagtcgactgagtaaacaatc

SEQ ID NO: 4137 - DNA, 3000 bp, Unknown
  misc_feature (1)..( 3000): cDNA_ID_1015447_gDNA_ID_1620686_Annot_ID_48460 3000 nt of promoter + ATG
acacagagttatacgtccatcttcatacaattaaaatcttttaactgaacctaactttattcagactacttaactcatacatgacacctataaacattttgtgtttactaatatttttccttttccaaattttatccaaaaaaacaattaatttcttcttagtattttagaccactttcattctagatatactggtagtggtgacatgcatgggagaattgaccacttggccattaactctagacacacatattagacatggaagctgcttaatggaacattttagatacaattgtcaaaacaaaaaataacatattagcaacaattgcatgttagagataaataatgcattatttgatacacaatttatacttatacaatgcatgtgtatgtatttataagcacacgcaatatgttttttagtacaataatttgtgcaataaaagcaccgctaagagagtcggtggcatttgcagtgatccatcaattctgacgctgcagagacaaaattcgattattctttaaattttaaatatcatatattgctctacattaaattatatatgttcatggatcagatttacgattgacgacgagcgaaggataacaatcctttacaaagtattttattgtctatttatgtttaattttctcatactctccttttttccatacaatttgacatagtcttctatagaaattaattttgacactcgagaaaattttctgtaattgatacatgcatttattcacattatgctaaaagtccgaccacatttatatctaagactataagtatactataatgtaaaaaagccaattatgtttcatcgtttaatttatatagtaatggttggttagttattttattgtaatatttcaaaaaagtcccaatatgcttagatagtttgtgattatgttggtcatgttcatctatggtttttttagtttggtttaagaatatcgatgattatttcccgacaaaggtgcagactaaatctaagaaagcacatgatgataaaagttggaaaaagactagttaaattaatttagatcgaagtcggaccattatttgtttaaactttaaactattgaagtaaacaaagagtccgcatggttttataatttatacttcacacttgggattgttggggcatgtgtgatgcgtttaacgattctaacagtatatgaaattatattttttggtcttgttatttgtctaaaaacctatatttttctcgtaagaatattgtaagagttatttttcgaaaatttaaataatgattcgatcaacactttttctcattttatcaaacccctttgattgaatagaccgctaaaacaatttgcttgattggtctttcttacaacgactaagttacaaatgtgactgaaagttaccgatcaaacccatgaaaaaaacttgagcccatataccttgctatggatttggcacacagaccaagctttcgaagcaactgtttggttgattcggaattgttttctgataataaataatatttatattattcgttatgtgtttgtgataggataactcggaacataagcaactttaacttgtggcgatgcgagaaccaatgtgaaataggcatgtgagagaccacattgtcccacagcttttgtcctcttcacccccgcaattatattaccattaattaatcacatagttatcgttttccaaatcgtaatatacatatcgtagttgttcatctttaatctattttcggtaatctaacaaaaagaaagatatctcgtagtgaaaatacgaatatcagtgctttttatgcaacaattatgacattaggtatcgttactcaaagttaaatgaatacaatctagacgacgcttaaaaaacgaatagatgatggaatcacgacttaacactagaattaccatggaatataggcaatttgcgaatttattcaaccaaaccaaaaatcgacagtgttatttagtcaaaccttctaagaaaaagtgacccatttccaaggaacgatgaataaaaaaaccggaccaatgttgttccgacataagtcactagtggcaaagtcataatttagacaaaggaaaggggcctttcttgcacaattttgcatataagagctctctctcctcctcgttctattccactcccactaaacattccttctctcgctcactcttctccaatccttattttattttttgaaagtttaaaattttatacaacatatcaatttggggtagaaaaattcgaaagaaatgaaagagatgggagtgatagtgcttcttctccttcactcgttcttctacgttgccttttgcttcaatgatggtaaatccctcgttctttatcttttccgtagaaatctcgcattttcgtatcttgtctatatactagccaaaccaacaaaagaaactcgtagtgagttccaacaatattctagtatttaagaaattcgtgttataaaaatttgtacagcttcttataacttgtgtgtccaaaattttgtttgtcgtcaaaataattcatttatattgcaccacaaatcatgaagaatgacctattagcttgacgaacatgttgaacactacgccgagacagatctgtaaatgcacatggtgtttagtcaatcgttttcaataaatgtgtcactaaattaccctcaccttcccatctgtaactaacctttttaatcatttaaatatttcatacttccaactttttattcaattattatacactgatcacttgtttattcatatacagatctaaaatagcaagattgagaatttgtttacctagaatcactgtcaattttaggtgactagatgcagttgaagttcaaatattattgtcagcaaatcactatcgtttaaatcaaatttcacaacaaatccctaactagttttgtttttgtaacttgattacattaacaaaacaaaacaggactactaccaaacggtgacttcgaactcggtccacgacattcggacatg

SEQ ID NO: 4138 - DNA, 3000 bp, Unknown
  misc_feature (1)..( 3000): cDNA_ID_1808192_gDNA_ID_1620686_Annot_ID_48462 3000 nt of promoter + ATG
tgcttgtcttttatcaaaaaaaaaaaacatatacatgttaaaaatagtaagattataactaatctttccattaacatttctttctttttgactcttcggatgctcttctagccaggctctagccctctctaataatataactgatgactgtcacaatataattgatcatacatttgaattagagaaatataccgattagcagcatgatatttaaccaaatctgttggagtaagttgaatatgactcagcagttagcctaaaagtttttaagatatatacaacaataattaaaggcgaaaagggtgatataaaatatagctgaacagagtttaacatatcttatactgggaaaatcatgtgtataattatatatacaaacgtatggaaacttgtcgaatgagtccgtcttctaaaaaaaacaaatctcctgcaattaaagatgggttttcactattgtaactgtcgtagagaaagaaaaataattgatggtattgttgtctacaacaagttttttttttttttttgttgttgttgttgtctacaacaacaaactctatttaattcagttttaaacttttttttcaaataatttttgttttcttctgtccgttaattgataaactttaatttatgtaaataaattagttgaaactttaattttttttgtagtatatattttccattgccatcaaaattctgtagtgtatattagcgcgaaagatgagcattatatatcagattggttagttaacgtgtccaatatgcactccactaaggcactaatttagtttgtaattgatgtatcaagaacattttttaaaaaaaagatcaagaacattataatagcatatccttgccacaaacatatatgggtacatggacagctttgaacagcactgacctaatttaattacacacaaatttatttgactctcatactaattaccaaacgtcgatttctgaaataaatcatttaaatttcaaatcttaattttatttcgtttttgttaaccaaatagtataacaagtacagtatcaaaagtttcaagtttccttagaatgacctaatcactattcgatgtaccaacgtatctactaaacataatatgcatgcaatggcattattgcattttttgcacattttacaatttctttctgttagtgactaacaaaatggtgtaactgtttagtatttacctcatctcaatgatgatctggtccacatgctgccaccatgtgacccttactccagaatattcccagtctccaaaatccttcgtggagaaaatgcggaatattctactaaaccgaatcctttcattttattttattttttcctactcttttctgattatatttaagatccgatcaacttttcatatgggcgatcgagaaaacatctatttaatttgtagaactgtaaaagtgatataaaacccatgcatgtgtccatggtttgatagacatctgaatatatatcgaaaatgtgatataattctataaccacatttgccaatccttcttaccaaactaaaactaaaagtatgtataccatttcattttgttgtaatttttggtatctgaaaactgattatatttttttaacaaaccgataaactgataccgttaatatttatattagagcaattttttttcaaaatataatcagatcgaatcaattgaaataaggaagatcatattttccggcatattttcttaaaataagttctaactttcagctaatttcctccgatccaatagttgttttggtggcaggacaaggagtccccgagtacgcacgagccgggataaggcgtttaggacaaaagagacacgtgtatggctatcttccacgtagatgtctttgtccgcgtctaattattggcacgtgggtcctagtatccaagatcaggacgattctagcgagtcgcaagtgcttttcatgattaatcatattattatataccttttttcatgatcaatacgcatcttctttaacgaaaattaaataaaaacaagcaacagaaaaagtttcttaatcctgtggacgatcgattcaaccatacaaaataaattctatgtcaaggaacataaacatttttttttttgcatgaaaccggttaaatcatcaagaaaaatatgagaacttgtttcttaaatggtatataccgtccttgagtttcatttaaattttttgtgatggatattgtaaaaagtagtttgtaagcttgctaataatgcatccaaaaaggatatgtgacatgattaacaaaatttgatacaattgatttgtgataatgaaaacaaaaatacaactaaaagctccataaaccttgccttaagataatgacaacgaaaataaaagctagtttactgtctcggttgattggttgatcccaagttctcctttatcttagagcaaccataccactagacaaacgagaattaatttttttactaaaaatggttcaaaaaaggtttatttagtggctctaattgtttcgttaatctaaactatacacgctttatctagttttcagataatcttatttcaaattaagaattaagaaaatagtatagagataaatctaattgttaaaaatggattatagtacatactaattatttgttaaaaaaaaagcatcgagtatatccgaatctgtggtccgaagttgggacaagctgacataagatctagctgtctttagccatcagatccgacttagttcccaatcatatactgacacgtcatcttcttccaaactcaaaacagagcatcgaagcactctttcgcggcgccttgtatctgttttttctcccacctctcaggcgggtccctaaccccttatccgggtcttacttaagccttcaatttttctgactatatatatcccttccacttatttctattttcttcatcgaaacaaaaaataattaagagagaaaaaaacaaaaaacattttccatctctctctctctctctctcgcctgcttcaagaa

SEQ ID NO: 4139 - DNA, 631 bp, Unknown
  misc_feature (1)..( 631): cDNA_ID_2106659_gDNA_ID_1620686_Annot_ID_164627 3000 nt of promoter + ATG
atacaaattgcataccaagcagaaccgttttgtcctaaaccaatcatcacactagacgacgtcgtttcacgtgtgatatttaggtggctgtcccgttcctggaacccggagctttttttgttgtgatatatcccgtaaaaccctaaacatagtcacttcatcgtctcctccactgtatcattcaatctctgtcttccttctttttagcgacctcgtctccaaagctcacaaattttctacctttccggtgagtgttactctgttctcgtttcctcgcttgtctctttctgggtttttagtttccgaaagattttcctttcaaaatccgtttttgaatgcgaattccctctgctgtatctattatatttagtaatttgatgtattgtttggttggtatgagctgataaagttcaacacgtttgttgttcacttttgggaaaatttgcgataaaacaaggatttttttacaattttgacatatatatatatatatatatatatatatatatatatatatatttgagacgagaatatttgttcagatatctactgagtaaaattagtggtctctctgtttattgcgttcatgtgacatttggaatttttgagtctaggagtagagagaaagatg

SEQ ID NO: 4140 - DNA, 3000 bp, Unknown; identical to SEQ ID NO: 4138
  misc_feature (1)..( 3000): cDNA_ID_1808192_gDNA_ID_1620686_Annot_ID_164622 3000 nt of promoter + ATG

SEQ ID NO: 4141 - DNA, 3000 bp, Unknown
  misc_feature (1)..( 3000): cDNA_ID_1015447_gDNA_ID_1620686_Annot_ID_164618 3000 nt of promoter + ATG
ccatatcgttctcgcaaaggagcagtggagaaaaagatgatcgcgtgtctcctccattcatacacaaaggcagcagtcagtgttaatctgcattccccaagacgcaagtcttgatctttttggggctgtcttgtccttttcttctatgtcttctccgttatttcgctcccatgcaaacaatttcttatcatcactctttttctatcaacattctctctactctttcctgagtaaactatttacaattttctttctttttgttaccatataaataaatttcccatacaagtaaattaattagttctgaataacagatgtgagattgtaatttataacaattggctctcaaacttgataggtagttaaataattgtagtataataaatagttgatgttttaaacatatataaaaataatctaaaacaactatgatgtatatgacattgccgttgcccgttggcaccacaagtcaaggttgtgatttcataagttacattaaatagtttggctacagatttgaattctactaaactaaacattagtaattttgcaaatcaagaaagacgatatatagtcaaatgtcgtttagtggtccactttcccatgcatgtatggctaaatctttttaatagtaatgtggatccagggttaacatcaagccaaagttacatggctgtgtggccccggttttatggccgaaaatcataaatttaggtttaaccaccaagtcaaaacacacagagttatacgtccatcttcatacaattaaaatcttttaactgaacctaactttattcagactacttaactcatacatgacacctataaacattttgtgtttactaatatttttccttttccaaattttatccaaaaaaacaattaatttcttcttagtattttagaccactttcattctagatatactggtagtggtgacatgcatgggagaattgaccacttggccattaactctagacacacatattagacatggaagctgcttaatggaacattttagatacaattgtcaaaacaaaaaataacatattagcaacaattgcatgttagagataaataatgcattatttgatacacaatttatacttatacaatgcatgtgtatgtatttataagcacacgcaatatgttttttagtacaataatttgtgcaataaaagcaccgctaagagagtcggtggcatttgcagtgatccatcaattctgacgctgcagagacaaaattcgattattctttaaattttaaatatcatatattgctctacattaaattatatatgttcatggatcagatttacgattgacgacgagcgaaggataacaatcctttacaaagtattttattgtctatttatgtttaattttctcatactctccttttttccatacaatttgacatagtcttctatagaaattaattttgacactcgagaaaattttctgtaattgatacatgcatttattcacattatgctaaaagtccgaccacatttatatctaagactataagtatactataatgtaaaaaagccaattatgtttcatcgtttaatttatatagtaatggttggttagttattttattgtaatatttcaaaaaagtcccaatatgcttagatagtttgtgattatgttggtcatgttcatctatggtttttttagtttggtttaagaatatcgatgattatttcccgacaaaggtgcagactaaatctaagaaagcacatgatgataaaagttggaaaaagactagttaaattaatttagatcgaagtcggaccattatttgtttaaactttaaactattgaagtaaacaaagagtccgcatggttttataatttatacttcacacttgggattgttggggcatgtgtgatgcgtttaacgattctaacagtatatgaaattatattttttggtcttgttatttgtctaaaaacctatatttttctcgtaagaatattgtaagagttatttttcgaaaatttaaataatgattcgatcaacactttttctcattttatcaaacccctttgattgaatagaccgctaaaacaatttgcttgattggtctttcttacaacgactaagttacaaatgtgactgaaagttaccgatcaaacccatgaaaaaaacttgagcccatataccttgctatggatttggcacacagaccaagctttcgaagcaactgtttggttgattcggaattgttttctgataataaataatatttatattattcgttatgtgtttgtgataggataactcggaacataagcaactttaacttgtggcgatgcgagaaccaatgtgaaataggcatgtgagagaccacattgtcccacagcttttgtcctcttcacccccgcaattatattaccattaattaatcacatagttatcgttttccaaatcgtaatatacatatcgtagttgttcatctttaatctattttcggtaatctaacaaaaagaaagatatctcgtagtgaaaatacgaatatcagtgctttttatgcaacaattatgacattaggtatcgttactcaaagttaaatgaatacaatctagacgacgcttaaaaaacgaatagatgatggaatcacgacttaacactagaattaccatggaatataggcaatttgcgaatttattcaaccaaaccaaaaatcgacagtgttatttagtcaaaccttctaagaaaaagtgacccatttccaaggaacgatgaataaaaaaaccggaccaatgttgttccgacataagtcactagtggcaaagtcataatttagacaaaggaaaggggcctttcttgcacaattttgcatataagagctctctctcctcctcgttctattccactcccactaaacattccttctctcgctcactcttctccaatccttattttattttttgaaagtttaaaattttatacaacatatcaatttggggtagaaaaattcgaaagaaatg

SEQ ID NO: 4142 - DNA, 3000 bp, Unknown; identical to SEQ ID NO: 4136
  misc_feature (1)..( 3000): cDNA_ID_3072644_gDNA_ID_1620686_Annot_ID_164616 3000 nt of promoter + ATG

SEQ ID NO: 4143 - DNA, 3000 bp, Unknown; identical to SEQ ID NO: 4135
  misc_feature (1)..( 3000): cDNA_ID_3072648_gDNA_ID_1620686_Annot_ID_164614 3000 nt of promoter + ATG

SEQ ID NO: 4144 - DNA, 3000 bp, Unknown; identical to SEQ ID NO: 4134
  misc_feature (1)..( 3000): cDNA_ID_1823108_gDNA_ID_1620686_Annot_ID_164613 3000 nt of promoter + ATG

SEQ ID NO: 4145 - DNA, 3000 bp, Unknown
  misc_feature (1)..( 3000): cDNA_ID_3070637_gDNA_ID_1620686_Annot_ID_164608 3000 nt of promoter + ATG
aagattgccgtgaagctatctcctcgttaatgtttgcagcctctggattttccgagttgcctgagctgcgtgaattgaggcaaatgtttcacgaaaaatacacagattcacttgcattgtttgtcaaccaggaggtaaagagtttttctagtgtattcatttatttgtaagactcatcttgaaatcttatacggttaagttaaccacctgcttgtttcttgtacagcttgttgagaatatgtcatccaagcccttttctatggagaagaaagtgaagttaatggaagatgttgcattggagttctctattcgttgggattctaaagatttcgagaagaggattgtgagacagaatagtatttcagtaatggtatgacaatgactcatttgttttagggaacaactaaactgaaatatttggatagtgattgaattctgatttctttcttggacgtgaacaggagaccccaaaaagcaccaacgacaagtataagcctgtagacagaaacatggccttgccaaaaagagaagagtttgaaggttctgaaaatggggttagcttgaacagaaaaacggctgaggcatcagaaagaagagatcctttgtttcaatctgataaagaaagttatcagaatggtctcagaggaaatcagcgtgggctaacatataaagaaaggtcagagaatgttcttcacgcctctagatcggaaagcaaagacaataaggccgaaaggaaagagttttatctgcattctaagcaaaaccctgctagagaaaaacatcagcctatttttaacgaaggtgacactatagtgatgaaggtcaactatgggaatctcggtcaagggaatggacatcgacctggtgtagttgatgcgcataagaaaaccgagtttgttgcctcagaaaggaaagagttttattcgcaatctaagcaagaaccttctagagaaagacatcaacctatttttaatgatggtgacactattgtaatgaaggtcaagcatgagaaccacgttcaagggaatggacataaaaatggtgtagttgatctgcataagaaaatagaggttaatgcttcagagaaacttaagtctagcagcagcaaaagagctgacaagttagttatcggctttaaacaagagagtttctttcaagggtacaaacatgagaaaaatgaagagcatgcacatcagaaagtggaagatagtacctcaagacctccgaagccaaatagcaagtcaaagagagcggaatctatcaatccaggttcgagacatcataatgatcgggagagtaaagaaaatgcagttcttgtgggaaagagcaccgaagaagatccatctggtgataatgttaagggtggagaatacgaatatgatcatgcaaatccagcaaggaaagttgaggagcgagaaacagagagaatgaaatcacccttctacaaatcccttccacctccgtatgttaaaaaatctattgctaaagcaaggcatgaaaaagctgaagctttagataatccaaaggctcgttttgatggtgaagaaggaaatcatccagacaatggtaaaaatgtttatggggcagagagacgaaatggagcaggtcatcatgaagtgaatgacatagacaatgcatctctgaaacggcaaactaacagaagaaagcacattgtagaatcgggaggtgatgatcacataagtagccgaagaagggaaaactcaaggaaaggccttcaagtcttaattgacgaggatgagaaagacagtgaggagaagatgatggataaacttctgatgcattacagtaaaaaaccttcaagctatgaaaaggacaatgtgcaagaagaatccaaaagcagacgtacccatcttaaaaaaggtgaatctgatgaagagatgatgattcatcagccggctcggtcacggtctctacccgctgaacagttggccgggccatctgaacctgcaaaaacatttgcccgtgcagcctcgtttcagccagaacgttccagtgaagctaagcacgttcaccccaagttaccaaactatgacgatttggctgccagatttgcagagctaaaaggaaggtaaatatatgaacagttgatgcctagaaagatagaattaatgagattaaatagcctgttacacattttcttacttcttgatatagtacttgtccgatattgccccatgtatgtggtgcttgttataatagttgaaattggaagagtgacgcattgttacggagtacggaccccaagagttgttgatcatctccttgtttttggatcatcttatgtaaccatttgaaaacaaggatctgtttagaaaaagggaaagtggttaccacacagtttattactagcgagttatttgatgttaccatgatttttgcattaggtcctgaccagcactaacttacaagctagtagctaccatatacaagatataaatttacttctaaattaccatgaagtgtttaagttgatcttactgagaatattttgagtttttttttttaaatctgaacatgataataaacaaaaactattaaagggaaaagtcaacgagaaccctttttaaacgaaaaaaaaaaggtcaacgtgaactgcagagtgagcttagatgttcccaaattcgttcataaaccctaaattcaattttcccgatttatccccagcaattgtgtgatatcttctcaattctcatctttatcttcctccttacacagtaaaaaaaatacgttgtctgattactacttacactttttctcaaatctatcgctacgattccttctctcataaagcctcccaaaatcaatcatagacaatctcattaacagttttgtgttgatctctaactccatcgtcttaggagtaattaagtgaaagaacccaaattcgtttgtcatagaaaccacaatttcgagggatccacgcactttcacagtttgctacactttcaaaacaagccctggtctttgaaattggtgaaa

SEQ ID NO: 4146 - DNA, 3000 bp, Unknown; identical to SEQ ID NO: 4132
  misc_feature (1)..( 3000): cDNA_ID_1808734_gDNA_ID_1620686_Annot_ID_164605 3000 nt of promoter + ATG

SEQ ID NO: 4147 - DNA, 3000 bp, Unknown
  misc_feature (1)..( 3000): cDNA_ID_1823088_gDNA_ID_1620686_Annot_ID_48464 3000 nt of promoter + ATG
atgtaatggaccaatgctaacgtcaacattcatcatatcaatacacttatttatgtttgtcttgattttgatgagggagatctaccaaaataaaaggtgatactggtttttcaacacatcatacgataaaattttatgtataggcaaaagtgcagaaattgatgtcttctatcatatatgcgagttcttagtagctatgatgaaattttgtgtatggccaaaagtgcataaattgatgtattctatgatatatgcgagttcttagtagctttgtgtaaagagtgttcttcgtaatgatagtattacatagacgacgagttccaatactccaacaaaacttattagaaccggaataacaagagaaaaaaataataattataattcgcaataaagaaggtccaatcctcaaaagaattgtaaaaactaagatgatgatgatgatgatttttcaacgaatatcattatcgacccaagaattaatcatatggagaagttttgtatgagctatgtgaatactaccagtacgcattaccatgatcataaattcataattaaacacaaacaaggactaatacgagacgggagaaatatataaaggtacaacaaacataatagaaaggtacattaatattaaaactcaattgtggagaaactgatactctcacaaattatatgaccagagataaaccctaaaccatggaacttatcataatcacaagaaccaagcctagagaaatcactcccggagcaacggaaccggccaaattgcgaacagctgcggcgggccctggagccggcgcaagaacttctgaatgggagggatccactcccggagtaggcgctggcgatgacaaagccttatggaccggaataggcgctggcgataacaaagccttacggaccggagacgctgagggggaaggggaaggagagggatgacgaggagtgtggctgtggtgtccggtagacatgaccgttacggctagcttttgacctttgagacaggatccggagttgccgctgacgaagaagaatgggtctgagcggctaagtaggaagagagagtcaccgtctgagagggaagtcaaagggtgagtcgtgttgcatgtgttgtactctttttcactcacctccaacactgaatcttttcccttcacgtacttaaaatctagcaaaatcaacaattgatataatcatgcattaatgacacatatctgtggccaaatagaagagaagagagagacttacaaagagtgtcgttgacttgaaaccggtttcggtgagaccaatgagaataatcctcggaaggagtaaggacccaaccatctctcccaccaacatagaacttgtgcccatttgataactctatactaaaccccaaacccatcaacatcacaatcatcaagtaaacatcagtcattttgacaaaaaccatcaatatccgaaccaaaactttaattaacaccaactttctactctcttatagcttaactctcattaatttggtgtggtttgggtgcttgcttgtatgtgtatttatggtgaaagtagacaagagatttatagccgttgggtgaagcgtttggctgtgcatcgatatgtagagaaaatgccaattaagtagaagcgtttcgttcttgctcatctctttcttttgttacacgtttcgacatgcaatagacttaacggctatctacacaatattactagtcaggtctttaactactcatcatcattcatcaagtacaacttaaaatttcattttttaaaattcaaactttaataacgtattgtcttattttacactattagcaggagatcagggatgacaattatgaattgtttttactttttagaggtattatgcaagttacatttcaaatatttaatagtcagtagttagtcaccaaaaggttaaatttgtgcataaaacatagcaaacataaagtgtatatgcaataaatgaaaagtttatcgtgattgtaatttttttttttttttaagattccgatatccaaaaatgttattctagcaacaaatggtttgactgagctactttagtaattcttcgtcaatagaattgaaattgatcgacaaatatacttattcgatcaagaaattcgaatatatcttatatttcaaagacatacttacgaaagaaacttttccatcactttttcataaaaaaatcgaatatatatcttatatcttaacgacatacttccgatccatagagatcgtcttattatatttttccttacaattcaacattttggtgattaagattttttactatacctaaaataagttttttaattacaattcaacattccttactataccttaccaccaaaatgttgaattgtaataataacactcttttaggtatagtaaggaatctttacaaaagaattcaacattctttgattttttcacaaaaattagtaccctttcgtaaccaaaatttcgagataaatttttgaaacttaactttaacaaaaaagatagttttgaaacttaaaacagcttatggtattttggaaacaaacccaataatttaggaaactttcataatatgaaactttacaattaaatgttgacccaaaacaaaatgactcgtcaaagatactatattacccctatagatattattattttttaactccatgcgtttagagttttcgtcaaacgaatctaatttcattaagaaatgtttgtggcttatagtaagaaatcggtatgaaaattgtattacgtggcgaataagattacaaggagggaaattagttgcagaaggggcaaaagcgtaaaattacatagaaaccagaaaggtcacacacacccaagtttatagagagcaaacgaacgaattctcgggaggagaccaacccatgtgtacacgctacttctctcaacaataacaaatcacacgcaccattaatacttcctcgacaacggaacgtgaacgcctttttttcactttcaaattcatcgatcggt

SEQ ID NO: 4148 - DNA, 3000 bp, Unknown
  misc_feature (1)..( 3000): cDNA_ID_1823084_gDNA_ID_1620686_Annot_ID_48465 3000 nt of promoter + ATG
gtaatgaagtatgtaagattagtttttgtggtgcacttctgtctcatctgctagatttcatagtatttctgttgtccatgtctcacagatattatggtggcaatgagtacattgatcagttggagacgctttgccagaaccgggctttggcagccttccgcttagattctacgaaatggggggttaatgttcagccgttatctggttcacctgcaaactttgctgtctacactgcgatacttagccctcatgatcggatcatggtaaagaacttttgcactcttcatctccgctttacttgtgtgcttgatatagattgaatataatggcttgttttatacgattagggtttggatttacctcacggtggtcatctgtcgcatgggttcatgaccgctaaaaggcgtgtatctggaacttcaatatactttgagtccatgccttatcgacttgatgaatcaacaggtaatgcatttcttatgagaagggtctctgaaactacttttgtatgaggctatttcctgatgtctgaatatttgaacaggcattgttgactacgatatgctcgagaaaactgctacacttttcagaccaaagcttattatcgcaggagctagtgcatacagccgagattttgactatcctcgcatgaggaaggtagaaacacaacctgatccttgaaaacacctttcatgtttctgtctacttttggctttcaaatataaatctgttatttcattttcctcacaatttgtatgaatttctgaagatcgcagactcagttggtgcttttctgatgatggatatggctcatatcagtgggcttgtggctgcttctgtggtagctgacccttttgagtattgtgatattgttacaacaacaactcacaaggtatgtatgttccgaaatatgaaacatgatttccatttgtatttagacaaaaagcgtttccagattatctgttagtaacacacttttaccttactagtctttgagaggtccgagaggtggcatgatcttcttcaggaaggatccaattaatggggttgatcttgaatctgccgtgaacaatgctgtcttccctggtttgcaggttgagatattcaccattatttttagctctcttagataattcttctcccaacgtgattaaaagttgtctgaattgtatatttgaagggtggccctcataaccacacaattggaggattagcagtctgcttgaaacacgcacaatcaccggaattcaaggcgtaccagaaaagagtacccacccttttacttgatcattaagttcttctgcaccggataaagtttgtaaattttgcttctaacaagaatcttttgctgcttgtttaggttgtgtctaactgtagagctctagctaaccgattggttgaactcgggtttaagctagtttctggtggcagcgataaccacttggttctcgtcgatcttagacccatggtaagtttacaaactgtattaatggcttgaataaatcaacttttttcttaaaccagaaaatcacttatgataatgcggtgtcagtctaacatttttgttgtggttagggtatggatggtgcgcgggttgagaaaatcttagacatggcatctattactctcaacaagaactctgtccctggtgagttcgtcctcctactctcggtcttcttcttcccatttgaaaagtcaattctgagagaagccctcttactcttttacaaaacagaaatgaagtcgataagtagaacttgtagaacacaactgttaaagaaatgcttaattgttgttatagcaaaatcatcaattgctatatttatatgtttgattcccctagagtagtgaaattgagacagtgttgttgtgtatgtgaaatggtgaaacaggggacaaaagtgcgttggtaccagggggaataaggataggatcccccgcgatgacgacaagaggactgtcagagaaagactttgtagtagtggctgacttcatcaaggaaggtgtggagataacaatggaagccaagaaagccgcgccgggttcaaagcttcaagatttcaacaagttcgtgacatctcctgagtttccattgaaagagagagtgaagagtctaaaggagagagtggaaaccttcacatctcgttttcccattcctggcgtttaagctataaacacacacagatatgctcttgttgtaccttaattattcacctttttcatctgtcttttagggtttttacttgcttgtgtcccaagtttaaagttacagttgaatcgagagaaattattttcaaaaataaatttatttgtggaacaatgattcgtctatgttcccaaatctcaatcaatatttagtataatcagttgttgtgaaagaaaaaaataataataatttgaaaaattgtttttagcgaagagagcaaatatttcgcgggatgtggcgaatatatctcacccaatctttctctttcatgcgttttttttgttgccttctccaaatattcatctctgcctcctctcagggatagactctctctctctctctctttctttctaaaactaaaacaaaagaaagagagagatcccaaattcaacgataacagattttatctgctttttttttttgtttcgtttcttctccctcgctccccaccggattatatatctcaccggaaatcggatctctcacgttggtcgatttttctattacggcggcggccatcgctttcttcttctcctccaggtgcgtgcgatcttactttcttccttgagactttggtttacgcatgcacctctgtgtctctgtctgtacgtacgtcattgatttcatttcggattttctcctttgtttgatcgatttgtatagttaaacaacattaatatggaaactcaagtgtttttaggctttgattcttctacctttccattataatcatctctgttgttaatttcattgcatggatccacacacaggaggccttcattggtattgctatg

SEQ ID NO: 4149 - DNA, 945 bp, Unknown
  misc_feature (1)..( 945): cDNA_ID_1839258_gDNA_ID_1620686_Annot_ID_48466 3000 nt of promoter + ATG
atacaaattgcataccaagcagaaccgttttgtcctaaaccaatcatcacactagacgacgtcgtttcacgtgtgatatttaggtggctgtcccgttcctggaacccggagctttttttgttgtgatatatcccgtaaaaccctaaacatagtcacttcatcgtctcctccactgtatcattcaatctctgtcttccttctttttagcgacctcgtctccaaagctcacaaattttctacctttccggtgagtgttactctgttctcgtttcctcgcttgtctctttctgggtttttagtttccgaaagattttcctttcaaaatccgtttttgaatgcgaattccctctgctgtatctattatatttagtaatttgatgtattgtttggttggtatgagctgataaagttcaacacgtttgttgttcacttttgggaaaatttgcgataaaacaaggatttttttacaattttgacatatatatatatatatatatatatatatatatatatatatatttgagacgagaatatttgttcagatatctactgagtaaaattagtggtctctctgtttattgcgttcatgtgacatttggaatttttgagtctaggagtagagagaaagatgcaagcttgttgtggtggtaattcgatggcttctcttcagcaacctggacgggttcaaggatctgtctttcccccaattatgcctccagtgaccaaattttctcagcagttgaagttcaatatttcaaaacctttccgttcttcatttctgaaaagaaacctggtctctgaaatgagagcatcttcagtctcgctacctaatgtcgagataagcagtaagatagtttaagtttcatttccttgattatgttgatgatgtgaaagatatttttacttgtttcatgcgtggttttgatttctttttactttttgatg

SEQ ID NO: 4150 - DNA, 1335 bp, Unknown
  misc_feature (1)..( 1335): cDNA_ID_3043238_gDNA_ID_1620687_Annot_ID_48467 3000 nt of promoter + ATG
gaattcaccgtcaagtctccgacggtgtcgtggtacatcaagaaagcagctggagtcgataaaggaagcacacgcccgggtcatttgtcggtgacgacgctatcggtgagacacgtgtacgagatcgcgaaggtgaagcagacggatccgttttgtcagtatatgccgttggaatcgatttgcaaatccatcattggtactgctaattctatgggtatcaagatcgttcaggatttggagtgattttagggtttctgatgaaagagtggaatcaatttgcttctggtaaacgtctttgctttgagtagtaaagtataaaccatgaatgaatttcacagattgttttgtgttttggtgttacttccattgtgttgtttgtttcaatggataattgagctccaaaagctttccaaaatcaaaatagatattgagtttgtttaactttgatcgtttgaataatttggacagtaaagacattgcattgttgttgttgtggatgtagaaattgttcgtatgagcaaagtattctaaagtttggtcctttaacttgatatatcagattccatggaagaagttttcctctgtaaattcgattttttcagagaattgtgtgttcatagctcagtgatttgaaggaacaatgggggtggtctgaaatggcaagacataagtaggatcttaaggaaacaacaatctcaaattaacaaaactgaaagcttttgaattgagttgcttgaatcttcttctgcaatatgttttcaagtgtcacagctttgtttgtagttgtatgtttggagaaactagaacttttcttgtgtttcattggagattagtttggagtctgtaatcgagccccaagcttatgagttatgactatcaagctcgatgaaatgtccagctcgaactagttgcttttgtgaccggatctttaaaatttgccgtctgtctatggaagtttttgaaattttggtaccatatcgaatgtttttggtcaagcaagacattgacttggcccttgggaaacaataagacagagacacctgaccggagcaaagggcaaaatagagaaatagggaaaaaaagtttaaatcgggaaaatctgaagcaacgagattgattaaaaaaatcacagaaaagagcaaaaagtggagagggtcttacgtttcagggccacacgcaatctgagtgccattcctctctttgtctttctctctctctttctctgttctaagaaagggaagctctttgtctttgtttgggtccttgccaagatccaatttttacgatcaaaatcgacccggtggaattcagacacgtcttttagatagagatatg

SEQ ID NO: 4151 - DNA, 3000 bp, Unknown
  misc_feature (1)..( 3000): cDNA_ID_1823210_gDNA_ID_1620687_Annot_ID_48470 3000 nt of promoter + ATG
agaggaagcagcatggtggaggttcttctggaaataataatggtgagtctgaggtagagactgaagttgaagcattgaatgagaagagagtagtgaggccagagagtcttcttggtcttccagatggaaatagcaacaataatgggttagggacaacaacagcaacaactactgctcctaggcctgaagatctttgctttcagagccctgagattagctcagaccttcacttgctagatgttctatcaaacccaagtaagtaacaaagatacctttttagttcacacgtaactgaaaaaaacagagacattggctttgaagaaatagtcaagtaagttgtgtctgtctcagataatttcttgtgatttgtgtttgtaggggatgagcatcttgttggaaagatgggactggcggaaagttacaacctttatgatcatgttgaagattatggcatgtcaggctgattgaatacaagctgaggaaacttctaattatcagagagatcaatgaaatggatttggtagtcagtcataagcagtattagacttttgtttttcttaaattgtttctttcagggcttattaaagaaacaagtagtttatcttattaatcattttcagagaaacatttacatggattgttgaatcgtcttgtgatgcttgctttgataatttctgcattcagaacgatttttacatccttaaatgaattatactgtaagaaataaaaaaattccaagagaaaaacatttcaattcaaacctctccagagttgaaaacatgcaagtctaacaaagttttgtaatggcctttctctatttcttcctcattcacattgtgtaagaccagagtctgtataaccaaatcctcccaatcaatttcagatcctttcttccttttcttcttgctatgttcaagctccaaagacaacgcaccttcactaacattgtcagaaggatgttgtattgcattaatccgcaacttagctgccttaatcttttctcttcgtctttcaactgcaacgcaaccctttatgtaagaaggaggcaaagcttcaagccctacatctttctccaacaagtctttgagcaaaagccttttactcaattccgatttccctttccaccaattttcagttgacaccattccaaaaacagatctcctttgccacatactctgactacttccctgacttcttttcgcaagagtcccaccacaaactcgatcctcaaattcattatactttgtagacaactgattctccgatatattatcatcatagttacataaactaagctgacgttcaccttctacatcaaaataccgagacatagtatcttgacgagcatcatcatcataacaatacatagattctttgcttaggcagtccatcactaaatcctccacacaaaatccatcagttctaactaattctttcccagtcccttgttttctctttttcatggacttggcttccattaaagcaaacaaagttcctgaatgtttcaaaacattcttcacagtaacatctttcgcccaaggcaaacccacctcttcagcaaccttcacaagcttctcagataactctttataccgcgttttacaagtagtcaacgaaacactagcatctttcgccaaatcatcaatctttaccttcacaccattcacttgaacaacaaacgccaaaacagccacaaccaaaggcattggtctcctccccgtcgacaaaaaccatttcaacgcacaattcatcaggaaagtcccttgctttattatcttctccttcttatccctatcaacatcagtcaatctcggtgaattagtaaccgtcttggtaaacaaacccacaagatcaaactctcgcaattccaaatctagatgatccacaacacgcttaatcataggccctaactgatgcaaatcacatccaacttcataagcaacctcttccatagacaaaacacctttcccttcttctcttaccacagcataacaacaagctccaatcaaaatagggaaccactcaccttgtccaaattccccatcagtaagcttactaatcatactcttaatcacttcagttttattaccaagattcaatctttctgttgtctcctcaattaaattgttggcttcatagatcttcttgtctttataatcaagaacagagcctctaccaatggtgcctactcgtatatatgtaccttgaggtcctcttatgccgccaagttgtgcctcataattatcatactctcgtaatgtcccacatccaccgcaatacgaattccccgtgtcttcgtcgcgttcaaagttgcttccattgcatctcttgcaacgcatgattcaaaccgaaagcttcacactttaaattacgggtttttttttccgacaagcagaagaatgagattcggatcgccggcgaatcgagaagtactggagagagaaatcaaaactaattaagatttgacctttccttaaaaataagctaggtttttatattgtcgagatgaaaacggcatgatgttaatatgaataaaacaaaaacgccagggtgttttatttaggacgccacacagtttgtattattttctctcttttggctttttgttgtctcctccaccatagtgccgtcttttatctctttaccggtaagagaagccggtttcagatttgatcaattcgaagaattgtggctttcgttcgttgggtgaatccttgcttcgtcctttttgatagattgctactgtgttttcgaggaagttgtgtggagatagttagagagatttatgagatttcaagaggggttattataacgcacgcatggtgttcgacggaaagccgcagagaagttttgttgctatccgatttgactgagactcaaagtttgaaaattgttacttgggtattgagaaagctaaccttgggcaggttcgtatatgagttgggagtaaaacgacggtgatacatttgactgtttttcaactaaactagctttgaaatg

SEQ ID NO: 4152 - DNA, 3000 bp, Unknown
  misc_feature (1)..( 3000): cDNA_ID_1807575_gDNA_ID_1620687_Annot_ID_48472 3000 nt of promoter + ATG
aatagaatgggttgtatgtgaaagcaacaaccaaagttagacccatcctgaatatatcattcctctgatacggtctctttaactttgtgggtttttttttttttccttgaatagcttttgttttatatattattggatttctcaactttatttatccactttgaattgataactacaactctacaagctacagccatcctaacgaaaactgaaatatcttattctccttttaaagtgaaacgttgttctcgttcaccatcaagaaggataatatatacaacaagatcaagataagtaatactagtgaaacggtttctgtaatgacattagaaaaaccgagacaccaaaaaacgtgaaaactttaacagagattcggttattagtgcgaagttcgatatttgatcaaaatcaacacatttgtaacgtctagatggtgagtaaacagcagcacacaatgacacacaaacaaaaaaaacactaatccattatacaacaattgatcctaccgtcaacctggtgggctgagatgggctgttaggagataataaatataggcctggataaatcattttttaagtactggtgcaataagtaagttgtcttcactttgagttcaagttttgttcatactgaagcttttttctttttcttttcacaatcctactatatatatacgtttttaagtaagattcaccgtatatatttattttctttggtagggaaagattcagcgtataataataattagcagtggtcaacagggtaaaaaacaacagtaagtagatttgtaaaccgggattaagaatatagatttcaatgataggaaacagagaagaaagcataaaataaggatagaagacaagagaagctataggtacaccaaactctccaatctaaaagaagaatccaaagaaagctgggccaaagagaatccaatgggttataatatggctcatcactaagtcagtcatgtaattaagattatgtatatatatatggacaaatttgtatgcaactattttcatctatatttaaattccttatcatttggtcgattgataatgcttacgtaaataatgtcttgttctggatatttccgtttgtgtctctatattgtcccggtggttgaatgttctactcctagacataaactagaaaataatcatctaatgtataattttaaaaataaatgattattatactggtaaattttttaaattaatgagctttgttagtaaaaaatctcaacttaattaatcaaaaaatcatctaatgtaaattattcttttctgtaatatatatatatatatatatatatatataattcaagtattagaatatttaaattttgtgagtattaatctaattttcctatcatctaatgacaataaataaaatgtatctatatttgtgtgaatatggactttttggtatttagatagactgcttctgcttggtctcgatacttgacttagggtcgcacatgcaaacctcattattttcttccataatgttgacaattaaaaaaattaccgaaacgaaaacactttccggaaaaaacgatgaggcgttatatcatttaaagaaaaaacgacgatactaattaaataaacaaaagttccgataatttttacgtataggttacgaagacaatgacttgaatagaattgtgaagcaagtataaatttcaagttttggctgaaaaattaaagtaataatttgtgtattagtgtaaaaaaaaaagtcacagaattaagtagaagagctaattatttacacgttccgacaaaacactactacgcccccgactacgatacggcatgagtcatgaccacatattatatttttctttatcttcatgtttttgtcgaccatggtcacatttcattgtttggcctggttattcgacagagatcaattttattggcaattaatgagtcagattagatcatattaaaatctaagtgcgcccgtggaacatgggcggcggacaccgaccacctacaaattctactgtttaaacgacacgtggaaactatttattttctttttgggtcgccgctccttaacttataagtcctgactggcccaacaattttttttttctttttggtttttcttaaaggtttcttattgaattagatgatagggattgcaaaagacggtgaagctaatactcttctatagaataattgagaaaaatataacctagaatgtgtcagaaaagttagatcgcaaccaaaatttatcaatcaacggaatgtcagttaatcggtcaggaaaagaggcaattaaaagtgtttatttattttgccacaagtgctctttatcgcatttttaaaaagttgtataccaccattttgactgttgacccaaaaatataacacaaattggactaaaaaagcataaggaaaaaacttttcggtgtaaacaaaatacataacttgaagaatggatattgaaaagaaaaaagtaattcagtttcttgaaaagtaccaaccaacgactataaaaaaaaactaacaatctacttcattgatacgatcaaactagctgttaatatttgtatcaagtcgattgcatccagacatgttatttccataaaataaaatagcaacggctctctccaactataaatcaaataacatttagattatggtaatgtaaatattcagatatggaagtagccgtttaaccgtatgtgaaatctcaaacggtcaatttccaaattaggaactaaaataaccgttggttaaatagtttcctttaacgattgtcaaagaatcattaccgtcttcttatttgtcttttcctttgtaatgaaactatatattataatttcaatatagaacaaaagaataacataaattaagttttttttgtccttttctgcctttacctttccttctactcccgaaaaagcactgactttgctctgtttccttcgttcacacagagaaagagagaaatcttctgagcgaaattctgacaaaagagatg

SEQ ID NO: 4153 - DNA, 3000 bp, Unknown
  misc_feature (1)..( 3000): cDNA_ID_1957076_gDNA_ID_1620687_Annot_ID_48475 3000 nt of promoter + ATG
aagcctatttgttcacaattaggtaatcttaactcattcactttacatagtccattgctatttttgtgccattgttgtcaaaatttgacagtcttggagtcaataagacagtaacactatataatctacaattcgattcaagagacctaattctaaaaaaaatcaatctgttatgtgaaaaatataacagcaccaaaaatttttaaaacaaaaacgttccgaataatgaatgagtcaaaactggcgttacctggaaagacagagaagagtaggaaaccgaggaagcgagtgattaaaccggaacacaaagatacaacgccacgtgccaaaaaccgacccttccgagatctccggtcgccggaaatcttccgaacgaaacagaggcttcgctttcttctctacataacagcttttgctcttgaaccagaactctctctcaatctccaccgattcatagacatgcaaactcctcaccatctctgcattaacaaaacccatagaaacaaaataaaaaccatttttcaatccgacccgagtcattccgacccgattcgagattctagtcagagttttgacttacctttgcggatgacgctctggaaaacggcgagtgaggttaaggaatgtgccatgtccgaagaagaccaagagtcgcaaaagcagaagcccaagattttaacataaaaaagttttattaatatatttttctttttttccttttttagtgtgaaaaatctgcagaagaatccaaggttttatgtacttgaagcgtttgtcattaagtgaaaaggctccaagaaaagtaggttaaaattttacccttggtccaccatcgaaattaccaaaaaggcagaatattccggaacgcacgtgtaggcaagcggagcgtgcgagggtagttatgtaaaattaacagtgggaagcgggttgcaccgaaccaagcccatgtagctaaacactcacacgcgcgacgcatgtctgaaaagtggtaattgaattttgtttagaatgattctacagaggttgaatttggtaaatgaatcagaggaatattaagcatttgagcataatttccaatttggtcagattatgatatatgtaaatatgtccatgattcattttctgtttttgggttctctttgttcatttattaagtcatgggctgaagttttcatattttaagtcatgggctgagttctcaaggactaaaactggtattgatattatgatctgttaaaagccaattcatttaaggtgttcaaaatctaaactgaataattgcgttaaattaagccggacatgtttcaatcaaaagtcaatagaatgtgtcaaaatactctgggtacttgggtagtattagtaacattaacttacaaggatttttctctatataaaaatacagagtactagttttgattttatctgagtgagaactttctaataaaactctaatcgaaaacaattaatattttgtataaaatggagtgtagaacctaaatattttgtattgcttggatatatagttttttttcttcttaacatggatatataagttctatttcgtacatatttcccctaattttaatgttgaattttggaaaacttttgttggatagtgacatgaagaccctaattttaatcataacattttggaaaacttgattgggtgagtgatatggaggtgatgttaacgtatgtttggtatcaatagttggtccaattaggcccaaagagtcaaaaaaggtgcccaagtgttgtcaaaagagaaaacaattaagaatagggcaaagcttggccagcaagatttagtggtcatttcctagaaacgtgtccaagaatttataaagatgggttgtcttataaatacatatcgttcacgtaattacctgagatcaaatcttaatcatatcattcatcgtatatagactccaaacacgtttttcaaactcctatgatcatgtgttctctctttgcctccgtctttgattgctttgttccaaaatcagactcaaagattagctcaactgatgagagtgacttgaaagtcctgtcctcaaagaaaccaaaaagcaaatccccgagagctccgattatggtgtcttactttcccgccggttcaaacctttcgcgtctataagtgccaaatagaagagaagagaagatgaagtattgggatgttgattttgatataaacgaaagaagtttttggttgtagacatgttgtatgcgcaggctttaattttatgttttatttaattatgtacaaatagaccatttagattgatagcatcatatatatgctttgtatttaagaccaaataaaagattaatgtttatatacatgcgtaaaaatgttaagagcttagttagtatcattttcaaaaactgattgtcacttgagcttttatttttcttatttttttaattaagaaaagttgtggccctcaaaaagttacatggaatcggaacaggaaaaaaaaaatgtcgaaaactgattaatctaggcaacgttatcgcattttcatatcttacaaatccctttttcaattcagatttggtagaaatgcaaggagagttccatagtgtatatgtaaaatttgtataaaacgtctagaagaattacaatgctgaatttgttggaagctctgtttttctctgcttagacgtttccaacgtgttttgggtttctctgatcactgtaaagcctaaaccacaagagaagaaaaaccacgaagctttgggctttaaggcctttttgggccctagccacaataatggaagcctatcaagaaaagacaagacaagacaataagacagaagaggacaagtgtttaaagtggaagttatctttctcacgtggtctaaagaaaggttaaaaaaaaagagggaaaaaaaaaagaagatgagagaaagcaaagtgttgaagactttttagaaagcagaaaaaaaagcagagagtgtattcaaagtcggaaagaaaccctaaagaagaggattatg

SEQ ID NO: 4154 - DNA, 3000 bp, Unknown
  misc_feature (1)..( 3000): cDNA_ID_1823186_gDNA_ID_1620687_Annot_ID_48479 3000 nt of promoter + ATG
ggtatgaaatgattttagagtctttattgtttcattctctttgaattaattcttgaaaggttttgtgtataatactgtttcttttgtaattctagataaatattttcattctatatatatttttttaaagtctatgtttacagagttgatattggtaaaaagtttgagaaagtttcatacaaaaagaggataatgatgtcgtttttcaaagattggtgaacatttgatggctctgagaagaatattttattgccaattgctattttcagatttaattatagtgggatttggacaaagtattatcttcatttcaatcatttagatcctgacaaaggtttccttttatgatcttacacattcatttttcctctgcattatttgcatgcactggaagttgtatgttttttgtttactattcattttgatgttgaatatttatataaatttatttgtactttttcacattgttgcagattaaaatggtgttaagaaataaaagttaatattaggtcctttaacaagatcttccttttcttcattgttgcaaaacattactaattcaaagaatcaacataatgtgttagataaatatatcaaatatgaaatatgaaaataataactatactatgtgttatagtaaattattaaatagtatgaaaaaatctttcacttgggtttgtcctcttcctcttcatcttttggtggagatttattaagatcgaacttggcaatacatccagattcagtcgcttcctctacttgctccacaggttccacattcaaatcaatacctgaacctctcccaccttcagatcctggcgcatcaccaccaccactgccagaaaaatcaccggaacttcttcctcctaccgctacaccaccagaacttcctcctccgacagtggcaatagtaaaagcagatcttagcccgggaatcacaaacctttcagcccccgcagagaatgtaggaggaggaagaaacccttgatagtttctatctctatgagccctcatatgcccaaacactgccttccacgaaccgaaacctcttccacagatatgacaaaccggtggtcctttcggtggatgagtcaattcctttgctttcttcttcggctttttcgcttctccttcacccaaaccatccccttcgtcatcggtttgcgtagatatccttggtctactctttttcttcccaccactcccacttccctcattcattcctttcataaccgcttcctctgccgcagccaaaatcaaccccgccgcaagaaccgcttgctcattcaaacgcgctttttctgcatcttcctcaacgacactactactctctccaaatattctactgctgatattcaaagcagggaggccgagaacaatttctctcatattggtttcttcatcgctccattgctcatcagattcctctttctcttcctcagtaacatccactttcgttttctctgggttcggattactcatactattttcgcactttagtctagggattgatgtttcaaaacgacattgaattagcccttatataaagttttctctgaaccatggcggttatgacagttaattcctctcccgccttttcgtttgaagatttgcatccgtcgtttgtgattggtccgtcctaaactctgatattacgtaaatttgggcttaatatcgtataaagcccattactagcccataagttattcgtacttggtaggttggttcaagagtttttcttgttttctgtttgtaatcgtttctcgtgcgtttttggtcatcgagattgcaagagtcgttgcaactgcactaatactattatgcatgtgacatccgacaatgacgtgacttgtaaacttttgttttgacatattttttctttatttattattacaataacattatcattttttttttttgggtggaaacattatcatttttattagccattctttatttattctatatgtttttactatttaaaatttaaacattgatgtataccggtaaacatagttttcaatgtcagaaggaagctcttgaagctatgtaataaatcacaaatacaacaaattgcaacaccaaaaaaaactaatgtaaccattgatgtgtgatatatgatatagcgaagccgcaactgtcttaaatattattttgaataatatctacacactagactctaactaaacgtttaacagttttctaaaaatgcagatataaaaagttatctaaaatatttcacatatttgaataagaaattagaaacacaatcaccttttgaccattctaaggaaattcaattacaataactatgaccagaatcatctagcctaatttttgatattctctaaattaaatatttttaaaaagcttgaccaaaaaaaaagaaatggcaagaacacttactacagagtcagcataattctcggtaacaataattcttaggaaagagagcaattcttagctctgtagtaaaacacagattaataagctaagattaagattaaagaatcaatatgttgactttaagatcttagagccgcgccttacggaggctctggctagtggtaacgagccttctttgtctgaaaaaggcaacaaaaaaaacacaaaaaaggaataataaatttgaaatgagaaagagagagccaccacacacaccacatggccaaaaaagttaccgttgggtttagacagacttagaaacaaatcgtttccttcatgatccaacggtcatcttaatcacctagccgttgctatttccttcaataataaaaaaaaataaaataaaaaaaggtagcaactttaattttaattgatttgatttaatttctctctctcgcttatttcatccccttctctgactcctactgattcattcaattgcatcagacgtatacacagagtcacagagagaagagagatccttcttcgtttgatgctcttcttcttcttctagattcttctccaggagcactatcaaatcgagtaaaataaaca

SEQ ID NO: 4155 - DNA, 3000 bp, Unknown
  misc_feature (1)..( 3000): cDNA_ID_1010997_gDNA_ID_1620687_Annot_ID_164663 3000 nt of promoter + ATG
caatactttggatttctgaaaagccagtttccaatttagatttcctggaccggtttaactatagttttagtcttttagacaagatcataacaaaaccgaaccgttatatatagtaaagtactcagtaaacaaaaaatgcatctttcttcttcctcttcataaacaaaactaaacatgatagttgcattatcccgtacatgatttctttctatgtatatagcagtagtggaagttattggcttcagatcaatggccctttactgtgtctgattgcttcaaaacgtgcagccaaaatatcatagtcaggcagttttgggtgaacctggtgaccgctcgagtcctgtctggactcaccggactgaggagcctgaggcggtgctcggtttggcgggagagaagaaacacgaccctgtgatggttcatctggctctgtctcttcctcgtagtagtctgactcatcaaacttgatctcagaagttgcaggaggaggaactgatcgagggttgtagctgtgtctcctcctcattgtttcttttgcttctgcttcggtattggtatactcttcctcgtagtcagattcattaatacccggattgttgtagctgtgtctcctacccattcctctgttttctgcaccaggttttgcgtaataggaacttgtttcggagtctcgtgattgtcttcttgaacctggatgatgatgatgatgatccatgtactgtgaatccttctggtgtgttgaatgatcagaagatacagagaactccttgttgctgctgtctcttctggtagctaataaggaggctacttgtgctgctgcaactgcctgtttggctaattctgtagctgcttccgctgctgactcggtgtcatgataatgcgtgttgatgctcatgctactagtcgatctgatgagcaaaacaacaataagacttcattgtttcagatcccttatttcaagctaacgactggaatggatacataccttggcactgctttggtaggatcaataggctcgttgatagctgcacgattaactggtaagcttgaagcgctaacaaacttacgtggcccgtcctgcaagaagaacacagcttctaagattctgattttgaataatgaaagaggaagttgagaggggagattaagagacatactatgctttcttcttgaggtttgagaagttcttgctctgtctctgtagtatcccaatcaacctggaattcctttgcaatttccttcatgattttcagtttgtattctccaccgggatttctaaccgaaagcttatcaatcaactacaaacgcacaagaaagaagaaaacaagttcgatttcatcttgcatctaaaaacgaatcacagttcaagttagactaatcagaaacatgaatgatttagttaccatccggttaacaccgcagctaggacgcaaatcagtagcagcagatacaaaatctttcccatatttcttcgcaaagatgtctctaagatctccaagctcaggaatttcagagcatctaggcgcagcaaaaatcaaactagcaataccttccttaagatccacaggacattgcctaaaagaaagccaaacacatacacatataagaagccaaactgaagcaaagcaaagagacaaatgaaaactgatagtagatatgaacatacttttgcttagtgatgatagtgagacgagaaacaataagttcacagaaaagctcaatgatttcgtttgctgcctgaatgttctgttcccttatcacatgctcaacctaaatttgtcaaaaaaagcaaaatcttcattgaattgaacgatccagggaaaactctaacaaagtgaaccaggaaagtgaaatactctgattcgagcagtggcatcttgaccggattgaagaagaacagcgatgtcacgcctcatttgcttcaccacaactaatctcttgttccttataagctttatacgagccacagccatcttcgccgccgttttgctttttgccgattgaaaaaaaaacagactttaatcagatacttacatcttagaaaagcccagatcggaaatttctcaaacacagatcaaagtttttgtttttttctacaaaattaagaaactgagaatacccagaactaagaagcatcaacacactaaaaaaacctaactttttccaacttcccaaaatcaaacacggaaaaaacattcaatacaagatttttcttcgcagtgtagcagattgagtgaatttaggaatctaagaagcatcaaatcaaataaaattgagtaccatttagaggagttaaagccacgacggaagagagaaagactaaacttcatgagcttcttggtctgcgcagaagctacttcggccgccgtcattttcttttcaccacagcgtctctgacacagaagaagaaagagatgtagaagaagacgaaggctagtgtgtgcgagtgtgtatgtaacggtccgctgaaattaggaaagtaacgctcttttagaggtcccacaagaacacaccgacttatgatagctggacttggaccatgtcaaaatatagccgttgtatcttacacacgttgccaaaaacccaacgagcagcatcctaagcaacaccgtggcttgttgattgattacataatgggcttagatgggctttggtaatgggcttcttttgagtcaaactaactttttaaaaacttttatcaatacagcgaataatttgaagatcttctcattaatagtagaaatcttattaggtaacaattgtcaattggattgtcgaccatattaggagatttgatcttatcttatctcattatcgatatcattttaattttcaccacaaagcaacaatttgatattaatcttcctaaattagtacactttctctgtcctataaaaaacgttatacaacattgtctatatcacatcgttttcttcaccaactctttctagtaagtctaaaaaagttatcaagaagaaacataatctttctacgacgatg

SEQ ID NO: 4156 - DNA, 3000 bp, Unknown
  misc_feature (1)..( 3000): cDNA_ID_1807632_gDNA_ID_1620687_Annot_ID_164656 3000 nt of promoter + ATG
tttttcttcttttcagaatgaataatgtttaacaatgtatcaaaatctttctccatcaattggaaaaacaagtttgttaacaaacaaagagctttgttatttgtttgaagtgattatgattgatgatgaaaaccgccttaaagaagctgcaggtgatctcatgttctctttttaatgtctcctttccctgcaactccctgaaactgaagatcctgttttaacaaaaaagcaaaattcaattcagatcccaaactatactcagatatataaatacacagttcactgtaggaattaagaaagtaagttaccatttggtattgtctctctataagcaacagctacattttgaaagaactctctggtagcatctgcatattcaatcaactagcatattggcacactacgaaagcctgagcaatggagaacaaaatcagaatactattttcacaatcaagactcaccatgctccattgtcatagatggatcttgctcatcaacaaacccgatgagttttgctggatttccagccaccatgcttcagaaacgcccgagagaaaatgtcaatttgagcaatgttcaaacaaaaaagctcaacgagattgatatttagatgcatgtcagtggtttcatacctatgcgaaggaacatcctttaacacaagcgaaccagcagctaccattgctccagcgcctatcttaatgttaccaagtatagtcacacatgctccaagaagagcaccgtcgcctatatttggatggcggtcaccggtttctttcccagttcctcctaatgtcacaccctgtaacatgaaaatataagctagcatttataacatcaacagttctttatagttttggagaaatgaagttagagaacggatttgtacatgcaaaattgagacacggtcgcctatcacagcagtctcacctatgaccacaccagttccatgatccaacaatattcctttcccaattcttgcagctgagcaaaaaaaacagaaaccaaagttattcagatgctagatgtaaaagcatagacaagctattagctatgaatctaaaatctttaccgggatgaatatcgattccaaaaacctgagagaaaccattgacatggatcagaggttaacgttgtacaccaagactataacagtaaccaaagaagttgtagaagttactcttacctcgcttactcggctttgcagtgccaatgctaatagttttcttccttgcttccacaacttatgtgctactctatacgcctgcagtgcaagatagccctgtggaacaaactattctggtaaaatacacatgaaaactcacttagcaatcattttatatcggtgtaagagatgttattgtctttaaatcagcaactatgatggttaagagactaccttcagatgtaaaatagccgaactatacgatagacaagcaggatctctgtctttgaatgccttcaatggaccaaaaaaaaaaaacattacactgcagtcacattctcagacaataatatcagtgtcaaaaggaagattcaccgatacgagatagcgtttttacctgaacatcaagacgaatcgagctttgaatacctctgtcatgtaccataacgttgcaaaatatatccataagctgagttgccaacaaggtagggttttggagacggttagctagaacaaaactcaatgcttgctctaaacagtcatgcgacaagatactagcatacaagaagctactcaaaaccggctcctcttctgcctgtaaaacacacaacaatattcaccattaaaggaacataaacacacacaaactctgttccttaacttgtccttcgtgtagttaatgaaaaattgacgctgaaaaagtagacgggtgagagaaatacgtaacagcaagaaaaatttaaaagctttaatcaagtagttaaagagacagagaaagcatttagtgagaattcgaccccacggttttgtcggattgatataaaaggtacacaagaatgtcattatcataacctttcaatgtagaaaatcgaagttgattaacaatatcaaagtttctgtctttgttgaattgaagtcacatatatgaaaaacgtataaatcaataataagaatatgattatggagcataaggagaaaacctcaagcttagcttcttctcttatagaatcccaaattgggtcataactagaattggtaaaatccagcaaaaccgggtcggccacgggattaagggttcctctagcgtaaaccgggaaaatcctctcgaaaggaaactcgtcaccggtctctccatcgtctctggcagaaaagttccgggagacaatcattggaagagaagacaaagatgacgaggaagaaaaatcacgattctcgccgtttatacaagccatgaccaaaaagagtgaagctattggtgaagagtgtagagaagatgataaaaaaaaggttaatgataaggaaactgagaaacccttttaaacacagtgattgattgtgttggaatcgaagtagcgacagtcaaaaagataaaagaaaaaaaaaagtaaaactgaagtcttgtgtttctgtcctcactgttttggaatgtttcatgcgaaatcagatgtggtctctctctctctgctcttgtttgtaatgcgtgtgaccgtgattcagtccaagttcttaataccaccaccattgcaagagaatccaaaactatttggaagtatcctttatctatattactttaaacgtaccacacacgaagtggacgtgaactttaggctacaataaaacatttctttatattatcataaaacaattttcatttttttacaaaatattattttagaaattacaaaaaaatgattgaacaaaataattttttttggaataaagctgattggccaaagaaataaaataaaactgacaaaggcataaacgctgcatgtaaatcgccgaaaacgaaatcgaccttcgttgctctgaaaccctaaaagaagctaaatctagca

SEQ ID NO: 4157 - DNA, 3000 bp, Unknown; identical to SEQ ID NO: 4154
  misc_feature (1)..( 3000): cDNA_ID_1823186_gDNA_ID_1620687_Annot_ID_164653 3000 nt of promoter + ATG

SEQ ID NO: 4158 - DNA, 3000 bp, Unknown
  misc_feature (1)..( 3000): cDNA_ID_3072688_gDNA_ID_1620687_Annot_ID_164651 3000 nt of promoter + ATG
aatcactcgcttcctcggtttcctactcttctctgtctttccaggtaacgccagttttgactcattcattattcggaacgtttttgttttaaaaatttttggtgctgttatatttttcacataacagattgattttttttagaattaggtctcttgaatcgaattgtagattatatagtgttactgtcttattgactccaagactgtcaaattttgacaacaatggcacaaaaatagcaatggactatgtaaagtgaatgagttaagattacctaattgtgaacaaataggcttgtaacaataacacattgtagtgttgcatagaattcgatcttctgttatctctgtattcggtaaaagaaattcatagatgttctaaaacttaacattttactaaaaaaaaagcacattgtagtgttacttgagttgtgagcatttttagcaaccaaacatgtttttgctctttttattgatagaaatcccaaactggaggacatccctaatttagccaacgagctcaagtttatctccgagttaaaaccatcaaagatttatgaagaagaacaatgcagtagcagtacagagggatattataactctgatctgcctaaaccacgaaagctcgttctgaaacaagatcttaactgccttcctgattcagaaaccgaatccgaggaatctgtaaacgaaaaaaccgaacattcggaatttgaaaacgataaaactgaacagtcggaatcaggtaaatctctttcttcaaatgtcaatagacttgccttccagataatatataactctaggccagttttaagctctcttttttttggtacaaggtccagttttaagcattttggtgattaatttcgggttattgtaaaaacacagatgctaagactgagattttgaagaagaagaagaggacaccatcgagacatgttgctgaactatccttagaagagctttcaaaatactttgacctcactatcgtggaagcttctcggaatctcaaggtcggtctcactgttttgaaaaagaaatgcagagagtttgggattccacggtggcctcataggaagatcaaatctctcgactgtctcatccacgatcttcaggtcttctctctctctctctctctttatcaatcctaatacatcaattcactgaaagaagcattgatttgttttggtattgattagagggaagcagagaagcagcaggaaaagaatgaagcagcagcaatggcggtagctaagaaacaggagaaactggagacagagaagagaaatatagtgaagagaccattcatggagatagggatagaaaccaaaaaattcagacaagaaaacttcaagaaaagacacagggcttctagagccaagaagaatcaagaatctcttgtcacttcctcttccacttaaagactttaggtcctttaacagtaacatcggatatattagttagttaggggtttctgtgaagcgttttggtatttagaaatgttagttacaagtctaacagatgatgctaagccatgtttgtttttggtataagaagttccaagaagagaggaactcttgtatcatgattttttgtggtcggatatcagaattgaatcttttattttttcttagtgcaattaggtagcaattaagatcgaatttctttatataatggtgaaagatcaaacccaaatcatggtttaggaactgatccaaattaacccatccatagtcaagaaaaactttcaaaagtgtgatgaccagttttgtttaaggctattggttatgtgtgttcttgagtggtcccagctcgtgctttgaaaatctacgacgactctgtccacacgacgaagaccatcaattaacgtgtatcgtacaaagaagttcgaagtctacaagtgtgtatacgtgtgtgtgtgatcctacgtcaatatttacgaaaatgagaaaatgtttttctttgtttcattttccatgcaactggcattttgtacgtggtcaagtatcattttgaagtcattttcagtgtttttgatcaaaaattttttttgttattttttggtgaagatcattttttttgttttaatattaaaaaagaaataacaatactttattttctgatctaaaaggcctatatatatatatttgaccaaacaaaaaaagatctatatattatatgatcatttaaaaatgaaaagtatgatgttttgaaaaaaggccaacttacgaacatctctgacaaagtgaagaaatttttttctcttacgcattcatataaagaaaaatatattctaattttgccattggagaattttggtgtttctaattgtgaaacagctctatagactatagtagaagtcgaatgactttcatatttgtggaaatgaatgagaaatttccataaagacacaaacgtccaagcactgtgactgagaggatgacttttaagcattttgctggcacaagcaaaagtctttttacttcctaacggtttcacatctctactattttttgaatgatgtggacagtgattaaaaaaaaacatgtgaaataaaattacaaataattcaaagatttccaaagtaaaaacaaaattctcaattatttttttcagatcacacgatcataaatagatagaaaaggctcttaggctatgattcttctttttggtcccatcttcttggcattttcgtttgtttttttttaatttcttttaaatgagaaagaaatgcataaaaaatgaaaaggtagaccaaaacccttcttcggttcacgctagcaacccccaattttcctccctttattttattttgttatctaaattaagtcaaaattattttgcaacccatcgttgcctctttcaatagttctaaactcgagcaataaaaactcaaataaaccaactgacttgagatccatatccactagctcttgtctgaattggtaaaacaagaagaagaagaagaagaagaagaagaaagagaaggctcattagaaattg

SEQ ID NO: 4159 - DNA, 3000 bp, Unknown; identical to SEQ ID NO: 4153
  misc_feature (1)..( 3000): cDNA_ID_1957076_gDNA_ID_1620687_Annot_ID_164648 3000 nt of promoter + ATG

SEQ ID NO: 4160 - DNA, 3000 bp, Unknown
  misc_feature (1)..( 3000): cDNA_ID_2140509_gDNA_ID_1620687_Annot_ID_164646 3000 nt of promoter + ATG
ttagtatcgtcgttttttctttaaatgatataacgcctcatcgttttttccggaaagtgttttcgtttcggtaatttttttaattgtcaacattatggaagaaaataatgaggtttgcatgtgcgaccctaagtcaagtatcgagaccaagcagaagcagtctatctaaataccaaaaagtccatattcacacaaatatagatacattttatttattgtcattagatgataggaaaattagattaatactcacaaaatttaaatattctaatacttgaattatatatatatatatatatatatatatattacagaaaagaataatttacattagatgattttttgattaattaagttgagattttttactaacaaagctcattaatttaaaaaatttaccagtataataatcatttatttttaaaattatacattagatgattattttctagtttatgtctaggagtagaacattcaaccaccgggacaatatagagacacaaacggaaatatccagaacaagacattatttacgtaagcattatcaatcgaccaaatgataaggaatttaaatatagatgaaaatagttgcatacaaatttgtccatatatatatacataatcttaattacatgactgacttagtgatgagccatattataacccattggattctctttggcccagctttctttggattcttcttttagattggagagtttggtgtacctatagcttctcttgtcttctatccttattttatgctttcttctctgtttcctatcattgaaatctatattcttaatcccggtttacaaatctacttactgttgttttttaccctgttgaccactgctaattattattatacgctgaatctttccctaccaaagaaaataaatatatacggtgaatcttacttaaaaacgtatatatatagtaggattgtgaaaagaaaaagaaaaaagcttcagtatgaacaaaacttgaactcaaagtgaagacaacttacttattgcaccagtacttaaaaaatgatttatccaggcctatatttattatctcctaacagcccatctcagcccaccaggttgacggtaggatcaattgttgtataatggattagtgttttttttgtttgtgtgtcattgtgtgctgctgtttactcaccatctagacgttacaaatgtgttgattttgatcaaatatcgaacttcgcactaataaccgaatctctgttaaagttttcacgttttttggtgtctcggtttttctaatgtcattacagaaaccgtttcactagtattacttatcttgatcttgttgtatatattatccttcttgatggtgaacgagaacaacgtttcactttaaaaggagaataagatatttcagttttcgttaggatggctgtagcttgtagagttgtagttatcaattcaaagtggataaataaagttgagaaatccaataatatataaaacaaaagctattcaaggaaaaaaaaaaaaacccacaaagttaaagagaccgtatcagaggaatgatatattcaggatgggtctaactttggttgttgctttcacatacaacccattctattacgctaagaatcgcaatagaaaatggcaattgcaaaatatatatttttagcttttatcaaaaagacaacaaatactaatgtttatgagtttttcttgtattttcatttatttatagatcaaaatagtcggtggtcagagcactcaaagaaaaaggcagcgtcatctcacaccgtccatctacatatcggacgtctctcgtgagaccacgttaaaaagggcagatcagatcaccaacttcatcttagagggacccctataacagattagcacttgccacgtgtactctattgacttgttttccacaacctgattcacataaaagagaaaagagtagaatatctatcaatttagctgatcttcttaccaaaaacaaaaaaatatgattaatctgatcattataaacacacaaaaacattgaatctttgttagatgcgaaaataatttttttttaattaattagattaaagtttctatgtaaatttttaattaatctggcctattgagctttcactctactcaaaaagagacctgcaaaagctccaagtcatgtgttggttggatgagttaataaggaccattgtcctacatatgtactcttatcgcatggattaagatttatgtggtagtaaattattttatttttgatcaatagaatatccgcgacgctagagttttatcagaattcaaaaatacttttaattagtggatatttagatttcatttgcaggttaattacaaatttccgactagaatacaacaattttaattcgttttaaaatgtttattatagtttagatattattttgtcacgaatactatatatatgccacctatgtgttaaaattttcataaattaccaagaaaaagtatgattttgtccttttgaaatgaaaatcaatcaaaaaatttatatacacatttgaatatctaatgaattttagttgaaattttggaaagacacaattcagtaataaaatgtgtatttctttgattttttttgttttgtgtggtcaaattcgttggaaatacttaaaaatgtgttgaaaattgaaatgattaatcttaattacatcacatgaatattgactaaaatgaaataatagtatatgatatgttgccataaatgttatgatgaattaactttataattttcgccgtttataataaaccgtcaaatcaaaggaaccgttacttctcaacactcacttcttcttcttcttcttcttctttttcttcttctttttctttctatctctctctatcttctctctaatgtccgaggaattgaaccagtgatttggtgatctcaaagactctcaaaaatttcgtgtttgatctttgtctattttcatttgttcgcttcgggttataagttaacttcaccgttggataaaag

SEQ ID NO: 4161 - DNA, 3000 bp, Unknown
  misc_feature (1)..( 3000): cDNA_ID_1807575_gDNA_ID_1620687_Annot_ID_164645 3000 nt of promoter + ATG
agaatgggttgtatgtgaaagcaacaaccaaagttagacccatcctgaatatatcattcctctgatacggtctctttaactttgtgggtttttttttttttccttgaatagcttttgttttatatattattggatttctcaactttatttatccactttgaattgataactacaactctacaagctacagccatcctaacgaaaactgaaatatcttattctccttttaaagtgaaacgttgttctcgttcaccatcaagaaggataatatatacaacaagatcaagataagtaatactagtgaaacggtttctgtaatgacattagaaaaaccgagacaccaaaaaacgtgaaaactttaacagagattcggttattagtgcgaagttcgatatttgatcaaaatcaacacatttgtaacgtctagatggtgagtaaacagcagcacacaatgacacacaaacaaaaaaaacactaatccattatacaacaattgatcctaccgtcaacctggtgggctgagatgggctgttaggagataataaatataggcctggataaatcattttttaagtactggtgcaataagtaagttgtcttcactttgagttcaagttttgttcatactgaagcttttttctttttcttttcacaatcctactatatatatacgtttttaagtaagattcaccgtatatatttattttctttggtagggaaagattcagcgtataataataattagcagtggtcaacagggtaaaaaacaacagtaagtagatttgtaaaccgggattaagaatatagatttcaatgataggaaacagagaagaaagcataaaataaggatagaagacaagagaagctataggtacaccaaactctccaatctaaaagaagaatccaaagaaagctgggccaaagagaatccaatgggttataatatggctcatcactaagtcagtcatgtaattaagattatgtatatatatatggacaaatttgtatgcaactattttcatctatatttaaattccttatcatttggtcgattgataatgcttacgtaaataatgtcttgttctggatatttccgtttgtgtctctatattgtcccggtggttgaatgttctactcctagacataaactagaaaataatcatctaatgtataattttaaaaataaatgattattatactggtaaattttttaaattaatgagctttgttagtaaaaaatctcaacttaattaatcaaaaaatcatctaatgtaaattattcttttctgtaatatatatatatatatatatatatatataattcaagtattagaatatttaaattttgtgagtattaatctaattttcctatcatctaatgacaataaataaaatgtatctatatttgtgtgaatatggactttttggtatttagatagactgcttctgcttggtctcgatacttgacttagggtcgcacatgcaaacctcattattttcttccataatgttgacaattaaaaaaattaccgaaacgaaaacactttccggaaaaaacgatgaggcgttatatcatttaaagaaaaaacgacgatactaattaaataaacaaaagttccgataatttttacgtataggttacgaagacaatgacttgaatagaattgtgaagcaagtataaatttcaagttttggctgaaaaattaaagtaataatttgtgtattagtgtaaaaaaaaaagtcacagaattaagtagaagagctaattatttacacgttccgacaaaacactactacgcccccgactacgatacggcatgagtcatgaccacatattatatttttctttatcttcatgtttttgtcgaccatggtcacatttcattgtttggcctggttattcgacagagatcaattttattggcaattaatgagtcagattagatcatattaaaatctaagtgcgcccgtggaacatgggcggcggacaccgaccacctacaaattctactgtttaaacgacacgtggaaactatttattttctttttgggtcgccgctccttaacttataagtcctgactggcccaacaattttttttttctttttggtttttcttaaaggtttcttattgaattagatgatagggattgcaaaagacggtgaagctaatactcttctatagaataattgagaaaaatataacctagaatgtgtcagaaaagttagatcgcaaccaaaatttatcaatcaacggaatgtcagttaatcggtcaggaaaagaggcaattaaaagtgtttatttattttgccacaagtgctctttatcgcatttttaaaaagttgtataccaccattttgactgttgacccaaaaatataacacaaattggactaaaaaagcataaggaaaaaacttttcggtgtaaacaaaatacataacttgaagaatggatattgaaaagaaaaaagtaattcagtttcttgaaaagtaccaaccaacgactataaaaaaaaactaacaatctacttcattgatacgatcaaactagctgttaatatttgtatcaagtcgattgcatccagacatgttatttccataaaataaaatagcaacggctctctccaactataaatcaaataacatttagattatggtaatgtaaatattcagatatggaagtagccgtttaaccgtatgtgaaatctcaaacggtcaatttccaaattaggaactaaaataaccgttggttaaatagtttcctttaacgattgtcaaagaatcattaccgtcttcttatttgtcttttcctttgtaatgaaactatatattataatttcaatatagaacaaaagaataacataaattaagttttttttgtccttttctgcctttacctttccttctactcccgaaaaagcactgactttgctctgtttccttcgttcacacagagaaagagagaaatcttctgagcgaaattctgacaaaagagatgatg

SEQ ID NO: 4162 - DNA, 1335 bp, Unknown; identical to SEQ ID NO: 4150
  misc_feature (1)..( 1335): cDNA_ID_3043238_gDNA_ID_1620687_Annot_ID_164639 3000 nt of promoter + ATG

SEQ ID NO: 4163 - DNA, 52 bp, Unknown
  misc_feature (1)..( 52): cDNA_ID_2140554_gDNA_ID_1620687_Annot_ID_164669 3000 nt of promoter + ATG
ttctggttttacttgagagagtttttcaattctgatctgctgttttgcgatg

SEQ ID NO: 4164 - DNA, 3000 bp, Unknown; identical to SEQ ID NO: 3912
  misc_feature (1)..( 3000): cDNA_ID_2999332_gDNA_ID_1620687_Annot_ID_164668 3000 nt of promoter + ATG

SEQ ID NO: 4165 - DNA, 3000 bp, Unknown; identical to SEQ ID NO: 3936
  misc_feature (1)..( 3000): cDNA_ID_1011433_gDNA_ID_1620687_Annot_ID_164667 3000 nt of promoter + ATG

SEQ ID NO: 4166 - DNA, 3000 bp, Unknown; identical to SEQ ID NO: 3911
  misc_feature (1)..( 3000): cDNA_ID_3093332_gDNA_ID_1620687_Annot_ID_164666 3000 nt of promoter + ATG

SEQ ID NO: 4167 - DNA, 3000 bp, Unknown
  misc_feature (1)..( 3000): cDNA_ID_3072668_gDNA_ID_1620687_Annot_ID_164665 3000 nt of promoter + ATG
atcttgtattgaatgttttttccgtgtttgattttgggaagttggaaaaagttaggtttttttagtgtgttgatgcttcttagttctgggtattctcagtttcttaattttgtagaaaaaaacaaaaactttgatctgtgtttgagaaatttccgatctgggcttttctaagatgtaagtatctgattaaagtctgtttttttttcaatcggcaaaaagcaaaacggcggcgaagatggctgtggctcgtataaagcttataaggaacaagagattagttgtggtgaagcaaatgaggcgtgacatcgctgttcttcttcaatccggtcaagatgccactgctcgaatcagagtatttcactttcctggttcactttgttagagttttccctggatcgttcaattcaatgaagattttgctttttttgacaaatttaggttgagcatgtgataagggaacagaacattcaggcagcaaacgaaatcattgagcttttctgtgaacttattgtttctcgtctcactatcatcactaagcaaaagtatgttcatatctactatcagttttcatttgtctctttgctttgcttcagtttggcttcttatatgtgtatgtgtttggctttcttttaggcaatgtcctgtggatcttaaggaaggtattgctagtttgatttttgctgcgcctagatgctctgaaattcctgagcttggagatcttagagacatctttgcgaagaaatatgggaaagattttgtatctgctgctactgatttgcgtcctagctgcggtgttaaccggatggtaactaaatcattcatgtttctgattagtctaacttgaactgtgattcgtttttagatgcaagatgaaatcgaacttgttttcttctttcttgtgcgtttgtagttgattgataagctttcggttagaaatcccggtggagaatacaaactgaaaatcatgaaggaaattgcaaaggaattccaggttgattgggatactacagagacagagcaagaacttctcaaacctcaagaagaaagcatagtatgtctcttaatctcccctctcaacttcctctttcattattcaaaatcagaatcttagaagctgtgttcttcttgcaggacgggccacgtaagtttgttagcgcttcaagcttaccagttaatcgtgcagctatcaacgagcctattgatcctaccaaagcagtgccaaggtatgtatccattccagtcgttagcttgaaataagggatctgaaacaatgaagtcttattgttgttttgctcatcagatcgactagtagcatgagcatcaacacgcattatcatgacaccgagtcagcagcggaagcagctacagaattagccaaacaggcagttgcagcagcacaagtagcctccttattagctaccagaagagacagcagcaacaaggagttctctgtatcttctgatcattcaacacaccagaaggattcacagtacatggatcatcatcatcatcatccaggttcaagaagacaatcacgagactccgaaacaagttcctattacgcaaaacctggtgcagaaaacagaggaatgggtaggagacacagctacaacaatccgggtattaatgaatctgactacgaggaagagtataccaataccgaagcagaagcaaaagaaacaatgaggaggagacacagctacaaccctcgatcagttcctcctcctgcaacttctgagatcaagtttgatgagtcagactactacgaggaagagacagagccagatgaaccatcacagggtcgtgtttcttctctcccgccaaaccgagcaccgcctcaggctcctcagtccggtgagtccagacaggactcgagcggtcaccaggttcacccaaaactgcctgactatgatattttggctgcacgttttgaagcaatcagacacagtaaagggccattgatctgaagccaataacttccactactgctatatacatagaaagaaatcatgtacgggataatgcaactatcatgtttagttttgtttatgaagaggaagaagaaagatgcattttttgtttactgagtactttactatatataacggttcggttttgttatgatcttgtctaaaagactaaaactatagttaaaccggtccaggaaatctaaattggaaactggcttttcagaaatccaaagtattgtatagattcagtgcaaaactgtaaccggaacaattagttattaatcttcatactagggaatgcttatctaatttaatggtgctgcaagagtggagacgaaagtagaattcggacaaaaatcagaaaccaagatgaagatttcatggacattatacttcacaggggacaaatctgtgccttaaacttaactggcgcaatttggtggattagtttatcacagctcagcctcgttgaattcacaccttcaactccaatggactactactacgaatatgatagttgcaaagacaagagattcgtggagtattgtgaatttgtggagatctatgcattattaatcaactttgcgcaaaggaagcttatatcgagaggaccattggttttaaggtttttattagatggaagaggatttggcaaattgggttgaggttagttccttggaagacaaggctctcattgtagcaaaatcttttatttcatttaatgtcatttataatttattaacaaaaattggccgaactaaattaagaaaactttatataaatattaatatatatataatgtcattggtataaaagagacttttattaagaaggaaaataaattataaacttcaaaaagtgcatcttaacatttaattttttttccacttattgacacttttttggtctatatagaaatttggactagacaataaataaaaatattcaccaataaactaatcttagtcaagtcaagaagtgaaaattaattgttaacaatactttcctatataaagggtattgatatatt

SEQ ID NO: 4168 - DNA, 3000 bp, Unknown
  misc_feature (1)..( 3000): cDNA_ID_2140539_gDNA_ID_1620687_Annot_ID_164664 3000 nt of promoter + ATG
tagactcgaggacaatagtccgtgacagtctctctggtctcaccgagctttacagatgtttaagtgaagatctcttcaagtcttcttctgaaactcaacaagcccttcttaatggtgatggtttgatggaagagcttcttgaagtatcactgaaatacttagaggtttgtggaggagctaaggacgcagcttcgaggatcaagaagattgttgtcgagcttcagtctgctttgagaaggagcaagaaaggaggtgagtttagcctcgagagtgacgtggatgcttatgtggcgtctaggaaagagatcaagcaggagatcaagaagtatatggtaatgtcgaaagagacagatgcgtctttggagagtgtttggtgtgatggcgatgatcaagagatgagtgctttagttagagtgatgcaagagacgagtgtaatgacttgtttcgtcttacgctcggtcttctcgttcttgtcgtcgcctaaagggttaaagactaagaatcatcatcaccacaaaggttgggggattgttatgaagcttgtgaagaaaggaatagaacatcatcaccaggagaaaagagattacgagacgggattttcttgtctcgtgcttgaagctatggaatctgagcttgggaagctcgttgtgatgatgacaagggaagatcaagaagaagagaaaaagattagtgaagaagtatctgagagggttcaatgtgcattggttagatccgaaggtgtagaggcagccatggaagagcttgaagagggacttgaaggattgttcaaggtaatgatacaagctagagtctctcttcttaacatcctctccacttaaaatggatcagattcgaatttcttggtctggattggaaataagttagttgctacttgaccagtcgattggttttaaaatcttggtttggtttttgtttgtttgttcttgtatgttgtgagagagagtttaaacatgcgtccatgttttagaggatgtgtgtttgttgtaagtgtgtaacccgttcaggtgtgaaaaactcttgtaaagttttatgtacgtaagcatctttattgcacaaataaaagaggtgtcttttaacaatattttaaaaaatttaaacaacaaaatattaatagttaaatatgaaaggtctttaattttaagacatctttttcaaaaatgtttccacaaagacacttaagacacagtgtctaaaatttaaggacacacaaacattataatgttatatacttttatatatattaattttattcgtgggaagaccctctctaatgatgtgggatggagatgacctaaatatctattattttaccacgtagaacgataaatttaaggagagaaagacgaaatgcaaaagcactaactttaatgtttagaataggataaattactgaatagtattattttttcgtaagaaaagcaatttagctatatagcatagcgttgaagtaaataattaatcaaatgtcacaattttctcaaaatgaaaaaccaaaaagaaatgggctaaaattaaagaggcaaaagtaatcatattaaaatgtcatccaaaaattacataaacaaacaaaatcatccattgatatcgagaatgtcatgaattttgctggtagacttttgacaaacctttcttagaattgataatgacaggaacttttgttaaatgacccaacttaacattttattttcttattttccttagaaaattagtcgataaatctttcactttcttttgaaataatgaaccattaaaaatagaattcagtggctaaaaatgggattgagagtgagcgccacatacggtggcagtacttcgaaagaatttatttgtcttagtttgattcacacaattctcacttaagtaggaaaccatattaaacactagtacttttacaatttagttggaggcgttaggacaaacgcaataacagcctgtaccaaaacataattctttgcattttggcgtacaaaaactaagctcattttgcttaatcgatagtggagcttcatgatgcacagatgcttcactagtggttagagattgaagattaggacaaacgcaataacaacttgtagcaaaacataactctttgcattctggcgtacaaaaaccaactccattttgtttaaccaatattgaagctttaagattcagagaagttttttcagataagagacgtttcgcctcagcaatctgaactgtcacggataccatcactacaagatataaatgtagtaaacattagtaacacaatacaattctttataaccatatcattatactacaaaaacattaattttaccagtaaaagctaaaaggatgatgaaagcagacttggatgaaaattttcccatcgtcgtagaaagattatgtttcttcttgataacttttttagacttactagaaagagttggtgaagaaaacgatgtgatatagacaatgttgtataacgttttttataggacagagaaagtgtactaatttaggaagattaatatcaaattgttgctttgtggtgaaaattaaaatgatatcgataatgagataagataagatcaaatctcctaatatggtcgacaatccaattgacaattgttacctaataagatttctactattaatgagaagatcttcaaattattcgctgtattgataaaagtttttaaaaagttagtttgactcaaaagaagcccattaccaaagcccatctaagcccattatgtaatcaatcaacaagccacggtgttgcttaggatgctgctcgttgggtttttggcaacgtgtgtaagatacaacggctatattttgacatggtccaagtccagctatcataagtcggtgtgttcttgtgggacctctaaaagagcgttactttcctaatttcagcggaccgttacatacacactcgcacacactagccttcgtcttcttctacatctctttcttcttctgtgtcagagacgctgtggtgaaaagaaa

SEQ ID NO: 4169 - DNA, 3 bp, Unknown
  misc_feature (1)..( 3): cDNA_ID_3093287_gDNA_ID_1620687_Annot_ID_164638 3000 nt of promoter + ATG
gaa

SEQ ID NO: 4170 - DNA, 3000 bp, Unknown; identical to SEQ ID NO: 4156
  misc_feature (1)..( 3000): cDNA_ID_1807632_gDNA_ID_1620687_Annot_ID_48482 3000 nt of promoter + ATG

SEQ ID NO: 4171 - DNA, 3000 bp, Unknown
  misc_feature (1)..( 3000): cDNA_ID_1823172_gDNA_ID_1620687_Annot_ID_48485 3000 nt of promoter + ATG
aacactaccgtacctagtacttatacattcaatagattttcatcatcgccatttcacgatggtacacatcaaatcaatccacttttctaatcttttttttttttttgttacgtgtttattctaacatttttttttatgtgttttagaaaaccatattggatatttcgatcttgataaattttctctgttttggtattgtatacggcaaaaattacaacgtactcaattttgatgccaaaggagatggtcaaactgatgattcagaggtaaaatatgttttgactttattttctctctacccaaaatatgtgactttttgataaatacatttttcttgtaatcaattagtactattttggctattaatatttttaaaaataattatgttaaaaaggcttttctacaagcatggactgctgcatgtggcggagacggggacataaaaacacttcttataccttccggcaaaacatttttacttcaacctactgtgtttcaaggcccatgtaaatctagttcgataaaagttcaggtaagtttatgttatatatatagacctatcttattcatcatatatatatagacgactaatccacaaatgtatatgatgaataagtttatgtttaattaagaaaatcaatcaaatttgtattttctcatttgaagttggatggcaccatcgttgcacctagtgacaaattcgcatggtcggaccccatctcccgaatgtggatcaaattttcaactgtgtctggcctaataatcgttggttcgggaaccattgatagtcgtggttcatctttttgggaggtgacaatttgatatatcataatttatattaattttaaaatataattttgttcattgcaatatcaaaatcactgagattttttttttttttttgcagcttaatctgaaagcttctcaacgacctacagtgagtatatctattaattttactatacattttttggaaattttgtttctgaattctgattatgattgcttttaatttattattaaataaaccactttttgtaggcattacatatcagcaaatgtgacaaccttaggataaacgggataacatcgattgatagtccaaaaaatcatatatcaatcaaaacatgtaatactgttgcaatatcaaatataaatctttttgcacctgagacaagtcccaatacagatgggattgatataagtgactcgactaatatcaacatatttgactctacaattcaaactggtgcgtacttatctataaatcgctcatgcattttatcaacacatgaatactacaccaaacgaactataaattattcaactactaagttttactatagctccaacttttatgtatttgttaatttataatattttttagactatgaaatatagcatagtaaaaatcatttgaatttcaatgactaaattttcaggtgacgattgtatagcaatcaatagtggaagttctaatattaacatcactggaatcaattgtggacctggtcatgggataaggtaattcataattttaagcttacttgcacataaaaaagatatgacataatttattaaaattattatcggaaaacagtgtggggagtttaggagcaggtggagcagaagctaaagtgagtgatgttcaagtgacacattgcactttcaatcagacgacgaatggagctagaatcaagacatggctggtattttctttctttcttttatactacgtcttatagttacactaatattaatcattcaaaatgtgttacatgtattgttacttttgaatttagggtggacaaggatatgcaagaaacataagttttacggacatcacactcgttaacacaaaaaatccaattataatcgaccaacattatatagataaaggacgtcttacagaggtaaatacttttttaataatttataaatacaaatatatttatattaatactaattttgaaagtatcattaaattgtgaaaatatatgattgcatgtgtttatgttcaacaggaatcagcagtagctattagtaatgtaaaatttgtcgattttcgcggaacatcgtcaaataaaaatgctataacgcttaaatgtagcgaaactacacattgtgtagacgtcgttatggatggaattgatattaccatggcaaatggaggaaagcctaaagttaattgtcaatatgttgatggagagtccagtgacactgatttgatgcgagactgctttaaaaataacactagttcttgattgagaatgtacatcaatagtcaaaagtttacccacgttttcaatttctactgtcgtgaaatgatatttgaatgtcaattttttttattaattgttattactcatcacagaatgtctgtatgaaatcacacaatagaaatcaattgatgtctttcaaacggttgatttacagtcacagaatttgctgccttggcaatcaaaactaaatacttctgttttgttatatcattttttgtcttttaaggaagagaaaaacgagaaatatttaatcgcaactaacctgaagattcctccaattgtttacgcaactcttacttttaattttattaaagcctttgtaacataagacaagctagccttggttctttgaagcaggacacatttttagatctctctaaaccaaaattatatttatcgtgacacacacaaaaaacagttggtatcgaaacaaacgaacaagaaactgaatttaaaaattaagttgcgagacaaagttgtatagatgcataagaagaagacaagaaggaacatgagttccaagagtcactgaccataactgatgaatttattcatgttagaaacaaacagatcagattaagtgacccatgttcttcacacatgttcccacattgtttaacccgaggatcgctctgtttgtgagcttctttgcaatatatatagaaaccctcaagaaccctaatagagcatctcaatccaattaagagttctgaaaaaa

SEQ ID NO: 4172 - DNA, 3000 bp, Unknown
  misc_feature (1)..( 3000): cDNA_ID_1823154_gDNA_ID_1620687_Annot_ID_48490 3000 nt of promoter + ATG
gtgctttagttagagtgatgcaagagacgagtgtaatgacttgtttcgtcttacgctcggtcttctcgttcttgtcgtcgcctaaagggttaaagactaagaatcatcatcaccacaaaggttgggggattgttatgaagcttgtgaagaaaggaatagaacatcatcaccaggagaaaagagattacgagacgggattttcttgtctcgtgcttgaagctatggaatctgagcttgggaagctcgttgtgatgatgacaagggaagatcaagaagaagagaaaaagattagtgaagaagtatctgagagggttcaatgtgcattggttagatccgaaggtgtagaggcagccatggaagagcttgaagagggacttgaaggattgttcaaggtaatgatacaagctagagtctctcttcttaacatcctctccacttaaaatggatcagattcgaatttcttggtctggattggaaataagttagttgctacttgaccagtcgattggttttaaaatcttggtttggtttttgtttgtttgttcttgtatgttgtgagagagagtttaaacatgcgtccatgttttagaggatgtgtgtttgttgtaagtgtgtaacccgttcaggtgtgaaaaactcttgtaaagttttatgtacgtaagcatctttattgcacaaataaaagaggtgtcttttaacaatattttaaaaaatttaaacaacaaaatattaatagttaaatatgaaaggtctttaattttaagacatctttttcaaaaatgtttccacaaagacacttaagacacagtgtctaaaatttaaggacacacaaacattataatgttatatacttttatatatattaattttattcgtgggaagaccctctctaatgatgtgggatggagatgacctaaatatctattattttaccacgtagaacgataaatttaaggagagaaagacgaaatgcaaaagcactaactttaatgtttagaataggataaattactgaatagtattattttttcgtaagaaaagcaatttagctatatagcatagcgttgaagtaaataattaatcaaatgtcacaattttctcaaaatgaaaaaccaaaaagaaatgggctaaaattaaagaggcaaaagtaatcatattaaaatgtcatccaaaaattacataaacaaacaaaatcatccattgatatcgagaatgtcatgaattttgctggtagacttttgacaaacctttcttagaattgataatgacaggaacttttgttaaatgacccaacttaacattttattttcttattttccttagaaaattagtcgataaatctttcactttcttttgaaataatgaaccattaaaaatagaattcagtggctaaaaatgggattgagagtgagcgccacatacggtggcagtacttcgaaagaatttatttgtcttagtttgattcacacaattctcacttaagtaggaaaccatattaaacactagtacttttacaatttagttggaggcgttaggacaaacgcaataacagcctgtaccaaaacataattctttgcattttggcgtacaaaaactaagctcattttgcttaatcgatagtggagcttcatgatgcacagatgcttcactagtggttagagattgaagattaggacaaacgcaataacaacttgtagcaaaacataactctttgcattctggcgtacaaaaaccaactccattttgtttaaccaatattgaagctttaagattcagagaagttttttcagataagagacgtttcgcctcagcaatctgaactgtcacggataccatcactacaagatataaatgtagtaaacattagtaacacaatacaattctttataaccatatcattatactacaaaaacattaattttaccagtaaaagctaaaaggatgatgaaagcagacttggatgaaaattttcccatcgtcgtagaaagattatgtttcttcttgataacttttttagacttactagaaagagttggtgaagaaaacgatgtgatatagacaatgttgtataacgttttttataggacagagaaagtgtactaatttaggaagattaatatcaaattgttgctttgtggtgaaaattaaaatgatatcgataatgagataagataagatcaaatctcctaatatggtcgacaatccaattgacaattgttacctaataagatttctactattaatgagaagatcttcaaattattcgctgtattgataaaagtttttaaaaagttagtttgactcaaaagaagcccattaccaaagcccatctaagcccattatgtaatcaatcaacaagccacggtgttgcttaggatgctgctcgttgggtttttggcaacgtgtgtaagatacaacggctatattttgacatggtccaagtccagctatcataagtcggtgtgttcttgtgggacctctaaaagagcgttactttcctaatttcagcggaccgttacatacacactcgcacacactagccttcgtcttcttctacatctctttcttcttctgtgtcagagacgctgtggtgaaaagaaaatgacggcggccgaagtagcttctgcgcagaccaagaagctcatgaagtttagtctttctctcttccgtcgtggctttaactcctctaaatggtactcaattttatttgatttgatgcttcttagattcctaaattcactcaatctgctacactgcgaagaaaaatcttgtattgaatgttttttccgtgtttgattttgggaagttggaaaaagttaggtttttttagtgtgttgatgcttcttagttctgggtattctcagtttcttaattttgtagaaaaaaacaaaaactttgatctgtgtttgagaaatttccgatctgggcttttctaagatgtaagtatctgattaaagtctgtttttttttcaatcggcaaaaagcaaaacggcggcgaag

SEQ ID NO: 4173 - DNA, 3000 bp, Unknown; identical to SEQ ID NO: 3911
  misc_feature (1)..( 3000): cDNA_ID_3093332_gDNA_ID_1620687_Annot_ID_48492 3000 nt of promoter + ATG

SEQ ID NO: 4174 - DNA, 3000 bp, Unknown; identical to SEQ ID NO: 3912
  misc_feature (1)..( 3000): cDNA_ID_2999332_gDNA_ID_1620687_Annot_ID_48494 3000 nt of promoter + ATG

SEQ ID NO: 4175 - DNA, 52 bp, Unknown; identical to SEQ ID NO: 4163
  misc_feature (1)..( 52): cDNA_ID_1823142_gDNA_ID_1620687_Annot_ID_48495 3000 nt of promoter + ATG

SEQ ID NO: 4176 - DNA, 3000 bp, Unknown
  misc_feature (1)..( 3000): cDNA_ID_2993363_gDNA_ID_1620689_Annot_ID_48522 3000 nt of promoter + ATG
tccaatagttcaatcttttgatcgtcgttttgactgagttaattagagctagatcttagtcaatggctcatgttacatttattttcacagatccagaagaaaaaaaaattctgtctaagtaccagctaggctggttattggatagtgttagcgatccaagacactgatggaggcaaatcattgtaatgggctcatagttgctgttaatggatctggtgcttctcaaatatttcatttggttgcagtctaacacaagtttgcgttagagtgttagtggcaaaagctgaaagtttcaagcccttatggtgcaagattgatttatgccacagatcaaatgttgtggaagcggtgcgcattgcatcctttgtggatcaaaccattctctttgttcgaagaagtgtaaagaatgtgtcaagaattttggcagcagagacgtgactagtaactttgtagctaagttcatttcttttaggaacattaaagttggcccaagatttatttacttgtaggattttgttggcgttttgccatatcagctttatctttacctttttatggatgtttccatcttaaaaagtacaagatccaagtttctctctatgtagaaagatgagcttgaaattgatttcttatccaaaaggtgaaccatatatagacacatacactagactctttgctcaaggtccgtggctaagggggattttaaatttaccatttttgctagtatttaaaccatgagtctcagtctcaccattattttaacaatttgatcagcaaacatatagaagaacaatttcagagctccaaggctacatgaatttgcatcaagactccaaataattggttccagtttcagagctctgctctagatgaaaacaatgatctctaattaactcctttcattttgggtttcataatgacaataaatatgacaatgctttaaacaaaaaaaacatgtaaagtaataaatgaaaatgagcttggcagagtaattaacgcattattattagggagttgtaacgtacacgaatttgcgttaggcgaaaagagaatagtggacataaaactttgtcacatgctttgccatcacgcccatcaccttataaccatcgactctgaccaaaattattattttaaattttgtatttataaacaaaaactttgatgttgaagacgtctatattgatctcatttggcagaaattgtgaaggtaaagaaacaaagtagaaataaattgtgagaatgaggagcataatagtatcactacagctaaaccaggattaaaactagaaatgatttcaatttttagaaacgatatgatagagtggcaaattaactcttgaaaaaatactccatatgtttcacaaacaatgtcgttttgacactttactaaacttatacggtaccaaaaccgtgaaaataacgtcaatcatcatcaatcatttagagagaaattaaataaactattgtgtatataattgaattaaattaaatgaactaatacatgtatccaatatgatcatgaactgtactgtccctagttgagttccgttttatttcatcattaaaaacccaataacgaaagaggaattaaaaacatatatacggtgaacacgcatgcaagaaatttgtgcaataggtttacacttagcaggaaaagaggaacaaaaaacaattagttataataactgataactgaaataagtttatgacaactgaaaacaaaataaaataaaaactaacggcaaaatctaacattgacgacgttgtaaggaatgggtgctgaaatgtttttatacagacatttcaaccgcacggcatctccatattactacgtactagtccagtcaatcagtattctcacacgtgaaaaacgacactttgcgttttcacatctagataagattgccttttctttagatcaaattttcattttaccattaatcaagctataaaagtgaacatatttacaatatttacgatgatatgttatatatttagttcgttacatcatctaataagtttgcaatttcattttccaaacgggtaactagtaaatgttcaattcaatttctgtcaaattatacatgcgaattaggaaatgaagtttgtttatcttttctgcatgtgaaagtattatttgtttatcttagtgaacttggattgtgggatacattcattatccatccaaaatatgggattttttctgcttgactatttattattagtttgcttgtatatcctaaagtataggcatggaatcggcgtatttgattttgattccttttaaaccaataccttttacgatcttttcttattcatttccttgtttcttaagtcaagtttcagatacatacctaaacacaattgtggatcgttatggagtatttttacaaatttacgacaatatatatgcgtaagaccagaggacctataggtatgggtttcttaggaaaccgatataaattgatatagattatagaactacatacaaacataggttttacacattgtttattagttttaagaaaaaacaataaaatcatttaaaagaagtagtgatttgatattttttttgttttgctgtaaatgaaccagaaaggtcttatttaaggaaatatattaaaacttctacattaaataacagtttataaaccttcacagatagaatcatagaaaagaaggaaaaaaaaagtgtggtggttaggaaaaaatatacgatgtgaaatgtttaactacaacttgctatatcgaaaacctttacttgtaagtccgtaatcatcgaaacttaattcttgttagagaaaataaaaacagtgcagccaaattaccctaaaattacgtgaaacatctcatgacatgacattacgtacccaacttaacttccatgcaatatctataaataccctcatgagtcacatttcatgcaaaatcaagaaactctcaaaacccatttcaaaagagaaacacttctttaaaaagttttattaataaataatg

SEQ ID NO: 4177 - DNA, 3000 bp, Unknown
  misc_feature (1)..( 3000): cDNA_ID_4257546_gDNA_ID_1620689_Annot_ID_164699 3000 nt of promoter + ATG
atcttgtttaaatctggagttgatttttcaatatccgttagtccgaataattacgaataaatagaacgtgatttcaagaaaatcgttgattagtagcaatcttagaagcaaagctagaacgtgatttggtgatttgttttacaagttacctaattttagccatatggaccgcacatgaatgatgggcggtctcaaagcaatatttccaaaatggtcttttaataattggtctttttttccatttctgcgtaacactttcgtttgacgttttgtttaaatttatttttcagataattagtatacacttgctgttacattagctagctagccttcgactttatgcttttaggttggactcaccataccgtttaataatagtttcaaatcattatatatatatatatatatatctttttcctgtcaaaaaatattaaatctatcaagaaagtgaaattaggttgtagcttagttaccaccaaccccgcttccgcatggtcgttaaaccttatgatctttctaatttatatcttaaatataaatcggcaaaacatcaacaacccattagatatgtccctcaaactttgaaaacgattatccaaataaattatttattaaaacaagtgaataatacttctatataaatgggtttaagcctccttcattaaacacatctcacaactcactaatctctagctaaccatggcatttctagtagagaaacaactcttcaaagccctcttctcattcttcttattagttttactcttctccgataccgtcttatctttccgaaaaacaatcgaccagaaaaaaccctgcaaacacttctcgttctatttccatgacatcctctacgatggcgacaatgtagcaaacgcaacctccgccgccatcgtgagccctccaggactaggaaacttcaagttcggtaagtttgtgatctttgatgggcccataacaatggacaagaactatctctcaaaacccgtggctcgcgcacaaggcttctatttctatgacatgaagatggacttcaattcgtggttttcctacacgttggtgtttaactcaacggaacacaaagggacattgaacataatgggtgctgatttgatgatggagccaacaagagatctatcggtcgttggtgggacaggtgacttcttcatggctcgtgggatcgctaccttcgtgactgatttatttcaaggggctaagtatttccgagttaagatggatattaagctctatgaatgttactaagtagctaagaatgtgtgttttgtttgaaaattttatgttgacacagagaaatgtgtttacaataattaagttttttttttgccttttcttttgctgttgtctttttgtttatctataattattatgtgatttatttcaaggggataagtatttccgagttaagatggatattaagctctatgaatgttactaactagcgaataatatttgttttgtttgaaaattggtatgtacacagagataatgtgttactaataagtagtgtttttttttgtggcctttttatttggtgttgtctttttgtttatcaatagtcaattatttctgtcaaagaaatatatttttgggatgtctcttcttcattagataagaagatatatatgtttcttcttcattagatcccaagtacttgcaatcccattttatcaggccgatctaagctggaccaagtagaataatatataggtccattaatgatccatcttgccgaaagtggttgctaactttttttcaactggtcagtggaattgtgtataatccgttattttttttgtctttctctatttggggtatgggctatgaatttaagggaattcgtaatctctatatgaattttgaaggggttctcttgattttatggattcatagtataatggcccaacggcaagggcagatatagtgtggggatatcaacgctttgaacagaaatggtatggtttcaagataagtgaaagcttaagtatcagataaacattgattagctttcgcatatagtaaacaaatacaatgtcaaagtttgtacttatgataaagaccaaaccattttgttactaatgtatattccgagaaaatataacaaattaggagattcttaattaaaatatatatggtaaattaaaacatgttaactcgatgttaatatatgattcgattgttcataaagctctcattcggtgtcgtaacttgattgtattcatcttataagatgcaattatgtcaacaatgatcgatgaatggtccatactcgatataccaatattaaaatataaaggaaatcaataccaaactatataataactacggactatactctagacacaaaattgtcattttccaatcccaataacataattaaaataaatctcaaagatagtatgggcaatagatttccacccttttacattattttaggtctcgaaaattgttatggtttgacagaccaaatcataaacgtagttcggccaatcatttcaaaccaaatccgaactactaaatgcatcaccatgctatgaaatggatctcattctatttatataatttttaaaaaaaattcaaagtctcgtatgaaatcaaaaatggtaaacaatcatagaaaatttcttccatttcttggtaaaaatatatttttatgtcataattatcttctaaaggatgttgtggcaactacccacattaataacgtggtggtcgaaaatcagcctaccaattaaagtacacatttttatgacgagttgatgacccatcagtgcccattaaataatacgtacgttaaaaaagatgaagaaaagaagattctagcatgcactatcaaatgataaaaagaaacggtaaaaactatgtttttaactgtcagattcactatataaaccacggcgacgacaagtggtatctcatcaaccaaaacaaaacataaaaaacaagtggaagctttaaaacgagagggagagagcaaaaatg

SEQ ID NO: 4178 - DNA, 3000 bp, Unknown
  misc_feature (1)..( 3000): cDNA_ID_4257564_gDNA_ID_1620689_Annot_ID_164697 3000 nt of promoter + ATG
agagatagacgatgagaccaaaacgttgacgttaagaggacttgagggtcacgtgatggagcagctcaaagtgtacgacgtcgtctaccaattcattcccaaatctgaggatacctgcatcggcaaaatcactttaatatgggagaagcgcaacgatgattccccagaaccaagcgggtacatgaaattcgtcaagagcttggttgctgacatgggaaaccacgttagcaaaacttaatcatcattcccacagtcgtcgtcgtcatcatcatcatcatcatcatcactatctcgatttataagttatgatgttttcagtataataaatggggtcttgtggatcgttaatttctatgtgtaaaccgtttggttctgtatgatgcttcgatatattgttatgttcatgatcatatgtcgggttcgatataatgattcttaagattaatttactacacatttcagattttcagtgtttatctataatttatgacttttcatatacggattactaaacatctaatggtgttagttaacgatctagtataggtggactaggcaaaattctgaataacagttaagtaaataacacgagtacgtatattatggtcatactcacgtacagggcggccatgagggaagccgggagaaacaaatgtatgtggactccaaaattttccaaaagagaattatttcaaatagatctccgaaaaagatatttttatgaaaaagacccccaaaatttaaaagtgtttatgataactttaaaaaaatattttactattttggccttaattttctaggaaccagtcatactcatgtatatactaaattttaacccgcgattcactgcagaataatttattattaaagttagtttctataaaagtttgtaaattatatatatttataaaatatttatatttatagtttttaatttttattaagtaatgtatatcagaattccacgaaacaattgttaatatacttaggatttaacatgtattaaaacggtatgttaatattattttaaaattttataaatattgattcaaatccatttgacacataatcttgttccaaaataagacctatcccgtaattttttaatttttcccgcaatttgtttttcacctcaattgaactgttatgcccctaatcttgatgacgaattgtctacacaatttcattgtgatagaattctgatattacaaattgccgaaagaccctaaataatctatcgatttaataagttttccatttttctctcaaaataaaggccttcgtattgaaaaaaaatgacaagtgcatcgtttatgcaaaatatttgcttgtttttttctaataatatattctgatatttaaaattcctaaacatggaggaaacgaaccataagaaacggcatctataaatatttatatatttatttatacatgtttatgaaacataaaattttacaaaattcactaaaaattgtaaaacatagaactacaaagttttcactacataacaaattaagtaccccgcttgatctagtataattgtataaattatgttgtaaatgtgcctgattgtaaaattttgagttgacgaccataaacgtggtaccaccagagagatcacccaaaatcggactttgcagtttcatcattataaaattgtaacgtatatatgcgttcaatgattgatgttacaggatccctggaccatgcagatgagtttatttgttttacggaaaatgcaactactctgatgcattcgagatctattattgcttgcttcttaccgaattcaaatacttgaccccactaatccgataaggctaattaatatgtgtctcaccctcatgagttattgccgatcctaacaaatttggaatcctgaaaagaaaaataaaagagtgtttctttcaactagtaataaagcttattttaaaagacgttaactttatccttctaaatagagtcttagaagtataagagagcatgattaatgtcccatataagcattatcaacggctggttccgagtctgaagacaaactatgagcttagaattagaacttcctgagttataaaaattatttttctttttttttgcatgttttaaattgtttttttgtagtgtaaaaacagtagttttttcccagaagataagtaaattagggtttgtttatctgcttccaattctatggctaattaatttggatactaattaaagcgttaacagagaggacgtatgtatttcttaattagactccaagtttttcttggcccatttggatcaaaagaccaattgtatgggcccataaatgacctattctgattactagagattgagtaaacggctccactttttttttatgagcctgtctcatgatctctcattctctcttcaaatctctatcccatatatgtatgtttattagtttgaatttcatttaaaatctaattttaaagtttaaaatgttagtaaaattatttggtgattgattatagtgttagtcaaattattttataatttaaaatgccatccagtaaaattttgaaagtaaaaaaatgtgattttccatatatattattatataccaacattatttgtcctcgcgatcattatgtatggggcattattataccgtatttttcctcgcgattaatatgtatggggcatgaatcatgaaccgtgattatcttctaaaggatgctgtgccaactacccacgtaaataacgtggtccaacattaaatataacaatttaattgaaagctcttcaacaaaaaagttaaaaaacaacacacatctatcattaaatagtgtttgagttaaaaaagaaacagagaagattttaggtatgcactatcaaatgatttaaagaaacggtagaaaccttgtttttaaccgtcacggtccctatataaacctatgagctagcgacgacaagtattcagtataatcaatcagaaaacaagtagaaactttaaaacgagagagagagaaagaaatg

SEQ ID NO: 4179 - DNA, 3000 bp, Unknown
  misc_feature (1)..( 3000): cDNA_ID_1807740_gDNA_ID_1620689_Annot_ID_164695 3000 nt of promoter + ATG
atatatgttacagtactatagttccactgggtttcttactcaggaatctgtttggaagtctttagatattataacgatgttccatgtttcgtcatggatctagttccagagctatgtaaatagatcgatactctgaatctccatcattgttgtataggtcgattgcgttggctgctgatcctggaagccttccaagttttaaatatatggctttatttggttgcggagcattacttcttagaggtgctggttgtactataaatgatctgcttgatcaggacatagatacaaaggtcagtttgtttttaagctatcttatggtatggtgataaagtgatgtcaaatttatatatccctttagtatgttggtttaggaaacatgttttgtgtaactatggtttctgtaaccatggtgggaaagtgttattgctttgacatctggaactggtcttgatttttctatgttggatcaatttacgacaacatttccagtcatatctctgttttgggtaatagcttatctgcatgttctgatgacttcgttcaaaaagtgaaagacttcaggtgttagatatggtgaaggtggaatatgtttttcgattgaaatatgtgtttagtagttagggtagatacacagcattcatgtaactggattcattcttccataaacaaagatgggttgcttgtatgtaaagctcaagattttgtatggttgttttgttttagattatgttgtcttacaaatttcttttatatccaggttgatcgtacaaaactaagacctatcgccagtggtcttttgacaccatttcaagggattggatttctcgggctgcagttgcttttaggcttagggattcttctccaacttaacaattacaggtttgtttggattttttacttgccctaaagtcgcgtatttgcaagtgtttgtttaaaaattcacatacacatatggttcacccttatgtagttggcccaaattctgaagatatgttctcaggtcttgtctttagttttgtgatcaaattcttttctacttgagctcatttcagtatgtatattctgcagccgtgttttaggggcttcatctttgttacttgtcttttcctacccacttatgaagaggtttacattttgggtaatttaaatctattctggcttctcaaagttagacattatatattttctgattttcttatgattgattcgtttttataattgcagcctcaagcctttttaggtttgaccataaactggggagcattgttaggatggactgcagttaaaggaagcatagcaccatctattgtactccctctctatctctccggagtctgctggacccttgtttatgatactatttatgcacatcaggtatattcactttttattttttagcttcaaaatctatttgattatgaccagtagcaaagtagttaatctcaatgtgtgcatattgcttgctttgttttctttttctagcttcaccaccacagatttctttttcagcttttgtttcatgtctcatgcaaatgcatccatttcgatgttcgacttttgtcaatcataaagaagaaaattaccctgatctcccaccttttccatctgatttctatactttaagtgaagagttagccccataaaagtcttcccgtttgcaacagaagtgagaaaagaaagttacctttgtggcccattgaaaatgaaatagtatatgccacaagctacgaacccaaaatttcagctcaagttcagtttttatgcaagtaattttgagatattctaggttaaatcattttttttccatggactaatgtctaatatattgtgtctccaggacaaagaagatgatgtaaaagttggtgttaagtcaacagcccttagattcggtgataatacaaagctttggttaactggatttggcacagcatccataggttttcttgcactttctggattcagtgcagatctcggtactcaataaactttacaaggactcatttgtgattcctaattccatttactgtcttttgattctttttgtttctcgctctaatgattaagggtggcaatattacgcatcactggccgctgcatcaggacagttaggatggcaaatagggacagctgacttatcatctggtgctgactgcagtagaaagtatgaaaatttgggtttatcttttgtactctttcacaatccaattatgtgatttgccttggaaaacctaatagtgtttttatatctgtacagatttgtgtcgaacaagtggtttggtgctattatatttagtggagttgtacttggaagaagttttcaataaagactctctctctgtcaacgaatgaggatgaagctgtagtgtgaggaacctatatatgaagaattgaagtagacttttgagacacactgtaagtgaaacagaggacatggtcttgctacaaagtgggtctccttcaggattgaaatgatcaaggagccattgccagaaaagctgaaacttaactcttttagattagtgactagttactactggttcttgtaaaagaagctattgttgttgtttgggatccatgtcttttcttccaggaggtagtttggctgtatgtatacaatgatcatgaccttctggtcaaacaagaggctttacttttggcttttatagttgacatacgcaatatcattgattttgtaacctaaaggatgttaataacttttcctttttcaatctcaaattgcaaaagattaacattgaattagccgtgtgattgattggagaagtggaaacaactaatatgcagaagatttccacatccactaatttatcttccaatgggacaaatacttttgtttatacgcggttcaactacgtaccaataaaaacacgccacgtggtcatcgtgtctgatctcagacattaaaaagccataagaatcggagatacaatctttctctctcgattgactttattgactgagagaaagcttttgacaatg

SEQ ID NO: 4180 - DNA, 3000 bp, Unknown
  misc_feature (1)..( 3000): cDNA_ID_3072738_gDNA_ID_1620689_Annot_ID_164694 3000 nt of promoter + ATG
ccgtcggatcgtcaggctccggaacaggcggatctcgttccaccacatctactcagcagaatggtcggatcttaggtcggccgatggaggaagtacggagaacctatgagtttggtcgtgagcttggtcgtggccagtttggtgtcacgtacctcgtaactcacaaagagacgaaacaacaggtcgcttgcaagtcaatccctacgcgccgccttgttcacaaagacgacattgaagatgttcgccgtgaagtccagattatgcaccatctcagcggtcaccggtaaatctctttttttgtatctcactggaaaatgcttctttgacattttccgaaatcgaatctgaaacgccttttgttggaatattggtgaatatttagacataggattcgttttctatattaatgaatggtttgcatcatatgtggatgaaaagtttggtggtcctatgttaaactcttgaaaaagtttccctttttgcatatttatatttacctgagtttcaaattggtgagttgattataggaacatagtggacttgaagggagcctacgaggacagacactctgtgaatctgataatggagttgtgtgaaggaggggaattgttcgataggatcatttctaaaggtctttactcagagagagctgctgcggatttgtgtaggcagatggtgatggttgtgcatagttgtcattctatgggtgtaatgcaccgagacttgaagcccgaaaactttctctttcttagtaaagatgagaactcaccattgaaagctacagactttggtctctctgtcttcttcaagccaggtttgaacagcctctatccttccctatttgatttctatagacaatttatccctctaatgaagttgatccattaatgcaggtgataagtttaaggatcttgttggaagtgcatactatgttgccccagaagttctaaaacggaactatggaccagaggctgatatctggagtgctggtgtgattctatacatccttctcagtggtgttccgcctttctggggaggtattgtcttgatcttatttgagaagagaatttggtttcactgtttaaatgttggactggaatgtatagtcacgttctttctgttgtgcagaaaatgaaacggggatctttgatgccattcttcaagggcaacttgatttttcagctgatccatggccagcactatcagatggtgccaaagatcttgtgaggaaaatgttaaaatatgaccctaaagatcggcttacagctgcggaagtgctaagtaagacccctttataacatgttttgatgaataaattgatgaaaacaccttcttttatccaattttaataacgttttgatacatacgcagatcatccgtggattagagaagatggggaggcatcagacaaaccgcttgacaatgcggtgttatccaggatgaaacaattccgggcgatgaacaaactaaaaaaaatggccctgaaggtaattaaaacactgattgaaacagtcttaccatcactattgtagtttatgtagtcttcttgttctaaagccaatctttggttttcgttttgcaatttcaggttatcgctgagaacctttctgaagaagaaatcattggtcttaaagagatgttcaaatctctagacactgataacaatggaatagtcaccttggaggaattgagaaccggtctcccaaaacttggttcaaagatctctgaagctgaaataaggcagttaatggaagcagtaagtctatcacaatccactactttgatgtcaaagcaataatgcttatgatgctttgtttcttttaggctgatatggatggagatggatcaattgattacttggagtttatatcagccacaatgcatatgaacagaatcgaacgtgaggatcacttgtacaccgcattccagttctttgacaatgacaacagcgggtaaaacattgttctttagctctctatttctttctttaacaagctataaataaagtctcactctttgatcttgatttgtgatattagctacataacaatggaagagctagagctagccatgaagaaatacaacatgggtgatgataaatccatcaaagagatcattgctgaagtagacaccgatcgtgtaagtatacgtaaatctctggtttcgtccaattcatacatctgtaagtatacgtgtaagtttaacactctcttctcatctttgtattcgaatctttaggacggaaaaatcaactacgaagaatttgtagcgatgatgaagaagggaaatccagaattggtgccaaaccgacgcagaatgtgagagatcttttgatgttgtttgtttgtttttggttatcactttactcaaactttgtgtttctgttacaatcaattattttgtttcctgcaatctctttttatcaacacaacataaaaaatactttgagatcagaaagccatttgcaggtttggttaatgacttatgagagattcaatatataataattacaggttgattcttgcatgatttgaagctgaaattcacttaaaaaattatagaatgataatcttaacccttacaaacaaatttgagattatatctaatcaaggcaataaaaaaataagcaaggtgcagtaggagggattagaagtttcaaatccgatttttatacatgaaaaatgacgaaatctaataatcttggtgacattttctcacagagaaatcggacaactaaaatgagtaaaaaaaattaaaagaacgaataaaaaatcaactgagatatatataaaaaaaaaactggaagaagaagaaggaccgcgagctttggatcgaatttgttaaatttttcttctctcgataataaaaacaacaaatgatcgttgatcgtttttctctagattcgattccgattccaaagaactagtctccggcgtgtaatctctgatcgttgaagatccaagctacgccgcatcttactcgccggcggcttgaatcatg

SEQ ID NO: 4181 - DNA, 3000 bp, Unknown
  misc_feature (1)..( 3000): cDNA_ID_3072747_gDNA_ID_1620689_Annot_ID_164688 3000 nt of promoter + ATG
caagactatcaaaaagaaaatgataaatattgcatgggtggttgacaaaattcaccaaaccgtagcagtaagagcatgcactaaacccacataaccgtttggcgttttggatataaacacattgtcaaaccactcaagcgttccccaaatttccccattttggtgtttttcaatcgcaatttccgcacaccaaatctttttttccctatcaacaaacatatactcctcccaagaaatcgccatttttccaccatgatccgccaatttaacatttgaatgagaagtaggcaaactaggcaatcttcccaagcccttcaaaattgtccatgctctattcttgaggtcataccaacgtatctccccctcacagtaacggtagaacacgttctctaccacacaataagatgatgatgacgacagactccatccattattcatacatatgtctgcctctctccatttacctttatgcatcttgtaagtcacatctttttcatcagacttcacatagacggttccttgataacttacgcttaagtactcagagcctttgcatatctcctcgctagggatctgtagaaactcccaagtttgagtcttcgtatcaaaaatctccatccagttcattgtatcgagattgtcgcagcctcccgtaacatatattctcccatcaagagtacaagcagatggaaacacacggcccacccgcatgcttggagcttcatgccatgtgtgagaacgagagttcataatcataacgctagacaaagcgttataagtctttgatccagtggcatatatcgaaacgtttttattctttgatccaccgccaatggcatatacatcaggaccaaccactacaacacccggcagggatggggaggtaaaactgggagatgaaatcggaaccaaaacgtttttggagctatgtggtctgtggcacagaatgaaccaatgtagtagttcagaatcggtacggagtcgtaagcacgcgtaaagacaactctcggttcggcctaagaggattcgggtttggtaaagctccgttgaagcaagaagagagcgaaatgttttggagactaatgagagagttggataatgtaatcttgagatgcgagctaagcagtttaataccaaatcatcaggaagcattagaaaacttcttctagttcttttaatcgggggctcttctccatattccatggttgttgatcactttttttctcttaaggtttaaggttgcttgttaagtaagaagatttctataacaaaaacgtatattctgtttcgttctttgtgtgctctttctgttacaacgatatatatatcaagttacttaccctaacagatccataactttatgtgttttcctatatttgttatgtttatccaattatataaaaaatgcataacaaagttaactattatcttccgataaattcgtgagattttatgcaggtgataatgttcaataatccaatcagacacgtaatacttttttccaaagctaaataggagaagaaatctatcaaaataggatatatttttttaggccgcctatgatcatctatatatatgaacaacccacaccttgttttaacaaacaaaatcaaactttttcacaacaaggcaaaacaaaaaccctaaaagcctctcagctgctctcttcgacaatggtgaatacttgtaggaccagcttcatcatcatcatgatcctcttgctcttcatcaatcagtctgctctttcttcttctgcacgcgtccgtcatctagaaggtcgagatcatcttcctcaccaccggacacttagtgagaaggagaaagctgataaggaacgtctcagtttcatatttagaacgatcgaggctgacatcaatctggaggaagatgtttctctccgtcttccccaatttgctcgatataataggcttcataattcctatttcagttactgaatctactagggctttgaatttgttccattaaggttcattacttcgattgatactcaatgaatcatgtaatctttatattttttagactttttatcatgacttttgtaaactcttcttcaatttaattgatatattattccagaatagtataaaaataagaaagcctcttttttttttttttttttttaatattgacattcttacgctctacgtctaacttttatgtaccctttgatgtaatgcgtcacaattaattttcgtgaatcttttggattgctgatgtgataatcaatttatgtagcataccgaatgaaacagattacacatgccatttaaaagtatgaaccattgaacaccaaaatcggttggtaaatatactaaattgttgtgttttgtatatatagtttatcaatctttatccataagcgttatcaacaaaatatgggtacctctttttaatagacgtgctcagggcataagattaagactaattgcatgatccgtaatttgcgttcttaattaataaggtttatcatcttgcaggtagatctaactcatgagtatataatttaatttatttgctcaagattgaacatgaacattattgtggtgttacaaagagagatagtacgaggtaaaactatcatagaaagtgattcaagtttcttagggactataaaccaacttgtataattgaagatccaaatataaaaaggctctgatccaatttcaacagtcaaaaatcttattataaatggaccatcttacgttgacaaacgtatcttatgtgatcaccttgataagaggaaacccacgttctaccatgtagggtttcgagatacattaatatttccattcttttcttatctcgatactattatatataatacttaccacgtgaaatatcaaatcaatataaaaaaaaacgtagaaacttttactatataatctcactagtagcaatgagggtaaaatcacgcaaaaacaatcatctctctataaaaataaaagaagttggttagttccaacgctagagttaagaaat

SEQ ID NO: 4182 - DNA, 3000 bp, Unknown
  misc_feature (1)..( 3000): cDNA_ID_2050738_gDNA_ID_1620689_Annot_ID_164686 3000 nt of promoter + ATG
atttagatcgtgtaacgcgagccagcccgttcgccatcctgggacaatccatcctttcgatatggacccgagtgtaatcactggtactatcgaggagaatttccccattggaacaaatggattactcccgaatacggaccatctatatacttcatccgaaacgaccattatcccgagttcccgtgccaatgtagcgagctgggattcatctttcaagtaaatattagggccttggttgctaaaataatgttatctattagattgtaaaatttaaattttgtaaattttttatctaatatagtgcaaattgtaaacgaaataaatgtgtattgctttgctggttacgtttacaacgtttgaaatatatatttcttataaaattaagtcaaagatgtagtcttttaatttaaagaaaaaaccatgtcaatataaacgtaaacacaaactaaaagatctcaagtctagatcatctagccaatcatgtgaatatatacttctccaagagtactaatacgtacgtaaatacctgcttaagatgagcctcagtgtagtagttcccattgggattgtgggggttgattataaatatcgcaaaagtgttctcgtctaccatctctctaacgctgttgaaatcgatctcaaagtctctttcagggatgaactcataccttcggacctcaaggtgtttgtagatagagtggaccatgtcccatgggaagcctggcctcggaagcaagatgttggctttcggtttagccagaatactaaccgcgagctcgattgcttgtttgcatccaacagtcatatatacgtcatctcccgttagcttattgtcaagatctcggtttagatattccgccacagcactgatcatatatacaagcgtagagttaagatgcaaaatatggataccctgactggacattaactttatttatgtatatattaccgtttggcaaccgggaggccaatacttggagcataggcgtttcccgtaccgcaaaggacagccttaacaaccgccttttcggcggtatggctggtctctgcctcttcacttagtggaggcaaaataggctttccttgagggtcacacagactgaagatttcagaagagtaagtgcctagggaggcttgggcggccttttcggctgcatcactgccactgaactgccaatctacgcatccttggctagccatatttcttaactctagcgttggaactaaccaacttcttttatttttatagagagatgattgtttttgcgtgattttaccctcattgctactagtgagattatatagtaaaagtttctacgtttttttttatattgatttgatatttcacgtggtaagtattatatataatagtatcgagataagaaaagaatggaaatattaatgtatctcgaaaccctacatggtagaacgtgggtttcctcttatcaaggtgatcacataagatacgtttgtcaacgtaagatggtccatttataataagatttttgactgttgaaattggatcagagcctttttatatttggatcttcaattatacaagttggtttatagtccctaagaaacttgaatcactttctatgatagttttacctcgtactatctctctttgtaacaccacaataatgttcatgttcaatcttgagcaaataaattaaattatatactcatgagttagatctacctgcaagatgataaaccttattaattaagaacgcaaattacggatcatgcaattagtcttaatcttatgccctgagcacgtctattaaaaagaggtacccatattttgttgataacgcttatggataaagattgataaactatatatacaaaacacaacaatttagtatatttaccaaccgattttggtgttcaatggttcatacttttaaatggcatgtgtaatctgtttcattcggtatgctacataaattgattatcacatcagcaatccaaaagattcacgaaaattaattgtgacgcattacatcaaagggtacataaaagttagacgtagagcgtaagaatgtcaatattaaaaaaaaaaaaaaaaaaaagaggctttcttatttttatactattctggaataatatatcaattaaattgaagaagagtttacaaaagtcatgataaaaagtctaaaaaatataaagattacatgattcattgagtatcaatcgaagtaatgaaccttaatggaacaaattcaaagccctagtagattcagtaactgaaataggaattatgaagcctattatatcgagcaaattggggaagacggagagaaacatcttcctccagattgatgtcagcctcgatcgttctaaatatgaaactgagacgttccttatcagctttctccttctcactaagtgtccggtggtgaggaagatgatctcgaccttctagatgacggacgcgtgcagaagaagaaagagcagactgattgatgaagagcaagaggatcatgatgatgatgaagctggtcctacaagtattcaccattgtcgaagagagcagctgagaggcttttagggtttttgttttgccttgttgtgaaaaagtttgattttgtttgttaaaacaaggtgtgggttgttcatatatatagatgatcataggcggcctaaaaaaatatatcctattttgatagatttcttctcctatttagctttggaaaaaagtattacgtgtctgattggattattgaacattatcacctgcataaaatctcacgaatttatcggaagataatagttaactttgttatgcattttttatataattggataaacataacaaatataggaaaacacataaagttatggatctgttagggtaagtaacttgatatatatatcgttgtaacagaaagagcacacaaagaacgaaacagaatatacgtttttgttatagaaatcttcttacttaacaagcaaccttaaaccttaagagaaaaaaagtgatcaacaaccatg

SEQ ID NO: 4183 - DNA, 3000 bp, Unknown
  misc_feature (1)..( 3000): cDNA_ID_3593727_gDNA_ID_1620689_Annot_ID_164685 3000 nt of promoter + ATG
tacaacgtcgtcaatgttagattttgccgttagtttttattttattttgttttcagttgtcataaacttatttcagttatcagttattataactaattgttttttgttcctcttttcctgctaagtgtaaacctattgcacaaatttcttgcatgcgtgttcaccgtatatatgtttttaattcctctttcgttattgggtttttaatgatgaaataaaacggaactcaactagggacagtacagttcatgatcatattggatacatgtattagttcatttaatttaattcaattatatacacaatagtttatttaatttctctctaaatgattgatgatgattgacgttattttcacggttttggtaccgtataagtttagtaaagtgtcaaaacgacattgtttgtgaaacatatggagtattttttcaagagttaatttgccactctatcatatcgtttctaaaaattgaaatcatttctagttttaatcctggtttagctgtagtgatactattatgctcctcattctcacaatttatttctactttgtttctttaccttcacaatttctgccaaatgagatcaatatagacgtcttcaacatcaaagtttttgtttataaatacaaaatttaaaataataattttggtcagagtcgatggttataaggtgatgggcgtgatggcaaagcatgtgacaaagttttatgtccactattctcttttcgcctaacgcaaattcgtgtacgttacaactccctaataataatgcgttaattactctgccaagctcattttcatttattactttacatgttttttttgtttaaagcattgtcatatttattgtcattatgaaacccaaaatgaaaggagttaattagagatcattgttttcatctagagcagagctctgaaactggaaccaattatttggagtcttgatgcaaattcatgtagccttggagctctgaaattgttcttctatatgtttgctgatcaaattgttaaaataatggtgagactgagactcatggtttaaatactagcaaaaatggtaaatttaaaatcccccttagccacggaccttgagcaaagagtctagtgtatgtgtctatatatggttcaccttttggataagaaatcaatttcaagctcatctttctacatagagagaaacttggatcttgtactttttaagatggaaacatccataaaaaggtaaagataaagctgatatggcaaaacgccaacaaaatcctacaagtaaataaatcttgggccaactttaatgttcctaaaagaaatgaacttagctacaaagttactagtcacgtctctgctgccaaaattcttgacacattctttacacttcttcgaacaaagagaatggtttgatccacaaaggatgcaatgcgcaccgcttccacaacatttgatctgtggcataaatcaatcttgcaccataagggcttgaaactttcagcttttgccactaacactctaacgcaaacttgtgttagactgcaaccaaatgaaatatttgagaagcaccagatccattaacagcaactatgagcccattacaatgatttgcctccatcagtgtcttggatcgctaacactatccaataaccagcctagctggtacttagacagaatttttttttcttctggatctgtgaaaataaatgtaacatgagccattgactaagatctagctctaattaactcagtcaaaacgacgatcaaaagattgaactattggaaatggaaggggccgcgcgaacgcaggcccccaaggcaacaaataatgacgcaggatctcccacttggggtgacctttggcttagcgcacctcaagtgcaggaagccaccagcctaggccacggatcttcatgatcacccgtaaaccccgtccaggtaagtaatttgcaatcctcgaccatcttctttatttatactatgctacacacgagtgcccatcctcaaacttccgatgagggagcatcaacattatctcgtatctactataggcaggctttcgttgtttgattagcccaagttttatttcttgataggccgcaatgtctatattccggtccaaatcaaacccaacagattttttttttgtcggctatttgtcacagatttctttttatatacgaggaacaaggttaattatattgaactaaacattaaaaaaaaaaaagaattttacagatgcaggttgatatttaacgttattgtgggtcaactcaactcataagcaaagttgatatgatactatttaaattgacttcaccacatccacttgacactaataaattgacttctccatccctatccacacatatttgaatcttccaataaggttccacgaaactgctaggaaaacaatattttctaaggcaatagtcccactttggttaatcataaaattgtcaaatccactatgtaatttgtgatccataataaattaaaccagttattcatcatctaagtcagacactattttaactctagaaaacttgacaaagtacatgaaatgtttttgaagtgaagtaacaaaattccaacatgtacaaaatatatatttttttttttaaacgaaaatatatacactagagacctcacctatttttcttaataatatcaaatctcacatatttgatgtacacacaaaattaaatttatagaaaatgaaatatattattttagaaaaataaggagaaactttgtggaaaaaatagaaaaatatttaaattattgtttttataaattttattttgggttcgaactcttcaactccctgaacacaagtcgcataaaacgaaggaacaatctagaagaagaacgataacatccaatctctctttatattccttccttccattgtggcaataagtaacaaaccttgccctctacttcattccctccttgttttgatttcatcgtctttgttagctctcctctgtttttttttcttagtcaatcg

SEQ ID NO: 4184 - DNA, 3000 bp, Unknown; identical to SEQ ID NO: 4176
  misc_feature (1)..( 3000): cDNA_ID_2993363_gDNA_ID_1620689_Annot_ID_164683 3000 nt of promoter + ATG

SEQ ID NO: 4185 - DNA, 1587 bp, Unknown
  misc_feature (1)..( 1587): cDNA_ID_1808099_gDNA_ID_1620689_Annot_ID_164724 3000 nt of promoter + ATG
ttcgggcatacaaacatcttcacgcaagaaactatattgaacatacacttgaacttcatttgtagggattaatgggtttaataaccaggaaatgatatttgaattttagaatcctgaagactaaatagtttctgtgcacattatactctatactcaacatagtagtagtacctagaactttacaattttagcagagctctctaacaaatttaactagatagatagatgataactattgaactacacagttcaataacatacatcatgcaattaaaacaaccctaatgactacaataaagaaagagcacaggtaatacctggagagaaatcaagttctgatcagttacaggtaagccgcccaaatccaaaagagacaattttttaagtgaagcaagaagagaaattccaacttcagtgacacctgtctgtgaaatccacaactttttcagatttacaacagattggaggtgcttcataccagcatccgtaaccttgaaacatcttgaaaggtccaactctgtcaaacttgttaatcctgaaaatccaatatcacatattaaacacttaaatttctcttaaacttccattccaaaactcggagtatatcactcaacatacctgtgataggccagagggtggaactgttgattctctggcaatctgaaagatttagagtaattagattaacgaagcctccaatgtaagccatccattctgcgttaactgagcttttgcctcggagatctatattctctacagaatatttgaatcctctgcacagaaaagagtcttgtttagttgtgtgatacagatacaatagttcagtgtccatgcaatcattgcattttccgcaacgatgtaccaagaccaacacaattctacagctaaacacttcaggaataattatttcaacatgaatacagaaaaaaaaaaaattctaatcaaatttaaaaactaagatcccaagcgatcactcaatatctcaaatcgaagcatatatatatatatatagctcagcatttcgagatcagaaatcagattcatattagaaacgatcagaactatgtaaggaagtgaagagtttactcgagtaacgaagggaaaagaagccgctttttgaggaggcgacggaggagagcatcagcaaggtgaggaggcagactctcaagactacgccgctgaagtcgccatcgttccaccgcatctccgctcttacaagcttcctttaagcatagacgcaccaaaggactctccatctccaatctccaaatcgctgaaatctctgatcttagctccaaatttcacaaaccgatccaacctttatataataagaataaaaaccctaaataaaatagaaaatcaaagaattaaaaaaatccgccaaaaacaaaaaacaaaaagttgttcatccttattgggccactaaagcccaaacgtttctagcttatatggcccgttgattcacgtgtatcagcacgtgccttcttctattgaacgttgtcgagtgtcgactatatcatactaatcttagctccaattctgcagattttactctcatcctaaataaacctctcttcatcgaaaatg

SEQ ID NO: 4186 - DNA, 3000 bp, Unknown
  misc_feature (1)..( 3000): cDNA_ID_1823302_gDNA_ID_1620689_Annot_ID_164723 3000 nt of promoter + ATG
agataattaatttatttatttataattttccctccattggttttgtagataagaaactaaagttaggctatttaatgcgtatatctatttatgtacctcaataatttgaattagtgaggaaagagttaaagttgaaggataataagtttattttaagtgtgaaaatgtcgaatatgtgttgactatatcaaagggattgaaagcaatgtttttccgtacatgagttttttttaaattgtttggcattttcctactttactaatttattgctgtttttagcgagtccaattggctactgatatttggcatagcaaattatatttttttttcattctactaaaaatactgtgcagcgttgacacacacacacaaaatactgttgcgtaattagaaataaatgcgatacttaatgccgtaaagtttacagatcatacaaaaaaaatcttcttggttttgtaatgaagcaatgcagaaataatatgtcaacttacgtcattatcttgtgagctgattcaaagatttcaagagttatgttttggatgcaaatatgtcaaattacataatttcagctgattctatgaagtgtaaatacaaatttagggtgcaaagtgccaagattcattttataaggatgaatgatgaatgagatccaaataataataataatacaatgaatgaatgacgcaaaagagagtgacgccattataaaaattaaaatatcatttggagtactaaaactagaaaacaaaaaagaatgataaaagggaaaatccacgcggagagaggtttgaaatgtcttcggtccaatcctgtccttttgaatattgattttctttttgatttttcttgctttttattaatcaacaaatctgttttttggaattacgttttttctacgttgaagtgattttttttccttttgtaaaaggcctacgttgaagtaaaattacataaataaatgtatgttatgaatatcgacccaaaaaacaaattatttctacactatactttgcgcaaatcaaatctatcgaaaacgattttggtaatcccattcccatgagtgagttttgacccaaaacaaatttaaaaaagtaaccatttcattagtaaaacggtaaatatggttcataaaccttttagtggttattggtcctgtacactacactcgtgtgtgtcaacttcagctatgagatttttgctgtaactttttggataacggttcaattattacaaaggttatttcttacgtatgagaggtccaaattacaattgaataatatttgatgacatacaaagttaaaaaggattaatcataagaaatgaatgttggaatggaatgcatctatcgatctgactactttagatagcttgatgttggacttagtcagcaaagaccttatcatactcttgttgtattgtatatatcgtatcacacagtgactggttttttctacttttctctttggaacatatcaatcattatgtataaataaattttgtccaaattaatggccatttgtctcaaccataaataaatatttattcacacacctatatgactatttgagataattccatggtgacttggtcagcaaaaaccttgtcatactcttggtgtattatcacataactttgtagattatattcttatggaacatatcatatatatttgtccaaattaaacccatttgtattattttcccctctcgagtttaatatttcttatttagaaacagttaacaacttgacatagctcacataatcactcacagactatatatgtataagcaactaccattttaaatattatttagttatattgttagactgcaactattatttattttctttgccaaacaaatttatattttttcatgttaatacaatattatatcttgaacaaatgtatgcttaaatatattgacacaaaacaaaaacatataggggtttttaggaagaaattttgtacagattaattaatcctcatcagatttttattttatatcttatttttagaagtgtatgattttaaaactagaacaatcaaatcttagtaaatttcattcaacataatttttatgttattgctaatctattgaatgttaataagaattgtattataccaaattaccaatatgtgttttgatacttgtacttaaaacagaatgtggaatatcctttcccttattaatgatattaaacatcattacaattcatagttatagcaatgaaatattatccatagaaaggttgttgcataatgcatactagtaaagcatcaaccaacatattttgaaaatattcttaatcaaataaaaaacatatattggaaattctttaacagtagaaaaaaacatataataatagagaatcttaatcacatgtacaaagtcgtagttttgaaagtgtacattgaaagagacagttgtataaccctttgttgtctaattatataattaacccactatagttaaataaatgataaacttggttacaactacattaacaaaattgaaatgttgaattggtcagcctttgaccttatactctttcactaccaccaccccacttatcaattacactctggccctatacttccttataccaaagacttttcttcaatttgaaagttttgtctctcttttaaaaagaaataaaataattatttatggtttggtcatttggtcaaattttcaaacactgaaaatccaatgcctttatataccaaaccaacactcatccatttttatcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaaatg

SEQ ID NO: 4187 - DNA, 3000 bp, Unknown
  misc_feature (1)..( 3000): cDNA_ID_1032427_gDNA_ID_1620689_Annot_ID_164717 3000 nt of promoter + ATG
caattagttatctcaaaaatatctctaaaatttataaccttgtgagaagctaaggttattgtctcacgaagcaagcagtgttcgacctagatggatggtaatcgtttctatcttgtggctctattccaatggtttactatttttcctaaataccactttgttttcaatccgaaatttataccacgttacaaaaaaaactttcatagagacttagagagtgtgttgtttgataaacctttcgtgtattttttttttttttttaattattattttaaaactctacgtaaacaattttaatcgccatttctgagaaaactcaaaagcaataaccgatgtaattgataaaataaaaataaaaaataacattaaaaagattgaaaatacagaggagatgcagggaaaagagctgacgacacgtaggctagagccgcaactactcgagaaagagcattgtcgtgtcgctttcgttaaatactactgtactatctttttctctgcccgtaaggttggttcagaggctactacatttctcaggccttttttttttggttctatataaaacgtgaacttaatttcatgagaaattaaatatttccgacaatctcaaaaattacccatgcaacttgctgattataatattttacgaggaagaaaatagatatcgaaatgctttcaaacattaattacgtacacaattcaatgacgtacggctattataagaatctagatgcataactatatagtaatatgtagatacgaaaaaatgcgaagtatttaatactttgggcccctcttcccaaaatgttcatgtgaatttcgtgattattcatgcatactcatcaatagacaatatgtaatgtccattctataaaatactacattttaatcttcgagctatagaagtatttcaagaatcatcaagataaagagaacaattaagaactcaatcaaattaaggaaaaaaaataaacagtttgcagtgattcactaaattgataattcaaatcttgtgtgggttcaaacttcaaatattgggccggggggtattaaagaggtttgttgcatttatatttcgtttattcaaaaaacaaaaatagtaaacaatcacatgacttttccagtgccctttcctaaattcgtaaggcttggcttcaagatggtcatggcccatagatgtatgcatatacacaatcatacatatactatataatgtattggtgtcccctcatgcaaagattttgtttgtcacaaaattccagagctcttttacaagatttatgccaaaagataaatggggacctttcatgagagatcttctccatgattttctaattatagtactttataatatatcatgataaacaaatctttgtgacacattcaagtattcaacagtctgatacttggtagagaagtagaaaatttagaaggtaagaaagaaagaacatggtaaaagcaattctaaccattcacgtcatgagttatatgatctagctaacgttctctaactgtgtattaacgaccataactacgatgacgcgtctcagatatgaaaatggtacggctttaggatcccgtggtccatcgaatcttgaccgtccacttgggtgggggcgtaatacctgttgggccattggataagcttttgtggaatggtggaaatgaaaccaagtgtttcttagatcttaagagttattgccaaaaaccaatttgtgaaccggatcaaaccaggattctgttatatgtaccggtcggtcaacgactgtcttggccaaaacccaaaaggacatggtttcaaactttcaacggatgtttgacttcttactggtaaatcctttccgtatgcattatgccttattccgtatttattccgtattttagtttggtctatcatcagccattatatgtctttcacgtcctgatgacatattgatcttgactgagatttagcagagatgtacatacgatagttttgaaatgttttaagaatgaattctgcattaatttttcgttaagatacaaagttttacacaatacattatctaaacccatgattcaatatagaattagttttactcaaccgacattctaatataatcaaaaatttgatgtgtggtcggatagtgtacatatttacatggtcaagataagcatacaaaccgtacaaattagaggcattaacatatatagagaatgtggatagtaaaaatacatgtggaatagaaagtgagtgagacagtgtctcatgaaaagtggcagagacacattaataaatacattaaaagaaggaccaacaaagaaattaaatgatgtctaattcatcttcatatttcacgtaccatttctcgtgccattcccatgcacttaacatgtttgctctgcttctccctttcaattttactgaactaaccttccaactaccttttcggttatcttctccataatgtaacaatctaatttgagtgtgaatattgtaccatataggtgttataacgttactagttttgtgacgatggtcacggctttaataacatcataaatatccccgagattttgtgtgtgttcctctataagaattggtgatcatgtagcgagtactaatcagcttttgatcaaagttaatgttgttaatatgtgatggtttgtgtaatcaacgtttcaatattatgtacaattatttaaattattgtgtttcttctatactacatcgtcattcattaatttttttgacgatctatcatctaccaaccatccacgactataattgtatgtatatcaaatattgttctgatagtcaaaacattatgggctaattaagaagtttgaacaagagttaaagaaagcttaaaagggctttgatgaatgaactcagatgggctttatggcccattaaagattttgttcttttttgagtcgtcgcccccgagatcgtgggtgatccgtctcactggaaacatctttgtctctctgagaaacccctctttagggtttataccttca

SEQ ID NO: 4188 - DNA, 3000 bp, Unknown
  misc_feature (1)..( 3000): cDNA_ID_2050748_gDNA_ID_1620689_Annot_ID_164715 3000 nt of promoter + ATG
tatatgaaaatgataatcctaagcggcgtggtctaacccacacatttctcttgcgatccagtgaaaaaaaaataaaagtttcgattatcacgtaaaatttacattgtgaaatatatcgagtttctatgaacttatcgttgtctcaagaactgatgattaatgattgtgtaatgattattatttcgtggaccaacaaatttttcattatcttaataattagtgcctattattatactgatttatttccggaaacgaaattttatttgtttcgaaatgagacatatgaaaataatgttatgggattcctgaattacgtggctcgaagtaaattttgctcatctagggtttgatgcttaattatactgtagtgatttagaataatctatttcacatttttcactcagctctattgtctgagaaattttataccacatttattacaactatatatatttatcaacttaaatctaaaatctatacatcaatgttgtccggaatataacatatacataatacatgatgaattatagtattatactatagttgtttgttatgcatgtattattcaaagattcgaaattagtgatactatatatatgtacatcagtacatggtcgagagtttgttagatgatattcactgcaaatctacactaaatattcatgtgaaaataattttacaaaacgcaggtagagtgttacatgttaaacgagtacgcttaaactagtgcgtacattgcagagtaaagaagttggacaaaaactgcatagcataaaggaagcaaataaaaaatgaagggaaagacaagacataacaaacgggtacatggttcacataccctgcgatcagattgtttcgttctttggtaatgtagcatgggcttccaatatcttctctatgcaaattatattattatatcagtacgtttttaaacatttctgtaatcaaaactcaaaaataataattcaatatatatgaaaactagttgtacgaaatacaaagtgttacccgatcgtgtcaaaatcaaaaacatttcaatcatgattaggaaacttaactcaaccatacgttacataggaaagtagatgctgcatagttgaccattggtcaaagtgtttaacacttttaaagatttttaacttaatagagaaagtaaatttttattctctaattaattagaaatgccaaatatgcttgtctttaaaaattgtcagtaaattaaagtcactctgttattatacattttatagtcacataaaatctgcaagcaaataacagaaaattatcaagtactcctaatcataattaagaagtagtaatacaatgattccaaaaaaaattactgtacttttttttaatgtgtgtgtgtggcgcaacgtcctagattgttgtctgccacgttagccagcaccagctgtaataactaaaaagtggcaaggttatgactggtaaaggttaaaacagtaaagaactacgagccgtaacggtctcttgtctttcttctttttcacaacgcaacttgcttaggtgaaagtacgatactatccctgtggtgaaaaagagaacttcgcacggaggttatgagattaatcacctgctgttaattataaattattggttctggtcaaaagtaagactggaccgtgtctccggtgtcacgtgacctgaatctccaattacgaggaaattttaaaaaatgattatagaagtaattagtattagtaatacatatgtttttctctttgtcagctgccccatggaaaggcacgtcccagccgttggattggacccaattctgtaattacacgtgtcgatatctcaatcgtttgacttatgcggcattttggttttgccaagctcgttttttccggctataattagtttttgctaaaaatcagtcaaaaattaagatttcattctaattttaaaaagacaaatttccttggtcggcactaatatctaattatcgaccattaatgtcatgattcttatttgcgttacaataattactgtcgacacttgttgtagttcttagtttttgttttttatctagttttgtctctaaatttcaatttcaattaagtgtacatttggactgtaacaagcatagttttgacaattgtctttcattcatttcatcatttgacatcaccaatgaaaagttaaaaatctcttaacactaattatgaaatgtctttcatattcttgtacatatatataaaacactaaactcaaagtgtttagcaaataaaaaagaatttagatacaaatgaatcttgtccacctcccttaaacagaaagaaatatctttgtcaaaagttttttttataagatattcgaaaattaaattaaataccaaaaaagaaagaaaggagtaaacactaataatatgagacgtttcaaagatcctataaaatagtcactctctaccattacatgtgctctgccgcttttaaatctctcatcttcttcctcgtgtcactctttctctcacactctgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgtgccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaa

SEQ ID NO: 4189 - DNA, 3000 bp, Unknown
  misc_feature (1)..( 3000): cDNA_ID_1823325_gDNA_ID_1620689_Annot_ID_164711 3000 nt of promoter + ATG
tcttttcatttcagcatgattaaattgctattgctcttgtttcagctttgagtttcatctgagagtctcattggcattagatgggaacctaacactgatatcacgagtcagaaacatcaattcaaagccttttagcttttccattgcttaccacacttacttctccatttccgatattaggtgaaacaccgaatttagcctctactagtctctgctgtcacataatataacgtagaactcaatacattctcttttcttttggtatttatcagtgaagttagacttgaagggctggaaactcttgactatcttgataatatgcatgatagagagcggttcacagagcaaggcgatgcattaacctttgaatcagagatcgatagagtgtacctaaattctaaagacgtggttgccattttcgaccatgagagaaaacgcacattcctcatcaagaaagaaggtctacctgatgtcggtaagatccaaataccgaaaaccttaaccgccctttttaccaagaatccagtttttaacagtattagattctcggtttgttgcagtggtatggaatccatgggagaagaaagcgagagcattgacggatttgggagatgatgagtatagacacatgttgtgtgtggatggagcagccattgagaaacccatcaccttgaaaccgggtgaagaatggaccgggaaattacatctctcgcttgttctttccacctaaaacccggtaccggttatcacaaactctgtgtctttcattatcttgtcttgtgggctattttttttgttttagtctatagaacatcacagtgtgtgtgattcgtcggtatcaaaaatccgaaatattaaaaggaaacctgagatttgaaaaggtcacccatttttaggaagtgactagatctcctggttttgtgcgagatttaacttgtgtatgaagacaatgttatatactatattgaagtttgtacttatttgatgaaatcttcaataatactagattttaacccgcggtatatcgcggggacaatttatttttttaagttagtatatataaaagtttacaaattatatctatctataaaatatttttattttatagtttacaattgttattaagtaacgtcctatcaaatccgtcccgccaacctgtcccgtaaaaaaaactcattgatctcatttatgatatgtttatgaatcattgtttaaatattttgtaattttgtagtaattaaatgctatcaaatatttgtgcggtttgatgattataatcgaattgttatagtcatgtagaaaaacaatatcaaaaataataattttgtagtaattcaatgatattaaatatattggaagttttattttagtaactaatcgtgtagttaatgtagagagatttcgggaagattttcaaatatttaattcaaaaattttatttttaattatcaaaacaaacattaaaatccagtggcagctattgtaaataaatctcaactacaaaatttatttcacaaaatggctgcaaaaatgtatatgtagatttaaagctttcttgttctcatggttgacaattcttgaataaaccatttctgagaccataagctaatttttttgggtacatatttcaagtataggaacaaaactatagtataaaataatctttatagattcaaatgctttaatggccttatactcattgcctctcaatgtggtaagatggtgtaaaatcatcataataatcatgaaagatttgaaaattattggtctattatgatgcactataaattctataattgcgtcggtcaaatatttaatacaccgaagaaatagtaatattataaaaagagaatatttattgatgccaaaaagaaaccaagaattttattaaaatggtagaagtcgatatgctttaaatgccttgagcttcattatgacaagtactacaaaacaaaaaaaaacgtatttgcctaatacatttggtaagttaaataatttccttcttaacataattaattactatatcgttctttttgttagcgttgaccaattaaacaaccggttatgtatatctcggttcagaaaacttaaccggtttaacaaatagctaatgttccgattaatttacattacttcagaacgaatcgaactttgtaaaacgaagatcgattacaaattgaaagatacagccttaatttggcattaaaaagttcaatggtccccggttcggtattaaataaccgggtacgtacagactcaccggtcaccaacctgtaaaccgtataaagaaacaatagagtcgcatcagtatcttccctcgtcactttcacccactttaatatgccaaaaaataagaacaaaattatatccgttgcttgaaaatcacaagctcttcttaacttcacaagtgcttcaatggcggttcttcacattatcttcactgcgtaattgaagaagttgttctctcttcctcttaatttcgagttgtgttcttaaaaaactccagagctgattcgattctcgagaagaaactaagccgacaataaagttcagatctggaaaaaagcgaggttaccaattctttatttttaataaatttaatctcgtagtagagttagggttctacttttcgacaattttaattaccagaaattctagggtttatgtgagtttaaattaaagcttcgtcattttcgaagcttaaagttactcactttttatgtctcccactcctgttgtattttaaaatctccagtggtcacatagaacaacttcaagattccacttttgcttttataatcagcagtcttctagaaatctgtaatcttttcgcttttttggtaccttttattttaaattaaagttcacaaattttcaccatttatatgtccatcatcatcatcaccacaatcaaattgagctaaattggtttttgattgttgtttttctccagctccagattacaaaaagaaacagctcgtttttttcactttcaaaaaa

SEQ ID NO: 4190 - DNA, 3000 bp, Unknown
  misc_feature (1)..( 3000): cDNA_ID_1025117_gDNA_ID_1620689_Annot_ID_164710 3000 nt of promoter + ATG
agtaggttgtcacacacaatcttcccaccgtgagacgctgcaacggattaagataacaaatacaactcctcctgagctgcaacgaaattccattcatacctatactttatatagaccgttctagtcaccaagcacacaaattctattattcagcattgctcctcttttctaaaaggaactagcttctaggactttctcacaatatataaaccagatgaccaaaattcgaaaataactatagctatgatctttaactaaaagccacagatagtcaataaacggttaacagttagtatgggccagctcatttaaacgagaaacccgaagggttcaagcctcaaggcctttgacacattttttttgtgtgtgtttgctaagtccaaaaacaaataaaaagcgtctttgacaaaataaaattttacatatttttgaagttgatggatttttcatttttccatacatttggtatttggatataccaaaaacaactttaaaaaaccaatttaattaaggtggtcgttttcaaaatattattatacacatgtttgatgtctctgtgtcttttatattctttttcaattgcaaaataggagttcgggttgcatgattacaaatgaattatcagcaaatccatcttattcaatcgttttccaatcctaaaatgcaaatttctctggaagtttagaagattgtaacgtgaaaagaacagagttagattatgaatccggaccatccggtctattgacatattttgatcgccagttgttgtgcacttgactttttaaatattcagattattgcatgaacgatgaatcattcctttgatataattaaagaaactaatgattacataaaacaacacgaccaacggcgtcgcagagggacgcaattgacgaattaaagatatcataggtcggcataaaatgacaagaacaatctgataataccttaattttccacgtttcaatagaattttataaagaaaaacatagatcaatcgttagctatctaaaatttaggaaataacatgtgtggactatatttaaagtatagagagacctcaatccatttgtttatcaagtaaattggcgaaatttgttagtatttaacattcgatggaactgattccttatcctaaaatgacggattaaatttcagttttcgtgaaaacccaaacatagtggtcaggtggaaataccacaagttttcatatcatttatatatcaattgaacatttcttattctacatattggatcaataagattctgcactttcaaattagtgatgatcaaaagaacgctacattacacataagtaggtatcgtccctttaacaactcgtaaaaaggggacatctacaagactactagctagtaaaaactgagaaaataagctatatttgatcatgaaacaaagtgccatgcaagtactaatgtttgggctaaacttattagatcatggaaacaagtcccaccagaccacttagacatgataaattgataagcttttcttactctacccgatgaatcttgttcttgtcttacataaatttaccaaaggtttcttatactcgtaaactttatacattaattttttggtatagagtgaaagttaaaacaccgacacggtatggtataaaccaataatacgaatgttttatataatcatgtttgagaaacgcttatcttctttttattaagttcaataactttaaatatatagtcgctgtctcttttggattatttgcttgcgcagacttctttgtttgattattctctctgttgaaacaccttttcgtttagtgattattcttttaatgtgtactagtatagtagtatgcatgttattcatctgctgaatatatcgaaaaggttaaagaaacagttgacacaattatcgactacaataagacttgcgaccaagtttataataaaattataaaatgaatttaattagtaattaacgataattttagtagttaattaattttccctccaaatatgaacaggtagttaattccgttaatcatggtggcatgtcaagatctaacccatccccacacctttcatcacaaccagctgtcctcctgccatcatcttatttgttctttggctttttcttctttttttttttttttttttgcaactagatttatcatttttcaattttattaagccagccaataagattgaagaaaaaaaaacttaaccactgaaaataaattaaaaagaattcgacactgttttttgacaaacaaaacttgatatttacggttaaattcataacgtcaagtgaatatttgatcatttttgagacgaaaatagatatttaggtttagtagttccaaacgcaagttttattatgggattatttcatggcgttatagagtttggtgactttggtctttaatattaacctaatgaatttcagaaaatatttatctaacaacttgatagattacggagtgaggaattaatcaagtaaacaattacatattaaaataccatttgcagtcttttattaaaacctgttgaatctttagcaacttttctacatattgcccaatttttctgacttgtgtctttttaaatatctcttccgtgtcaaaaatagtttgtgtgttcttgattatacgtaaattcatctgggcatctcttaattttttctaatcgttaaccttaattacaacctcacgatctgtcttaatcgtgtcttaatcgtgtttttactttatcctctttttattgcaacattagagagttttgtgtgttgcagctttatcggtgtgtaagaaaaagacttataagcaagcagttgaagtggtggttgaggtttcggtttcatttccacgagatctctttggctttcttgttgagatctttccacaagaaagtttagttgttttcttcttcctgtgatttcttcgcctaattttttctggatttaaaaacacgagaagtcaaggtgaaatattatcgaagtctctgaatctgtttttga

SEQ ID NO: 4191 - DNA, 3000 bp, Unknown
  misc_feature (1)..( 3000): cDNA_ID_1823332_gDNA_ID_1620689_Annot_ID_164701 3000 nt of promoter + ATG
gtaacaggtgtgcacactatacacaaccaaagcgttagataaagagtatagtaccacgatttatatttacgataatatatacttttgtacatttagacaaattgcaatgataattttgtctatatatcataaattcaaacatctaaacagacttaatcgcttgctgaatgctgatcgcgaacgctaacatatcatatgagtcatatcccaaacttgtggatatactaatggtttatgttaatgtaactgtatgttaaaacattaatcagcaatgtatgattttataagagattcgaaaagaatctgacaatagtttgtgtgtcattataattatttccgttcaaagaactaaattttgtaagtggtccaataatcaaaaaacattttttatatgttcaatcaaccgagcattgacattaacttagtaaacgataatacactgaatttgtaatctgactttacaagtatgattgatgattttttaattatcgatgaacatttcaaatatattattattatgttgggagaaagaatggttttgttgttttgaaacataaatgcttttatttcaaactaatatcatattccctgtttagttaggttactaattcatatagatttttttttttaacttttggattaatttttgacaaaggtctggatacaactcagttataaagattgaatggaagtctaactttatggcacgtgtatataacgaatatagtgatatcatatactgtatatgagtcatatgacaacttcataatgtaaaattatccaaattgactatacacaattattcaatcgctaaagaaaagaacattgaaaaatttaatatataatttaaatgtattactactctaaactctgcattgaaaaattttagaacgtaatttagtatataaaataaatgtattactattctaagataattagttaattagttttgagatgtaaagtttcgtcaagtgtcaacgagcttcatagattttgcgctgtatattattatgtctagcttaaaaatttgctgtatattattatgtctagcttaaaaatttactgtttgggaaaaatatgaaagtctcctctacctgagtttgttttaaccttctttttaaaattatcaaatccaaacatgtgaaattttttggttcagtcaggtacccaatgattcatttttaacaattagaagttggaatatatttgacttaaatttctctagttaaaacatgtgatctgtcatattaattgcactgttgaatgttaatcgaatttggatatgtattcactctttgttatcccatatggcgggttgaatcacctgtcaaactaatattttcaatctaatgtcttattcattcctttgtacaactgagaccttaattccattttacttaatttatatagggatacgtgtatatagaaaaggtggatcggtgttttatttcaagagttttagtcatacagatatactttttgtgcatatacgagatatatggttgtatttctgtgtttaagagcaagcaaaattcgatcaagaagcttaatttggtcaaccttacgttactagaaaggtatgtgatggtggcgaaccgacgataaccgataagagagagagagagataatatacatttgaggtctattttacgaaagagtctaatttgactgtttatttgctttcttcttttttggtggcctgaaatatgaataccaagatagaaaaaaagactaattttggcttatcctacaagtggcaactggcaagtatacaaataagacttgtatttttatctgaacatactgtcaaatttctatgtcatctcatatactaatgttatataattatatgttatacacataatattagttaaaaatagaagtcttaaaaataaatttcgttatactcatcatatcaactaattatcgattctatgaatatgttgggttaaattttgatggtaggagagaagacgaatatcagatgttgacatgtgaacgaatcgacgtcaatgagaacatgcatacgatgaaatgagtgtgtaaatccaatatttgataagtgaataagaattatgtgattaatgggaattggaatcaaggagctcaaattagaactatcaagactagttgtttgaccataccaaaatatggtaaaataagactaatagtatgtgaaatcttagatcttgtggcctaaaggaattactagtgatagtgaaactacattattgcttgagctaataaaccaatataatttaaaacaatgtaccactcacatatcccataccgaaaacaagtagataattagatatttatatattactagtttccaaataccgtccaaattgggaagcatttctcaccaatttcttaaagaaatcagtttgctagttgccaaccctagcctcaagaatcaagataatgtttacttgttttatttatattagaaaaaaaaaacagaagaagaaatcattcccgcgcaaataaggacattattggtatttcgttgacttgcagcctataaaaagacccctagtaacggcctgatactgcatccgcttcttactcaaacactttatcctcaacctcaagtctctctttaaaacccaaaaatattccaacttcacgaacataaatcatcaactacattaaatcaatcgatttagatcggataatcatctccgtcccgatataatctgcgttttcagatattaatccgtgagtatcgcctctttacctatcgaaatctcgtgtattgatctgatctgtttggtttcaaggaaaaaataacgtaatcaagaaaattattgactaatgactaatcataattttgtttttgttaaaggcctgatcatagttttactctgtaattaatgtatcatgataatgtttgataaatgaatcaaaagtcttaaatcgcttcacgtgctattttaacttaccacaatgactaattctcgtggcatattcatcatttgtcagatctttaaagcatg

SEQ ID NO: 4192 - DNA, 3000 bp, Unknown; identical to SEQ ID NO: 4183
  misc_feature (1)..( 3000): cDNA_ID_3593727_gDNA_ID_1620689_Annot_ID_48523 3000 nt of promoter + ATG

SEQ ID NO: 4193 - DNA, 3000 bp, Unknown
  misc_feature (1)..( 3000): cDNA_ID_2027089_gDNA_ID_1620689_Annot_ID_48526 3000 nt of promoter + ATG
tcttgcttccgaggccaggcttcccatgggacatggtccactctatctacaaacaccttgaggtccgaaggtatgagttcatccctgaaagagactttgagatcgatttcaacagcgttagagagatggtagacgagaacacttttgcgatatttataatcaacccccacaatcccaatgggaactactacactgaggctcatcttaagcaggtatttacgtacgtattagtactcttggagaagtatatattcacatgattggctagatgatctagacttgagatcttttagtttgtgtttacgtttatattgacatggttttttctttaaattaaaagactacatctttgacttaattttataagaaatatatatttcaaacgttgtaaacgtaaccagcaaagcaatacacatttatttcgtttacaatttgcactatattagataaaaaatttacaaaatttaaattttacaatctaatagataacattattttagcaaccaaggccctaatatttacttgaaagatgaatcccagctcgctacattggcacgggaactcgggataatggtcgtttcggatgaagtatatagatggtccgtattcgggagtaatccatttgttccaatggggaaattctcctcgatagtaccagtgattacactcgggtccatatcgaaaggatggattgtcccaggatggcgaacgggctggctcgcgttacacgatctaaatggtgtctttagatccacaaaggtcccggtcactttttttgttttgtttaatatcgatatacgtgatatgcatcgttttcctatatactattatatttgattaactgtaaatgaaaaaattcatttcaattaggcttatctagttttatatggacaggtcttaaaagctgcgaaagaatttctggagattacttccaaaccaccaactgtcatccaggtttggatcattattggtttactctcgtaaatgaaaaaaatacaaaaatcgataatccatttattattgtcaattgttatagtctatggccaattcactatcataatcttatgatataggcggctattcccacaatcttggagaaaactcctcaagattttttcgagaagagggggatttttctaaaagacaaagtggattttggatattctaagctcaagaacataccaactctcacctgctacatgaaacctgaatcatgcaccttcttatgggtattctatcctataatcattacatgtctagtctactataacttttcttttaatgtattagtttgaaacaaacttctcattgtggataatccgcatagcgcagaccaagctggacccattgcattttgtagacattgaagacgatcacgacttctgcaggaagcttgctaaggaagaaaatctcgttgttttaccaggtaatataatcattatccctctctagagttttcagaagattgagatttaagttttagggaactatgatttaaggaaaaatatattcgattgtttttttttttaacttgtaatataaagaaatgtagactaagacatgtaatctagtggttcgtcattgagttacaacctaactttaacacgattaaacgcatgttgttggattggtaggaattgcatttggtcagaataactggttgaggcattctatcgacatggagactccaagattggaggatgcatttgaaagattaaagagcttctgtgaacgccattccgttatagttgaagcttcttcactcaaagacgtcaatggcgtcaactaaagggtcaatataaatttctttgccttaagtcttttacatatgctataataataaatgtgtgttttattgatatgagatcaatcatgaacacttttgtatctgtaacaaataaaattggtgaatttatcaccatgtcgtgtaatgttttctcatagtttgcaatatttcgatcgatgtatttctacttttcgaaacataagataaataatttattttcattaggtatagctagactggtgtgaaaataccatgggagcacaagaacatctatattgacctccttaattagccattcaaatacatttggtcatgtcttatatatggctcaaaagcatgttgaatcggattcgtactgaatagccaggagtacttcctaacccgaactaaccggcaacaccgatcgactagattgagattctaattaagaaaatgttagcgtgcaactttgataagtttgataagctttttatctacttttttttgttcagtttagatcataatgaaggaaaaattgattcctaccattggatattttgtctttagtaacaatatttttaggtttacttaattacataattagtcttgtatgttgatctgatagttttctcaataataaaatttagtattaactattacgtcacattaaaatatacttgttttaaaattaaatataaatttatgcatgacacggataaccttgtaaagataataacaacgagtaaatcatgaaatcgtacgttactatttatattttaaaatgggcaaaacataacaaaaaaccatgggtggttttcctcctctcgtcggtcgaagacagagacaaaaaatatttaaatacgtaagaatctttgcttcttcttgatgctgatgagtgatgagtaatcgacagagttattttgtttcttttgtataataaaggagattgcgactctacaagagagggctaatatagcatgcattaagatcaatcatacagtttacttaaacaagatttaagatcaccgaaggctcgagattcgagatacattattttctttttgtcttctatgttgatgttaatatcccacgtgagatatcaaatgtttagaacaatgtgaaaaccattggcaaaaaaatgaaaagtggttgggaattttcactatatattcgacttcgtagcaatgagagttagtcacccaaaaacaaaatctaatagagaaaaataagtagat

SEQ ID NO: 4194 - DNA, 3000 bp, Unknown; identical to SEQ ID NO: 4180
  misc_feature (1)..( 3000): cDNA_ID_1823340_gDNA_ID_1620689_Annot_ID_48530 3000 nt of promoter + ATG

SEQ ID NO: 4195 - DNA, 3000 bp, Unknown; identical to SEQ ID NO: 4179
  misc_feature (1)..( 3000): cDNA_ID_1807740_gDNA_ID_1620689_Annot_ID_48531 3000 nt of promoter + ATG

SEQ ID NO: 4196 - DNA, 3000 bp, Unknown; identical to SEQ ID NO: 4178
  misc_feature (1)..( 3000): cDNA_ID_4257564_gDNA_ID_1620689_Annot_ID_48533 3000 nt of promoter + ATG

SEQ ID NO: 4197 - DNA, 3000 bp, Unknown; identical to SEQ ID NO: 4177
  misc_feature (1)..( 3000): cDNA_ID_4257546_gDNA_ID_1620689_Annot_ID_48534 3000 nt of promoter + ATG

SEQ ID NO: 4198 - DNA, 3000 bp, Unknown; identical to SEQ ID NO: 4191
  misc_feature (1)..( 3000): cDNA_ID_1823332_gDNA_ID_1620689_Annot_ID_48536 3000 nt of promoter + ATG

SEQ ID NO: 4199 - DNA, 3000 bp, Unknown
  misc_feature (1)..( 3000): cDNA_ID_1823329_gDNA_ID_1620689_Annot_ID_48538 3000 nt of promoter + ATG
tacgaacgtggttagaaaccaactgttcatcaaacagttgcaattggtgtaacagttgttttggatgatttgggaaattggtttaaacagttgtagaatcatgcattttgataatgaggtaattaagcaccttttctccggaacggcatggtcatttgttgcctaaacgattaccaatataaaaaaaggacacataatcataaaaactagtagcatatggagacagcaataatttggtgatataagaaaacatacgacagatataagcaatcaaacatgtcgtctattctttggtgcgctctctaaaattcaaaatagttaagtattatagtatcgactttaaaattctgttcttttacaatcacaagattaccacttataatcaaaatggtaatcttgaggatttgtgatttaactattggtgttacttgtcattggtgtgtcatcacctgaattcataaaatttctattgtatgttattgacaaaacaaattattgtatattgaagtcttttatcttttttttttatcttctttttattgttataaaacatgatgtctttaaaattttactaatagtgattctcatatttaatcaaatcagtagtgatcgttagaaaaatgattatgaattttgtatttgtaagaatataaataatttggtgctataataagatattagcgtaaaacatgatgttatttgcaaatcatagcgatatatctaattaactctcttttatattttggtcaatctaattaaatttcttttttctaattatggagttataattatgaaatttgtaaggtaaatagaggtgatacaaaggattccaatacctttattggacatatagggttgtcccatgatttgactctgtccttctacagctgtcttaattaaatcttatgcaattttattcagtatctgctaattttctatccttcaaatataaataatatatgtgtgtgtgttttaaattgaattttacatataaaacaaagagatattgatagaaaaagtggagcatggaagaaaaaaacagaagtgggaaacaaaactgcagagattccatgggtctcttgttaacttgcttcagtcttcttgtagtcttcccatcatcatatcagctgtgtcactgattttttttctgtttcctgaaaaaattgaaaatttctaagtttataaagcttactgacatcatatgatagttcaatggtaaatgaataattttattttatttttttatcaaggttggtttgttataaagggaatttaaataacaaaaaaataactaacattataaagttccactcgatctttcattcatgataacaaagatttcttctgctaaaactattttgttttcgttttgtctagaaaaatatttattctctttaggttcaccatatttacttaagatataatatgaacatgtttgttgaattctcagaatatttacatactaaataaatagttttatttggtgtaaaatgtttgttgtatattaagcatggttcaatatgttactgctgtccagaacttaaaattctgcttcaactcgatagattttgtgaatttgtgattaaatatcgttaatcgagttctctctaaccaaattttgcaagatctacaataaataaagaaagacaactaaaaaagcaagacctacaacacaatatgttgcattttaaaaataattacaaaggaataatcgaagggtggtttcaatttgggtatagaaggtgagtacctttttgttgtggtgaaatggaaacacacaactcatggctaagcagagactctctctcttacctgttttttattttattttgtttgattattttattccaaaagagtgaatcctcagttttccacatcatttgatatgaccattcagttaatttttttatatttctactttcttacatttatacactcaccaacctccaatctactttcaggaagaaaaaatgtagcattagtgagttcatcacttgttatacaattctttcttctcaaatattcaatttcattacaaaaattcataattagtcttactttcttgaaaattttccaaatcaaaatttataatttccttttcagtattggcgtcaaggattataggaaaggcaaggaattaagtttttcagtataaacgactaaagtcactaaataatcatcaaaaaataaaatcaaattcatatattgggccagtttaggcccattaatatagagttggatatatgctccatttattttcacttgtgggctcaatattttggtctgtgtacatttgttttggcaactaaaacttagttttatgagattttttttgttaatgataatataatcagctttaatactcacagtgccttagacaaattcaaatccaattcaatgttgattactattattttcttgtcaagtctaaaagtgctaaattgaactcttataatatgtaaactgctgtaatgaaaatttatccaatccttttaagtttatgttttaggatttatagagataaaatgatgagaaagcaacgcatgcatagaaaaaaacactaaagagttgactcttttttctctttttgacttttgagtaacgagttcatgccgctgattgcgctctttcttcccttccctaaataattatctctacttttcaaaattaaaagtttcaattataaatttgcttcttttttttcattttatcccaatttcattcgaaaacaaaacttgtctataacgtcttatagtacgtaattagtttataaatcaaagaaagcaaaactataatattaatatctaatttcgatatgttagaagattctaatccttaacgacactagattcatttaatcgagttataatatataatacatgcatcatcatctatttacttatggtcctacatttacttgcctttttcacttctttacacaacctcgaactctaacgaacattttcccaaagacagaaaaaaaaaacactaaagagaaac

SEQ ID NO: 4200 - DNA, 3000 bp, Unknown; identical to SEQ ID NO: 4190
  misc_feature (1)..( 3000): cDNA_ID_1025117_gDNA_ID_1620689_Annot_ID_48539 3000 nt of promoter + ATG

SEQ ID NO: 4201 - DNA, 3000 bp, Unknown; identical to SEQ ID NO: 4189
  misc_feature (1)..( 3000): cDNA_ID_1823325_gDNA_ID_1620689_Annot_ID_48540 3000 nt of promoter + ATG

SEQ ID NO: 4202 - DNA, 3000 bp, Unknown; identical to SEQ ID NO: 4186
  misc_feature (1)..( 3000): cDNA_ID_1823302_gDNA_ID_1620689_Annot_ID_48547 3000 nt of promoter + ATG

SEQ ID NO: 4203 - DNA, 1587 bp, Unknown; identical to SEQ ID NO: 4185
  misc_feature (1)..( 1587): cDNA_ID_1808099_gDNA_ID_1620689_Annot_ID_48548 3000 nt of promoter + ATG

SEQ ID NO: 4204 - DNA, 3000 bp, Unknown
  misc_feature (1)..( 3000): cDNA_ID_1841114_gDNA_ID_1620691_Annot_ID_48581 3000 nt of promoter + ATG
ttacaatttacgatgaataatcttggtgactggtggcttatgctattcttacaaatggccagcaccaagtcaaaatatatatcttctcgaggaattctacgaggcgactcaacccgatatatccatatgtttttagtatatgcaccgaagttttgatccaaatgccttaaaaggccgagtttcgaaaaatgattttggaactccgaatatcataaaactgtcaatgatagcttattcttttgttgggcaacgaaggaggaaactaatgcactaatgaacattattattacaacttataagtgagattcggagtcaaaatgtcaaatttggaaaaatgttgaagaggaagaggatttaaagaccattttcagcagttctattaatgtaatctacaaaaaatttatatattatttacaaaaaaatgtaattttatcgaaattgtttctattggaaatcgatcgaaaataataaaatatgatataaaaatatattacttctttcagtatatgagaagtatttattaaaatttttaaatgtgataacataccggtaaaactatttttcaaaacagaaaaagacaacacaattatttgaaaaacgtgaaaatttggtatttcatttctttttgtaagcaaaccatgacgtataaaagaaagaattcattctaggttttaatatattttaggaataatctcaccggtcatcatacaagtttagcagaagaataatctcaccggtttcattatgtagtatgtcaccatgtcgacaccacaataggagtatatatatgatatgactccaaaagaattgttatttaattaagaaagtattataagacaatacttttcgttgtatttgcggaggtaggtgggtttccaattatacaggtctaaaaatcgaggttggtgaagcttactttacaacaaaagtcctcctctattattctaccacatggaaaaaattcaccaaaacgtgatttacacatactctcactttattctaatatttaatatttttgtattcatattttacgtagatcgtttaattttctacatgtcgaataaataaataaacactattaaattgactttaacgttcaaacttaaaagtttacttttaccagccttttttctttactgagtaaatattacctgaaaaagacatttttctaacttcagtattctgtgtgtttacgaagaaaatgaagatcttcgtcacatcacatgttgacctcagatctgccaataccactaggcactacgttactatttaatgaccacataatcaaatcttaaattgaaaagacgattttgaccctcaccgactcacatgcatacaaaaccacctactctcctctccaaaccccatgatcatgccattctctagcaaatattaaatacttaatattctttgatcaaccgagggcacgatgcaataataataaataaatttgttaaccataacaactcctcaatcgtgtagttagttaattagtatgtccacgaaaaaaggtttcaaagggaggctaccaactatttcttgtttataaaaatgtgtgtttaatggctcttttcatatgctaaattataaaatttgtgacagagaatatctaagactttagtggaataacaaacttattttttctcattagaaactgagagtatcgaaaaataacaatttgtacacatttcatttggcattttcaacataagcaaaatgggcgaaagagttggatatgttctctaactataatgtgatgttaatttggatatggtatcgattaagtgatctagtcaggatgctaagcaaagaccaccaatttcttataatgttgggataatgaatagtgaggcaaagtgatgctgtagttacacatatgatgagttgtcactgaaattataacataaacataaacaaggatatagtcttatagagggtacggttacacatatgatgagttgtcattgaaaattataacgtaaacataaacaaggatatagtcatatagagggtacggtgacttcgtgattcttagtgatgattgatgaatatgaactaagattcatccgcaagtaactttaaaatcagattactatgaaaatacaattttaattttgcgttatccgttttcaagtgtttcgtttaagaccgtataaagttttatttagcttggagatatgtgagagactatttttatccgcaaaattcatatgtttaaattcatcgtgaatacttcctttgtgaaaaagctttaaaaaatacattattaacatttaaggggttaatcacataatattgaagcggataaattgttgaaatcttcacaacatagatgaaaattttgtggtcgacaatgttgacgttggtttaattacctttgcattgttaacacataatacatcttatttacaccagatgtacgaccatttgagttttgaaaggttaaactatgaaaaactatagagtttcttattaaaatgtaattactcctatctaaaacactgggctgaatcaagatcatgggccctcaaagccctttttccaattttaattcctccgatttatagggatttatacagttttttttttttttttggaatcaatagattatatttttgtttgtaattactttttattttctaccaacaaattcaatttctgatgtcaaaaaaataaaaataatccgagagagagatttacccaacacaaccttaaatgcaattgggccttaagtatccatctaatcataattaattaagggaaacaaatattggtaagagggtaaaatagtcaaaacacactaagcttgttctcctaccacacacacctaaccaactaacaccaaaattagcaaaggaggacaaatccgtaatttaccccattttctactcctcttttaaacccaaccgcctctcttcccacttctcactctctgatctcagatctctccctccctctttctccgatctcagatccattcaacaatctacaaagaagatg

SEQ ID NO: 4205 - DNA, 3000 bp, Unknown
  misc_feature (1)..( 3000): cDNA_ID_2050886_gDNA_ID_1620691_Annot_ID_48582 3000 nt of promoter + ATG
gtcaatttaatagtgtttatttatttattcgacatgtagaaaattaaacgatctacgtaaaatatgaatacaaaaatattaaatattagaataaagtgagagtatgtgtaaatcacgttttggtgaattttttccatgtggtagaataatagaggaggacttttgttgtaaagtaagcttcaccaacctcgatttttagacctgtataattggaaacccacctacctccgcaaatacaacgaaaagtattgtcttataatactttcttaattaaataacaattcttttggagtcatatcatatatatactcctattgtggtgtcgacatggtgacatactacataatgaaaccggtgagattattcttctgctaaacttgtatgatgaccggtgagattattcctaaaatatattaaaacctagaatgaattctttcttttatacgtcatggtttgcttacaaaaagaaatgaaataccaaattttcacgtttttcaaataattgtgttgtctttttctgttttgaaaaatagttttaccggtatgttatcacatttaaaaattttaataaatacttctcatatactgaaagaagtaatatatttttatatcatattttattattttcgatcgatttccaatagaaacaatttcgataaaattacatttttttgtaaataatatataaattttttgtagattacattaatagaactgctgaaaatggtctttaaatcctcttcctcttcaacatttttccaaatttgacattttgactccgaatctcacttataagttgtaataataatgttcattagtgcattagtttcctccttcgttgcccaacaaaagaataagctatcattgacagttttatgatattcggagttccaaaatcatttttcgaaactcggccttttaaggcatttggatcaaaacttcggtgcatatactaaaaacatatggatatatcgggttgagtcgcctcgtagaattcctcgagaagatatatattttgacttggtgctggccatttgtaagaatagcataagccaccagtcaccaagattattcatcgtaaattgtaacaaactcaccattatttggagagcccaaagatactactcaatcttcttaccataaacttttgtcactgtcttataagctataagattactggtctacttaactcagaaatatttatgtcctttgtagccaaaagctacactgaaattgacacaactcgagtgttgtccttttctggtcgattgaatagaatcgaatgtcttaatccagtaccctccagcttttatttcgtgtaatttattttccaaacctaccactaccagtttcataactctcgaataaatttatcaaatagtcttttgagtgctcaaagtcttgggataataaatggtcagtgctatgtatcacccggatgtgaaacattatgggtggagatagactattataaatttattgaaatatacgattgttactcgtttaatagcaaaagtagtacaatgtatatagtttctatcgagaacaagatctatttaaaattcgaaaagtacatttaaaattcataaacatataaagatagtaacatgttagatctgcatagtaccaccaaaacaagaaaaaagaaacgcacatcgccacataattgctatgattctcactgtcggctgctttgaaatattacgattcttttggtaaatcacacaacataatataattacaataaatatatatatactaaagtataattaatataattaataccacattgtttaattctgttttgatcttttaagatcagtcagatccaccgacgttcctacacgcgcaggtccagatccaaacagcacacacacacacacaatgccactagtgtaaatgcttggtggctattgcatttgcacctattgatactctttcttcaaaaacaagttattgtttttattttcaacccaactttaatacggattcatactgggatttaggtgttaaatctgataatttaggtttgaataagttgtatatttgtttctttgattaaaaaaagaacctatatatatacaaaaataaataaaaagttctagatttcaattttccgtatatagcgggttgaattgtctattttaatatgaaaattgacggatcttataaacaaaatgttctgaaatatgtaaaaggatttagccaaagttaaccaaaaaaaaaaaacaaacagaaaagtcacattcacatgtcgtggtagatctaaggcattaatttagaaatatgtcgttacaataagcggagaacatgggacgtttctcgtggtccaatcagacgaacgagatctcataaattaaatgacttcagacgagggaattcatggcagaatgataatgcaacttaagtgactttagagtgaaaatgatacgagaacaatgcataatccatatgaccgttgagtgagtgataccattagcgcgatacaagcgggactataaactgatctagattgtttttcttgggaaaaaatgttacaaattttaaatatgtagtttgaattgttaaaccaagattcaacagaaatataccgtaaataaacaacagttgataatagtcatcgaaaagatatcaactgattcttcacttgggctactgtgacggcccgttagggttctcaatataagtcaataactacgatctacgattcactgaaacaaataaaacacagccacgtgtccaccctcccacatcaccgtccgatctaacccacgacaagcttacaacacgggtcataccgctcgtgcagcgtgttccgtcatccacgggattacaacttctaccagatccaccaaaccctcaaaacaatctgaaccgttcatttcattttgacctcatctatatattctctgtcactccctttctcttctcctcgcacacacttctctctctctctctctctgcctcctttcggattcaaatctcagatctagctcaacc

SEQ ID NO: 4206 - DNA, 3000 bp, Unknown
  misc_feature (1)..( 3000): cDNA_ID_1823521_gDNA_ID_1620691_Annot_ID_48584 3000 nt of promoter + ATG
ttgatatgtttaatattagtggtcttaaaaaataataaattaaagatttaacccgtattaaaacggtagattaattatattttacatttttattaatgttgattcaaaaacctgtcactccaaatccgtcttgccaaaaagtcatttattttattaatattaattttattaatgatatgactccgaattataatctaaacattttagctaataacataggagtacaccatatttatttaataagagaatgtatcatatgacccgaatgcatttttacccaaatccaccaaaaaagtcttgcaaaaatactatagagataagaaacgatagtcggttttgataggtataatattagcaaatatattagttagcttaaattagttaaaaaaatacaaattgaaaaggtatattatactttattcgaatatagtatcaaaacttatataacacagagatttgataattttttaattgttgaatacttttttttgtgctaatttttatgtgattaagatttaattgattttgtatataaaatatgaaattgttttacgaacttatttgtttataatttggtaacagatagatatttgagtattcaatatattttgcttcagtttatgaaatctttgatgacccgtctttagatccaataagccctataatctagattaacctgcagtataccgcaagtaggcttatattttagttaagctaaaaacttttattgtaaagatgatttaaaaaatatgatattattttatttgattttaaatgtatagtaaactgtgagttgtatatgttttgttgatattatctatattgtttagtgtttaagattatacacttgtagtttgattgttaatttaagagtttcacatgtagtataccatcttgtattaatatcgatctaaacccgttcaattctaggattttccggcttgtattaaaaattgaatcacatcatacacataaaaaaatctaatatgttattaattattatagtatataagattataaattttcaatataatatgtatgaaattgaatataaatatttcaaattatgacccgttactcagtagaatgtttttttaaatctatttttcacctttataatatttttcatgtattgaacagtttatattcgtttttaaaaattcaaattatggcatatgcgaaaaaactctaattatttttttataatgatgatattatttttcgcaaaaatagaatcatataaagatgagaagtgaactataataattaataaaaaattaatatgataatttagatatcaaatctaatttgttgactttaataggttacttttttggaaattaataatgtatttcgtttttctaattaaattaaattagtgaaaatttagatatcaaatcttatatgtttattttgattggttattatttttgaaaattaataatgtatttcgtttttttaattaaatttaattaattaaattagtatttgactttttaatctttaaagagataaattaatttactttttaatctttaaagagataaattaatttactctttaaaattttatttctaatggcatacctatgtaattacttacaaaaattaaggttatatttaaaatgtacttcccaaataatatagtaggattttctatctcacaaaaaataaaaaaagtgtctatttctctaacttttcaaaaaactacctagtttgcaaattatttttgaaaaagtgtctatttttccaagaagccctttatataatctagtttggatgaaaaaatgagaaagaaaaaaccaaactcatatctattgtgagcgtgatacaactcttatttggagctactcttagttttttggcatttggaagaagcgattgagaaaaaaacgtttgatgcgtatgtatgtttatttggtgaaactaagtatggtaaaaatagagaaaaaaatttatctaacaaaaaaggagaggcttaggtatggttccttggagaaagcattcccataatcgtggcagctttgaggaggtggaaagacaaaaaaacggttatggactctttcttatgcccccaaatataatagctgcttttactttgttatagtttgtttgttttaccataaaaagaagtgaaggaaaggatattaatagcatacttcggagctctaacttttgccatctccgcgttgctctttaccttattcaaactcgagcagcaccgtctgcattttgagggtgaaggcgtatatcataaggatttgaaataaattggacaatgaaatgatggttactttcttttcattgtttaggattccttaacttataatctccaaaacttgggactagcatgtctttctttgtttttcttttttgatgtttttgacagaagatatgatggtgacagtatgagagagacctagatgttgtgaatgaagacacaagacaggatcaaagaagtccggctacgaagtcggagtataagtatggatgtcagatgaagtaaaaccattttggtaaagatgacagaccccattttatgtactatctatatggtcaattctaacaagtcactcactcaaattcatgaaatatacaatgcaaaaaagaaagtcccgtcgaaccctttgatgggtgttccatcgatattcggttaaccgttggcacttgaattctttgctatacgaaaagtttggttcaatttcttccggttcattaaagttaccggttaatattcgttaaaccgggacagcttgacttgacctaagaagagccctagtatcgtttttcatgtttcggtttctacgaagtatttgcaaatcgttctctcttctcactgaaacccctaaattcgggtcttggatttactcgtaaaatcacaaagtttatatttgtgttgtgattttgtgaattgtgtatcaaacctttctctcttaggtaatcgtgttgttaataatattaactctcttcgtctcgtgctgtgcacagtgcatagaagatg

SEQ ID NO: 4207 - DNA, 3000 bp, Unknown
  misc_feature (1)..( 3000): cDNA_ID_1823517_gDNA_ID_1620691_Annot_ID_48585 3000 nt of promoter + ATG
ctctttttattaatcaatatattttgatgaaaatcttccggatagcatatttagctttcgaaactattctcgacccttactcgtattcttccgttataaatgtattaagtaatggtttatatttaggaaaaatgtcatatttagcttttgatgtttagatcacttgttaatgtacaagatcaaagacataaaaattctattattattttggagacagtttttattttattacaaaattcaaaaatatgttttgaaataaacagttttctctatagttttatttctatgttgtaattcaatcaaaacaaccatctcagatatataatctccactttgttcattttgatatagtttttttttcaagtagatgtgctaaatctccaaaaacaaatatattttgttatctgttgcgttcttcatgattatgtggaaagtggtttatcaaatgttagattatgtatgtggctttgttctttcttgttatgttatgtatgtgtccttcataattatgtggaaattgttttttgttgttgatgatttggtgactggttgaatttgaccattttgtcattttgtgaactatgcttaacggccaacgcaatggggatattgaggtggttttctctaagcggctatcaaagacattcagacagaaagaattggagtatatttggatgccactaacgaggctatatggttcgaaaagagtaatcgtctcctttgataggatacaaagtgtttggtcatactttttttccgttcacttgtatatctatctaaaaacccgattgcattacaaaatttctttgggcggtacatgggactatttgtcagcttagataacccaaaggaagatatcgaattattaatctaaagaatatccgaaaattcgaaataaatttacatatccaaaatattagctatatttagttacaaaatttataccacaaactacaaaataacaaaaatatcttaaataacctaggcttccaaaattttgtagttatatttgataaatttatacatttttttttttttgcaaaatataaccaaattttagtataatcaaaatgtttattatttttttgtttttttcttccaaacaccaatccaaattcgacagctatttgaattgaatagtcataaaatctgaatatataataaactcttctatccaaattatccaaatccaaaaatattcaaactaaatcctattcaaaatctgaatgcctaggcatagttatatacttatatacagtaaacggatttatttcggcgggtatggttcagacagagacttcacacccgtgggccgacgtggaattactcgaccaaggcttcactaaaaatgaatatgtgctactaaaacgcaccgtttcttagtttaattcaaacggcgtcttattgcttctcactctcccaatctcgattctcagactcaagacactctggaagaaccctaaagcattttcctcaatcgttattggggttttacgaattcgacatctgtttctgactccgccgggtaagtgattatttctctccgttgaacctaccttgaaactgaaaaattctcttttgattactccgttctttcactcgatatcagaagtttttttcctgtttcattttttctgtgtttatgacgaagtcctttctctcctttgatttgtctatcgaggtcatggtcttgtttttttctctgaaacccatttgggagttttcagatttttagttgaatcgagaaatttgatcttcaatttcctgaaattttgtgtaaaggtcccatttttaatgcctagtgcttgctttttccagtggtttacccaaatgcttgaaatgatataagttaagctccggtcatttgcgtcgtttatgttttttacgttaacccttttggggaattgcgtctttgggcgacaaagtcttcaacttttctggatttctgttgaaatattatctttctgtctcatttatttcattgctactttaagtgtttgaattgatgcttgtcgtatctctgattgtgtaaagtttgtctcgaagtcattatatttagagtttgtcttatctctgcttgtgtataatgtttgtcttatcttctgattgtttgtcttgttttataattgaacattcttttagtgtaatttgtcttagtgcttcttcatctgagtgtgcgagaggaagctagcttatgatccatgtacttcagatttaagttctttgtacagaagactcggtaaaatccctgaggccgagtctctctaatttttgaacttttttagagcacttgagctatttctagctttctactgtgaatgttgtttgtgaaatttttggtgtttgagcttagatagattttgagttttaattgtttgcactttggctatgtgatatctcctgagttcgtggattggtcatgttagctctgtcgttattattctttgatcatataattcatctgattggtggagtgttcttattatccactgattcatttgttgaaaaaatgaagttggttgaaaaaaatggagaaattgatgcgattcttgagttttgttatgccaattactgtgaaaagtttgttgattgttgttggaattgatgtgaaatatgtgtgctttgggaattttatgctacaattgtgaacagatgtatcaaactccgttgcattgaaaatctctgtttgggcatgtctcgttgtagtatacagttcccaggattctgacataatgtttcaactcatgacatttcttaatttgtgtaatctaatggtcgttttgactacataatgaatgcagatggctagatgggatcagattttctccttacctgtgcaaaatcctaccttgccagaattttcttctaccgatcttgtctggtcaaaggttgaaggttaccgggacaatatagataggttagccctcatcccatatactagggtggatgattttgtaagaggtgaatgctcgaataaagattgtcctacaagtttccatg

SEQ ID NO: 4208 - DNA, 3000 bp, Unknown
  misc_feature (1)..( 3000): cDNA_ID_1823513_gDNA_ID_1620691_Annot_ID_48586 3000 nt of promoter + ATG
ggagatgggtcgtcgggaaatcgagaaaagttgtcatctttcgtgaattcagaggatgttgatttctgggtaacgtcgggaattgagaaagcggtttcgtctgtgtcggtgaagagagcagagtagtcgaaacagaggagaacgaaacagaggataaagaagagtggaacaacgaaccagacattgttatgattgttgttgttgttggtccgaaacttccccgtcgtgatggagatgggtttctccatctgagaataattcttgggtcgcatcaaaaaaaggagagagaaggatcaaaaaataaaaaaggggaagatttgtttgttgagaagttaaaggaagattagtgtgaccatgaaattggggagaagaagagtgagagagttagagtgacacatggatgtgttcgagatactcaaagtgaagcgtttacgttgtcggcaaattaaattaggggagattcagtttcacatgggtcagtcaataaagaccttctctttactctcggctccacctaattatagtactctattaatggtaatttaaattgaatataaatgttagattatactataattactaaaataaatgttgtattctctctgttttagattagttgatgtttaatatttttacataaattaaaaaaatatataatttttctgttttatctctaattaatgtattattaaatttgatatcatcaattaatcagctaaaataataaggataaaattgaaaaatctgtttaaaaacatgcattaaaaacataaaacaacaactaatttaaaaagaattaatttataaaacgataattaattgaaacggaggaagtataatttaagtatgatgattttagttttaagattttacaaatttgttttagtggatttatttggatagagaaaaatacagaaatagcgaaaaattttaattggagagcaaaagttaaataccatttcacatatttgattgtgattaataagagctcaattgatgatatctaaagcttttgtacacacaaaaggggaaaaagaaaagcacttttgctaggaaaaaactacattaaatgggtacaaatctttattgttttgtgctaaattttgagtatgttgtttaatctttcttgctttagtttcggctttccctctttgtatatgctttgttttgcctttgctttcctctttgttttgtgctaaattttgtatatgctttgtttctgagatcatctcgttgatcgccgacattcataattttttatatataatctatgacacgaagaaaaaaaatgggtacaaatctcagtcgaatcattctcatatttgaatatattagttctgtgaaccgattgacatatctgatagtgactagtaggctagctagtgattactgatgtagtatgcaaattgaccaaaagatgagatttaaagcttagtttggcaaaaataaattaaattggtacaattatcactcgaatcgtatatattgttgacgtcaatcggtttcttactaaatgactaaatttttaagcgtttagtatacagtctgagtctatatagtatataaaaacattaattgaaaagaaatggatgatttgtttcattcacatatttatgatttctatataccgtattgttttaaagatacacataatcattctcatatttatgatttctatataccgtattgttttaaagatacacataatcattctcatatttatgatttctatataccgtatatgaggaaacaatacattaacgttgaatttgttgacgatgcgcgatcgtatggaacgtagaaaatacttctgtagtattgagtcttttgagatgatagtcaacgtaggagattactttagatttcaaccaccattgatctcggcgaatattatgaaatttatatgaccaccgacgaaatttcaacggagtcgattatagacatgtcaattaggattaaagcaaactctaaaacagacttacataaatatgttcaaaacaatttggacttttcgaggtaagtccggccaggttcggatcagcccaaaaaatccttaaaaatatattttaatcttttttttgatcttttaaaatatattttaattttgtttttttgatattttagtttaattgggagattttggtttaagaattatttttagtagatttgaaaacctaaacctaattttataattgtgttttactatgaatctgaaaagcaaattttgggctctactactcagttcaaagtgatatgactttatattttagttggtacgagtttaaatcatttatttgattgagtcgttttatatttagatttttttcgtaactatgcaattttttttaaaaaacttacatatattataaattataagttattttttcttttaaaagaaaatccaaaaatatcaacaaaaaccctgtaaaagattggtcggactataaaatataggttcggaattttaacgggacgaaccaaactagattcaaatagttgattttgcgggtttggggcgagccgggcctcacatgcctagggttatggttttaatatgatgtaacaccgtttatggtttttgaatataaattcgtcgatttgcaccaaaacttttttaatcggtttggttcgatttttatctatagtgggctaagttcttaaaagcccagacttgtgtttttttttttcgtaactatagatcgatcacttaaaactaaattaaactgaacatgtttattatttattatacacgtagttcgaaacagcacttagagacttttcacctttccactactgacctgaaaaagttgaaaccctaaaactggagtgaagacacagtagatacgatcggaaaattccatggagatttaagcatctcaatctcgatctcgctccgtttgatctgattaggtacatatttctgtcattttgatgtctttcacgttggaagatttattcgattcttcatttcagttcgatgtttgctaggcagataacatg

SEQ ID NO: 4209 - DNA, 3000 bp, Unknown
  misc_feature (1)..( 3000): cDNA_ID_1823507_gDNA_ID_1620691_Annot_ID_48588 3000 nt of promoter + ATG
gtcatcctcaacaccttctcaagcgtctcacgcatgttccaagttatactgatggaaaatgttgtttgtgtggaagcaaacttcataacttgttttatcactgttctatttgcaattttagcgtggatgtcaactgtgaaaaaaatccaccctctttcactctttttcaccctaaagctcatgagcataagctcactcttatgccgcaacgaagttttgtatgcagcgcttgtggaatggatgacgatccaaatccttacgtatgtcctcagtgtaatttcatgattcacagaagttgtattgatataccacgcgttattaagatctatcgtcatgatcaccatatttgttacaataactttcttgacgctggagattggaaatgtggaatatgtcataaaaagataaactggacatgtggggcttattcttgttcggaatgtccagatcttgtcatgcacttgagatgtgccacaagattcgggatatggaatgggattgaacttgaaggcatatcaaaaaatactctaaaagtcaaatcatacgaggagatcgaagaaggggtaataaagcattttagtcacgaccatactttaaagtttaaagaagggagtgatggtaacggtgaatgcatacagtgcacaatatgcacttatcccatattttctaatccattttatagttgcatggagtgtgatgatttcatccttcataaaaaatgtgtggatctcccaaaaaagaaaatagattctttctacaagatgtcgacctcgctaatcacaaattatcagggtaatgcagaaaacatttgcaatgcttgtcaaaacatctatcaaggtttttcttacttaagtgatgatggaaacactttattggatgtgcgatgtggttctatttccgagccttttttccatgaaagtcatcctcattcgttatacgtcagctacttaacaggcggccgattttgtaatgcttgtagagaaaaagcaacaatggttttgagttgtgaggaatgtgaatttgttttagacattaaatgctctactctgccaaacattgttaaacacgaaaatgataaagatcatttgttgtctctatgttatggagaaaacaaatgtgagcaatgctggtgcgagatgtgtgaggagacaataaatccaaagaaatggttttattcatgtgatcattgtggcattgcttttcacatcagatgcacacttggagacttcatatggtttaaaccggaaaaaaaatctgaatcatccaccaattgtgtgattcttaataatcgtgcaagtcggccattttgttattcttgtaattctcgctgtaaatacccatccatcttgtttttctatgggaaaacattgtgttctttgcaatgtttccaacaaaaagtttatgcaatcctggcataaatcttatttattttctcaaatattttatgataaaaaacaaattagattatgtgttgcatgttaatactatatatattttaagcatcaagtatattaaaaaaaaatttatgtgcaatttggaattcaattcgatttaggttggatttctttttatttctttgttatacttttggtttagaaataatagtattcaaaacaaaatataatatactttaagtttcgatatgtattcaaatctaatcaaatactaaattttataccacgtcgtgcacatgatgattttcttttgaaacaatttgtgaattttgataagggtttattggtaacgagtgtttacttgttgctgtaagaactttttttttgttttttccacaaaagttggattttattgaactgaaccaatcaatatgggctaatataaacaaaagccgtataactataattttacaagaattaattaaagcccaacatgagcctaaacataaccctaatgaagaggaaaatacaaaaagcctccatcactaacacgtgtttcaattagaacaaacagagagcttccatcacagaccgactttaaccttgccgttcaccaccgattccggtgacaagagtcatcgtcgatattaatttgttcagtaaattttgtggtttttcaccgtttaacaaaatcggagcccataagaggataacagctaaagggaattgatagtatgcttcagttcttctacttcttctctttaattaaaattgcaaatcactgggataattaaaaaacctttcccaattaaaaaaccaaacactcaaaagataaatcagtgaaaacaattgattagtgaaatttactaaattgcaatcaccaatgagaaatcccatgaaattatttaaagcaaacaaatatggaagccgactaaaagatgttaacgaaaccatctatgtcagttgataagctggacatcactgcgtgggaagccaatagattccagacggaagccgaccaaagatgttaaagaaaccatccatgtcagaagagaagccggaaatcacggctgaggaagccagttgattccggacggaagccaactatcttggctaacagagtcataagatgctggataaaagcccgagtcatacgagacggcgatttactgaaaaattcagtcggtagaaacagagttcatctctgtaaaagatatgtaggaaaaaagagagaactttttgttttgctgtaaagaactttggatgcaaatgtttttactatttgtgaaactattattttatatttatagccaaatttaattttttaactaaacaaaaattatgccgtccatatagtatcctgtaaattaagttttagattattaattttgttaattattgataaaaaaaactcaaataatgtcatattttctcttaattcaaaagttaattgtgtataatttgattggttcccccaaaagaaaaattgattggtttagtgaaccgataaatccaatctcgtaccgaccggttcaatgggttttgtatttgctcctctgtgctctggcctctacactttggatagctgccgccgaagttttgtgca

SEQ ID NO: 4210 - DNA, 3000 bp, Unknown
  misc_feature (1)..( 3000): cDNA_ID_3072763_gDNA_ID_1620691_Annot_ID_48591 3000 nt of promoter + ATG
aagtctctttatatctatatcttaattcaaaacacatccatatacactttggttacaacttgcaagaaatctgtttcaatttcttaatgtacaactaaaccctctttagcaaaagtagaattattaaacgaatattgtttcttgtcacatactttatatagagacatataaatagaaacatatatgtagataacaacgacacaagtcacaatcgtgcttactcacgtattacgtatagccaaaagtttcctactcatatatatcacaagtgtgcttgcgtttgagatatactcagagacgtgtagcttcactaattccacatactcagagagaaatggcaaccgaaaccgtattagccacggcggtgagcaatggcaaaagcaaaggatgttgcaagtccggtccaggttacgcgacgcctctcgccgccatggccggtccacgggaaaagctcatctatgtcactgccctttactccggtaaacatttcattttctcatcttcaacttatatataaataaatatattttttttgttaaacattttcaacttatatttttattcaacaatttcttgctattttgagactaaaaaaaaaatctgacttaatcttatacttttaacgtttaaagaatctttgttagatcccatggaatctcaattgaatcacataacaatgttaagtttcatggacttgtaactcaagtcccttggcaatagttggcttaaatccgtttaatcttataaaaccggactacgtactagtactaggtaatgttttgagagcttttgctttatttgattgtgttaatttaggaacggggcgagacaaaccggactacttggcaacggtggatgtggatccaagctcacccacattttcaagcgtcattcacagactaaaaatgccatatataggagatgagcttcaccacactggttggaactcttgcagctcttgccatggtgatgcttctgctgatagacgttaccttgtcttaccaggcttaatgtaagatccttacattgaccctctcacatttcttgatgatgaattgactaaaaatatgtttctttcttgtttgaatgaagttctggtcgcatctatgcaatcgacacaaagaccgacccaaaggctccgtctttgtacaaggttgtagagcctaaggagattgctgaaaagacaggattagcatttccacatacatctcattgcctagcttcaggggatatgttggtgtcatgccttggggacaaagaaggaaacgccaaagggaacgggtttcttttgctagactctgacttcaatgtcaaaagcaggtgggacaaaccaggacatggtcctttgtttggttatgatttttggtaccaacctcggttcaagaccatgatcagcacttcttggggtgcacctaaagccttctccaaaggtttcaatctccagcatgttgcggatggcttgtatggaagtcatttgcatatttatcaatggcctgaaggtgaaatgaaacagataattgaccttggaaataccggtctcttacctcttgaggtaacattacaccaacataaatgttgatgatctgtgttagtaaccaagtatgtaagcttattgggtttttgttgttatgtggttgcagatcagattcttgcatgatccttctaaagatacagggtatgttgggagtgctttgtctagtaatatgataaggtttttcaagaacagtgatgacacgtggagccatgaggcaagtgaagtttctaaatctttttcttttgtcttatctcaaatctatgattaacttgtgatttaaactggtgttgttttaggttgttatatcggttaaaccgttgaaagtcgaaaactggatacttccagaaatgccggggcttatcaccgacttcttgatctccctcgatgaccggtttttctactttgtgaactggcttcatggagacattcgtcagtacaacatcgaagaccctaaaaacccggtcttaaccggacaaatatgggtcggaggattactacaaaagggtagtccttataaggctgttggagaagatggtaatacttaccaattcgatgttcctcagatcaaggtttgtaaccaaaatataatcttttggagcgttttaaccaaagtttaaacaatttgcattctattgaaactgtcttggtgatttcaggggaagtctctaagagcaggacctcagatgatccaactaagcctagatgggaaaagattatatgcgacaaactcgctatttagcgcatgggaccgtcagttttacccggaaatcatggagaaaggctcacacataattcaaatcgatgttgatacagacaaaggtggtctcactctaaaccctgacttctttgtggactttggtgatgaaccagacggtcctgcactagctcacgagatgagatatcccggcggagactgcacttccgatatctggatctgattttggctccctaagagtgtaagctggatttgtggctagattcgtgatcaagacaattaaagttgttcttactcctttgtggcttattccgtgataataaaactttctatttatgttgtgtgtctctatctttcgagtaaccgaattgaaccgatcaaaaccgggtcgaattatggatcatcaactcaaaaacacgtcagatacagtgtacgtggacacatggaccagatttgttatcttcttcttgttattttgttaatggacaagatctggttaattgtttatgttatctattttgtgcatggagacgtattttaattcgaaatacatctcaattaacttactataattttcagtaatgtgattcattaatttaattacaaggactaatcaagttcactcgcaaatagccaaaagcttgtcactgtgtgtttgcgatatactttaaagagagagacgtgtagcttaacgactaccatatacacacaattcaatatttgacttcacatagagagagatagagagatg

SEQ ID NO: 4211 - DNA, 3000 bp, Unknown
  misc_feature (1)..( 3000): cDNA_ID_1823503_gDNA_ID_1620691_Annot_ID_48592 3000 nt of promoter + ATG
gtttacaaaattgaattttattactgtattactgttgcaaacaatcaattaagttattatttgcatttatttaaatttttatgtataagaagaataactaaatcagtgatacataaataaatttattattattcatgaaatatttaatgataaataaaattaataaataaaataatagagaataagtagatttattacattgaattgtttacgaattaaataactgaaatgttgttttcaaatttgttaatttcaatacatatatagaaaaagtgtaaactaatttagatattagcgttaccataataactctagaagcccttaagcaacaacagctgatgaatgcttatccctcactatcttcatcagctccagctctgcgccaggaatcgaaccctaaccactgctaaagccctccatgcccacatcgtcaagctcgggatcgttcaatgttgccctttggccaacacacttgtcaatgtctatgggaaatgcggtgctgcttctcatgctctccaggtgttcgacgaaatgcctcatagagatcacatcgcctgggcctcggttctcacagctcttaatcaagccaatctctctggtaagacactatcagtattttcttcagtgggttcgagctctgggttgcgtcctgatgattttgtgttctcggctcttgttaaggcttgtgctaacttaggatctattgatcacgggaggcaagttcattgccattttatagtctctgagtatgctaatgatgaagttgttaagtcttcactggttgatatgtatgctaaatgtggattgcttaatagtgctaaagcagttttcgattctataagagtgaaaaacaccatttcatggactgcaatggtatctggatatgctaaaagcggaagaaaggaagaagctttggagctttttaggatattaccagtcaagaatttgtattcttggactgcgttgatctctggttttgtacagagtgggaaagggcttgaagctttttctgttttcactgaaatgaggagagaaagagttgacattttggatcctttagttctttcgagcatcgttggcgcttgtgctaatttggcagcttctatagcggggaggcaggttcatgggttggttatagctctaggatttgattcttgtgtgtttattagtaacgcccttatcgatatgtacgctaaatgcagcgatgttatagctgcaaaggatattttcagtaggatgcgtcacagagatgtagtttcatggacatcgcttatagttggaatggctcagcacgggcaggctgagaaggcattagcgttgtatgatgacatggtttctcacggtgtaaagcccaatgaggtcacatttgttgggttgatatatgcgtgtagccatgtcggttttgttgagaaaggccgtgagcttttccaatcaatgactaaggactatggaattcgcccatctttgcagcattatacatgcttattggatcttctcggtcgctctggactccttgatgaggctgagaacttaattcatacaatgccgtttcctccagatgaaccaacatgggctgctttacttagcgcttgcaagcgccagggacgaggtcagatgggtataagaatcgctgatcatctcgtaagcagctttaaactgaaagatccatcgacttatatacttttatcaaacatctatgcaagtgcttctttgtggggaaaagtatcagaagcaagaaggaaactaggagaaatggaagttagaaaggatccagggcacagtagcgtcgaggtacggaaagaaaccgaagtgttttacgcaggagaaacatctcatcctctaaaagaagacatttttcgattgcttaagaagctagaggaagaaatgaggataagaaatggttatgttcctgatactagttggatcctacacgacatggatgagcaagagaaagaaaagcttttgttttggcatagcgaacgatccgctgttgcatacggattgcttaaagctgttccgggaactcctatacggattgtgaaaaatctaagggtttgtggagattgtcatgttgttctgaaacatataagtgagattacagaaagagagattatagttagagatgcgactagatatcatcattttaagggaggaaaatgttcctgcaatgacttctggtaagcttcttctctattgtaacattttatttatgaaaattgttgagatttttacatttttttaatagtatagtaactacggtcacgcaaaatcgatttttatcctcaataaagaaacaataaagtgggtgagttaattcatatgcgttgtagataacaacaaaagagtcactgttttaatagcactcactcactcaccaactcacggattaagtaacatgtttgtttattcaaatttcacttaccaactcacaagtcatgactatagtaacaacaacacgtgcatggacttatgctaataatgaatgatatgaataaaataatgaaaatgtttgtgttgaacaatttttcacgattagtaatttcaaattttttttctaattatatattttagcatgctatagataattgcggaagtaagttttgaattcgtgaaatttgaggaatgttataaaatataaaaccaaaaccaaaaatgtaccaacaaagtctctttatatctatatcttaattcaaaacacatccatatacactttggttacaacttgcaagaaatctgtttcaatttcttaatgtacaactaaaccctctttagcaaaagtagaattattaaacgaatattgtttcttgtcacatactttatatagagacatataaatagaaacatatatgtagataacaacgacacaagtcacaatcgtgcttactcacgtattacgtatagccaaaagtttcctactcatatatatcacaagtgtgcttgcgtttgagatatactcagagacgtgtagcttcactaattccacatactcagagagaaatg

SEQ ID NO: 4212 - DNA, 3000 bp, Unknown
  misc_feature (1)..( 3000): cDNA_ID_1823495_gDNA_ID_1620691_Annot_ID_48595 3000 nt of promoter + ATG
aaggtcgtaggtaataccaccgagctgctcctggatgatattgaaattacgaccgttggtccagtcgtaccaaaggtcgatcatcgagagatcgccggagtaattcatgaacattagcgcgtggaactggtgtggccatggcgtcggcaccggctcatccgcggcggcgattttcacgccggcggttatataaatgaagataacgattactatgagtggtcgtctaaaagccatgtgtatcagtgtggtactgaagttttggttcgtgcacggaagataaattaaaatactatatagtatacagttcttttaaattctacataaattgttatcatcgaaacatacattttagtccattagtctactaaactcattattgatgtataatctctcaatctacaatcagaaatgtatttgcaaaattaacaatattggggaaagtgtttcttggttcaatttgaaccatccaaccaacaatccttttaaaatcatagcacaaaagaactatgagagtttcaaaaagaaaatcaaaagccaaaacaaagcttttcttgcatgactcaataaacctacactacaccatactcttacttataaacctcatctccaatgccacaccattccatcttaaaatcacattctgatcatcaccaacacattgcaaaccaaaccagacacaaacacaaagacatgtctcttcttgctttcttcctcttcaccatccttgtcttttcaagtaagtcatcttaataatgcatcatgtttacattttctttacgtaatctcccatattgaacatggttttcttggttttacaggttcatgttgttccgcaactcggttccaagggcacaggtacatgcagaggaaaacaatgctagatttggctagcaagattggtatcaactatggaagaagaggaaacaacctcccatctccatatcaatccatcaacttcatcaaatctatcaaagctggtcatgtcaagctctatgacgccgatccagagagtctcacactcctctctcaaaccaatctctacgtcaccataaccgtccctaaccaccaaatcaccgccctcagctctaaccaaaccatagctgacgaatgggtcagaactaacatcctcccttactatccacaaacacaaatccgttttgtccttgtcggaaacgaaatcctcagctacaattctgggaatgtctctgtgaatcttgtaccggcgatgcgcaaaatcgttaactcactcagattacatgggattcacaacatcaaagttgggacacctctagctatggattctctccggtcgtcgtttcctccatcgaacggaacattccgggaagaaatcaccggaccggtgatgttaccgttgctgaagtttctcaacggaacaaactcttacttcttccttaatgttcatccttacttccgttggtcaagaaaccccatgaacaccagtttggattttgctctgttccaaggacactcaacctataccgatcctcaaaccggtttggtttaccgtaatcttctagaccaaatgttggattcggttctcttcgccatgaccaaactcggttatccacatatgcgcctcgcgatctctgaaaccggatggcctaatttcggtgacatcgacgaaaccggagccaacattctcaacgcagctacctataaccgtaatctgatcaagaagatgagcgcaagtcctccaatcggtacaccatcaagacccggtttaccaataccgacatttgttttctccttattcaacgaaaaccagaaatccggttcggggacacagagacattggggaatcttgcatcccgacggttcaccaatctacgacgtagatttcaccggtcaaacacccttaaccggtttcaacccgttacctaaaccgacgaacaacgttccttacaaaggtcaagtgtggtgcgtaccagtcgaaggagccaacgagactgagcttgaagaaacattgaggatggcttgtgcccaaagcaacaccacttgtgcagctttagctcctgggagagaatgttacgaaccagtctccatttattggcatgcaagctacgcgcttaattcgtactgggctcagtttcgtaaccaaagcattcaatgtttcttcaatggattggctcatgagacaacaaccaaccctggtgagccattctttgtagtttccaaatttagaccaaaataaccttttcgtatagtcactaacaaagattttttacaggaaatgatcgttgcaagtttccgagcgttactctgtgaggaggacttgaggaagaagacacatgattaaagctggattattcgtataactcaatattgttccttatcttttttttattataccttttctgcttcaagtttcgctatgttgagaaaaaaaattcaaataattaataaatagtaatttttttcccttacaaagctgattattattacattctctaatcaacaacaaaattatctatcacaaactgtaacagctacaaaaacgtaaatgggtgggagatttactttgccctaaagctgcaaaaaaatcaagaactttaataattttaagaatttttagattttctgacataaacacaaacccaaattagctaagaattaatgtaaagaccataattggatcatcagcaccaaatgtcgtatattctcatgtgattccattgagtaacactaaagttttcgtacgagattatgagcaaaaagacaaaaaaataataataataaattaaaacacataaattttttaattgaatgtatatataaaaaaatctcctccggtgagcttcttctggaaccagtgaagatcaaaatcaagacaacgacatggttactacgtttgcttcgagatctcattctctctctgttccatttcttctataaagacagtcctcatcttcatcttatctgcaaatgcaaattcgtctgaaacctgattattccttcttcatcgcctcttcctcaacgatg

SEQ ID NO: 4213 - DNA, 3000 bp, Unknown
  misc_feature (1)..( 3000): cDNA_ID_1823491_gDNA_ID_1620691_Annot_ID_48596 3000 nt of promoter + ATG
actgccactgatcaccaccggtgacctcccgtcgtttcttcaaccttcgaaggcattaccgtcagctcttgtgactctaagagaacatatcgaagctctcgaaacggaatcaaaccctaagattcttgttaacacattctctgctttggaacacgatgctttaacctctgttgagaaactcaagatgatcccaatcggaccgttggtttcttcctccgagggtaaaaccgatcttttcaaatcttccgacgaggattacacgaaatggttagactcgaagctcgagagatcagtgatttacatttccttaggcacacacgccgatgatttaccagagaaacacatggaagcgcttactcacggcgtgttagctacaaacagaccgtttttatggatcgtgagggagaaaaatccagaagagaagaagaagaatcggtttcttgaattgatcagaggaagtgatcgaggattggtggtgggatggtgttctcagacagctgttttggcgcattgtgctgtgggatgttttgtgactcattgtggttggaattcgacgttggagagtttagagagtggtgttccggtggttgcgtttccgcagtttgctgatcagtgtacaacggcgaagcttgtggaggatacgtggaggattggagtgaaggtgaaggttggggaggaaggagatgtggatggggaggagattagaaggtgtttggagaaggtgatgagtggtggagaagaggcggaggagatgagagagaatgcagagaagtggaaggcgatggctgttgatgcggcagcggaaggtggaccgtcggatttgaatcttaaaggttttgtggacgaggatgagtagtgggttttaagtttttgaagttaaagaatgtgcatcttaccttgttcaaataaagagaacaaacagagaagaaggtctcgtttattcactcttgtactcctcctgattggtcatctagaagaaaagaaggtctcgttaattaacattacaaagcagccttttctttgtatcctttaaattcactcaaagctccctttgtagacaaactcttcttctctttgttgaaacaataaaccggtgcttgccatttctcatcctctaggaccgcacctacctcgtatgtcattatatgagcctccctccctgcaacagttatatgtcagatgaattttgctagaaaaaaccattagacagatcgaagacaatgggcatgttgatggtatcaatcacctgtatagaatatccattgcacgggtctcttggtttcaacatcttcatagtaccatataaagtctaccttctcccatacattgcagagaaacccactcacgttctgttgaccaaggtacttggctccatctagccagtttggtcgcagtattccaaccttatgtgacataaaattccaagaatattcagcaagttactatttacaaaagcattccaggttcatacaggaccaatctaagtgaacttgctactataaaaacgaaaaaccaagccttagtaaacatgtgaagtcactcactgaaccctcttgaataatcatctgttgatcctacaagtttctactctgcaaaggtattccaagagaccagaccaggtcatgtaccctactactaccgaatcctaatctcctgatcctggttaaggattttgtaaagtattgttacttaacgagcatatcaaagtcaccagagtgattaggtagcttcagtcttcccataagatgcaaagcacaaagagtattggtaacaatcaaaatgtacaccctgcctgctacagttaacaaggaaatactacaaattactggaattttttaaaaagaaagaccaagtgagagtgaagtagtaagaaacaagagagaacttcagactaaatctgcagagagctccattttcatcaaatgaagatttgtgaaatcacctgactttaacaaaaccgagaactctcctactctcctaagatatttcaatttcctactcaaaatgaaaaactcaaaccttacacaatgactatcctataaaccagacactataactaaggtcattgttgcttcaaattggagcaatctctggttttctaactctcattcccagtgaattcacacaaagcaattaacaaagttaaccaaatcccaaattcgaatttggttccctattctacagcctaaccgtattctgagatctgtaacagagtcatgaacagaaaataccaacctcgagctgaccggagcggcacgattttgactcgtcgagcgtgtaaaagaaggaagtaccattgttccattcaaggtcgtaggtaataccaccgagctgctcctggatgatattgaaattacgaccgttggtccagtcgtaccaaaggtcgatcatcgagagatcgccggagtaattcatgaacattagcgcgtggaactggtgtggccatggcgtcggcaccggctcatccgcggcggcgattttcacgccggcggttatataaatgaagataacgattactatgagtggtcgtctaaaagccatgtgtatcagtgtggtactgaagttttggttcgtgcacggaagataaattaaaatactatatagtatacagttcttttaaattctacataaattgttatcatcgaaacatacattttagtccattagtctactaaactcattattgatgtataatctctcaatctacaatcagaaatgtatttgcaaaattaacaatattggggaaagtgtttcttggttcaatttgaaccatccaaccaacaatccttttaaaatcatagcacaaaagaactatgagagtttcaaaaagaaaatcaaaagccaaaacaaagcttttcttgcatgactcaataaacctacactacaccatactcttacttataaacctcatctccaatgccacaccattccatcttaaaatcacattctgatcatcaccaacacattgcaaaccaaaccagacacaaacacaaagacatg

SEQ ID NO: 4214 - DNA, 3000 bp, Unknown
  misc_feature (1)..( 3000): cDNA_ID_2993367_gDNA_ID_1620691_Annot_ID_48601 3000 nt of promoter + ATG
atttaaaatatttttaatgtaatcatgaatttatacatatacatatacggatgccgtgttaattccgaaattccatgaatctgcatgcatttcgagttttgtaagacaggacaaagaactcgttagtttaataatttaaatttgttatgagtttgtgacttgagagacggaccacaccaccttatccattactcttgttaatttatactggcaacaactatctatattttcttatttattagtcaggattcaggaaccatacttgaataccaaaatgtgttgcctctttaaatggccacattcaaacaaaatccaccggtcatgcatgaatttttttaaaattctctagtcaatactccgaaattcaatatacaattttcattttttcgatcgataatgtcaattcaaaatttgagggtgaaaaaatttttaacctacaatctatccaatggcctctcatttccagagcatatgattttttcttaaatgcaatgttatgtttttttgtgtgtgtacttcataccgtataaacggaaaacctaaaggccggagaagctgaatatatctgttttaaaaaacctaaaaaatactactccacaataattattgacgtataaacgaaaaaaaataaagaagtcaaacgctcttttgttgtttttatttgaggtacatatatgcggactaaccagaacctacaaaatcataaaattagacactaaaactttgaaaatgagttggtggaaaatatcacgatttaagaatcgaacacaaatctcttttggtatcataaaagtaacaagaacatattctctgaataaaaaacttggtctaatatagtttaatgaaacggcactttgtctattgtctatactaatcatataaattatagatatattcgacagattaattataagaaaacttatgttaccgtaaacccgtaaaaaaacaattgtgtaatcggaattaattggatttcattgtatttgcatgccatgccatgcccgcatgccggctggaatagatagagatcgaagagtccgttaggtcacagtcacacgtgaaggaggtacgagggaagtgacacgtcggatgtagcactaaatctaagacataagataacacaaagtacaaagggagaagagtggccatttccatgccagcttgtctcactcccattcttgcttttgttttttctttttcatgtcgtccactttctcatttccaatactagaaacaaaaacgagcattattgatcttttaaattgttacaaaatagtatatgggttaccttgtcgttttctcctaattatttcggtaattaatagtttaactatgccacaccataaacgatagaaaagtgggaaagctagctaatataataaactggtgtggcctccttaaaaaaacaaaaaggtaacttatgtgattacttttaaaaagtttccagagtgtaatactttctctaagtttttttcattaatattatcaaaatcctgaaatcttaaaattaggttgagaaatgttcctataactttaggaaaataaaataaaatctaatttaatgttatagtgattcttactaattgttttgttaagcaaattcaattacggataactgatccacagaggagaaacctagtttacaaacgtttgtcaatttgcccaaaaaaaaaggccgaatagtctatttaagaatataacctatatgagactaaaaaaacagaaaatttactaaatctttttgataaactatactaaacttgaaaagcatggggaagttctccaatcataaatattagtaaccctttatgatttctcgtttttgtcctgcaaactattattatatacagaacaatatggatttgattggtttcaatagacgatccttgtatattacatagaatagttttctagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaactcatctcacaccaaaacacaaagctctcatcttcttttagtttccaaactcacccccacaactttcatttctatcaaccaaacccaaatg

SEQ ID NO: 4215 - DNA, 3000 bp, Unknown
  misc_feature (1)..( 3000): cDNA_ID_3072817_gDNA_ID_1620691_Annot_ID_164808 3000 nt of promoter + ATG
ttcaatactgtgatatactttgaatctaccagaaatggtcctggtttttaatttaaataggacttggtcttatggatgtcttttaatttggttaaccaatctttcttcattaggctgcccttgagtattctctataacttgcgacaaagtagacataacactctttaagttctaaaaaccactttctattttcggatctcgaaaaatcatttatcgttttgtgctgcaaatcagtgttatatatgagcttggcaaattaaaatgacatatacgtatagaaatgaattgataatactaaatattatttgttttcttcttttaacttcagccatactaactttcactaaatttcttaagagcatacagaagtttctcctcggtatattggtggttctatattccccgcaacgtgaatggaaaatgaaggttctattttggctatatgataatcatgccattagctgacccgaaactaatgtgttacaataaaaccaaattatataaatagaagaacatgtttcctggctccttattgcacaaaagagaacatgaacaactctttttatattaccatgatagtcctatgtgttttggcctttgtgttagttttaattgagagctgtgcgggcaaaatggtagatgagatgatattctcttgtgtctgctgtggtggtcctggctgctgtggtgatagaggagaaggacctgttggtggtggtattgacaatgaaccggtgaatgtagtagtggtggtggtggagccaggcagccagcggcggaagatgtggtgacggtcaaggatgctacttcagtttttctttttttactttattatacttagattctggtactatatatattatgggtatagataatttacactaaagttttatttccgttatttaaaattcgtgttttatttaatctctaattttctgtttccaagtcgaattcctctgtactaattatacggccttttaattttacaatatgaatagccattttctactaacacattcttaccttttagaggtgttaattttaaggtaagtttcttctctacaattacgtaatatcattcaaatctgttcatgctgacaaaagttaggtacttttgtgtatatttctcgatcattgacattgtctactacgctaatatctaaggaaagtggcatcgattctacttgcttgtaaaacatacatcgcgatgtaagtcaaattctctaataatgtaagaaacgaagtgagaaagaaagataaatccaaaaaatttacttgcaaatcaatagagatccaaaccaactgcgcatgcgttagtcaattgatatattgtatataatagaacaaatacaatttttgtttttataaatgtataaccaaaaacgtaagagcaatactatcgaaataaatacgtactgcatattacacgataataatagaaagagatttgatgtttgatcacttggaagtaaaatggagatagagaaacacaaagagcaatacgaccggaaacatcaagatcattggaagagatggtgcagtcaccggtcccatcatcaacggaacaaacagtaacattagtgcaacgacaacaatcgccaaaaccgaacccatcccgaatccatactcattcgccattttcgtctacttttcgataggagtagtgatcaattctgtgttagtgtctctaattggagaagttatatatacacagattcagacatcaaatctacggttgtgtcgtttccccgagaagtagaagacaacgtttcgtgtactaatgcatgaaacacaaaaactggcgagacctttcacgttaataaccacctcaaaacgctgcgtttcggtttatttgttgctgccacgtgttttaaaaacagcataccctaaacgcatcgtttcgtgtcgcaatcaactattcaactgttactgtatattttattaaaaacgcagcgttttagttaacaaaattcgtgtcgctatttctacactgccacgtgtttcaaaatgtcgcgttctgcatttgttgctatcacgtgtttaataaatttacctaaacgctgcgtttcgttaatcaatcgactttttgaacattcgcgatctccaaaaattttgagttttttttttggaaatcccgcccaaatattttgaaattgaaactctaataaatttgtcggcttgtggagttgcggtagtgatatcctccatttatcgttttgtgctttttcttcaaaaatcaaaagcttttatttttcccccaaacttttttttcaaaatcctaaatcattttaccctacgattttgcagatgtcagcttcaacgaatcgccgccggctaaaagatataaacaccggcgccggtgaaaatccatcatctggtaaaaaaccattgaggtctgtaactccacttccgatctcaagcaaaaattcaaatcccgctcttcagaaatcattatccagcaaagagaatccgaatccgaagcttagtcaccgctcatttggatcgactcagaagccagtgctccggcctgtaccgcgcattgataagtccgccgtgagtggcgagggtcgggttacgcgatccacgtcatctggtttgcgaggtaggagttctagtccatctgatttgattagggttttctcggatttgagaaagagaaatgaatctagggttattggggaaaagggtgaatcgggtcaggataagaagtctgggctcaagagttctggattcaaacagggtacgagtgaaattaaggttgagccaagtagtgtttgtgagaaagcagatgaaggaagtagttgtccagtgaattcaagcaaatttgaaggttctagtgtggcgagaaattcaatttctgatccaaaggcacatgctttagttggttctggagagaaatctactgttgctttgaaatctgatagtaagattgaaaagactgggaaagggactagtgtagctttaagaaggaagtctttggataatgttgggaaggcaatg

SEQ ID NO: 4216 - DNA, 3000 bp, Unknown
  misc_feature (1)..( 3000): cDNA_ID_3072827_gDNA_ID_1620691_Annot_ID_164804 3000 nt of promoter + ATG
aaaacaaacaatccggcaagaatactaggaagacaaacataatacgaaaacagcaaagcctgtagttataataactctgccaaaactcaaaagtacactcaaccgaaaaataacttaatagaagtgacttattgtaatagatagcacatgcttataaagagattcaagcagtccaacccgttaggaagttgtggaacctttgatttgagctaaattcttcttgacaaggatccagaaaccagggcggtcataatccccttacacagtcactactggccttgtcgaccctgaccatcattgtacccaccaccataaccttgtgacgggtcagatcgccaagatccatcaccataaccacctcccatgtagccaccactaccagggttgtttgaaccgccaccactaggacgccctccaaccacaccatatgcagcttgatttccataaccagaatcacttccactgtaccctccataaccgtagccttggttactatagccagatggtgactgcgtaggaggagctgcaccaggaactccatatccactatgagcagcaccactcccatagcctgggttcccataaccactagaagctggagtgtcccatgagtttctcggagcaactccagtactacttccatagccagcacctggaatgttcgttgctccatatccagcagtagcaccagcgccataacctccagcagaaccagtgtaacctccataggcaccatacccggcaccattactaccatttccatagccagcgccataaccagaagaaccataagatggtaaaccatttccaacactttgatgctgcaaaaacctattggaatccatacgtccatcataactgctttcattgccaccataaccctggtaaccaccagagccaccaccacccattgatcgtccaccacctccaggattggcatctttaggaagagcacgctttacttcaacttgtttaccgctcaaatcatggaaagtcttgtgcaaaacactgtctaccgcatcttcagagtcgaaggaaacaaatccaaacccacgaggacggttggtagcctggtcatacatgattgcaacatcagtcacagggccataaacttcaaagtactggcgaaactcttcatcagtcaaagtaggtggcaagcctccaacaaagatcttcttggttttattgtaagcatcacctccagaacttctagatgtattaagattcccagttcttccagagacttgctgctcctctcttgacatggctctcttcacatcaacctaaacattaaccaaaatcaataaagctcataataaacttccaagaatcatactttacccaaatcgagaacataacgcaacagaaaatatatacatctgtttttccttatcctaataaaccaaaccaagctctcttttctaatactatactcaatcacttcatagagtgtacgattaacatatatcgagtaccctataatacctcttatacaagttaaaaccaatcctagaatctaagaaacactaaggcgaatttgccaaccaaacaaaattctatatttactctcgttctcaatcaacacagcaaaacgcaaaaaggataaaactttaacacaattagagaaatggagctataagagaacaataataacctctctggtatcaatgctgtgtttctcttgaagaaccctatcgagaacagaaggatccgagaagataacgaacccaaaacccctaggtcgacctgtgagcttgtctctcatcacaatagcctgagaaacctctccatagttggtgaaatgttctctcagcttatcttcatcagtttcccatgaaataccaccgacaaaaagctttccttgatccgaatccatgaatttatattccactatcttacttctgacccagaatcacaaatccacctcaatctacgaaaccgtgaaaaccgactgcagaaacttccagaaattacgaaaaggctttagcttttccaatggctgtagccgatttgagaggaggaagaggaagaagacagcgaacgaatatttctattggtttggtattgatattcgcgaaggtacgaatctgtcagcagataaataaatcaacggtctagatcctttctaatattattaacggttcagatctgtttcccgttttcttgtaacagagatgcttacttatgggcttaagtccagcccaatagaagtataaataatgggctacaaagaccgacgatggtttcactcgtgtgttttctattccacacgtgccagcaaatcctacaagaacgacaaaaaaatctttcgtgctgtgacaatctctgtgccagatgtgcactttgttgtcgaaaattccaaactccacattacagctttattagtacttgtaataattaacctcatatgtttaagtttaattaatctcttaattacctcgtatatattttaaaataattaaaacaatagcctataaacgacaattaacgtgcacgatctccactaaaaaaccttaattgaatttttgagttttttttcgaaattttttaagagactttggtcaatgtcagctttcactgaaaaaactttggaattagtaataatgattaatgattatacatgacaataccaattaattaatttccataatgaaatgtgaagacgttaaatgtaaaaagcggcaaaaatgtggggctaatttataaagtttgtttatatatttttaaatataaaaacagtttcaggcttcaacaacgaaaaagccgtttttctattactttgctttattttcttctctttctctgtgtttttctttcttcgatctcactgtctttcttctggaacagctcgatcttttgatttagggtttttttagttacatttcttgttctatctgaatctctttcgttggttaggttttattcgatttttgactatttgtgagaaatatggaagaatgagaagaagaagaaggtgatttgtttgatttttttctaatg

SEQ ID NO: 4217 - DNA, 3000 bp, Unknown
  misc_feature (1)..( 3000): cDNA_ID_3090020_gDNA_ID_1620691_Annot_ID_164801 3000 nt of promoter + ATG
catcaacatgaatcacacagagacgataggcctataatcttgctcacgatgccgctcaactcctttacgatagatctaggcctaaaaatatgcttcaattgtactttaagcgtttaactttctcacgatctctctacagcaccttgacaatgaagacaagagctatagaaaatggaaccattgtgaccttagcctgaagattctacactacgtcactaccgttggcattttttttttttttttttcgatgccttctccgatcatcttaatcaggggagagaccgagagaccgagagaaccgagaactggcgacttggacttcttcactggttacacgaatgtagacatatacgatttggttcggtttaacgtcggctccaatttcgttcaacgaaataaaaaaaaagaacctccttttcgggtttttgttttgtttgctatatttccattttttttgggatttactctttgcttttaatgtactgtagtataacacgattacattaaagaacatattgagatctatctttatagatctaagttggaaaacaaagaattcacaaacactagattacaaaacacttgttttttagttttttcctaatcaaattaaaagttaaaaccactgcttttggttataggctttcaataatctttctcttgcacccgtatgcagtggcaaattcggaaaagacaaaagaaaaaaaaaatctaagaataacatattgaaagaggcacataggatttcaatgatagcatgggaaagcaaatacacgtgcaagagccatgttaattaagtaggaactagtagataggggttggcggaggccagtaagggaaactaacgttctttagtggccttacactagtgtaaaaggtagagcaagtttcggtggtgagatcataaacaccaaagttattgccaacaaaatagatgcagttaggctcgagtccacacgacgtactagccgggatgcagaaagcctcactatgtccaagaaaaatgcaaagatctccaatgtgttctgtgtagatcatagtcttcttcttttcgtcagaagcctcatttgctctaaacaccatgaacttttttgttacgtgcatgggtgtattgtcgcaaaggtcctccacgtcctccacgaacctgcaaagacatgatagaaccaatacgattctcaagccaaaaaaccaccaacgaaatgaagatatattgtaaatatgttatgagagatgtctagttaattagatactataccacttgacgaggaaaagttggccggtgggtgactccacaaggtgatctgtcttggaacatgaactcactcccgccaactgcttaaacaccgactctggaagattttcataatccaagtcgatgaagctgggttgcccattctcctgcctagagttgaaatgatcatcaccctccttagagttgagatccaagtagcacaagtagttgcctccgtaacttggaatgtagaacctttgatctctcttggagaacatgaggctagataaagggtttatacactgagacatgaatttcatgttgatccatttagagctgccaaaaggcctgcaaagactaacccgagatcccgataatttgacacccactacccaatctttatcttgaacaggtatagaggacatggctaggttatggattttggtaccggtgggtacagaaggtaaatgaatggtcaagttttctagtttgggattggaggtctcataagtgatcacaggttgatggtcgctgcttctgtacgaaagatagaattttaatccatcacgtaaaaatccgacagtcatcgcctcaatgacctccttctcgagtttcttgtccttaatagtgacttttgttgcctttccctttgaagaatcgtcgtcgtatactattacgcgaccatccgaagaagaattttggatgttagtgatgtattcaatcaataaaaacgggtaggctggttcagacgacaagagttgagtcactttagtctcgtcatccgaatcccacccgcttgtgtgagaagttgtagatgagaacatacgaacaacatttttgtgtctctgccatatatatgttcaagtagtcagagacgatatcaataacaagaagaagttaaagaaaaatgaatttattacttagaagcttaagaggaagtttttgcagacagagggtttaaagactcggctgattataagctgtgccattgttgaacttctttaagtgttttcgtctcttgtataatctgtgtcattattgtacttaatactaataagaatatccttgctcagcaagtacaagacataaatgagaatatttagaaattccataaatagctcgttaaaatcttattataatttttgtttttttctgtggaatttgttgttcaatatttgttcccaaaaattgttttattcataaaatctaaaatcatttcctaaaatcaatgcatacaaattactctatattctacccttttttttttaatttttcgatatgtttttaattgaaacagaaaacttttcatgcaaccacgttcgattttttttttttttctttagcttaatgggcttatgggcttctacgttctagaaatttcctactacacaaaatatctttcgttttatccaaattccaaaacagtaataagattataagaacaataaatatcttatccagtaactaacgaacgtatatcccaattattgtgaacatcaccaccgtcagatcacgcccttatcattcatgaccgtcagatcctcatattttacatcacacgtggccgtgactctttaccggataaccggattgtctcttctttaaaaccgtgcccaagcgactcgtgagtgagactcgctctaagacccagtttgactcgttgatcaacgaaaggtaacgacaaaactctgatttccgatttcattactatgaatcgattcgaatttctgagtttctgactttgtttcagtgtgagtttgaggtgaaag

SEQ ID NO: 4218 - DNA, 3000 bp, Unknown
  misc_feature (1)..( 3000): cDNA_ID_2040829_gDNA_ID_1620691_Annot_ID_164798 3000 nt of promoter + ATG
ggaaggagacaacgatacaggcctacaagagcctaaaaggtgtttctttgtggaattgatgagcataggttgggaattattaaaaaaaaaaaactgagcctcgataattagcatatgaatttgtaaattcgcttgtgtccccaattcactttctttgtttcgtttgcagagaagcaaaagcagagtttgattcggaaaaaaagcagtgttttgtgtaaccaccaatcagtaaaacctagtgtttgtgaagtccttgtttttttacccttttttaatcaccaaaaagaatataaaagtaaacccaaaaggcccaaacaatgtacaaaatcccaaaaaatggaaatatatcacaaaaacaaaaagcgaaaaggagtttccttttttttcgtgggcctctgcgttgaacaaaattggagtaggaaaaggaaacacaaatctgaggagtcctctctataaatactaaacaaatagaagcaaaggtaaaacacaaacacttccattcgtaatttagggttcccacaaattccttgtttctctcgctctcttacacacaggaaacaatggagactgcaacgaggactcaccaacagagaaaactgatctcatctttcctcgatatcaccgttaaccaaactgtggaaatcgcaacacagttccttgaggcaacaacctggaaccttgaagatgcgatcaacctctttctcatcgctcggagaaaccctcatcatcaccatggagaagaactagtccctcttcctttaccttcgaagaagaatactctctacgactacgatcctttcatgtctcacaacacttcggtcgcagtatgtcctgaagagatctgggacgacgagtcgacatctgaggaatccgattctaggttgtcttctttgtaccgtcctcctccaagtctgtttttccacggttcgtttgaagatgcgaaagcaacgtcctctagagaggatctatggttgcttgttaacctccagtccacgaccgagtttgcttctcacttacttaaccgagatttatggccacacgacgctgtttttcaagccatcaagtccagcttcatcttgttgtaggtctatgatgataccagcgaaggtcagaaaatatctactttctacaagatcgactctgttcctcctgtggtgcttctcatcgatcccatcactggccagaagatgcgtatgtggagcggtgtgattgaacctcagggctttctcgaggatttgatgaagtacatggattctggtcctcacgaacacgttgcatctctgacaagcaacaaacgtatgaaaacagagaagatctcctgttcaagtaacaacgctgatgatcaagacatggctactttctggggaaacgctattgaagaagaaaagactgtaatcaaatctggaaaggaggagacttttacgtctgatcgcgttgtggctccttcttgggggccagaatttgaagacataatgactttatccgaacatgaggaggaaacttgtttgtcatgcgacctgcttgagtttccggttttgacagaagagcctaaagcagactgtgatagaagcgttgtgtgcagtatttgtgttcgatttccagatgggagaagaaagcagaggaagtttctcaagagcgaaccgattcagcttctctggtctttctgttattctcacatggaggaatccgagaaaaaggagttcaagcttgtgcaggcgattcctggtgcttccaagactctggattatggagctaaggccacgtttgttcaatctgggatcgctaattcgatgatttcagttacttgggagtgaagatttcgatatgttgttgcttctttatattatcttgaagttatattgaagaaacccttaaattctggagattaattctagactacttttgttttgtttgtcaattggagtattaagttcaaatatacaattcttacaacacagatcacttatccgctttactgttcttttactaatatagagctaacacagtgaagaagttatattctgcaactaaaactctccaaccataactgttgaaaactgctgatccgaatatttgaagattacaacataatcacaaatcgcattaccaatatatcttaacataaacctatttatcataacttcataagattcaggtacaataagattcataacattggtttcttaagttcacaatgatgaattgaatatatgtttggacagcattaacttgccactggattcaaagaagactgtcctaagtggatgcagggttatgattggtcaaattgctagtagtggcctaactaagaagctgatgataaagagaaacatgtgggctaaggttcgtggtgtggctatgatgaacccagtggagcatcctcatggaggaaggtaaccatctacacattagtgtcttgcactgaaacttaatagttaaatgtaaaagtcaaggttttaactcttaaccgtattaaaccgggtccaatttgttcgaaccatataaaatcgtattaaccgtataaaacagaggagtttagctccagattcacatgcttatctcagagaatcatacctctggtgctcgccgatttgatcagtgatcacagaatcatgtctctggtggtcaccgatttgaggtaatcaaaattacctctctttttttttttactcaaacattagaaaaaactttaatttgcacatctcttatttgggaagtatatttaaacatatctaattttaaaaatattacatagaatgatattaataaacaacataagtaatttaattataaaaatgtatatatagatgtcattcaaaataattgttgtatgtatttttctagtctttctttctcataaaatctcttaaaagattattttcttatagaaaacaatttaataaataaataatctggtatttagctccaaattcacatgcttatctcagagaatcattcttttggtgctcgccgatttgatcagttgagcacaaaatcatg

SEQ ID NO: 4219 - DNA, 3000 bp, Unknown
  misc_feature (1)..( 3000): cDNA_ID_3072839_gDNA_ID_1620691_Annot_ID_164797 3000 nt of promoter + ATG
cccaagtacttgtttgttttctctcagaacaaagcaacaatggggcactttttctcagcgaataaccgacagagagcgataacaacaaggctacagcttgacgaagagattgttctctttcgtcaagatcaactaatctcgtctttcctcgagatcgctgtcgatcagaccgccgaaaccgcaagatattgttacagacgacagattggaatattgatcaagccgtaaacctctttctcaccaacaacgcgatgtatcgggaggttgtggactcgacgacatcaggaacttctgatgattcagactcgagatcgtctttctcgtttcctcctccttcatatatacttcacgagggtttgtttgaatatgcgaaatatgtttccattgaaaagaatctatggttggtagtgaatctccagtccaggacagagttaggttctcatatacttaatcgagatgtatgggcgaacgacgcggtttcgagaaccattgagtcccacttcatcgtatggcaggtctatgatgatacaaacgaaggtcagaaaatctctagtttctacaagatcgaagctcctcctcctgtggtgtttgtaatcaatcccatcactggccagaagatgcatatgtggagcggcgtgattgaagctgagagtattgtcgaggatttgatgatgttttgggacgctggtcctcacgaaaacattgcttctctgacaaggaacaggcgcacggaaactgcggagacttgtttgtcaagctacaacttctatgaaacccctgctccttcctggggtgaagagtttgaagaggaggataattggtcgtcaagaagcaacaataatcaagtcgtggctcctacttgggagaaagaacttgaagaacaagacgagtgggagatttggtcgtcacgcagtgacactgatgacttcgtgcctccttttatgggggacgaatatgaagatccggatgaagtaaaggaggaggagatatgtttagtgttcccggttttgacagaagagccaaaaggagactgtgatcgaagcgttgtgtgtagtctctgcgttcgatttccagatgggagaagaaagcagaggaagtttctcaagagcgaaccgattcagcttctttggtcattctgttattctcacattgatgaatctgagaaaaaggcattcaagctggtgcaggcgattcccggtgcttcaaagactctagattgtgaagctgacgccacgttcgaccaatctgggcttgctaattcgctgatctcggttacttgggaatgaagctttcaaggtttaggttaacctgtaaccaaaaataggggtttgagttttatcaaatttggtgttgacttagttccttctttattccatcgtagtgcattgtgaagaaaacaagtacctttctagtattatatatattcttttgtgtttcgaatatcatgttcaaatatgcgattagatcaacacacatcactcttctaaatcactttagtggttcgataaattaagatatatcttggcctcgaaatcgcaaaatgcatcagaaatctttcatttttgatgcgaatagtcaattgctaactcacgttagtgtactccttcacattctgttttagagcaaaatatcaattttatagcagacaagaccacacaatacggcttgaatagtcactagtttacggattttagcaccattcaaaattgaacatgtagactaaattaaacttatttctgtttcatgttaggggttagaaagatttaagttaactatggagttttgagctaatttgactaagaatcttatgaaacatgaaaaagacaagcgacttgtttggcccaatgatttgtatggaggaccaatgattttaaattttaagtatcagagaaatcatcaatatatagttcattatattttcagacgatttagatttcagtggatatggttctatttattttatcaatataaatagtttctttttttcaaatgttcaaagaacttcattataaagtacaaaacaaccttaacaaaataataaaaaaaattacatcgttcgcacatataagttttgaatgtatgttgtggcgaaatcggactagactaattttggatggacaataatgtgccctaaaccaattttatttttatgtttgaagtggtccgcaacaactttcttctattttttttaatccatactaatacaaactttaatttatcaatgttaaataaaaagtggtataatctccaaactagtttttccacctcaaccgccgtaaccatttaagtttttctacttcaaccgccgcaaccatttaaacttataaagagatacgatagcatccaccaaaagcgtatcactcgctccctcatataagtagcctctttgacaagaagatatttgaaagcatctcaactcttttatccatcacgcctacccaactatcctctttgagagtgctgatttttgggaagttctcatttttgtatagatatgtttctctttcttttttcttaggtgcaaaatattattctcttaaaaacaatttttgaaatttctttcctcttagaaataacctttgtttgttgaaaacaatcacattccaaaacatagaaaataatcttctataagaaatatatataaatttgttgcttctaaagagtgttgtctgagatcacaaatctctgtggacacgctacaattttaacatttgtggttgtaaagaatagagagcttcacgaaaaaaacaaaaatcaaaggggtctttttatcataatgaataactttagggtctaaatttaatttccttacaaaactttttgccgttttgtcctggaaaattgtactgaactgaatccgacatgttggtgagatccaacgaattataaaattatcaaaaagaggcaaaattaaaaaagaaggtcgtgtgaccagagaatcacaaacacagagagattcatcatcgaatcataaagctctgttttcaagaagaaaatatg

SEQ ID NO: 4220 - DNA, 3000 bp, Unknown
  misc_feature (1)..( 3000): cDNA_ID_3072843_gDNA_ID_1620691_Annot_ID_164796 3000 nt of promoter + ATG
tgatgagacgacaatcattagtggagctcttgatttgactgagaaggtgtgtgcttgactttctagaattcctgaaccatggcttgatctgtgtagaaatatggtgaaagttatttatgcaaaagtggtatttggtttgacagactgcacaagaagccatgacaccaattgagtctaccttctccttggatgtaaattcaaaattggattggtgagtttagttctcaactgtcagtggtataaaatattttatctgttgtctcaatgattctgaaaagtcctgcatggcagttgtttcggcaactattttctgacatgtatcttatactgctgtctgtgtaattaatctcttagggaagctatggggaagattctggcacgaggccatagccgcgttcctgtctactctgggaatccgaaaaacgttatcggacttctcttggtaatgttgctgactcttattttgcatgtttcaatggtggcttatcatgtttctgcaaactctaatcaagaaattgttctgttttctaggtgaagagtcttcttacagttcgccctgaaacagagacccttgtcagcgcagtttgtatacgccggattccaaggttctgccattaccattttaacctccagtctttactattatgtagaatgaagtttcgtattattgatgttataatgtttgaatagggttccagctgatatgcctctctatgatatactgaatgagtttcaaaagggaagcagtcacatggctgcagttgtgaaggttaaggggaaaagcaaagtcccaccttcaactttgcttgaagaacacactgatgaaagcaatgactccgacttgactgcacctttgttactaaaacgagagggaaaccatgacaatgtcattgtcacaatcgacaaggctaatggacaatctttctttcaaaacaacgagagtggacctcacgggttttcacatacttcagaggctatcgaggatggtgaggtaattggtatcatcactttagaagatgtctttgaagaacttttgcaagaagagattgtggatgaaactgatgaatatgttgacgtacataaaaggttcggctaaatactctctatggcatcacatatcaccttgtcatatcatcactgagaatttccgcgtttgcaggattcgagtagcagcagcagcggctgcttcatcaatagcgagagctccttcaagccggaagttgcttgcgcaaaagggaactgtgagttaacactcttttgtttctttgttgtttatgcaagagagaaagttagaattgttgaaacttgtatttgcagggaggacaaaataagcaagggcagacgaataaagttcctggtcaggaacaagataaaatgcttggaactattaccgagccgattcgaagaaacaactgatgttgtgttcttgcttaaggaggcaaaaactctgttgcggtataaagaaagaaaacaaagaataaattataagatccaggttcttctgtatactttgatccatcacataaattatatatatataaaaatataaaaagtcagcagaagcaatggttcaacccgatttttgaagatgctttgtttccttgtattatacaaaatacctacaatttgtaatttactccgtaacttgattcttttttcctttttgttcactcaatttttcgtagaatgcagtagtaatagttagctatatggtcacatactgttgtggccgctattttgtaattgcacttttgaaacaatggatcaaaagtttctccatccatcgctaatctttgatacaccggtgattcggtgaccggtggcttttgacaaagtcttttagacaaggataattcatcgatggctttgtcaactttcgtgtctcatgttaacttcctttttattagacaacaaaatttttgcaatgatttgatttggtcgaactagaccaaatattagtcaaacttaatcctttttaacgggatggtaacgggatggtaagtttgattaacgttagatccaatttatcctagttaacgcaaaagttgcttaataatgtacttcaaagaaataaaatttggacgtttcccaaaagaattttttttgggacaaaacaaataagtgagagaaatttagactttattttttttcctttaaatcacaatatcaaaatcttacaccattaagttgtgaatgactcaatataacatataatctagttgtttgtattagtgtcgtcattgtgttacaatgcagatttcaaactcgagtccttgagttacaatgcagatttcaaactcaaaatagtaaaggttgtacaaaaaaactcgcacaacaaccgatgcattagactagtggtttaagtgcaaagattggatccatgtgtttcttacaagtgcaaacgttagatccatgtggtttaagtgtagtccatgtgctccctagggaaagtgttgaactaatgttttttttttttttttcgtctgaactaatggttttattgcagggatattagaccaatgtactcgattgatagaagagatgctttacgccgatgtatttgatatcagcacaagccggttccgggtcatgaggaactagggcccaaggcccaaacccctccatgttaaaaaacaaaaaacaaaaaatctcgtagatgacagcacaatcacacatttgaaatatacaattccgatattcgctaaagggtgtttgtcagattgtataagatccattccgtacaagaagatcctgcaccaggaccaccagaaaaaaaagaaagtaaaggggtggatttgaaaaatataaaacatattggggaccaatgttaaaaaacaaaaccaaatatttgctgtatatgctaagaattcaaaattgtacaaaacccagaccccattaggtcgatgagagagatataaaaaacaacaaaattagacgagaaaatatctaagaaaggcgtcggaaaattgcaaacagatagatatagagacgacgaagatg

SEQ ID NO: 4221 - DNA, 3000 bp, Unknown
  misc_feature (1)..( 3000): cDNA_ID_3072847_gDNA_ID_1620691_Annot_ID_164791 3000 nt of promoter + ATG
agaaattggataaattagttggagtaccagttattaatgttcatatatggttagtgaaaccgttatctcccttgttttcttttggccattatgtgagaatcgagattacatgcaggtcttaactgctgtgaactaatattgcaggtttgatcgaaaactgaagaacacatatgatcacctactctttagcaggtgaatttcttatttatgcagttttgaggaattatgtcttatagaatacttagttggatacagtgttggaaaaaaagaatacaagtgttttgtcttgaatcagcaacagttaaggcttgttcttggttaaacatttgttgtatattcaacaatcttgttttgttgttttttgcagaagtaaccttctgagcgtgtatgccgacatgtccttaacttgtaaggtaagaacgcggcttgtttttctaaacgtgttcctccacttgtttatctatcataaattggtgctctgtggatcttctcataatttttgatggcttatcttgattccgaatctgattcaacaaagcgttttctttctatgataaactgtaggaatattacgatcctaaccggtcaatgctggagctagtatttgcaccagcagaggaatggatatcacggactgattctgacatcatagatgcaacaatgaaagaacttgagaaactcttccctgatgaaatctcagctgaccaaagcaaagctaaaattctgaagtaccatgtcgttaagactccaaggttagtgaagttgtaccatttatttagcttcaaatgagggaccaggctttacattgataaattcaacatctttctctattgttgcatgatcagatctgtgtacaagaccatcccaaactgtgaaccatgtcgtcctctacaaagatcacctattgaaggattctacttagctggagattacacaaaacagaagtacttagcttccatggaaggcgctgtcctctctggcaaattctgctctcagtctattgttcaggtaaacacaagcttgccattcaaatagttaaccagtaaccttgttctctgtttcttgttggaatatatcgccaataaccggtcggtttacctgattttgtctcactattatactgttccggttatgtagagaaattgctaaagtcagaatttactggttatacaggattacgagctactggctgcgtctggaccaagaaagttgtcggaggcaacagtatcatcatcatgagaagaggacaaaacttaaagatgatttgcttgtaagcattattatttgtgtataaatctcattgcaatccaaacttaaccttactctcttcagtaaatgaatctcacagatttgacatctcacgtttctgtcaattttataatttttaaaaagtaattactgtcgaccttttgtaatcatagtgatttatcattatgtctctctttttaaaaccttttctggtacaaattataaaaggtcgatcatcattgattgatcaaggggtaaaaacaaatgttcatgaacaattaaaagaaacagaaaaaaaggaagacgattgttttcaaccacaaaaattccatttgttttgttgttgaaggctatagctagctagggccggtaaggtctaaaaaggtctcttgcaagccacgtgagcggcgacctgaaatagcttttggcttgagtagtggatacagcaggtggtgtgatatgtacatcatacatacagtacaaaagacatcaaatatcttttgttttttttggtaatatacaaatgtgtaacagttgattatatatatatatataaataatcaattcaaatgattgaatttacaaaatttattaaaatatttaaaatcttaattgagtaacaatagtaaactttaaatctttgaaatgtgatttatacatatcatataaaaaaaaagaattaaaatatattatgacttgatttaaaatctattaaaatcatgatttacagaaacacctcaaagataaagataaacactttacccaaaaaaaagaagaagataaagataaacatattaatcaaatatccaatttaaaaaggaagttaatagttatgttacatggaaacggaaacagaaacgaaacaggaaacaatttttttttttaaattaaggaatgaaaatttttggaaacgtatatagatattcaaaacataaatatcaaataatttaactaaattctgaaaaataaagattaaaaggcttaatatcaaatatatagacaatcatttttattagtttcatcaaaattcatatataaagcacctaaaatctgattcgttgggaggaaaacttaaaacccgaatctctcaaaattaggtaaatcttaatatttctaaattttaattataagtttccaaagtaaaattcagaaaatgtttatcgcgtttccatcgtgtttacaaacataaaatttaaaaaacgcttttttttgtgagtttccatatatttcaattctgaaacgggaatgaagtacggagagagtttccatgcaagatagttaatagtctctaaccccaattataattccattcacgggatccgaatatctattactcaagatcttagaaagaatcctaaaaatcagttattaatttgttggattttgtttagtgagataatggtaacaacaatcagttggtaacaaacaaaagtcaccaaatgatatgattaaaggaattttgttggtcatgagaattagcaatgagccaatgataataatccgtacaaatatacgaatgtatctactaactaatataatattgggccccacccaccagatcgtcgtttagtttggttaagtgagtgttgtttgtagtagtgggctttttgcttcgcttcttcgttttccaaaatctctctctctctcacattcattgcttttaaattaaaactccccaaaaactgaaactgttactacttctctccttccttctctaaaaacctaaaaaaaaaaccccaacacacacacatg

SEQ ID NO: 4222 - DNA, 3000 bp, Unknown
  misc_feature (1)..( 3000): cDNA_ID_3072859_gDNA_ID_1620691_Annot_ID_164786 3000 nt of promoter + ATG
tagaaagtacacaaaccatctccaattagaaacctaaccaattctagcaactacacaatctttcaattggggtgaattcaaagatatgattcaacattacttaattagaaattttgtctcgataatacctaatttctgagaaaagggtgaaattaccttgacacctgagtctgaaaacccagattccgtcgcagtctccgcactaagtttccgtttaagaggattagacggcggcggacgcggaggcaacggattcttcattctcatcgacctatggtcaggcgtcgacgtgttccgatctagaggtggagcattttctttggcggatcttaatttgcgtggaggcttcgatttcgagatactagggtttggcgagtgtggctctccgccgtcgcgtaagatagcgtttcttggtaacgtaaagtgcttcttcatctccgccgtgaaatctacaattagaaacccaaagtagaagaaagagggaaagtaaatcgaatctgcgcttctacgagagcgtcagtgaaaccctagtgtttgggcaaagaaaagaggaagaagaacgagagaagagaagagagagagagccgttaaagagcgagaattttgaatttgtttttgtcagatcttgtgaagtgttgacgattcgcatcacatgaatttctaaattattttatttaaaaagaaatgaattttatgtgatcgtgactttatggccgtaggatgaatccaacggagggaatgagcaacaaaaaaagaaaaggcccacgtgtgtgtttaatggtgtgtgttttagtctttagacgtgtggtagtaatactgccgcacgggttttttaagatccaccgcgcgtaaaaatccaatccatccgctatggagcgggtatgggtttaaaacttttgacccgttacgaagcatggctcgcgagtaatcgtatcgtgggttgcagatttagtggttgtcattgggcagcagtagtactcatttctatcttcaactatattatatgtctttgactgtgaataaatgtagttcgaacgacaaaatcatcaaagcagtaaattagtcaatagcacagattttttttttttgggttaaaagtcaatagcacagatgcgaccacatttagtcatttacttacaatttagtcttaccaacgacatgaagagctaatatgagtgtcaaaaaatacaaaattcgatggtagcgatgagcaatctcttcaaaattgaagtaagtgattcttatgtcataaaattcattgaatactagacaattcattgaagatgatgcaatttaaaaattaaaaataaaaaaattcatacatgataaagcatgaattgaaattcttcatgcaatttaaaaaaaaaataaaaaaattcatacatgataaagcatgaattgaaactaatgtcaggtcctccggacttgggagcgtgtgctaaactgctaataatatcaagagagtaaacaaaaccacttgcaaattttataaaatctgccaaagattagcagattatgctgataacttggtacaatagtaggcaaaatcttattctactataaaatcttctcaagtcttcacaactattcaccatgtacttgaagtcgaaagaatgttctcatatatatatatatattttgttacgaatgttctcatatatagtatgccaataaaaccacaaaatttgtctgacacaagatagagtatcatgcttagtcaaaatatgtaaatattctcctaaagttcacaactacttgcacactttcattaagtatgctgctatgtttacatattatacaaataaaatcgtaaattttgttagaaacgtggcaaactagcataaataaataatctaaggcttctagtaatctttgcattacaacttgcataatttccataagatctattggatattgtaaaatctgccaataaaaccacgtatcttttaagaaaacacaggagactaaccaaaataaatccaaccgtattataattctctaaattttacacattgactcacgaacatttataaaatctgccatattcgaaaaatttgtcaacaacatccctataatgtttgagagacatgaaaaattagcaaaacatatgctaaatgtgctagtaatccctaatgtacgtttacataattttttttttgaccgattttaattagagctcaaaagaatcatccatgaaaaatgtacgtttacataacattttccatactttgtaaaatccgtcaatgttggataaacaatgttatgaaaaacattcaagtctacaaaacaaaacctaagtttctatggcttataattaatcccatagttttttaatcatgttagatttgttaaaattttgctagcgttgatgattttcttgtattctaaaattttaattttttgaaaaaaattaattcgagaaattttttcactaaaaagacaatgttttttttttttaatttaaaacttaaatctaactcttctttttgtcaaatatagattcttattattcttaccttttaaaatttatcttatttccttcttttttttaaaagagatttacaataaataagtaatattgaccaaagatatagaacacaccaaaaaagaggcaaagatatagaaaacatactatttagattttttataaattttggtagatatcttagattattctagcaaatctcctttaattgttttttttaacagcaaatctcctttaattacatcaaatccgtaaaggttgaaaaaaaaaataacaatagaattttagtaatgaattaattaccaatacttgacccaaacccgaacctaaacaccagatccatcgtcatcatccatccaatcaaattgactcatcgtgttgtgacctcccagtgattaagccgcgactcctcctaactcgtaatccctcacgtctctgagaattctcagtttcttcagtttcattgcaattcaattcccgatctgatccgttcctgcttagatcggagcaaaaca

SEQ ID NO: 4223 - DNA, 3000 bp, Unknown
  misc_feature (1)..( 3000): cDNA_ID_3072863_gDNA_ID_1620691_Annot_ID_164785 3000 nt of promoter + ATG
catgcacgtatcgagaacaaacacaaacacaggtggtggaggcacacgagacggatcaggaggcaacgtgtactcaacagtagtgtactggggataaagctcaccagggagattaatctcagagatcgaatggtaatgagaagggaaatgattcctatgatagcaaaaaggacagacccagttcatagcggcgaaatcaacacgagcgaaggcgttgagaagagctttacaagtcttgcaatcgagaggagcataagggagatcaaggataagggggtgacgacggatcggtgaaattgaagcggcgagaggaatcacacacttgcttgcttcaaccttagtgcgaggccaaaggttccaagtcatacgaactccatcaataccttcccaatccatctcctccactttcgccttatccgccatctccgccattgttttgctccgatctaagcaggaacggatcagatcgggaattgaattgcaatgaaactgaagaaactgagaattctcagagacgtgagggattacgagttaggaggagtcgcggcttaatcactgggaggtcacaacacgatgagtcaatttgattggatggatgatgacgatggatctggtgtttaggttcgggtttgggtcaagtattggtaattaattcattactaaaattctattgttattttttttttcaacctttacggatttgatgtaattaaaggagatttgctgttaaaaaaaacaattaaaggagatttgctagaataatctaagatatctaccaaaatttataaaaaatctaaatagtatgttttctatatctttgcctcttttttggtgtgttctatatctttggtcaatattacttatttattgtaaatctcttttaaaaaaaagaaggaaataagataaattttaaaaggtaagaataataagaatctatatttgacaaaaagaagagttagatttaagttttaaattaaaaaaaaaaaacattgtctttttagtgaaaaaatttctcgaattaatttttttcaaaaaattaaaattttagaatacaagaaaatcatcaacgctagcaaaattttaacaaatctaacatgattaaaaaactatgggattaattataagccatagaaacttaggttttgttttgtagacttgaatgtttttcataacattgtttatccaacattgacggattttacaaagtatggaaaatgttatgtaaacgtacatttttcatggatgattcttttgagctctaattaaaatcggtcaaaaaaaaaattatgtaaacgtacattagggattactagcacatttagcatatgttttgctaatttttcatgtctctcaaacattatagggatgttgttgacaaatttttcgaatatggcagattttataaatgttcgtgagtcaatgtgtaaaatttagagaattataatacggttggatttattttggttagtctcctgtgttttcttaaaagatacgtggttttattggcagattttacaatatccaatagatcttatggaaattatgcaagttgtaatgcaaagattactagaagccttagattatttatttatgctagtttgccacgtttctaacaaaatttacgattttatttgtataatatgtaaacatagcagcatacttaatgaaagtgtgcaagtagttgtgaactttaggagaatatttacatattttgactaagcatgatactctatcttgtgtcagacaaattttgtggttttattggcatactatatatgagaacattcgtaacaaaatatatatatatatatgagaacattctttcgacttcaagtacatggtgaatagttgtgaagacttgagaagattttatagtagaataagattttgcctactattgtaccaagttatcagcataatctgctaatctttggcagattttataaaatttgcaagtggttttgtttactctcttgatattattagcagtttagcacacgctcccaagtccggaggacctgacattagtttcaattcatgctttatcatgtatgaatttttttattttttttttaaattgcatgaagaatttcaattcatgctttatcatgtatgaatttttttatttttaatttttaaattgcatcatcttcaatgaattgtctagtattcaatgaattttatgacataagaatcacttacttcaattttgaagagattgctcatcgctaccatcgaattttgtattttttgacactcatattagctcttcatgtcgttggtaagactaaattgtaagtaaatgactaaatgtggtcgcatctgtgctattgacttttaacccaaaaaaaaaaaatctgtgctattgactaatttactgctttgatgattttgtcgttcgaactacatttattcacagtcaaagacatataatatagttgaagatagaaatgagtactactgctgcccaatgacaaccactaaatctgcaacccacgatacgattactcgcgagccatgcttcgtaacgggtcaaaagttttaaacccatacccgctccatagcggatggattggatttttacgcgcggtggatcttaaaaaacccgtgcggcagtattactaccacacgtctaaagactaaaacacacaccattaaacacacacgtgggccttttctttttttgttgctcattccctccgttggattcatcctacggccataaagtcacgatcacataaaattcatttctttttaaataaaataatttagaaattcatgtgatgcgaatcgtcaacacttcacaagatctgacaaaaacaaattcaaaattctcgctctttaacggctctctctctcttctcttctctcgttcttcttcctcttttctttgcccaaacactagggtttcactgacgctctcgtagaagcgcagattcgatttactttccctctttcttctactttgggtttctaattgtagatttcacggcggagatg

SEQ ID NO: 4224 - DNA, 3000 bp, Unknown; identical to SEQ ID NO: 4214
  misc_feature (1)..( 3000): cDNA_ID_2993367_gDNA_ID_1620691_Annot_ID_164781 3000 nt of promoter + ATG

SEQ ID NO: 4225 - DNA, 3000 bp, Unknown
  misc_feature (1)..( 3000): cDNA_ID_2040893_gDNA_ID_1620691_Annot_ID_164777 3000 nt of promoter + ATG
cttacaagaccggtggatgagaaaagtcttatgtgacgaccgacgagtaacagccacgagtagaaagatgattaggaatatttcagtctgtttttgatcagttctcaacctccacaagaccgcaaccaaccaccatggtaaggaaatgattgttgtcttttcttttaaaaaatattagttattttagttttttttttttatgattgctaatttaatacagacacaaaactgagaatttgatctcttttaacagtttgttacttcacagtgaccatttgagaagttgcatccactgtccatccattctcatactgttaatcaaaaaataaaacaattatcgatgaatcaaattttgtcatgtttttgtaataaagtgctagtatgtatagtggagttcttaaagaatcttacaaaaagttattggtgggctatgctttttaggatatgacactaaagtaaagaaggctagcctaagaactcacactttcttctttactcttcttccctacaattacgatcgccaaaaaccctaaatttctaaaaactgcttttatctccaagtaagtttcaatattgatcttctgctctttttatttgttcaagctagcatgttgtttgatctttagcttttcggttggttttcaggaagttgaaaaagatggatcttagtggttgtagagatataatcagtagtttaccagaagccattagttgccatatcctatccttccttcccactaaagaagctgcttccacttcggttctttcgaaaaaatggcggtatctctttgcttttgtccctaatcttgatttagatgaatctgtttatctgaatcctgagaatgagacggaagtttcttcaagttttatggattttgtggatagagtgttggcattgcaaggcaattctccattacataagttctctctaaagatcggagatggcgttgaaccagaccgtatcattccttggataaataatgtgttggaacgcggtgtatccgatcttgatctacacgtgtatatggaaacggaatttgtgtttccttcagagatgttcttgagcaagacactggttaggctgaagctaatgctatatcctctcttggaatttgaagatgtttatctcccgaagcttaagacgctttatattgactcatgctattttgaaaagtatggtattgggcttaccaagcttctttctggttgtcccatacttgaggatttagttcttgatgatataccttggtgcacttgggattttgcctcggtgtctgtcccaactctcaagagactaacgtttagcacgcaagtgcgagatgagtttccaaagagtgtgtctattgatactccgaatcttgtctacttgaagtttactgacactgttgcaggcaagtatccgaaagtgaatttcgattcgcttgttgaagctcatatcgatcttagattgttacagggccatcaaggttatggtgaaaatgatatggttggcaatgcaacagattttataatgcgtatatgcaatgtgaagactctctatctatcttccaacactcttcaggtttgttttcatcatgaaaaacaacttgtaatctttttaacattgttcaaggatttgagttagtgattgcaattgagtgatgataatctagttgttgtggttgtgtttcaggtacttacttacagttgtgatgctataccaatattcaacaacctgactcatttaaccatcgagagtaatcccgaagtaggatggcagtcattgccaggtttgctcaagaattctccaaatcttgaaactcttatcttccaagtaagaaacaaaacccttggaaagcatttgttgactcaatttttcaaagtttaagaatatttcactatgtatgtttcagggcctcatccacaaagccaccgataaatgtggagacgtgtgcttgtgcaaacctcgtgaggagattcgcagttgcttagcatcaagtccggtgaaggttataaagatactgaaatttggtgaaatcagtgatgacatggagaagcagagagagcagatcaagtatttcttggagacaatgccgaatcttgagaagatgattttgtactacaatacaacaagtgttgaagatgtaactgaagtttcaagccgacttcagaggctagtttctaaattagcttcatcgacgtgcattgtccaactaatctctgataacctcagcttgtcatctactgtatcgacaaatgggctcctctgtttctaaagggtacctcttcggtttgaagatgaacctctttatctcagagatgattaccaaagcttagggagtaccctagcttgtcgtcactaaaataatcttctcttgtttctgcctaattatgttctaaagacgtgttatttaggctttgtccttattgacttgcaatgttaacttcagttttttcttgttacagttggtctgttgtgtaaaatgatcttgtaagagtaattggtaggagtaagcagacaacaaaagctgaaacatcccttttgtgtaaagatctgcaacaaaaccgaattaacattttatctaatcaaacaaataaaacaattatcgctaaatcaaattatgtcaagtaatgtttttgtaagatgctagtatatctgattaaatatattattttatctaatggagctcaaaatatcttccaaaatcttacaaaatcttttagccttttaggacaagacactaaaaaaaggctagcctaggaagtaggaactcacactttcttcttcactcttgcctacaaatacaatcgccaaaaaccctaaatttctacaatagttgagtcattttggtgagctatcttcactttagcctacaaatacaagtaagtttcaatatcgatctttttattttttcaagctagcgtgtttgtttgtttgtttgattcttagcttctcggttggaacacgtagaggaagattgaatcggtctcgtgtctttggttttcaggttgttgaaaagg

SEQ ID NO: 4226 - DNA, 3000 bp, Unknown; identical to SEQ ID NO: 4204
  misc_feature (1)..( 3000): cDNA_ID_3072785_gDNA_ID_1620691_Annot_ID_164749 3000 nt of promoter + ATG

SEQ ID NO: 4227 - DNA, 3000 bp, Unknown
  misc_feature (1)..( 3000): cDNA_ID_1823471_gDNA_ID_1620691_Annot_ID_48602 3000 nt of promoter + ATG
acgagttcttaaacaaatttgttataaataaatttaatatataagtaccattaaatatgttaagtaacatattaatgatattaataaaccattttaatattgcataaagttttacaaccattgtcatcatatcctctttttctataggtgttactagctctcatctcaaggtctccaccatactctttaattaaccggctattatttattttaatagtaacacatttgttcaaaataacactagatgttttacggatggtgattttaagatgtttagatatttataacagaaagtcaggtcgatccaacattctttcatgccctacacaaataaacatattatggcctgtaatttttgtttttacaaattcacaaatcatagtaataaagaaaagatcatactaaaccttaaataataaaacagtttttaaattcattagcagtttgtaaaaagagaaaaaagaaaagaaaaaattatatccatttttttttggtaagggataggggacaaagtcccttaccgtttgttaagaaaacttaaaagaaattagaaaggaacgattcaagttttagttataaaaaaacttcaaaaaaatatatcatttaaatatagctctagttacatttttacctgtaaaatcactcatcaattagtcaagtttttcacacaaaaatcattcgatcatgtctagttgcctacaaacaagtaaaccaaaaatcgcatgccctttacctacgaatgactaatataatttaaaattgcaaactaattagatttaaagcaaagttgcaaaattaaagtccagacacaaaacctagagagacttcagactttttctttagtaatcaaactcgattttgcaagtttagtattttacgttttttaaaaccaaatttttaccaaacaaaattcattaactagacgtaaatttagctaaaaaccacaaaatataatgaaaggaagctaaaaaaaaatatatatatatatataatgaaagcctatattattttttattttatcataaaaggcttataaaagttttttgtaaaacatgttctattaactttgatgtcctaagccataacttctcttgattttgtggtgggccagacctaaaacattaaaaatatgatattatatataaaaatatgatatcagaaaaataaaactattaatttgtaaacaaaacttaactgacattttactttctttcatataatatatgaacgtttttaactatgtacatgaaaataaaacataacttaaaattagaaaactacattaaaacgagatctatataatttttggccgtcgaaacgatcgtctaaacgttatccagagaacctagatgaccgtctagactgtttttaagaacatatgacaatgttttataaacataagtatatttgtcataatgtttaacataatagttttgaaaagagagaacaaagtgcaacactgttgttatataatacaattttttattaactattgaaaatatgagatttccatgggatattgcacaaaagctaaattgcaattcataagattaataaaaatctttatgtacaatgtatcacaccatttctgtcagttttaaaatattagttttagaaaataaatgaggatctaatacttttttttttctttttcataatgagtcaattttattgttatggaggatcaaatctcagtgttaaaaaagggtaacaattcataatattaattaaaatctttcagtaaaatgtatcacaccatttttgtcagctctaaaatgttagttttagaaaataaatgagaatacgatttttttttttttgtctttttgataatgagtcaactttatgtttatgaaagatagaatttcaatgttataaaggggtaacaatttataagattaattaaaaaaattatctacaatgtatcacaccatatctgctagctcgaaaatgacagttttagaaaataaatgagaatagaatatcatttttcttctttttcatagtggatcaactttatgtttatggaggataaaatctcaatgttaaaaaggggtaacaaatcataagattaattaatatgtttatatacaatgtatcacaccatttctgccagatctaaaatgacagttttggaaaataatgaaaatataatatcattttttgtctttttcataatgagtcaactttatgtttatagaacataaaatctcaatgtgaaaaagggtaagaaaatcttctatataaattggtcaaactttctttcaattcaaatcattattttttattaataaatgaaaatataatattttttcaaaatgagtccactttatgtttatggaggatataatctcattgtttaaaagggtaaaaaatctcttctatataaatttggtcaaagtttatttcaatcttcaacaaaaatctttatttttctatgatttaatggaaatatgggatttatgatattctctaaaagctaagtttcaactaatataaaaataaaaaagctaaattacagctcatcacattaaatgaaattgtaatggacagtgtatcacaagatttttgccagtcttaaacgttctaaaatttcaggcgttttttttgttctatttataaatatcaaagttttagcttcataatccattcatagtcctctgctcttgttttactactcttactaaaagtttttttaaaaaagaaaagtcttagctactagcttgctccatttataatcccttcactcaactttcttgttttactactctcactaaacgtaagtttttctgtatcatttatctaaattttattgtcaatatcaaactagatttgaaggatttcaattgaaagtcttatgatatttaattgttacgtcgatataatctatgtgatgtagaaacactcatttggagtggtttaattacatatattgcaaattacttatttaaagtgcatgctaatgatttagataattttgtttcaaaattaggtcttttc

SEQ ID NO: 4228 - DNA, 3000 bp, Unknown; identical to SEQ ID NO: 4223
  misc_feature (1)..( 3000): cDNA_ID_1823467_gDNA_ID_1620691_Annot_ID_48603 3000 nt of promoter + ATG

SEQ ID NO: 4229 - DNA, 3000 bp, Unknown
  misc_feature (1)..( 3000): cDNA_ID_3072859_gDNA_ID_1620691_Annot_ID_48604 3000 nt of promoter + ATG
cacaaaccatctccaattagaaacctaaccaattctagcaactacacaatctttcaattggggtgaattcaaagatatgattcaacattacttaattagaaattttgtctcgataatacctaatttctgagaaaagggtgaaattaccttgacacctgagtctgaaaacccagattccgtcgcagtctccgcactaagtttccgtttaagaggattagacggcggcggacgcggaggcaacggattcttcattctcatcgacctatggtcaggcgtcgacgtgttccgatctagaggtggagcattttctttggcggatcttaatttgcgtggaggcttcgatttcgagatactagggtttggcgagtgtggctctccgccgtcgcgtaagatagcgtttcttggtaacgtaaagtgcttcttcatctccgccgtgaaatctacaattagaaacccaaagtagaagaaagagggaaagtaaatcgaatctgcgcttctacgagagcgtcagtgaaaccctagtgtttgggcaaagaaaagaggaagaagaacgagagaagagaagagagagagagccgttaaagagcgagaattttgaatttgtttttgtcagatcttgtgaagtgttgacgattcgcatcacatgaatttctaaattattttatttaaaaagaaatgaattttatgtgatcgtgactttatggccgtaggatgaatccaacggagggaatgagcaacaaaaaaagaaaaggcccacgtgtgtgtttaatggtgtgtgttttagtctttagacgtgtggtagtaatactgccgcacgggttttttaagatccaccgcgcgtaaaaatccaatccatccgctatggagcgggtatgggtttaaaacttttgacccgttacgaagcatggctcgcgagtaatcgtatcgtgggttgcagatttagtggttgtcattgggcagcagtagtactcatttctatcttcaactatattatatgtctttgactgtgaataaatgtagttcgaacgacaaaatcatcaaagcagtaaattagtcaatagcacagattttttttttttgggttaaaagtcaatagcacagatgcgaccacatttagtcatttacttacaatttagtcttaccaacgacatgaagagctaatatgagtgtcaaaaaatacaaaattcgatggtagcgatgagcaatctcttcaaaattgaagtaagtgattcttatgtcataaaattcattgaatactagacaattcattgaagatgatgcaatttaaaaattaaaaataaaaaaattcatacatgataaagcatgaattgaaattcttcatgcaatttaaaaaaaaaataaaaaaattcatacatgataaagcatgaattgaaactaatgtcaggtcctccggacttgggagcgtgtgctaaactgctaataatatcaagagagtaaacaaaaccacttgcaaattttataaaatctgccaaagattagcagattatgctgataacttggtacaatagtaggcaaaatcttattctactataaaatcttctcaagtcttcacaactattcaccatgtacttgaagtcgaaagaatgttctcatatatatatatatattttgttacgaatgttctcatatatagtatgccaataaaaccacaaaatttgtctgacacaagatagagtatcatgcttagtcaaaatatgtaaatattctcctaaagttcacaactacttgcacactttcattaagtatgctgctatgtttacatattatacaaataaaatcgtaaattttgttagaaacgtggcaaactagcataaataaataatctaaggcttctagtaatctttgcattacaacttgcataatttccataagatctattggatattgtaaaatctgccaataaaaccacgtatcttttaagaaaacacaggagactaaccaaaataaatccaaccgtattataattctctaaattttacacattgactcacgaacatttataaaatctgccatattcgaaaaatttgtcaacaacatccctataatgtttgagagacatgaaaaattagcaaaacatatgctaaatgtgctagtaatccctaatgtacgtttacataattttttttttgaccgattttaattagagctcaaaagaatcatccatgaaaaatgtacgtttacataacattttccatactttgtaaaatccgtcaatgttggataaacaatgttatgaaaaacattcaagtctacaaaacaaaacctaagtttctatggcttataattaatcccatagttttttaatcatgttagatttgttaaaattttgctagcgttgatgattttcttgtattctaaaattttaattttttgaaaaaaattaattcgagaaattttttcactaaaaagacaatgttttttttttttaatttaaaacttaaatctaactcttctttttgtcaaatatagattcttattattcttaccttttaaaatttatcttatttccttcttttttttaaaagagatttacaataaataagtaatattgaccaaagatatagaacacaccaaaaaagaggcaaagatatagaaaacatactatttagattttttataaattttggtagatatcttagattattctagcaaatctcctttaattgttttttttaacagcaaatctcctttaattacatcaaatccgtaaaggttgaaaaaaaaaataacaatagaattttagtaatgaattaattaccaatacttgacccaaacccgaacctaaacaccagatccatcgtcatcatccatccaatcaaattgactcatcgtgttgtgacctcccagtgattaagccgcgactcctcctaactcgtaatccctcacgtctctgagaattctcagtttcttcagtttcattgcaattcaattcccgatctgatccgttcctgcttagatcggagcaaaacaatggcggag

SEQ ID NO: 4230 - DNA, 3000 bp, Unknown
  misc_feature (1)..( 3000): cDNA_ID_1823455_gDNA_ID_1620691_Annot_ID_48606 3000 nt of promoter + ATG
tctgacttgcatggcgtaacgcataatctttccacaataaatctgcaggaggtagactgatccaatcatgggtaaagagattcacaatatagagatcacaccatcgatctcccataaggagccaacttccatgagttgccctacaaacactctttgtaaattcctcaccaaaatcttgcgttttgtaaactttatctttttcctcgggattcaacaacgtgcatgaattgttgttgttgtctcgggggaatcaaatcagccaatggatgtgtttttgggcacgacttgtctggaagcagagtaccaagaggaacacacggatttagctcgggaagctccgaccaggtatgagacgtatgagaagtagggttatgcttattctccatggcaaattggagagaacaagggaaatctcaaaatgagaatagggttgttacgatttggtgaagaattagggttacgcttttaatatagtcaacgagaagaaaaatttgcttgttttgggattttaagaagttattgggccattaacatatctaagcccacttaaacaattgtttttggtgacttagctagaaccgacgaagaagaagatgaagtagcaattagagagaaaaagacaaggacaagaagaaagttgtgctgtcgcaaccaaactaagggtgtatatatgtgtgtgtggtaagtagaaaaactactaaggtatgcttgtatgtatcatgttgtgtaaaaggaatccgagttatcatgttccaaacgtttttgtgtttcatcaaacaagtagacacaaaacagagagtgaggtatataagaattcgcaataaaagattattctgaaataattcaaaaaaatgttccttccggtatatcaaatcccatgatctacaaccctaataacaaaaagttaactttgaaaagagcttatctttatcctattaaacaccaagtatattctacatcaaaagcttacttaagcatatcagtttgtgtataagcacaagacatttttaacttatccataacaattgaaactttgtaacccttttgaccacccagctactcttttggatgatgaccctctgcagacagctgagactgtagtctccaggccatgtttaaatgtcttatttgctgaggcaatcaaaagtcccttgctttccactaacagcgaggtgaaacatgccgtagtagctaaagactgttttcaaagtcggaccagacaccacaacttttccatgtacacaattagctgtggtctgagcctcattaccaaaatctagatgtaagtttcaagagcttttggtgcggttttgatctttaccattctggtaatctttcacatgtacaaccagaagacgctgaaatctccatcccatctttcatattgagctacacccgggaaccttagaaatctgtttctccttcatccactgcctcagactctcagcttcatcaaaccgacctgcagctgaatatagaccggccaacgttacatagtagctagcttttctcggcttaagttgaatcagctccctcgccactctttccccaacttctacatttccatacaccttgcacccactcaacaccgcacccataacagcctcatcaggtttcacgggcatatcttccagaaacttctctgcttcctccagaagacctgctcgagacatacaatccgccacactagcatagtgtttcagttcaggaactatattatattcctgcattagtctgaaatacagccaagatttttccacaagaccgccatgggcacaggctgataagacaccaagaaaagtgacagcattgggttcaattccttccttaagcatctcatcaaagagtttaaaagacattaccacgtctccatccaaaccataccccaaaataagcgagctccaagagatcacatctcgtctcgacatatttacaaatacagtgtgcgcatagtccagtatcgagcactttacatacatatctgttatagcattgccgagattcaagcccaagcaggagcatctcctgatacaccatccatggacgctcttcccgtgcttcaacgctccaagttgtccacaagccataagtaaactcaccatcaccactgaatccagcgcaaatccagaataccccatttctctgaacatggctaaacccaacatagcttctccttgctgaacatacccaccaaacatagctgtataaagaacagagtctctcacaggcatatcgtcgaacaacttacgtgcatgtaaaagtttccccatatctacatacattatcactaaagccgaactaacaaacaaacttgagctaaacccaagtttcaaacacagaacatgaatcaaatctccagatttcgcttccctagacgcagagcaagctcgtagaataagaggaagcgtaaaatcatccggtctaacacaagactctcgccacatacgaagaaacaaatcaattgacttggaagcaaaacccgatctagagaactcaccgatgattatattccaagagaaaatgttgcgataaggcatgtgccagaagacagaaagcgaagtaggaaagagatggttcagcttggaataagcgaggacgagcttggagctgagcacaacgttggaatagagaaatgtacgaagaaggtgagcgtggagatggcgtagatgtttagcgtttggagaatgatgtagaagcgagaagagatcaggaggattctgtgtagttactgataaagctcgagctttcaagaacattgcgaatagactcttcgtaggagacgagtacaaggaagaggaagatggtaagtgcatcgcatcacaaaatccagagaatagtggaagatgctttatgatttaatccaaaactttattttatgattttatatcaaattttaaaataaggaactcttaaaagtaatataactgtaaaatcatttttgttgggacgccatttctaaaagttcgaaatttcccagtctctctctttcgcgctctcaca

SEQ ID NO: 4231 - DNA, 3000 bp, Unknown
  misc_feature (1)..( 3000): cDNA_ID_1823451_gDNA_ID_1620691_Annot_ID_48607 3000 nt of promoter + ATG
tgagccaatgataataatccgtacaaatatacgaatgtatctactaactaatataatattgggccccacccaccagatcgtcgtttagtttggttaagtgagtgttgtttgtagtagtgggctttttgcttcgcttcttcgttttccaaaatctctctctctctcacattcattgcttttaaattaaaactccccaaaaactgaaactgttactacttctctccttccttctctaaaaacctaaaaaaaaaaccccaacacacacacatggattctcaggaccactgcagcaactctccaggttcttccctaatcattatcaatgtctttagggtttccttctttaagtcccaattttgcatctttcttcctccaatgtcgtcacattatcgggtctagttcggtttttacttgtgtgttaatctcttgtcgggtctagttagaatgatttcttcatgtgttttttttttgtgtgtaacttttgtagcaataatggtttcttcctttttgtcttgtaatggtctatttgattaatgtttcttcagattacgactggtttcgctttctgaatttttttatttttttttaatctttagaaaagtctttgttagaaaaaatatcaatttttgagaatatggacactgaggattttgtgaacccttgttatataggaggaggtaagaaccatgtctgtactaaatgtggttggagttattcaaatccacatcctagtgctaaaaaccgtcgtgctcacaagaaaatctgtggaaccatcaaaggatttgagatctttgactctgaaatgaagaaagagaatcttgatttgccggaagaacactctttggatgatgagcaaaaaccaccaaccccaagtaagaacaatttgtgctttggatggataaagtttctttctttccttgattctaatgttataatgtatgcttaatgatgaggttaggtccaacagttgtcgaaaaatctgctccaacagttgtcgaaaaagctgctaatgagagaattggggatgtttctgaagaggatgtgtttactgatgctgtttgtgagttttcgagatctgattctttcaaggaagagacagctacaaacttcccggcaaagggtactgagaatcccggtgagttaccttccgatgctaatgtgtttgataggttttcttcatcaagtaatagaatctcaaacctgtagagtatagttcaaagggaaactatttagttcactgactcatctgtttgtcacattgctcggttttattcccatttggctttcatgtttttgtgtgatgtgtctgctttatttcaactatatagttgatgaatatggaacttctcaggtgaaactcagcagtgcaacaattcatctacggcctgtgagatgaaaagttctgaagtggttcaagacagctgtgaagttccacctgtggaagttgaatcagcttcagagaatcgacaaggtgcacagcattctactgaaggacactctatgtcatctgaaactgtgattgagtcatcacaggaagctcaggtcattgacggtggtgataccatatcaaatgatagattagagacagaatgcaaagggaagttaacgaaagaatctcaatctaagttagcatctgcattaggaaagagagaggatacttcagattcatcgtggaacgatgaagtgatttactcagatgtggagggtccctatggtttttcatcagaagcaactagtatgactcatcctgatgaagctagctgtatagtcagtgaggatgttccagtccatacttctccagtaaaagctgatgcaactcaggttatcagtgccagtaaatctgttcctgatgatatgccttttgttgagaatgctgatgtctatttgcatggaatcaaaggctttgaagaatttgaagtgagtcattctgtgaatccttttcttcctgagacatctaagggagaagaatgtgaaatagatacacttactgaggcagagaatttaggaattaagcctgaaggcttaagtattggctcagaggtttcttcatcagacaagcttctcgctggagacaaaactgaacctcaaggccaaaccgatttggttgcggtcaaggaatttcccagtgcagagaacatactgatatctaagattaactctgaagatatcggaatgaaagctgaagagggtaaatcatcattagggaatgcacaaactgttgaatcagaaaccttgagagtttctctacctgctgtagattctgtagttgttgactcaaatgctgatatgagcagtgcagcgaacaaaactggtttagttgatctcgctggtaatgaaagtgaacttatgcaagcaaatgttgtagctgagaaggggaacaaaccaaaagacactttgagttctgaatcctcttgttatgcttctcctgtgtctgttgtatttgagggatctgatgcaagtgatcagatcaaaagttcaacagaaacatccaaagactccgccctccaaatcagcgctgaaagtaaagatgaagtttgcagagagagtaacaacggaaggcttgtggaggaaagcagtttcataaacgaaccaaataaaacggaatatcctataagccattttggatcaacaggcactgcacctgacactgttaatacagctaatcagacgtcactggaaatcggaaggacagaattcaatagagttgttggtggcttgggggtaattcaagcaaatgaggtcgacggtaatgtcaaagcacacaacaattatgctgaggtcccagtgacaatagaatcaaacgatcatcgagattttgggagattgcagaatctttcagaagctcacattagatctctggtttctagtccgctagtcactagaaataatacatctaatgcttctgaatctaacttgggaccagtttcaggtacttatcctatacatcttgtatgagcgaaaaaacaaaactctcttcaagatataacactcattaaaatg

SEQ ID NO: 4232 - DNA, 3000 bp, Unknown; identical to SEQ ID NO: 4221
  misc_feature (1)..( 3000): cDNA_ID_1823447_gDNA_ID_1620691_Annot_ID_48608 3000 nt of promoter + ATG

SEQ ID NO: 4233 - DNA, 3000 bp, Unknown
  misc_feature (1)..( 3000): cDNA_ID_1823443_gDNA_ID_1620691_Annot_ID_48609 3000 nt of promoter + ATG
agaggaattgagatagccatactttgcagaagcagcagctagtttcgatttaatggcttccggaagcgaggatgcttcaggtgattttggactttgagatgaacgagatggagaagggccaggagagattctgatgacagatacaagaaaagatgaagatatattacatatggtttaggtaagttctaaacaatttaaaggcttgaccaattctccaagaagtagctgcataataaagagacatggtctagaattccagagccatctaaattatttatcagtagacgataatcccagtaactaagcgaaacaggaagtataagagcatctgcattgtgcagctcaagcaaatggaaaccatacaaatcatgaaagctggttatagagacagcacaagcaaatggaaagcgaataaatcatgaaagctcgttatcaataaaccagacttgattatgtgtatgtcaatacctggatccgttattgctatctgcaggaatggaagaatgaccagagacgggagatggagtcattgagccaggacttggacaagggtttgagttttgatgttcaacatgggaaatagcagagagacgataaagattgaccaaatcagtaggatgaatcgtagtgggatcgctggacgaaacaagactagaggatatttgaccatcccttctgcgaagcaaacaacgtctatgtgcagcttcagtaagatgcctcaagaattgttcatcaaagctgctaaactgtgattcctcctggaaacattatcaagtcaactactataacttaaaactcctaaattttaataaatcacactggagactttgtcgaacctcctcagagtgaaaatcgtcatgagagtgatgaatagagattggagaggatgaagatatattcctggttttcaaaagtctttccttttccacagcagctaaaagctcttggctacaaaacaaaggaaccaataatactatcaagacctaactatgagcaaagtatcatgagaacaaaatctttctttctccttaaagatggatgagagtacctagcagggtctctcaaaacaaacaattgccagcaaataggacactctttgcttctctgtgacctgtgtaataataaaccccaatgacaaatcaatcagtgatagagatatgaagagaagattcaagtccaaagaaagataaaaaagatcacagattcatgtttgcaagtaccattcaatgatgcactgaaggtgatattcatgtttgcagctggtgacctgagaaaaccatcggaaagctttagatatcggagaagaaacaacaatagaagatgtttatgttagatccaataggaccaaaatgagaaagcgagaggatcaatcaaacatgttcaacgatggttcaagaacaagtgatcgagttaatcaaacgatctcgttattaatctgagtcaaaatatcgcaaggcacaaaatccgattatcccagatttcaagtaaaagcgaaataaaagcgagaaggagatcgttaaaccccgaagagcttatagacaaaaacaaaaagagagaggattaaaagaatctgacagtggaaggatcctggagggtgaaaggctcgagacagatgctacaagcatcatcggtattattatcatcatcggaagctacgacgagcgcggaggaagaagaagacgaagaaccaatggcgggattaaaaggggagttgtcggataagttgaaagcagatgtataagtgaaattagacattgttgttgaagcgaagatggaaagaagaagaagaaggagaagcttgatgattgagattttgagatttaagaggttgaagaagaagaagaagaagaagaagaagaagaggtgtgagattgatttgtttgatcaaaaaaaaaaaagaagagaaaaggggaagagaagactgacaagtcaaagcaaaggaaaagtcaaaaaagagaaaatgcaaggaggaggagtatttggtttttatatttaaaatttgttacacaacttattatgattgggctttgtttaagtccactagttttagattctaaaacatacttcgtcatcagacaatggacccaattcctgggctaaattatgtgggcaaactaagcggaatcggatatccaaaccgaaccgacccgagaagagatttggaggaaatgcaatgggaacagaagttgatgcgttggagcatataacagaacttgagatatcaccactctctcaccgaataaacaagccactggttgtacaaatgtgtgtattccacaaagtttcgatcggattcggatggctccgttaaatataaggtgggttagggtatacttgggaatcacgagaaggaagatcatgattataacgaataagataacacagaattcatatctatttgacaccaactccaccaaaattatttatttttattttgtcgtagttactttggtgggcaaaaacatattagctgagaggtcaatttctttttcccctaaaccaaattacgttgagatgcatggtctctctctactcaattaaccaaataaggaaaagaatcatatggtcatcaattcgtaaatcaaaattttaatttgtgtggtatttaatccatctacatgtttcgtaagcaacaaaagagcttggtctgaaaaccaaacaagaccatatgggcactcgaatactccattttgttatcggctacttccactagcctcctccttcgctgcgtctcctgtttctctacttcacgattactcgctaggtaaaagataagatactaaacaactactatagcccctttaattcaagtccgtttttttttgttcttcttcttttcaattatgtgttaaagatacaaacttttgtctgatttgcttccaccggtttcacctaagatactcaattttcttactttttgtgtgttttgtaattctaattcttttatagcttcaatttttagattcattgaagcagttgtgagttaagttggagaaaatg

SEQ ID NO: 4234 - DNA, 3000 bp, Unknown; identical to SEQ ID NO: 4213
  misc_feature (1)..( 3000): cDNA_ID_1823491_gDNA_ID_1620691_Annot_ID_164773 3000 nt of promoter + ATG

SEQ ID NO: 4235 - DNA, 3000 bp, Unknown; identical to SEQ ID NO: 4212
  misc_feature (1)..( 3000): cDNA_ID_3072879_gDNA_ID_1620691_Annot_ID_164772 3000 nt of promoter + ATG

SEQ ID NO: 4236 - DNA, 3000 bp, Unknown; identical to SEQ ID NO: 4211
  misc_feature (1)..( 3000): cDNA_ID_3089922_gDNA_ID_1620691_Annot_ID_164766 3000 nt of promoter + ATG

SEQ ID NO: 4237 - DNA, 3000 bp, Unknown; identical to SEQ ID NO: 4210
  misc_feature (1)..( 3000): cDNA_ID_3072763_gDNA_ID_1620691_Annot_ID_164765 3000 nt of promoter + ATG

SEQ ID NO: 4238 - DNA, 3000 bp, Unknown; identical to SEQ ID NO: 4209
  misc_feature (1)..( 3000): cDNA_ID_3089926_gDNA_ID_1620691_Annot_ID_164761 3000 nt of promoter + ATG

SEQ ID NO: 4239 - DNA, 3000 bp, Unknown; identical to SEQ ID NO: 4208
  misc_feature (1)..( 3000): cDNA_ID_1823513_gDNA_ID_1620691_Annot_ID_164757 3000 nt of promoter + ATG

SEQ ID NO: 4240 - DNA, 3000 bp, Unknown
  misc_feature (1)..( 3000): cDNA_ID_2040933_gDNA_ID_1620691_Annot_ID_164754 3000 nt of promoter + ATG
cctagctagcgagtatttccaagatttgaatgagcaaaatctaacgttgagcacacaaactgagaagcaacatctacggggtctcagaaaacttgattcgagggaggattcgacttcataactatgatgaagaggctcctacaaaaagtaaactgaaagaagccgttgtggtgacattgtgtcttccctacaacgtgaatgagacatccaaggacacttgctttggtctgaaagccgcaacagctgtcaagtaatacgaggaatgtcttgtcctcagctctgttccctggatttcttaaactatagacttgttgaatagatcatgaaagccactaatgagagtgtctctgtcgacttttctatgctggagatggaactatcgaactgtaaattggataattatgatttaatacaactgtctaggaaaatgattgtattcaaataactttttttttctcaaataaattatggaataaattgaatactaaaagtccttgtaatgtttcctacccaaaaaagtacgtgtaatgtttataagacgattaaagaaaattaaccaaccatatagaaaactgccaatgtcaatggagactccactctccatagaccataacacatttataacacgtaaagtagataatttataactgttataagagaatatataatccatatttaaatagatttttaatttgttattctgataatagagaatacatattttaatttttttgtaatcataaaaaattaatacatataaaatgatgaattaattaattagtaatgaatacattattcgtatccttggataaggaagactcttgagatttgacgacactaacgtagcagcaacaacagttagcgcgacgaagacaaacacctcctaagttgttatttctaggattgcaataatcattgcatgtcccgtcgtctgtacatgctattcctgagtaacattgcatggtttgtcctgtttggttcaattgttatttgtttataaattagtatcacttgtgcaccatttatgcttctattccagttcaattaattttattaatatttttctatattaaagatacaatttctttgttttttataactaaaatgtcactaatacaactattcaaattttagaccaatcaattaaacatatttttgccaaccataaatttaaactaaacactctaaatggaaaccgaagacaggggagaaatgtttacaaacgaaaccaaacaaatccaaacaataagcaaactatattaaataaagtcaaataatttataatgtaaacataatattttaacatgttacccaaatttcatcaaattttgttagaataaaatctcagtttgaattctcaccatgatattatagaaaaataaagataattttttttgcatttaagaaaatttaaccccaaataaataagcaaaatagtttatccttgaaaatgaaaaatatgtattaccagaaatcatggggagaaggataagagcaaagaccatcaccgatacaagagataaattattcttgaatcccatttcgctagaggatgcaacaagtattagttagaatatactcactttaattagaagatataaagaataatgagcctatagaaaagtaagattcaaatcaacattagaagaagtaagatatctaataagaacaatagcaaaaatagatacatcgataaaaactaatatcttacaaatattaagtaatattgatcttgaaaatttatttctacactggttgataagaaatcgttgtcttctcctatataaaattgtgaatgtcttaggaatttatacatatttagaacctaatttaggaaattcagaaatttgattttaataataaaaaccattgatttctttttaagacttccagattattattattatttttttattttattttttggtaaaccttcgcaactatttttgatgcatgcatacatttgtgttaccaaattaaaatacataaataatgtcaataatgaaatttttcaaagctagcaagatttaaagctgttgacttaactcacattcaagaagaaaaactatattcttagcacatttacataattaataatgtctaacaatgaatttttcaaagctagctagatttaaagctatcctctcaacatacatttaagaagaaaaactatattattagcacatttacataataatgtattttttcaaagctagctagatttaaagctattttcttaacatatatgtaagaagaaaatatatattcttagcccatacaacaataaaatcttcaaagctagctagattcaaagctattctcttaacataccaattaagaagtataactatattcttagcacatttacataaagatgcacaacaataaatttttcaaagctagctatagatttaaagctattctcttaacatacatttgagaagaaaaactatattcttagcacatttacataaagatgtacaacaataattttttcaaagctagctatagatttaaagctattctcttaacatacatttaagaagaaaaactatattcttaacagactttttacattttaatgttctcaagtagacaatagataaatgtatatactattttttttcttttgtggctttaaccaagaaacaacaaagacattagcaccatgtttcccattcaaacgtcttctacgatggattttgatatgtaatagatttttccattatgtgtacttcttttctgtttttaccttttagtttgaatttgtcattctagaaatatagaaataatactttaatacacataaatttccaaggaaaaaaatacattttaaaataaatggttatgacttatgcgactaatcattatcttcaaaaattacacaaattctatccttcgaaaccctaactcttctacttcgccttatactttctacggcagccgaattcgaccaactccatcaacgcacaaaattcttcaatacaaacctgaccaatg

SEQ ID NO: 4241 - DNA, 3000 bp, Unknown; identical to SEQ ID NO: 4205
  misc_feature (1)..( 3000): cDNA_ID_2050886_gDNA_ID_1620691_Annot_ID_164750 3000 nt of promoter + ATG

SEQ ID NO: 4242 - DNA, 3000 bp, Unknown
  misc_feature (1)..( 3000): cDNA_ID_1823441_gDNA_ID_1620691_Annot_ID_48610 3000 nt of promoter + ATG
ttcttcctgacgtctaaattagatggagatacttcatatcctcaaacattcatcagttctttgattactattaaatgtcaaaatctataattagcttgaattgatcaatacaaataaatacatgcatcatagttactaacctcacttttttactcaattacatcatactttgttttacattcaacaagtgtgtgcacattaatccaattttatcaaaccaaatacatggcgccactaactaatagttcaaccactgttttcatcagatagtttaaaagtttaattacttgaagcagtaatattataacagctgactagcaagtaagaatatgcgataagtttattctctcaccatttaagggtgctggtaggacatctgggaagtcaaatctactaaattctccaggtttacttggcatagcaaaaatcatggagtgttccttccactgcaaccgatcattgatcccaagttctccaaataaattctgcacattcggataagcaccgacttccaacaagaacatgaagagagtatcagtaacgaaaagtaataacagggaaaacaagatacaatataatttaaccagtgttttgcaactttcttcaaattgatggtagagctgataagatatatgtaacaaatatattgggggagcaacagagagggtatgagttttggacttacagaaaatatgtaaaccagtctcataccagtccccatcttcatccttccatgcagctatctggaggaagacaaatatcacatcataaatatcgctctccaataagataggtaaattgttaaaacggaacaaacaagaacctaacctaagaaccagagaacacaataacaacttaacaaaatatatatccaaaagatatcttccagtaaactactctatatttgattcacattaagcctagaaactggaaagggttgtgcggtgtgtagcacaagactgaagacattagaacataataaaaaacaaattgggcagtacaagactaatacaacaaacaggacagatacattgggtacctaggagctgtaacactctaaacactagttataccttgtagtctcacaaacataattggtacagcctttgggaatcagcaaatcatataagaatgagaaatgcaaacaacaataagtaattcggaaagtgagaccaatcaaagtacctttccaccaagaacatctcttgcttcaagcaacagaggtttgtggcctgcatcagccaggtactttgcagttgacaatccagccaatcctgcaattatttgagagccaaaagaacttcatcacatgaacattaattccatcagatcccaaacaaagcagtaagaaatgaagttgtagacataccagcaccagcaattacaactttcaaaggcttagcaggacgaggagcactacggaaggatgcagataaactagcagcttccaagaaattgacagtgttctctagctctggccttggaatatccacacaaactacctgcaatttcctctctttaatcaaaattacacttatacactagatgaaatttcgagaactccaagttaaaaaccagaaaggtagatacctgcaaaggaccagcagtactcctcctccttgttcttgtcttaagcgcttgagaagtgggaaccctaaagctatgtcccattagttcacaacctccagatgaaagtgcctccaaaaacccgttttgataaggcaaattcgccgcagaaacattcccaaacacaaccattttctccaacttaactcacaactgcttcaatgaatctaaaaattgaagctataaaagaattagaattacaaaacacacaaaaagtaagaaaattgagtatcttaggtgaaaccggtggaagcaaatcagacaaaagtttgtatctttaacacataattgaaaagaagaagaacaaaaaaaaacggacttgaattaaaggggctatagtagttgtttagtatcttatcttttacctagcgagtaatcgtgaagtagagaaacaggagacgcagcgaaggaggaggctagtggaagtagccgataacaaaatggagtattcgagtgcccatatggtcttgtttggttttcagaccaagctcttttgttgcttacgaaacatgtagatggattaaataccacacaaattaaaattttgatttacgaattgatgaccatatgattcttttccttatttggttaattgagtagagagagaccatgcatctcaacgtaatttggtttaggggaaaaagaaattgacctctcagctaatatgtttttgcccaccaaagtaactacgacaaaataaaaataaataattttggtggagttggtgtcaaatagatatgaattctgtgttatcttattcgttataatcatgatcttccttctcgtgattcccaagtataccctaacccaccttatatttaacggagccatccgaatccgatcgaaactttgtggaatacacacatttgtacaaccagtggcttgtttattcggtgagagagtggtgatatctcaagttctgttatatgctccaacgcatcaacttctgttcccattgcatttcctccaaatctcttctcgggtcggttcggtttggatatccgattccgcttagtttgcccacataatttagcccaggaattgggtccattgtctgatgacgaagtatgttttagaatctaaaactagtggacttaaacaaagcccaatcataataagttgtgtaacaaattttaaatataaaaaccaaatactcctcctccttgcattttctcttttttgacttttcctttgctttgacttgtcagtcttctcttccccttttctcttcttttttttttttgatcaaacaaatcaatctcacacctcttcttcttcttcttcttcttcttcttcttcaacctcttaaatctcaaaatctcaatcatcaagcttctccttcttcttcttctttccatcttcgcttcaacaaca

SEQ ID NO: 4243 - DNA, 3000 bp, Unknown; identical to SEQ ID NO: 4220
  misc_feature (1)..( 3000): cDNA_ID_1807149_gDNA_ID_1620691_Annot_ID_48611 3000 nt of promoter + ATG

SEQ ID NO: 4244 - DNA, 3000 bp, Unknown; identical to SEQ ID NO: 4219
  misc_feature (1)..( 3000): cDNA_ID_1823437_gDNA_ID_1620691_Annot_ID_48612 3000 nt of promoter + ATG

SEQ ID NO: 4245 - DNA, 3000 bp, Unknown
  misc_feature (1)..( 3000): cDNA_ID_1823433_gDNA_ID_1620691_Annot_ID_48613 3000 nt of promoter + ATG
ttcttagattttttttttcttttgtcttttccgaatttgccactgcatacgggtgcaagagaaagattattgaaagcctataaccaaaagcagtggttttaacttttaatttgattaggaaaaaactaaaaaacaagtgttttgtaatctagtgtttgtgaattctttgttttccaacttagatctataaagatagatctcaatatgttctttaatgtaatcgtgttatactacagtacattaaaagcaaagagtaaatcccaaaaaaaatggaaatatagcaaacaaaacaaaaacccgaaaaggaggttctttttttttatttcgttgaacgaaattggagccgacgttaaaccgaaccaaatcgtatatgtctacattcgtgtaaccagtgaagaagtccaagtcgccagttctcggttctctcggtctctcggtctctcccctgattaagatgatcggagaaggcatcgaaaaaaaaaaaaaaaaaatgccaacggtagtgacgtagtgtagaatcttcaggctaaggtcacaatggttccattttctatagctcttgtcttcattgtcaaggtgctgtagagagatcgtgagaaagttaaacgcttaaagtacaattgaagcatatttttaggcctagatctatcgtaaaggagttgagcggcatcgtgagcaagattataggcctatcgtctctgtgtgattcatgttgatgaaaaagatccaaagggctttcagcatgagattcaaggcttggtagagattgatgtacataaaattatggttttggggtttgtttttgacgtttgaaccatgtaatcgtgttttcttctatgaaatttaagattttatattattttatttataattattgattgttgaaaataacacaattctttatgaaaacatatattgtaatatgatacaacaattattatagctattattgtaaatgatacaaatcatttaaatcatttattaaaactgatattaatcttaacattggttatttacaattgacaaatacatatatatattattttatttttgacagaaatatttaacatcacttactataaccaaaaaaaataagtatgcccggataataagcagtggccgatgcagaggtttgacaaggaggtcagttgaccctcataaattttcaaaaattcattatctgtcattagcaataattttaatgaccccaacttaggataaattttgaccccagtacaaaattattgttgcaatatgaaagaaaaaatagtacaaatatttgaaagttgtatttttactaaaagtttagacccataatttaccttaaataaaaaaatattaacctaatattattttaatttttacaaaacacaaaaataaaaatatttttttttaatgtatgattttatattaaaaaaatatattttagaccccataacagaaagttctagctttgccactgttaataagtatgccgtgattttaggaatgattttagattttatgaataaaacaatataacatatgacaatagattttatttcggaacaaatattgaacaacaacaaaatccgttatttttacttcctgaaaaataaaacaagaatcggatttatttattttttcgatgataaagagcaatttatgtgccttgtgtgataaattctaaatattctctaaatattgtatgttcattgttatcttgtacttggtgagcacgtatattctcagtattaagtctaacatacagattcgggacacgaaacacacaaaaaatttagggtttcagcaatggcacatctgataatcagccgagtctttaaactcagtggcggaggcagaatagttaatcatgggggtcaaaaaaaattctaagccaaatgcaaaagaaagatttgagaaaaaaaaatgacaatataatcacaaatgatagttttttaaaaaaacaagataatatgagaaagaatttttttttgataaagtaaacactaaaactaaagttggcgataactttggtgtttacgatctcaccaccaaaatttgcactaccttctacacagaagacgaagtttcaataagaaacttggacttcccttactggcctcctccaattcctcactactagctcctaattaattaaccttgctcttgccgtgtgtttgctttctcatgctattagtgaaatcctatgtttctttttcagtatacgttttttcttcgattccataaaatatggtaacctttaaattttcatacagtcctcctaatgtgtgtggtatactatatggagtgaaaccgatcgagaaacctctctgatgtgaagtatatatcagaacaatacactgaattgcatgactcatgaaaacttagggtctctctcatccaaaggtataaaccaggacaaataccacaagctcaaactcgaatattttggtacggaaggagacaacgatacaggcctacaagagcctaaaaggtgtttctttgtggaattgatgagcataggttgggaattattaaaaaaaaaaaactgagcctcgataattagcatatgaatttgtaaattcgcttgtgtccccaattcactttctttgtttcgtttgcagagaagcaaaagcagagtttgattcggaaaaaaagcagtgttttgtgtaaccaccaatcagtaaaacctagtgtttgtgaagtccttgtttttttacccttttttaatcaccaaaaagaatataaaagtaaacccaaaaggcccaaacaatgtacaaaatcccaaaaaatggaaatatatcacaaaaacaaaaagcgaaaaggagtttccttttttttcgtgggcctctgcgttgaacaaaattggagtaggaaaaggaaacacaaatctgaggagtcctctctataaatactaaacaaatagaagcaaaggtaaaacacaaacacttccattcgtaatttagggttcccacaaattccttgtttctctcgctctcttacacacaggaaacaatg

SEQ ID NO: 4246 - DNA, 3000 bp, Unknown
  misc_feature (1)..( 3000): cDNA_ID_1823417_gDNA_ID_1620691_Annot_ID_48617 3000 nt of promoter + ATG
ggcaaaggaggtggaatcgctgccggggaagtggtggttttggaggtgccattggtaaaggtggaggcattttcggccacggaataggcaaaggcggtggttttggaggtggcattagtaaaggtggaggctttggtggtggaatcggcaaaggtggtgggattggaggcggcattggaaaaggtaaaggatggggctttggcggcggaataggcaaaggtggtggtattggaggcggcattggaaaaggtaaaggatggggctttggtgttggctggtttggacaccactgagctaaatgagaagaagattgtagttgcattgcatggatgtctcacgtaaacaagttggttaaagcaactacttctgaataaattaaattagctttcacgtatttgtaactttgagtttcacagctcaagataagctttgtactgttgagtttccactagtttctatctataattatgagaatttggtatcctaatatccatcattacggatcaaaccccgtaatcccaaaagatattttaacaatgtggctctgccttgtgctatcacagtgtgtgcctatctatgtttgtttcaatctcacccctcacaaaagaacctagtagctcacatactgataacaccttgcctcttcgttcttcaagtgattacctcaactcggagtaggagcagaccttgaattcaacctcgatgagtcgttgccccacctaagaactcaagcagcccttgataagtcctgtacaaacacacgacgcaaaatgattatgcctttttctcaaagctacctctcactattttctacaccttcttcttaatggtaccactaacgttaccaactacctctactttctactcaaaccatacattcagcaatttgactctcacctccatcgagttctgctctcaccatctgctttcttaacaagtaccctgaagcattattccctgcttaagttatatccatcagggccaaaacaaaataacacaatcaaaacaaacaatccggcaagaatactaggaagacaaacataatacgaaaacagcaaagcctgtagttataataactctgccaaaactcaaaagtacactcaaccgaaaaataacttaatagaagtgacttattgtaatagatagcacatgcttataaagagattcaagcagtccaacccgttaggaagttgtggaacctttgatttgagctaaattcttcttgacaaggatccagaaaccagggcggtcataatccccttacacagtcactactggccttgtcgaccctgaccatcattgtacccaccaccataaccttgtgacgggtcagatcgccaagatccatcaccataaccacctcccatgtagccaccactaccagggttgtttgaaccgccaccactaggacgccctccaaccacaccatatgcagcttgatttccataaccagaatcacttccactgtaccctccataaccgtagccttggttactatagccagatggtgactgcgtaggaggagctgcaccaggaactccatatccactatgagcagcaccactcccatagcctgggttcccataaccactagaagctggagtgtcccatgagtttctcggagcaactccagtactacttccatagccagcacctggaatgttcgttgctccatatccagcagtagcaccagcgccataacctccagcagaaccagtgtaacctccataggcaccatacccggcaccattactaccatttccatagccagcgccataaccagaagaaccataagatggtaaaccatttccaacactttgatgctgcaaaaacctattggaatccatacgtccatcataactgctttcattgccaccataaccctggtaaccaccagagccaccaccacccattgatcgtccaccacctccaggattggcatctttaggaagagcacgctttacttcaacttgtttaccgctcaaatcatggaaagtcttgtgcaaaacactgtctaccgcatcttcagagtcgaaggaaacaaatccaaacccacgaggacggttggtagcctggtcatacatgattgcaacatcagtcacagggccataaacttcaaagtactggcgaaactcttcatcagtcaaagtaggtggcaagcctccaacaaagatcttcttggttttattgtaagcatcacctccagaacttctagatgtattaagattcccagttcttccagagacttgctgctcctctcttgacatggctctcttcacatcaacctaaacattaaccaaaatcaataaagctcataataaacttccaagaatcatactttacccaaatcgagaacataacgcaacagaaaatatatacatctgtttttccttatcctaataaaccaaaccaagctctcttttctaatactatactcaatcacttcatagagtgtacgattaacatatatcgagtaccctataatacctcttatacaagttaaaaccaatcctagaatctaagaaacactaaggcgaatttgccaaccaaacaaaattctatatttactctcgttctcaatcaacacagcaaaacgcaaaaaggataaaactttaacacaattagagaaatggagctataagagaacaataataacctctctggtatcaatgctgtgtttctcttgaagaaccctatcgagaacagaaggatccgagaagataacgaacccaaaacccctaggtcgacctgtgagcttgtctctcatcacaatagcctgagaaacctctccatagttggtgaaatgttctctcagcttatcttcatcagtttcccatgaaataccaccgacaaaaagctttccttgatccgaatccatgaatttatattccactatcttacttctgacccagaatcacaaatccacctcaatctacgaaaccgtgaaaaccgactgcagaaacttccagaaattacgaaaaggctttagcttttccaatg

SEQ ID NO: 4247 - DNA, 3000 bp, Unknown
  misc_feature (1)..( 3000): cDNA_ID_1823413_gDNA_ID_1620691_Annot_ID_48618 3000 nt of promoter + ATG
cgtttgccatgttgtagatcatttagacacaggagagtcagctaaatagacaacaaacccgaccaaagaatatttcattcggttcttagcaactattctcctctccactggtaaagaaaaaggggctcacaagataagtaaatcctcaattgcttacaaaattcagttctatagtaaacacttccatacagtttcatgcaacactggaaatgaaaacgctcttattaagtagttcaacaaatgaaagacttaaaggaaccttgtgacagcacccattgaacgaccccataagccaatcagggagacattcccatccgtgcgcaaatactcaaccacagccttcagatcatctttctgcaaccaccaacgtcacgtttaacagtaataaaagaagtgactgctctcacaattcaggattatgacttatgaaggcagcgactgtgagggaaggaaaaatcattgacaacctaatcaaggacactcaaaggcacctaagtctaccatgaaatagagcatcaaaaactctaaatcatttggaaatctttcttcagaaagataacaataccttcatagaccaaatgaagcatcataggtgtattggttatagtgggatagaattccaataaaccacgagacattcaatctaacaaatatcaatcgagaagcagatatattgacttaagacagcttgtttactccaaacaacgataagtttaggccataacagctgaagggaagaagaggaatattttgagaaaagatcaaaggaggacatacttcgttccaacccaaagtgacatgctccccgccagagagaccggatcccgaaaagtcaagcgtgaaaatcgtgatgtttgaaggaagtaatacgatcgcagcttcactggcatcagctctacatccactgaataagaatgaatccattaatgaatagtatactaaaagaaacattaagctattatgataattggaaaactttagtaatgttggcaaccatatcagttgtttcatttcaatgcatggttgtcatagtatcctaccagctattgcatcgattgaaggatgagttaactagtttatttcaccagtacagctcaaatcacgttttattaaaataaaagttacgattacctgttgccatggcagtatattacacaaggtagaggcctatcttcaggacgctcaactggcatgtaatgactacactgaaggatatctcctctgatgtttttaacctgtcacaatataagttcttctatagtcttaggtgaacaaagcacaactaaaaccttgagatcctaaaggcagtccaaggctggaaaataaggaactcacgctgatcaacagtgaacaactgatgaaatctacattgacattgaatcacaacatgtttgcttggattctctagtcaggagttcacaacaacaacagaagaaaaaaagctttacctctaaatctttcctctggtaccatctccctttaagcaagaactcttgttccaagagatcatgttctggattgtattcagctctacatcaaaacaccagttatattcaaccgtagatgaaacaaactaattaaaacaaattggatttgaaagaggaacagggttttcttgaggaaatgcaaccctaaatcctagtatatattacttcatctatataaaaatccaaaatcaactcaagaacaagaaccaaaatttcaaaactcaaatctaaaaatctaaactttgtgtgaaacccaattctacaacctagtaaagagaaatagaaagatgaaactgaaaactaaattccagaatcagtaagtaatttttttcaattttctgagagaatcatcaccttggaggtcgaatgacgaagttaacaagctgctccattagaaaaaaatcaaacaaatcaccttcttcttcttctcattcttccatatttctcacaaatagtcaaaaatcgaataaaacctaaccaacgaaagagattcagatagaacaagaaatgtaactaaaaaaaccctaaatcaaaagatcgagctgttccagaagaaagacagtgagatcgaagaaagaaaaacacagagaaagagaagaaaataaagcaaagtaatagaaaaacggctttttcgttgttgaagcctgaaactgtttttatatttaaaaatatataaacaaactttataaattagccccacatttttgccgctttttacatttaacgtcttcacatttcattatggaaattaattaattggtattgtcatgtataatcattaatcattattactaattccaaagttttttcagtgaaagctgacattgaccaaagtctcttaaaaaatttcgaaaaaaaactcaaaaattcaattaaggttttttagtggagatcgtgcacgttaattgtcgtttataggctattgttttaattattttaaaatatatacgaggtaattaagagattaattaaacttaaacatatgaggttaattattacaagtactaataaagctgtaatgtggagtttggaattttcgacaacaaagtgcacatctggcacagagattgtcacagcacgaaagatttttttgtcgttcttgtaggatttgctggcacgtgtggaatagaaaacacacgagtgaaaccatcgtcggtctttgtagcccattatttatacttctattgggctggacttaagcccataagtaagcatctctgttacaagaaaacgggaaacagatctgaaccgttaataatattagaaaggatctagaccgttgatttatttatctgctgacagattcgtaccttcgcgaatatcaataccaaaccaatagaaatattcgttcgctgtcttcttcctcttcctcctctcaaatcggctacagccattggaaaagctaaagccttttcgtaatttctggaagtttctgcagtcggttttcacggtttcgtagattgaggtggatttgtgattctgggtcagaagtaagatagtggaatataaattc

SEQ ID NO: 4248 - DNA, 684 bp, Unknown
  misc_feature (1)..( 684): cDNA_ID_1823409_gDNA_ID_1620691_Annot_ID_48619 3000 nt of promoter + ATG
gttgtttcatctatctacttttttttgttttgtttggtacctgtcctgcttcaatactgtgatatactttgaatctaccagaaatggtcctggtttttaatttaaataggacttggtcttatggatgtcttttaatttggttaaccaatctttcttcattaggctgcccttgagtattctctataacttgcgacaaagtagacataacactctttaagttctaaaaaccactttctattttcggatctcgaaaaatcatttatcgttttgtgctgcaaatcagtgttatatatgagcttggcaaattaaaatgacatatacgtatagaaatgaattgataatactaaatattatttgttttcttcttttaacttcagccatactaactttcactaaatttcttaagagcatacagaagtttctcctcggtatattggtggttctatattccccgcaacgtgaatggaaaatgaaggttctattttggctatatgataatcatgccattagctgacccgaaactaatgtgttacaataaaaccaaattatataaatagaagaacatgtttcctggctccttattgcacaaaagagaacatgaacaactctttttatattaccatgatagtcctatgtgttttggcctttgtgttagttttaattgagagctgtgcgggcaaaatg

SEQ ID NO: 4249 - DNA, 3000 bp, Unknown
  misc_feature (1)..( 3000): cDNA_ID_4257458_gDNA_ID_1620692_Annot_ID_48620 3000 nt of promoter + ATG
cccaataactgttttgttttctaatttatatttcgaatgactgacaataaaaacgttatcttttatatttcgaatccttgttattttttcttctcagttctcactcacgttgaatcgtaccttcatatccatttaaaaaaactatatatatattttggtttatcctatttatcgttacattgattcaacaatattttcatatgccaataattcttcccatgcaggctatgcagcacaaattttgatattggggaccaaaaataagtaagactattttagtatttgtctctatgcatgatgatgcaatgtaaagttggaaacaaggcattgcgtatattttttaagtaagaatcattcttaatcaccaataacaataatttaactatagataaaaaaagaagttaccatcaaaataattaactaaaagacaaaagaagaagaaaatttttgccgttgaaaaagaaaagaagaagaaaaactaaactttgacaaaccaaaaaaagaaatgaacgaaaggaaaagagaagagaaacagagagtaaaggatcaagatcaaaattgaaaattagaaacttgcttttgttattttcttgtggtccacccaaaaacgtgattaaggtatattctagtttcttaattcagcgggggatcaggatagcattttaaattaaatgaaaatatgataatttatccttaaacagttagtcaggtggttgcttatatgaacacttgatgtgcttgtttatatgtgtgatagtaccatacaatgtcgtaatacaaaagtgcttgagttatcttttaaaaattggtttataaaaataaaataaaaaatttaccatacaacctcgtatgcatgcgcatattgtaatttttatttgaccaaattatttaatgtaaaaaatgagaatattgaaatggaaaatcaacttaaaaggataaccagaaagatgaaagaataattaggaaaggaaagaaaaaacgagatacgaaaaaggtaaaaagcttttatgtatgtactaacaatgtacaagttataatgtatgtatatttgtttagttttatgctaggtgcatcataacttgtatacagagctgttagtataaattccccaccgttttcatttatacaacgtgaagtgttttcatttatacaaaaaagaaaaagaatgaaacttggcctttcaggtctgtgtgctagctaattttccctaattttatgctgagtttctagttattatttcgtaactagagttttcatactatcgaaattcggttaattttgttgtttaaggtttttaattaaggcttcatttgtaaatgtagaacaacaatggatgatctcgaaagaagacttggagatatcaggacttcggtctgcgagagcaatgtgtttctcttaactattggggcggtaacacttccttgcagtttgttaagcttttggaaaatacttaaactctaaaactttgattacaaaataaacaattaaagaaaaattaaaaattaaaaactttctaatgtaaggtgcttgaactttgattacaaaataaaaaactttgttttgattaatcaaataaatgagttggctttgctatccattaaaacaactatgtttgaaaaactcgattacgtgaatttaatgaatggttttgcaggcaaaaatctaattagagctataattaaaaatataatttttttattttttcttttttttttgcttacaaaatgcttataaaattaaaaatattctataaagttttaatataatttttatatactattattatttgtgattatgcaaaaaaaatagaatgcataaatattttatttatatataggacattcctacatggcgttttgtttgtcctatatcttatacatttcatcgtcgtgtttcgcatcacggaagaatatgatatagcaggtgggtttactcaggcgtcatttgttttactctatgaaataaccccttcaaattggctgctggcgcctctaatactaggtgccataattataacatgttacaaggttcttctaattgaaggtgtgtcgcccaatcgtgaacttctgccgacagggtcggggcaactgacgggagaagtggggaaaggttaatgaaagaaaaggagttaactagaatgttgtaatagaaaatacactgatatttactatagcataccgagatacgactttcttgtatatatataaccaaaaatacactacaatgttgtaatagaaaacttatccattctgttatgtatctttgacgttggttaattgattttcacatcaagacgaaatgttatgtttttgactaataaaatctttatcagtagcatgcatcatttgggctttatgatctcgaaatattgtgtaatttaagtcacgtgtttttcaaaatttaagatttacattagtatttgattatagagtagaaaatttttgaaggtaatcaaacttaatatttatggaccaaaattcaaaaaataaattataataataggctaatttccgtcttaaattttataaatgaaacgaaatcagtcatgcaaatatatatgctttggcctttgtaattgttatttatcatctgtcggcaaaataagcggaataatcaaagagctagaattagacgataaatctttttcactgatcaaatcattagcatacgttcgtaaaccttcaaattaaagaaaaattcaccaagccctaaaatttcagtttttttttttgacgaatgtggttggtttagatcgcacgagtcacgagaccaaaactaacgaagatacgttgtcgttttggtttccacaaagtactcacgcgcattcagcagcgcgtgattggcaattcctgaatatcttcagatcacaggccctgataatttctcttctccgacagagagagagagaagcagatcgtatcatcacgagacgaccatcggaataacagagaaagagagaaaaagagagagagagagagagagagagagagagagaggatg

SEQ ID NO: 4250 - DNA, 1727 bp, Unknown
  misc_feature (1)..( 1727): cDNA_ID_1023707_gDNA_ID_1620692_Annot_ID_164840 3000 nt of promoter + ATG
agcagatggatcaagttttctctcatctcgctactgatttccctcgtgctcacttctttagggttcgtcgtctctgttcgaattttatctctttcaattggtttttgactttgattggttttatttatcttcttaggtagaagctgaggaacatcctgagatatctgaggcttattctgttgctcttgtgccgtatttcgtcttcttcaaggtaaactttaggcatattgattctttgtttggttgcaattttttggcttattgacaaagcttgaatctttgtcactgcactgaatccttttcttattgaaggatggcaaaactgtggatacacttgaaggggcagatccatcaagtttagctaataaagttggcaaagttgctggttctattactcctgcaagcttagggttggctgcagggccaacgattcttgaaactgttaagaagaatgcgaaagcttctggacaagaccgagctcagcctgtatctaccgctgatgctctcaagaatcgtttggaaaaactcaccctgttatgttattcatgaatggtactcctgaagagcctcgatttttaatatctattgagtactttctttatagttggaattcttgtggatatatatcaggtagctacttggagcaaacatgttgctaaagttgacctgctactgttgtttgaagaacacgtgctatgtcttgtcgttgaaggaattatgttcatatgggaagaacataagcctactggaaagtttacccctagctctattgttaacccagatacttgagcctccatatcacaaacatctagttaaggtttgtgtagtaagaacaagaaaaacaacacgtgttcccaattcccatataaatgaccattatacttctatcaacccaattaatcacagtccggagactagttgattaaaaaatcagctaatactaatttggtggtttcaataaacatcttaaatactccataattaaactagattaaagtgggaaaaatcgtcatgagtagttgtaaaatcgatttcatttaagagtatagaaattcgtcatgagtggttggttcatgagttctctctcttactcatattagagtaagaaatcaaacacttataatcattcaaaattcaacaactctcatctcaaaaccatatatttaggtaaagttatatgcatacattttgcattttaattttaaaacagattatttggcgcgtaatgataaaattatgtgtataaaaattatttaactaatcgatctaacaaccacatatgagtaaagtagttaacattgtactactacaccaaattatagtgtgttggttagattagatacacaaactcactttctcaaatcaataacattatgaatctatgataaccttaatttaaaaagagtctataatgccatgattttacaatcgtacttttttcttttgggctgaacttttaatcatatattatttgaaagatgtgattattataatattaaagggaattaaaatcatgtaagagaaacccaataaagtagcttgaagaagaaaaagacaagctttattatacacttacccagaaaaacaaaaaacaaaaaactgataatatctctctctctctctctcgttgagtgtgtccatgaaataatactctgccagagacagagagaaagactgtaacggaggatgtggtggcgaagtggccacactgacacactggtttcatg

SEQ ID NO: 4251 - DNA, 3000 bp, Unknown
  misc_feature (1)..( 3000): cDNA_ID_2170085_gDNA_ID_1620692_Annot_ID_164839 3000 nt of promoter + ATG
atgctacttaaggttggccttgtcttctttttttacaaatcttaagtggctggctttcatgtctttcaaaattttgcaactctgaataaactcttaagggtattgtttggtaaatttggaagaagatataataatctctgctctttttcaatggctgtgacgtttgccctaaatttttaataattgattatgctttgtagttaaagatggctctgttacagcagcagcagcaaaatcaacagcagggtggtgggaatccaccacagccacagccgcagccacaaccacttaatcagcttgcccttacaaatccgcaaccacagagttcaaatcacagtattcatcaacaagagaaattgggaggtggtggtagtattacgatggatggtagcatttcaaattcttttcgaggaaacgaacaggtctgtttataaattcctgtttcttttcctagttcatgtttcaatgatctgttgcatacgtttttagtttctggtgagtctgaggttggttcctaaacttgttttgcattttactgaaggtattgaagaatcagagtgggaggaaaagaaagcaaccggtttcgtcttctggaccagctaatagttcaggaacagctaacactgcgggaccatcaccaagctcagcaccttctacaccttcaactcatactcctggagatgtgatctctatgcctaatctgccgcacagtggtggttcctccaaatcaatgatgatgtttggcactgaaggaactgggactcttacatctccatcaaatcagttggtgggtttccttaaactgttgatgggaatgaataatggtttctgtaatcaatatgaattagtagcgttaattattggctattttgcaggctgatatggatcgatttgtggaagatggatcacttgacgacaatgttgagtcttttttatcccaggaggatggtgatcaacgggacgctgttacacggtgtatggatgttagtaaaggtgtgtgttttagtctcacttaacattattcgacaataacacggtgaacttttcttcagtaatccaacagtatttctcaatcactacaatgatggctctgcactaggttttacgtttactgaagtgaattcagtacgtgcgagcacaaccaaagttacctgttgccacttctcatcggatggaaaaatgcttgctagtgctggacatgacaaaaaggtaagccagaaatcatcattaggtgttctagcgttctgaaacttagagagcctcttggtttggttcattttgcaggctgtactatggtacacagacactatgaagccaaagacgaccctagaggagcacacagctatgataacagatatccgttttagtcctagccagcttcgccttgcgacttcttcgtttgacaagactgtcagggtttgggatgctgataatgtaaagtgaaagttgatccatacactatgttgttttatctctgcatgaatataattttttccgacattgtgattgcttaagagtttgtgaatctactttgcagaaaggttattcccttcgtactttcatgggacattcttctatggttacatcacttgacttccatcccatcaaggatgatcttatatgttcctgtgacaatgataacgaaataaggtactggagtatcaacaatggaagttgcacaagagtgtacaaggtagatttttttctcttgaaagccaatagttcaacattatttacgtgcttaatttagcaattagatacatataatttcacttttgtctttccacagggtggttccacccagataaggttccaaccacgtgttggaaagtatcttgcggcttcatcagcaaatcttgtcaatgtactagatgtagaaacacaagctattcgacactctttacaggtttagtgttcaaacttttcaaacacgatgtttctgatagatacttattttgtaatatgtaccagcaaaagagagcaactaaaaaaatagcaaaagagagcaactaaaaaaacggttgactaattcgtttgtgtaggggcatgctaatccgataaactcggtttgctgggatccctctggtgacttcctggcatctgttagtgaagatatggtaaaagtatggacgctggggacaggtagtgaaggagaatgtgttcatgagctaagctgcaacgggaacaaattccagtcatgtgttttccatccggcttacccctcgctgctcgtaattggttgctaccaggtaaagttgaaatcattacaatatctgtttaaaaaagtttgtgaagaaagtaatgcaaaaatcccaaatttactcctaaacttgtgtgtgtatgcatgcagtctttagaactatggaacatgtcagagaacaagacgatgacattaccagctcacgaagggctaattacatctttggctgtttcaactgcaactggattggttgcatcagctagtcatgataagctagtgaaactgtggaagtgaaaactatgagagaggaaaagagacgtttgttgtttaggtattattagtaatcatggttttttttttaacttgtagtgttctctctcggccattatctcgatctcaagatagttttccagatgttgaacaaatgttgttgtatgatctgacgaaattgggatcttgagaaattgtgaacaactcttgttgtaatctttactagtccttttggctcagctttaatttactggcactcttcttcacttagtttgggttggtttggtattttatgtttgaacgtttcaataactctttagcttttcgaaacgcttgaaaattgaaatgtgagagccaatccaataatacagttgcatcttatttcaaaactacaaaagtataaaactaaacgcaaacgtgatagttgaaaacgcaaacgtgaaagttgtaaacgcaaacgtgatcctaaacgcaatgtcgaagtgaaagtcgtgatggctccgtcgtatctgaaatcgtggtaattggtg

SEQ ID NO: 4252 - DNA, 3000 bp, Unknown; identical to SEQ ID NO: 4249
  misc_feature (1)..( 3000): cDNA_ID_4257458_gDNA_ID_1620692_Annot_ID_164833 3000 nt of promoter + ATG

SEQ ID NO: 4253 - DNA, 3000 bp, Unknown
  misc_feature (1)..( 3000): cDNA_ID_2106659_gDNA_ID_1620692_Annot_ID_164832 3000 nt of promoter + ATG
gaattagacgataaatctttttcactgatcaaatcattagcatacgttcgtaaaccttcaaattaaagaaaaattcaccaagccctaaaatttcagtttttttttttgacgaatgtggttggtttagatcgcacgagtcacgagaccaaaactaacgaagatacgttgtcgttttggtttccacaaagtactcacgcgcattcagcagcgcgtgattggcaattcctgaatatcttcagatcacaggccctgataatttctcttctccgacagagagagagagaagcagatcgtatcatcacgagacgaccatcggaataacagagaaagagagaaaaagagagagagagagagagagagagagagagagaggatgtctggtgtggttgctcttggtcatgcgagctcgtggggcgcagcgctggtaaggatctcgccgtatactttctccgcaatcggaatcgccatctcgatcggtgtctcagtcctcggtgccgcctggtaaatcgaatcttattcttcttcgtccccgcagattaaagcattgacctttttcatcatctttttttggtttgtcttattcaggggaatttacattacgggaagtagtttgatcggtgcggctatagaagctcctcgtattacttcgaagaatctcatcaggttcgttaaaagtttcaagcttttttaattctagttttgttcctttggttgatcaattagtggctttaaggaactgtgtagattccatgtcttgttctgaatagcaatgagaattcatcgctgagtagcttgattcatttggatatttcaatgccacatctctgcaagagtagattgtcacattatgatacaagttgttgacctgggattcaggaggtagaaatttagaattctcaaggactcatctggttggtagggctagtaactttggatcgtgaaggctctggctttgcggattcaagcactggatgtaatgataatgaagtgtcttttgtctttccacgtatttcagcagaaacatatatctaccatcgagatagctaaatgttaaattaggggatatagatttaaagtttgtgtttacgttatttgtggtgccttcctattccgctccttcattcttgggccggagtcacttaagtaaacactcaacacagtcattgctattatatcccatgggtctacggggtagatttaaggaatgcttaacagggagtagctgtgtatgcaatttgatttgttgttacagagctacaggcttggagttagatgctctgcaacatcagtgtcaacagtgtcattaccacacaccatttcttaaccatattgagtagagcatttggctgtaaaggcactagtacttaggaatgcttaagtaggaaacagttgtgtttgcattctacattttctactttgttaacacttaacagagctttaggctcaagattagatgcaaaaagtatacaatgacgaagcatttcttgttcttttaaactgtcccagtgtcatcttttgcgaagctgttgctatatatggagttattgttgcaatcatactgcaaacaaagttggagagtgtcccatcttcaaagatgtatgatgctgagtctcttagagctggatatgcaatctttgcatctggaattatagttggattcgccaaccttgtatgcgggtctgtatctacccttttctccttccttacagttttggtttttggattccattgtcagatatgcaaccgaggtccacatttctcttgcaggttatgtgtaggaatcattggaagcagttgtgcattgtccgatgctcagaactccacactttttgtaaagattcttgtgatcgagatattcgggagtgctctcgggttgtttggagttattgtgggaattattatgtctgcacaagcgacatggccaacgaaatagatatatatatatccggtctgtatatgttgtggtctacttgcaaatctggaaaaacatggcttcttgattatcttcattgttatatcgttccaatgtctagacgaaaatcttgtgtgaaaactgagaaccacttttggatccccaattttttgtatttgtttaaaacttttgaataagtccttttggagaacatcttcatgtttgtattctcttataatcaaagacaaagagtttgtatatgatttgttaaaactgaactagtcattttatcaagtctgtttcctctatatactgtagttatgttttatcttttttttttctttctcaagttatgatttatctcaagcaattatgttgttgatacaaatggtcttgcctctttggccacaccctgtgtagtgctgtacccaacaaaaccaatgaaagaattcgatctatacaaattgcataccaagcagaaccgttttgtcctaaaccaatcatcacactagacgacgtcgtttcacgtgtgatatttaggtggctgtcccgttcctggaacccggagctttttttgttgtgatatatcccgtaaaaccctaaacatagtcacttcatcgtctcctccactgtatcattcaatctctgtcttccttctttttagcgacctcgtctccaaagctcacaaattttctacctttccggtgagtgttactctgttctcgtttcctcgcttgtctctttctgggtttttagtttccgaaagattttcctttcaaaatccgtttttgaatgcgaattccctctgctgtatctattatatttagtaatttgatgtattgtttggttggtatgagctgataaagttcaacacgtttgttgttcacttttgggaaaatttgcgataaaacaaggatttttttacaattttgacatatatatatatatatatatatatatatatatatatatatatttgagacgagaatatttgttcagatatctactgagtaaaattagtggtctctctgtttattgcgttcatgtgacatttggaatttttgagtctaggagtagagagaaagatg

SEQ ID NO: 4254 - DNA, 3000 bp, Unknown
  misc_feature (1)..( 3000): cDNA_ID_1823536_gDNA_ID_1620692_Annot_ID_48622 3000 nt of promoter + ATG
ctctcagattgctatgcccactttttcttcccttcttagtatcttccaccatttataatggccaacaatactagctcctatttcatttcgaaatttttgaacttttgaatcatcattcaattttgactataatttatgcaaatttattgcaaccactaaaattgttagaaaactcaacacccagtgctagtataaagagattatatatacaagggtttatatttctcttaataactagatattaattaactaatccattctaaattttgtgttaattgcactagctagtaaaacttaagctagcttaaaactcaacctcacgcttgacttgctgctgtgtacttcatagctgacatatagccttagcacttgtggtcggatagctaaaatgttatattaggtttttaccttaagaatatgtaaaattgtattgaaatatttttataacaaattgtagtgaaaaaaaacaacaacaaatttgatggtcgtaaagatatgacctcaattctagaacaaaaataaactaagtggctaaaaagaaaacaaaaatgaatggtcttattctgttgttaatcctctaaatctctaaaacaattaggtctgccaaaaaaaaaaaaaaaaaaaaaaaaaaaacaattaggtctgccattttgataatcctctaaataaatgtgggctcaattcctaccaaaacatgaaataattatgggcttaattgtccgtatggcccagttaccttataacttcccccccccctccccatggcccagttacctttcttattcagctatttcagagtcttttttaaaaaaaataaaaataaattaatttgagtctttgcgctgacttttgcttcctcgtgattttttttttttttttttcctcatgattctttctcttgcgcaaattcttcctccattgttacaggatcaaatttggatgacaattttaaaatcgttgcacataaacgtctcatttccatttatgtttaccatttttctttttttttaaatcaacagataagaattgtagtatgggtactggtagtggtgtgaggtctacgcatatacttgaattgtctcaagtctcaacaataaagagctctggaaccgacattttggtaatgtcagcaacattacatccaatcatattgttatattcatataaatagtattctcagcaacacctatgaaatgtacaactacaaactgattcaagaatactcaataatataacgactgtattcaatattccaaatataattcagcttgtatattaacattttaataaaaaaaaattggacgccactacaaaaataataatcatctttatcactacaatttgttagagactttcttgcgtatcaaattagatatacgaaaattttcaaggcaaacatgtaaggtagggtaatcacaaattattttcctacacaatgaatctagtgaatatatattataaagatgagggttttgttacatgctcaaagatcttggcgaccgcaaattgagaatttcttgttccaggtctggcagctttctgtgtgtttgtagcctagtaggggtcagctcttagaatcgtagttgtgatgaaaacagaattgtcgtagttgtcatgaaaacagaattgactaattaaaaactcttgatagtttcaaattcttttagaaccaacctccaaaaatcatgccgttcgttgattcatttcgttaccgaatttgattttatgcaaggccttggtcttatggacctgagatttaatgttgggcctcacatcaaacgacttttcaagatggattagtaaaaacagaagcacatattttttgctttaagaacttaaattactctgtttttgtatggatctttagaaaacctcaattgttttccaaaagtagcctaaaaagactttaagctcacgaacttaagtcacatggatttttgtaaataattaaacgatttaataaaactaatgaaatgataggaaaatgaccgatatacacaattgatttaaacaattgaattcgagtagttatgattttgataaaatgaaaaaggactgtttgttccctctatgatcctaaaaatgtcataaaaatgaaaaaggaaatatgaatttgataagatttacagcgaacaagacaaattggaaaaaaaggaaagaatgaatatacagatacgttaaaatgaaaaagatatttacgtcaatctattgattattaaaaggttaattttgtcattaaaagcaaaagtgctttgccaaaggcgtgctacgtcacgtaaattatacaacactatgagggctttttggtaattttacaggaataaagctaacctcataatatatcttctgcaattccgtccacccaaaacaactgacatggaaactactttttaagtttgatacaataaaataaatatacttatccggtcaacatttttattctgatgaagtaaaaatattactaaaataacgaaaaacacgttttctccaaatgaaaaaaacgaaatttacactgaaatgtttttttttgtaaaaaaaagatgtacttattcttttagtacattaataaattagaataaaaattttaattgattaaatcgctagttgctattaatcagaagagctgagctacttctaatgcttttttacagagagatgctttcttcttctttctctcgaactttctctctctaaatattttgtttcgttttctctctctctctctatttactttcgttctctctattttttttgtttggtttagcttatttgtgaagtgttaaatcttcttcagtttctggggaaattaggtggggaggtgaaaaagggggaaatataattgaaattgggttctctctgctgtgcaataataatttctgagaggattgtgaagaagcgcttttatgtaagaagatatctcattattagttatttacatgagaatctgacattcttaacaactgtctgtggggttagttttgtccaaagaactatacagag

SEQ ID NO: 4255 - DNA, 3000 bp, Unknown
  misc_feature (1)..( 3000): cDNA_ID_1823565_gDNA_ID_1620693_Annot_ID_48625 3000 nt of promoter + ATG
acagaccctctaccagagcaggaacatgagtatcccgcaccagctgcttctgacaaggtcatagattttaacttgtatcaagattttcttgtttagagtcacatgttttagttacctaacagtatggttctgtatacaggcggcattgtcaaagcggagattgtctttgatctttatatgtattccggtcagtccaggtcgtagtaggctgatatggacgttcccgaggaattttggtgtatttattgataagattgtccctagatgggtgtttcacattggtcaaaatacgattctagactcagatttgcacctccttcatgtagaggtaattccaaatctatctagtacacacattgttctgagtagaggctgatcaatgtaccagactgatttgtatcttgtaatggaatgtgtgtaggagcggaagatactggagagaggccctgaaaactggcaaaaagcttgctttatcccaacaaaatcagacgctaatgtggttacattcaggagatggtttaacaagtacagcgaggctcgagtcgattggagaggaaagtttgatccatttcttcttcctcctacgcctccccgagaacagctcttcgacaggttatttatctcgcttgtgaggtttaatgaaaagtagtgctaaacatcctaatgataaaagttgcgtgttccaggtattggtcgcatgttgagaactgcagcagctgcaagaaagctcacaaatatctcaatgcgctagaggtgatcttacaaatcgcatccgttgctatgatcggagtcatggcggtgttgaagcaaacgacaatgtcgaatgtggctagaattgcagtgcttgtggcggctgttttaagttttgcagcttcaaagtggctatcacacttcatctacaagacattccattaccatgactacaaccatgctgttgtttgaaatgtatattggtgtttgtacttcgtatatatactcatcggatgtattcagtccacatggtgttgtacataacagttatacagaaactaattcttgaatctataccgtttactaacattctagatgattcatttactgaagaaatggcctcatgagcattttctgagtctattttatcctcccgaacaaatttatcggtttaaatgatctgctcggtaagatatttgttttatgataatgtttttgtttttgtcaatagtatcatcatcatctaacaacgatgtgtatcttatgatacaaaatcgaaatgggcctggccgtaactggtgaactgactgggcttggtcgacatgaagtctttttttttttttttttgacatgcacaaataataatagtcaatggaaaatgtcatcatcatctgtttgggttaaagacaaaggttttaaatgatgaagcagagtcaataaatacaaaaggatgaagacataaataagaatgctggaccactggactatgaagtttccgtagaaacgcaattataaaaagatcttctctatgactcttctacctatattcatttcatttgcatacgtaacctaattcgcatcttttttgccttctagaagccttgtaaaaaacagtatacggaatcacctatttttggaaacgacagcattccattttggtacctaatttccatttttatccgagcttatagttggattaagcaattttcctaacttacatattcattttaatgacttccagctatcttaggaagtttgattttcttgaccacttgagttcaaaatgtagagttttgtttgagccttcgacttttgtttttgagtatgagaaagtttgcttcttatttttccggaatctcttttcaatatagtagtaataattaagggatagatgtcaaaatggagggttaataagcctattgcatatattctctgttgtttaagacttttaaattaattaccaagtgaccaaactaaatacattgaccaaaatgcaatttgcttttttcgtataattatgttatacagtattataaaatatcacatttttagataaaaaatatattttcatcaaaaaaaaaaagctgaaaatatcattataaaagtagtattattgcacatgaaatttaataccgggaaaacatgtaaacaaaaattggtcataaatgtaagatataatatcagtcactagaaaagtattggatcccataacgtaataacaattttcatgtgattttctttctatcagtcactgaaaagtattggatcccataacgtaataaaaaaattcatgtgattttctctctaccaaacattattttttgggggtaaaatctctaccagaccttcacaaccgtaccctaataaatacgtgtatcttttgactgaaaagggaaagcatctaagaaagacaccacgtcgtcatatcaggaagactttctcttttaagtttatttggatgcttcggatagtctttcattcttatggattgttgatatagcaacgtggttcctcatgaaccaccgattagccctcacctacgttatctactccgaagacaaaacgtacataaattaatacaagcaaaatagacacaaccattaatgatatttcgttagttacataattagaggtaatcgggtgcgttacgttacgaattaaatctgcaatcttataagacataaacaaaaccaacacattagatttcttgtccagaaattgagacatgtatatacttgtggatctagtgcatggattggtggaaagtcatcgtcaaataatatttaaggatttttcattgaagaattattagagtccacgagtatatattttaattatcattagcttccacgaggatttttttcttttattttaaagaaagagaaaatgcatgattcatgattcaacggtttgttatataaaccaaccattaagtccgcaacaaaccttgactcagagaggcagagagagagagagagagagatatagaagagaagtgagtggcgtttggttaatcattttcagaagatg

SEQ ID NO: 4256 - DNA, 3000 bp, Unknown
  misc_feature (1)..( 3000): cDNA_ID_1823561_gDNA_ID_1620693_Annot_ID_48626 3000 nt of promoter + ATG
tcttcagttgtctcctgttgtttctttctgggattgtattgtccgcaccatgaggtattcctatataccagagtgggtgtagttcttgagttcctctacaacatcatcgagtttagtgcagttttttagttagaaatttatagtcaagcaataatggatcacacggtgtgcaagcaagttcagccagtcgttaggaaagcgaagaagaagcatggtaaagatgaatttgatcgtatcaaacaagctgagaagaaaaagagacgtttggagaaagctcttgctacttctgcagccatccgggctgagcttgaaaagaagaagcagaagagattggaagaacaacaaaggttagatgaagaaggagctgcaattgcagaagctgttgctctgcacgtcctactgggcgaagattctgatgattcatctcgagtcaagtttggtgaagaaaagggtttcacaatggatctgtttagagatgaaagaactaactacgttcctcgccaaagctgtgctagctatgcggttcaagggattgggtttgtgtcaaatggctatggactaggagatagtaactggtcgccattcacgaggaggggtgcttgggataacaacatgggaatatcagctgatttgattgctgctcaggctgtctcggcgctacagatatctgaaaatgctgatgggaacgcctttgtgttcaatgggatgttccggggatgacagatgccacgactcgtcctcattcggtttttaaaataaacatttgccttctgcttgctttggtgtcaatgctctgtttttttctcttgacgttagaccttatactctgttttcgttcgctgtaatattaaagacgcattttgagttgtatctattatacatgttgaagtctcttcatactgcattgttgcttatcttatatcacattcttttaacaaaccctctaataggtgtgcaatgcatatgctaagacttgcttggtctttgccagtaacgtgttgaaaatatcttcttaacaaaatcacacgttctgctgtgaaaaggggaaaaaaaaagagaggtgtgttcgaatcgtgatacaaagtaatggatacaaacgaataaattttggataggtggatatacagtaagtgaatacattggggtggatcagtacagttgctactgaaatagtagaacatcagagtcacggttctgctttttctgattggtgattgtatgatttgtatcttcctctttgttccctatctctgtacttgtggagggtttggcagtgttaagtatacctttcaaccaactaccttgcaatctaaagctcccattgtctgaattgttgagagttcctggccgctgtggagagccactggagccatttgaaccattggttatgtttgaggtaacattcgaaaggaagcgataagccactttactggctgaaacaagttcagttttggcttgctttacctgcaaaagtcacagttcacaaggacttaacatccacatgcattcaggtgtaaaaaaagaaacagcgtgggcagagcaaaatgagagagaacccacccgcattgctgtgtttcctgctacttccaaggctgtgtcgccagcatgagcaaaacgattcacccaacctgttaagagacagaacccaagccgtcacataacataaacacacacacaaaccctgattcccacaataatggttttacctgggatctttggcacaccaaggcggtcacataatacatcgcagaagtgattgcaatttttggacagcaaatcataagtgtgtcctggccattccctgctgagctcacgcaagatctgatttaccatgaagattgtacaatctgtcttcccaagaacaattttctcacgatatgtgtacattggattcttgccactaggacagctgaacacaccagttccttgttcacaatacccataagaccattcatcgtttccatatacctgcacaaagttcatacaagattctattcaatcactcttccctgcgaatcaatagcaacatgtaaacctaaagttcatcgcacccataatcccataacacgtttctaaaattacttgaagaaccgagtattgagatcctcagtacagacgaaaagggagcttaagctcaagatcttacagagacctttacgaccatatgccattagattagagcctcacagataaaaccaaaaatatcattccttcaaattcttcatttccacatacagacacacaaacaacaactcaaaagagagacatcatcgatacatgtgcagatgtagattgatagactaaagacgaagaagatcgaggcagtggagtagtagtacctgaatagcgctgtggaatataccgccaagaccgatcccgtctttgaagaacctattgatctgaactatggtgttgttagtcttctctgatccactgttcgtcacatcgtatatgtgcagaacaacctccgccattgattctatctttaccaagaaacacgaaccctaatttactacgaaattgagctcgcagattctctctatagtagcttcagagaagaaggaaacctatagaatcgtaccaaatccacttttcttcaacaaatccaaattctctaatctactagatctctaagaaaccactgcacgaaactcttgtttttagattttgatctaaagctgaggtattttgagtttgtttatcttctcccaaacttttcaatctcagacgtgggagattgaagaaactgatgctgtggtgtctggaaaggacccttataccctcactttgccgacgccggtttcacactcaaccgacactttctctttcaattaaccggtttagttttcattaaaccagaaaaatgattatcaattggtttaaatacatcctgagatattttaatttgaaccgttggattataaatttgtcaaaagagattggtaaagaagactttcatttgcttcgtctctccggttgttaccaccacacaacgccatg

SEQ ID NO: 4257 - DNA, 3000 bp, Unknown
  misc_feature (1)..( 3000): cDNA_ID_2999608_gDNA_ID_1620693_Annot_ID_48627 3000 nt of promoter + ATG
caagcccagtcagttcaccagttacggccaggcccatttcgattttgtatcataagatacacatcgttgttagatgatgatgatactattgacaaaaacaaaaacattatcataaaacaaatatcttaccgagcagatcatttaaaccgataaatttgttcgggaggataaaatagactcagaaaatgctcatgaggccatttcttcagtaaatgaatcatctagaatgttagtaaacggtatagattcaagaattagtttctgtataactgttatgtacaacaccatgtggactgaatacatccgatgagtatatatacgaagtacaaacaccaatatacatttcaaacaacagcatggttgtagtcatggtaatggaatgtcttgtagatgaagtgtgatagccactttgaagctgcaaaacttaaaacagccgccacaagcactgcaattctagccacattcgacattgtcgtttgcttcaacaccgccatgactccgatcatagcaacggatgcgatttgtaagatcacctctagcgcattgagatatttgtgagctttcttgcagctgctgcagttctcaacatgcgaccaatacctggaacacgcaacttttatcattaggatgtttagcactacttttcattaaacctcacaagcgagataaataacctgtcgaagagctgttctcggggaggcgtaggaggaagaagaaatggatcaaactttcctctccaatcgactcgagcctcgctgtacttgttaaaccatctcctgaatgtaaccacattagcgtctgattttgttgggataaagcaagctttttgccagttttcagggcctctctccagtatcttccgctcctacacacattccattacaagatacaaatcagtctggtacattgatcagcctctactcagaacaatgtgtgtactagatagatttggaattacctctacatgaaggaggtgcaaatctgagtctagaatcgtattttgaccaatgtgaaacacccatctagggacaatcttatcaataaatacaccaaaattcctcgggaacgtccatatcagcctactacgacctggactgaccggaatacatataaagatcaaagacaatctccgctttgacaatgccgcctgtatacagaaccatactgttaggtaactaaaacatgtgactctaaacaagaaaatcttgatacaagttaaaatctatgaccttgtcagaagcagctggtgcgggatactcatgttcctgctctggtagagggtctgtggaagagcgatacacacatggtgcaataaaattagaataaccccattcttgttttgaaaagaaccctttgttgtctagttttttaacgttgatttcgagtggtttccccccttctctgtcaatcttctctgcaagaagaatctgaaggttggtaaaaggattaaaacaactatttgaaatacaaattatgtatttgccttttggtttaggaaaccgcatcagtccataatgtgcataaggaacatgagccgggtccatgaggttttccaccaagacatcgtacctgaaagatttcagatttacacaaaaacatcaacggagaattaccacacatagttgaaatgatgtaaaagccaatagatacccgtaaggaatatcacgattccccatcaacttagtgaatgatgggtcttctaactctggaatgtaaggaggcttgttggtttcaataatgtttttgtactttggatcactgtttggccaaaaccaaatgatctcatgctgcacagtactcgggtaaacagctacacaagcttgcttgaaagtgtggacctgatttgcattaccaaaataatcattgatacaaccaaagactttgactttatgttccatataaaccatatgctaaaccaatctaaaacaaacaaatcatcatcaatagctataaaaatttaccggaggaccatcaggaggagcttgaggaatgagtttacagtcaccggaaccattaaagcaccatccatgataaacacattgcaacctcccccattgatcaatccttccatcagacaaaggagcaagacgatgaggacacgtgtcatccatcactttccattgcttctcgttcctatcccaccaaacaaccaaatcaatccccataactttcttcccatgaggaaccttcttgtcaagatcgcaaattggcatcactgggtaccaattagcgtaccaatcgaacttatccgacccgggttcgaatagggcttcaggttccggtggagaattcgttgacgtagcggctgatgatgatggtggtgatgatactgcggttgtgaatcgacttgatttgcgggtgataagggaattaggagaaatgggtaggcttggattggagaaggaacatctgaaacgaggtttcgtattgagaattcggagcgatggaagagcgcatgcagcaagagcagcttccatggcgttgtgtggtggtaacaaccggagagacgaagcaaatgaaagtcttctttaccaatctcttttgacaaatttataatccaacggttcaaattaaaatatctcaggatgtatttaaaccaattgataatcatttttctggtttaatgaaaactaaaccggttaattgaaagagaaagtgtcggttgagtgtgaaaccggcgtcggcaaagtgagggtataagggtcctttccagacaccacagcatcagtttcttcaatctcccacgtctgagattgaaaagtttgggagaagataaacaaactcaaaatacctcagctttagatcaaaatctaaaaacaagagtttcgtgcagtggtttcttagagatctagtagattagagaatttggatttgttgaagaaaagtggatttggtacgattctataggtttccttcttctctgaagctactatagagagaatctgcgagctcaatttcgtagtaaattagggttcgtgtttcttggtaaagatagaatca

SEQ ID NO: 4258 - DNA, 3000 bp, Unknown
  misc_feature (1)..( 3000): cDNA_ID_1823557_gDNA_ID_1620693_Annot_ID_48628 3000 nt of promoter + ATG
tcgggcagctgaatacaccagttcctagttcacaatacccgtaagaccattcatcgtttccatatacctgcacaaaggtcataaaatattctattcaatcactcttccctgcgaatcaatagtcatctacaagacacaaaaaaataacaaaaccatgaacaagaataatcaaatgatattgcatagatatacagacctaagaacatagaatgattagcactaacttgaaaacctaaattctggtagttttgttggaatacaccaaattgtcacgactcaaatgggaaagtggtatatgcaattatatttgcccaggtcaaagatcacagaagtaaacgtaagccatcattggatttaacaagtctccagagagcacttggtcaatatatcgcaatcattatcatatggaaagttaccaaaagtactaggaaacacaagatcctgagcaaaagagagacttcagctccagacctttaggaccataaaccattaaactaaagcctcacatatcaaaagaaaagtatcatgccgtcaacttcttaatttccacatacatacacagaaacaaaaaccaaatctacataaagtagaccaaaaccaagcttagacatcatcgataattgtacataaatgtagattcatagaatatagacgaagagtagtacctgaatagcgctgtggaatataccgccaagaccgatcccgtctttgaagaacctattgatctgaacaatggtgttgttagtcttctccgatccactgttcgtcacatcgtatatatgcagaacaacctccgtcattgattctatatttaccaagcaacacgaaccctaatttcctaccaaaaagagctcgcagattctctctatatagagcttttggtgaagaaggaaacctaaagactcgtaccaaatccacttctccgtttaacgaatccaacaactactagatctccccgaaaagaaatctaaaggcacaagattagacttatctttcttcttccgatttctcaatttcagacgtaggagatgaagaagaaactggtgcggcggtggtggtggtggtggggatccactgaaatgacaattttaccctcgcttttcctgcggaattgctactttacgtgtcccttgttaattccttttgtttacaacttaagcacgcgtttagattatgaatttatggtaacaaattatattagtatgaacgttgttcgcagttgattaaacgggtcaactactgaaccttttttctttcatttaactaacatttctttagctagacaagtgtccttaccaaaacaaatcaaaaatactagtaaagcatctctataacaaaataatgacttaagtaatctgacacaaccaaggaagatgattcatgactattaaaaaatggggtaaacaaaaaaaaaagagggtaatcaattgaccgattcttccgataattttcgaaaatgcaaaacggacacaagtctggttttcgttagccatctgattcgtctcgaattagtccatccattcatacaccaaatttataattttgcttctatgtaaaaaagtcaatcataaaaacttaatgacttcttttttatggtacatacatattgggccaattgggcctaggcccagtacaacagatgggattcaggaaataaattaggaccaaagaaattcgaccaagttttttgttatatcaaaagtgtattcaaagtctcattttggtggatgaatcttgaatgggatgctcaaagcacaaacaaagcttagtcaagttgataaactttgaatgcaaattaagctcttatattttattgtaatgtaaggtaacatgacacttgtacatattcgtgaaaggctcaaattttctttcttacatgataaatattgcaaagttggaaccggaagtcgacaaaaaaaaaagttggaaccggaaacatctcaaaacagttatcgggggatctaacggctgctaatagccctcattaggacccacaaaatactgggagtagacgaagtcgcaccggccaagtctccaaagtcccaattgaaaacttacacttgaaaaaaaagtcagacatcattcgacacgtgtccccatttcattagaagtcgcgctgcgtttctttctctgtactagttataattccttctattatcctctctctctcgtcttcttcgtctgctcttcttttttatctctcgaaattcctctctctttctctctgcatcaaaacagcaactttacttctgcgtttttgtttatctctctgtattatccgattaatttaaaggagttctttgaaggcagctgcttctatgccatattgccgaggtttggatctaaatttcatcatcatctttgtttctccgtttatcttcaatttccctttatcttttcaatataattgacttatttcgttaaaagtctttttgattagcttcctcggatcttatgcttattcatggatcttagacctacataatggattaaatccgattgtttctcttattgttcttgttgaattgaggttaattttgatctgaaaattagtttctgcggcagatctggtgtctgtatttgtgtaatttgtatccattagtcttaattgagttattagctgaggattaagagagatcctgaaatttgccgtggaattaactctttctgtggatggatggataccctttgtattcttcaactttgctcctactctgggaaattagggtttgagtaatcattaggttttactctttggctgttgttgactatcttcaatctaattggtggctgattttgtttgacttctttaggacttttggtgtctttcgaggtcattagaacaattgtgtctgcttggttggtggtctatctacaactgttagcttttacaagtttgaatgctattgttttggctttcagattttgatgttatggatttctgtgttactactcctctgcaacttgaaactaatcaagtaattgtcaatgcagaaaatg

SEQ ID NO: 4259 - DNA, 3000 bp, Unknown
  misc_feature (1)..( 3000): cDNA_ID_1382080_gDNA_ID_1620693_Annot_ID_48629 3000 nt of promoter + ATG
catctgtcatccccggaacatcccattgaacacaaaggcgttcccatcagcattttcagatatctgtagcgccgagacagcctgagcagcaatcaaatcagctgatattcccatgttgttatcccaagcacccctcctcgtgaatggcgaccagttactatctcctagtccatagccatttgacacaaacccaatcccttgaaccgcatagctagcacagctttggcgaggaacgtagttagttctttcatctctaaacagatccattgtgaaacccttttcttcaccaaacttgactcgagatgaatcatcagaatcttcgcccagtaggacgtgcagagcaacagcttctgcaattgcagctccttcttcatctaacctttgttgttcttccaatctcttctgcttcttcttttcaagctcagcccggatggctgcagaagtagcaagagctttctccaaacgtctctttttcttctcagcttgtttgatacgatcaaattcatctttaccatgcttcttcttcgctttcctaacgactggctgaacttgcttgcacaccgtgtgatccattattgcttgactataaatttctaactaaaaaactgcactaaactcgatgatgttgtagaggaactcaagaactacacccactctggtatataggaatacctcatggtgcggacaatacaatcccagaaagaaacaacaggagacaactgaagagagaggttataagaattcgcagacttattcttcgaaatcattcgtccaacattcccgcaccccttagactcgcccattttctgcattgacaattacttgattagtttcaagttgcagaggagtagtaacacagaaatccataacatcaaaatctgaaagccaaaacaatagcattcaaacttgtaaaagctaacagttgtagatagaccaccaaccaagcagacacaattgttctaatgacctcgaaagacaccaaaagtcctaaagaagtcaaacaaaatcagccaccaattagattgaagatagtcaacaacagccaaagagtaaaacctaatgattactcaaaccctaatttcccagagtaggagcaaagttgaagaatacaaagggtatccatccatccacagaaagagttaattccacggcaaatttcaggatctctcttaatcctcagctaataactcaattaagactaatggatacaaattacacaaatacagacaccagatctgccgcagaaactaattttcagatcaaaattaacctcaattcaacaagaacaataagagaaacaatcggatttaatccattatgtaggtctaagatccatgaataagcataagatccgaggaagctaatcaaaaagacttttaacgaaataagtcaattatattgaaaagataaagggaaattgaagataaacggagaaacaaagatgatgatgaaatttagatccaaacctcggcaatatggcatagaagcagctgccttcaaagaactcctttaaattaatcggataatacagagagataaacaaaaacgcagaagtaaagttgctgttttgatgcagagagaaagagagaggaatttcgagagataaaaaagaagagcagacgaagaagacgagagagagaggataatagaaggaattataactagtacagagaaagaaacgcagcgcgacttctaatgaaatggggacacgtgtcgaatgatgtctgacttttttttcaagtgtaagttttcaattgggactttggagacttggccggtgcgacttcgtctactcccagtattttgtgggtcctaatgagggctattagcagccgttagatcccccgataactgttttgagatgtttccggttccaacttttttttttgtcgacttccggttccaactttgcaatatttatcatgtaagaaagaaaatttgagcctttcacgaatatgtacaagtgtcatgttaccttacattacaataaaatataagagcttaatttgcattcaaagtttatcaacttgactaagctttgtttgtgctttgagcatcccattcaagattcatccaccaaaatgagactttgaatacacttttgatataacaaaaaacttggtcgaatttctttggtcctaatttatttcctgaatcccatctgttgtactgggcctaggcccaattggcccaatatgtatgtaccataaaaaagaagtcattaagtttttatgattgacttttttacatagaagcaaaattataaatttggtgtatgaatggatggactaattcgagacgaatcagatggctaacgaaaaccagacttgtgtccgttttgcattttcgaaaattatcggaagaatcggtcaattgattaccctcttttttttttgtttaccccattttttaatagtcatgaatcatcttccttggttgtgtcagattacttaagtcattattttgttatagagatgctttactagtatttttgatttgttttggtaaggacacttgtctagctaaagaaatgttagttaaatgaaagaaaaaaggttcagtagttgacccgtttaatcaactgcgaacaacgttcatactaatataatttgttaccataaattcataatctaaacgcgtgcttaagttgtaaacaaaaggaattaacaagggacacgtaaagtagcaattccgcaggaaaagcgagggtaaaattgtcatttcagtggatccccaccaccaccaccaccgccgcaccagtttcttcttcatctcctacgtctgaaattgagaaatcggaagaagaaagataagtctaatcttgtgcctttagatttcttttcggggagatctagtagttgttggattcgttaaacggagaagtggatttggtacgagtctttaggtttccttcttcaccaaaagctctatatagagagaatctgcgagctctttttggtaggaaattagggttcgtgttgcttggtaaatatagaatca

SEQ ID NO: 4260 - DNA, 3000 bp, Unknown
  misc_feature (1)..( 3000): cDNA_ID_1823551_gDNA_ID_1620693_Annot_ID_48631 3000 nt of promoter + ATG
ggctatcccatgcagcgtgtcacaaggcaaggagatcttcataagcacaagtgttggcggaaaggtcaacctcgtgactgggagaaaggtggttgattacaatccagtggaaggtagctgggaggaggttggagataccatgtgtgagtttatgttttcaaaatgtttttgcgtggttggtaatgttttgtactcatgtgctattgaccgagtgttcagatggtatgacactgaggtaagaacatggagaaatttggagtgtttgataggaggacgactacccaagttatctccgcgtgcttttgttagtttggctgattatggtggaaagctcgctgttttttggaaccaaggtgtcggcgattggcagatgctttggtgtgcagtgattgcgcttgaaaggcgcaatacttgtgaaattttggggaatgttgagtggtctgatcatgtgcttcatgtccctaagatacgttcttactacaacgctctttctgctactctctgagatgaatgtgtcagtatgcttgaaccgtgtcttcatctttttgtgtaaccgttgtattgtggtctttgttctgtggtattttatgatttattggctttgatttcgattttatttagtttatttgattgtttgtcttgctcttttggctcggtagtttaagatccttttgtaaagagacgattggaataaacaagtatcctatttgagcttagtagcaaatggagtattcattatcttgaataaatggtgcagtagaagataccagtctaattgtattgctagaatttcacccaatgacggatcactgcttggatggatactgttaccaaaattaaggtcattgtttcttgtaacatgtcattgtttagaataaaccgtcgtgttataccatgatactcttacttcttcttttctaactaacatgctgaaatctggacatggggtgagctgagatttgaagttcacaaattttgtctcccttaataagtcatttttaaaactcattttcccttgccttaatcttgtctgcaatgtagggtattgatgtcttgaacggcatagtgacaagcaacgcctatttggtaataaatctcgctatgcatgcgttttcgagtggtgttgactattttgctgacaaggaggatgttagctattgtgatttagtgccaccagctgaaccccttttaagtataatgaaggaaataccaccgctgagataagggtgttcaatggagaagatgcaaactgcacgaccctaggaacgtgaggcaaagagacgaaagtttggcgctcttgttccagaggaccagtttctagctcaaaatccggtaatgtttttgttttccttccttgtgactagactcgtgtatctaactagcagtaatacattttcagggtccctttaggatcatgatcagagtttctggtgcagacgactatgtggagtctttgaaatcacggtggactcgttatcacacagacagatgttaagtggaaagctggggttttagaggacaacaagtcattgcacattacaatgttggagcaggagaaattctaacagtgtcttggtgacaaggtttttgtgcacattagcaatagtccggtcattctttaatgcaaaccataatctatattcatcccaaaatctcagaatccaaagcgcaagagaatcaaacgtttcatcatcttatatctacaacggcctttagcagaagagtgtaattgaaggtccatgacccaagttgcagtatccatatcacaatttgaggtccaaaaaaagaaaaaaaaaataataattctataaaagaaccaaaaaacaaagatactaggaggatttgtcatagtgaatagtgatgtgacacgtagagaaagcccatatggcatcatcagcctcataaatgggtgtaacttgtaaggaacttgttgcgttcgtttctggtttggagcctaactttttgtttctttgtctttcaccatcgctgtttctgtgattttacgtttatgccattttaagttaaggacttagtccagacatcttagaattacatcattattcatcacgatatcgaaaattatacaaatgacgtttagaacaaacggatataaacaatacaaaatcacacgcaatacacggaactatgacaaccatgccacaagtctccacatgtactcatgtagtgatgatgtagcgtcctaaacatatccacattccttaaaatgaaaaaatctactttttagaaaacgaatccaaaacaatagacagtaaatgaatctagtagaatttctacataagtttactttctctatatatcttatattttataacaacaataatgtttataaatttgtttcaccttaattatggtttacaaaatactgtatcttggatttaattaaaaaagataaatcatttataaactaaattgatgtgattcatactaaaatactaaagtgttcttaagatattgttagctttgtagacaagtgagaagaataaaaaaaggcttttgtatggtttaagtcttatagtaaatgctaatttggtttataaaacatatttatactaaaaatctagaaattaataaattaaacataactgagcttatgtgaaaaaggtaagcaaatacatttttggtcaaagaaaagatggaaaaaaatccaaaaaagaaaacaaatattatcaaaaaataagaaagtaacccattttgagtgggggtaataatgtaaatgtgatataagggtggggtaggattagtcgctaaaaaaacttgagggcaattttagtcacacgaaactaaaccatccttcacttgtttaatttaattttgaaaaggcaaaaaaaagagcacttacttttacccaaaaacaaaaaaatcgtggcctcacttgcatttaaatccatccacaccacatctctctctctgtctatctatctctctcgctcgcataaaaggttaacctcaaaacaagtagctcctccttccattaggatg

SEQ ID NO: 4261 - DNA, 3000 bp, Unknown; identical to SEQ ID NO: 3158
  misc_feature (1)..( 3000): cDNA_ID_2049474_gDNA_ID_1620693_Annot_ID_164858 3000 nt of promoter + ATG

SEQ ID NO: 4262 - DNA, 3000 bp, Unknown; identical to SEQ ID NO: 4260
  misc_feature (1)..( 3000): cDNA_ID_3072906_gDNA_ID_1620693_Annot_ID_164855 3000 nt of promoter + ATG

SEQ ID NO: 4263 - DNA, 3000 bp, Unknown; identical to SEQ ID NO: 4259
  misc_feature (1)..( 3000): cDNA_ID_1382080_gDNA_ID_1620693_Annot_ID_164853 3000 nt of promoter + ATG

SEQ ID NO: 4264 - DNA, 3000 bp, Unknown; identical to SEQ ID NO: 4258
  misc_feature (1)..( 3000): cDNA_ID_3072910_gDNA_ID_1620693_Annot_ID_164852 3000 nt of promoter + ATG

SEQ ID NO: 4265 - DNA, 3000 bp, Unknown; identical to SEQ ID NO: 4257
  misc_feature (1)..( 3000): cDNA_ID_2999608_gDNA_ID_1620693_Annot_ID_164851 3000 nt of promoter + ATG

SEQ ID NO: 4266 - DNA, 3000 bp, Unknown; identical to SEQ ID NO: 4256
  misc_feature (1)..( 3000): cDNA_ID_2050918_gDNA_ID_1620693_Annot_ID_164850 3000 nt of promoter + ATG

SEQ ID NO: 4267 - DNA, 3000 bp, Unknown
  misc_feature (1)..( 3000): cDNA_ID_3593514_gDNA_ID_1620694_Annot_ID_48634 3000 nt of promoter + ATG
tactagtacatgctattatcttttttattttattaaatatttttgtccttcattctcaaccgttgccacattttctttgttaatgatcattatattattattatgaagtcgtttttggaatcctacaacattaacatacacaaatgtctttttgtgataccatacaaataatttgtttttctaaaacaaacaaaaaaatatcttttgtgataagcaaattgtgaatctgtgataacctcgcccacaaatcatatcacttattcgacaatttgtgataatttagcccacaatatttatgcactagctgatagaaagaaacatatccttatcactcacttactgtataaaatcccggattggccccatcaaatatacatcgctcttatcattaaccacatctggcaagtggtttaagctgtcaaatacaacacgactttgttgaacatatttttgtttctcaatctgtaatccaccgacgttcattttttggttaatcttttgtctgctgatctgatcatgtaaacctgacggaatcgaataacatatataactcaatctaattatgcaatgcaaaacaattatttgtgaataactcatttttaacccgttgaaagaaatgatggttttttaaagatacatgcaacctttaatctcctttattcatgcgtgtctgaatttgtatcacaggatagagtaacttacgaattttcttggattagattattagaacttcattttgccaaagaaaatattgcttacataataataaggaggcggctaaggataacatgaattacaatcgctatacaacacataattattacactttttgttcttcttaaaaataaatgttatccagctatattttcatccagcaaagccgtcaggcgttgtcgataagcttcaaaaaaagaactgatgaaattccgaaattcctcctccatattagcgtacgttacgttttatttaatttattttgcaaatgatattttcttcacttccagttatttttttatttttttaattggtagagtaaaaaaagatttattggcactctaatttttgacggttaacacacatatactgcaattatgtttaacaaaactaaaccgatcgatgaaatattctttacttggtcgatgaaaatagttgtctcatccgatgatccgaatgactctttccaagttggtaccttaaattgtggtatctgctgtattccatacgaaagtaaaccgcggaataactaaattcttaaaccatctttatcagaacaaagcaactaatctgcaaaattgtcagtgttgcaagctataaatgttccgtacaagctacaaataaagaaatacaaggcttagccgatgtgaaacgtacgttagagttgtacacgatatgttttgtgtgaatttgataaattcaaaaaaaaaattgttgtacaccttgatcctagtcatgctggttggtgtatattaatatattatatcagaaagtgactgtcattctattttaatgtgatatttacggtcaaagacatgttgcatgtaattgcgcgcgcaatgtatacgaccattttttgatgaagtaactcagcgggtaaacattctatcactttccatttcattggtaagtacaatattggattttcttttgtggtatgcactagtcggtatcagtcccgagatgtaattagagaaatatttgtaactagaacttttttccaactctttcgaatttttttttttttttttttttgccgtagatttggaatatgattctaacagaatatcaatacaatatagcaactttggctcactggtcactgcttcataacatgataacaaaactctcaagcaactactttcatctgaccctttttatgtcaaaaaaggtctttcgtctgaaccgaaaatcaaaccgagttggaagcttctagcaaagataatgagccgtactagtcacaactcacaagtcacactttcgaatttcaaacttcaattgaagatccgaatatccactgccgtagtttgtacgatactttcactcatttcatgttgtcatgtgtcgtacaacagtttccagtttcccattattatttaatgtttatttattaatatttggactttaattacggcaggttatactatatggtatgatagaatattttcttcattccactggattttgctaattatatatatttattccaaatcacaattttgatttatcgtcattacaaaaactaaaaagtaatgaccaaaataaaagatatgtaatttcagatattccgttctaactattctattctcttcctgattccattaccaaacactgagagacaaataagctactggccgctaattggctatcgctctctttacatcttcgaacataagcaatagttgaaaaatataactttactaaaaaaatacatatttttcgttaaaaaaaaccttgtggtcgtctatatactattctaataagtaaaaaaaaaaaaaaaaagtaacggaagcatgaactttcatgcctggaagaaactactggccaaaaccatccactaaatacaactaatgaagtaatcatcctagttgagcatattgtaatcatcacattcaagaaaaatatcccatggagaacaattttgcattatataaaaagttaattccttgtcgacttttatataacacaaacaagaaggagcacatcgtaaattcatcaccgcttctacaccttcaccgtacgtgtctctttcgtactttctcactatttgtcattctaattataaagtacaaaaaaatcaatagtttaattattaaattaatattaaaaataaatactttctactaaaagtctaaaatattataacatcgaagttgcgaaaaataaaataaaataaacgtaacatttcacctttaaaaccgtacgcagagtgctcaacgaacccaaacacactctaaaaatatcttctttctccttcttcttcattcttctcaatatctcctaatg

SEQ ID NO: 4268 - DNA, 3000 bp, Unknown
  misc_feature (1)..( 3000): cDNA_ID_1823608_gDNA_ID_1620694_Annot_ID_48635 3000 nt of promoter + ATG
gaaagaccttttttgacataaaaagggtcagatgaaagtagttgcttgagagttttgttatcatgttatgaagcagtgaccagtgagccaaagttgctatattgtattgatattctgttagaatcatattccaaatctacggcaaaaaaaaaaaaaaaaaaaaattcgaaagagttggaaaaaagttctagttacaaatatttctctaattacatctcgggactgataccgactagtgcataccacaaaagaaaatccaatattgtacttaccaatgaaatggaaagtgatagaatgtttacccgctgagttacttcatcaaaaaatggtcgtatacattgcgcgcgcaattacatgcaacatgtctttgaccgtaaatatcacattaaaatagaatgacagtcactttctgatataatatattaatatacaccaaccagcatgactaggatcaaggtgtacaacaattttttttttgaatttatcaaattcacacaaaacatatcgtgtacaactctaacgtacgtttcacatcggctaagccttgtatttctttatttgtagcttgtacggaacatttatagcttgcaacactgacaattttgcagattagttgctttgttctgataaagatggtttaagaatttagttattccgcggtttactttcgtatggaatacagcagataccacaatttaaggtaccaacttggaaagagtcattcggatcatcggatgagacaactattttcatcgaccaagtaaagaatatttcatcgatcggtttagttttgttaaacataattgcagtatatgtgtgttaaccgtcaaaaattagagtgccaataaatctttttttactctaccaattaaaaaaataaaaaaataactggaagtgaagaaaatatcatttgcaaaataaattaaataaaacgtaacgtacgctaatatggaggaggaatttcggaatttcatcagttctttttttgaagcttatcgacaacgcctgacggctttgctggatgaaaatatagctggataacatttatttttaagaagaacaaaaagtgtaataattatgtgttgtatagcgattgtaattcatgttatccttagccgcctccttattattatgtaagcaatattttctttggcaaaatgaagttctaataatctaatccaagaaaattcgtaagttactctatcctgtgatacaaattcagacacgcatgaataaaggagattaaaggttgcatgtatctttaaaaaaccatcatttctttcaacgggttaaaaatgagttattcacaaataattgttttgcattgcataattagattgagttatatatgttattcgattccgtcaggtttacatgatcagatcagcagacaaaagattaaccaaaaaatgaacgtcggtggattacagattgagaaacaaaaatatgttcaacaaagtcgtgttgtatttgacagcttaaaccacttgccagatgtggttaatgataagagcgatgtatatttgatggggccaatccgggattttatacagtaagtgagtgataaggatatgtttctttctatcagctagtgcataaatattgtgggctaaattatcacaaattgtcgaataagtgatatgatttgtgggcgaggttatcacagattcacaatttgcttatcacaaaagatatttttttgtttgttttagaaaaacaaattatttgtatggtatcacaaaaagacatttgtgtatgttaatgttgtaggattccaaaaacgacttcataataataatataatgatcattaacaaagaaaatgtggcaacggttgagaatgaaggacaaaaatatttaataaaataaaaaagataatagcatgtactagtagcaaacaacataaaagaaatgagtaactatcgctttaattaaaagtgggactaaacatgtctctagactattgaaatattcttattgatttgaattttcttattgtaaagataactttgaaattcactctttaattattttcttaacgagtttttggaatggatccgaatgtatatatatatattgatttgtgtttctatttatctaagcttgtggtaactttattggcgatggttaataaaaaacacgttgggtgcgtatatgcaatattcttgatactcgaattcattcctgaacatgagatattaagataaacgacctactacttcgtgattaaaaaacataagttaaaatttaaatgtccgaaggaatcatagttaagtgacagcatttaagttgtctaaaaattgccatttgccactcgcatcaatttgtaattttgcaaagtgcaattttatgtctcaagatttgtttcgcagtaagtaatgaaataacataatcaatgttctaacaaaatatctcacctaccagccacacgagtgtcaatttagtttacatttgaaccagagacctaaaagtttgaactaccaaaataatgattttgccgacaaaataggaaaactaagaaagtagtaatgaatatcagatatctgtttcttcagatcaaagcctactaaggaacgcaaaaatatataactaaacaaaattgcgtaaatttagaaacagtgattaaaagcccatatttgattcaatagtaattgaaaacagcataagataatggcccattagccgttatttaggcccgttatcatatcacaaaacaaaacacgaatcatctacgacgaagacctgaaaaaacacactgcaattgagatcgatttcgactgtaagtgaactttgattgccgcgaagattactcaaatcgccggacacaagtttttcagtgaattccattggcatagaactcgagagaaagagacacagagagagagagagatctaacaagagtcaaagtttctgactttttcgcattctttttgagatcgagttctgtttttgttggcgtgtgagatgaattcttaagaaggaagaagaagaagaaggaaag

SEQ ID NO: 4269 - DNA, 3000 bp, Unknown
  misc_feature (1)..( 3000): cDNA_ID_2132959_gDNA_ID_1620694_Annot_ID_48636 3000 nt of promoter + ATG
tgaattattgtatacattctatcattattttcacctcttacgtatgatacaattctgacatacataaacatccaaaagtatcaaaacaatttgccaactagttcttactattcttctactcgcttttccgggagaaaaaaaaaataaaaaaaaattcgttgattaacatttttaataaaaaaaattgttcctgaattatgcctttattagttgggttaaaatataattatattgacatatctaattaaacctctttacactcaaatcaagacctacaatttcacaagtttaaggttgggattactcgatatatagaatgaaactattgcaacaaaaaaaaataaaaaaatgaatgaataggattgatggtgtgataaaagaagagatgaatacaaagaagaaacgaacacaagtattgtgaacaagtcaaagcctaactattgaacaactttagaagacaagccaccaaatgtacaaacaaatcctcccaataacaaactacaaaagagaaattaatcaattagaaatcataagacatatcgacacatgctaatggtattatctacttacacctcatcaaactcgtgcatgggctattgttatccacatatgtatacagtcatggttatgtcccctcaatctcttccagcttgagaactatttgtaaaccactagtcaattatttcatattcagttcatagatagcctataaacattacatattatatctctagagataacaaaggggagcaggaagtgttagtactgtcgaccttatgcgcccatataattcttccatagctttagattttagtgtttgggctattttaattgcacccgaataatgacaggtaggggtccatgcaaactcatattcatgtgcatatcatcataaaatatccaaaaatctatcttatctatataacttcattgaacaaaacatatatatattcatgcagacgtatggcatgatacagttaatggtctgaattgctcaacgtaaaccatacatgcactagacagtttcatgggaagactaagattttgggactgcaaaattcttcttggaattgtgtagcggctttcaacgtatctttaggttatattcggtgaaccctttatttaccggcacagaatattacggttgatattcaattgatcaaacaatgtgaattagacgtctaattattgatggtcgccatatgaatatcttcttcttccttttccaaaccaacaccaacatcttttaatcgatagaagtgtcaattcgagctcgactctcacatctaatgcgtcattataagattgaaaatcagagacttgaagttttcgtttaggaacttaaaatgaagtttataactattgcttaacgtttttgttgttcatcccaagaaataattgacgttttcaagttaggtttttccaacccaatttattttattatccaataatattataaattctctagtgaaatttcattccttagcttccacgcaaagggtcgcttgagttttgagtaacacaagattggagagatcaatgagaatgttggcattggatccaatcctactatttgggaccagcttcactcgattcatcgcgtcctatttttgtccgtttacacatcttcggatcattcaattcttgtttaatcatcttcattagtaataacgttgccactttatttttaagacggatttatcttctgcaactcccaaattcatattcgctaaatcttctctaaactcagcataatagttaacttgaaaaagaaaaaaacgaaaacgataactaagatggtgaccactcgcatggtttagtgatgaatttagttaaaccgtatgttaatttccttggttaggctcttcaaacagaaattcgaaaacgatatcaaatgctccatgataagtttatgatttcttagcattgtctaatctaagagactagtaagaacatgaaaacaatattcgttaaaccaagtggtaaaacaactatatacagtatgtgtttttcgattataatgttgttaacttttaagattattatattttatattatttcttaaaatatgttgaggtttaaaagatttcttttcagaaaaggattaatgtcttcagcaatatatgctagtaatttactaagtgatattttgcaagtttgttggcaatatttaaccttttctgaataaaataaattcaatattaagaaacaaaattatatacatatagtagtatttaattgttatctatttttaaattatatgtgaataaaacaaagcaagtgtaactgtgtaattataacattggtacacgcacgggaaaaaacacagctagcaaattgaaacgttaatttggtaaagaagaaaaatattttatttttaaaaacacttaatatagttttaattggtgattttcccaattctgaacatatatatgatgataagttttccatcccaagttgttttttctcattagtcactggaaacattaattaccagcaatcagtagttactttggtattccccacacaaattcaaatttaaaagaaataattagtagtacttcttatgactgttttttttactgaataaaaaagaactatatataggttgttcttaactataaccactaaaaaaaggttctaaaattaattttaaaaagaaaaatatatgaagttaacttttatatattacacatcaaattccaatttcaggggctggtaatttggtaataattaaagaaactcaatggcaatgatttaagcacttctttatataagtccaccaaactacactgatctcctcaacaccacacacagcaaaacaaaaagctctctacactcaaaatataacgaaagaacaagaagacatcatcttagctcactatggctttgaagacggtaacaatatacaaactttctctattttttccacttttgatttaatgaatctaaaagaaaatattttggatgattggtatataggcgacgagtggtatgtgg

SEQ ID NO: 4270 - DNA, 3000 bp, Unknown; identical to SEQ ID NO: 3095
  misc_feature (1)..( 3000): cDNA_ID_1823602_gDNA_ID_1620694_Annot_ID_48638 3000 nt of promoter + ATG

SEQ ID NO: 4271 - DNA, 3000 bp, Unknown
  misc_feature (1)..( 3000): cDNA_ID_1823598_gDNA_ID_1620694_Annot_ID_48640 3000 nt of promoter + ATG
aggggcagataacgcaaagaaagagattgatcaacaaacatatatgtttggtaaagagaagccaagcttattcaccataaattttatttaatcaatgatttatttttccttttttttgtcttttccggtgagagttaaaatcaatcattctattatctccaaggggaaaacgtctagtcaataagcaaaatgaatatcaaataaatttgattaaaaatgtaaaatcaaaagttttgaggttctgaaatcattgaagattatagtctaaagatcaggttaggtctatgtggaattgatatgtatggaagacactctggctcattcagaaggtttcaaataagctggtttagatactattgtccaagaaagacaagtgctctctcattctcattggttcgcgcgtgtaagctctcattgtctttaggtttggaacataatccttaagacaattggtgtgaatctaggaaacagagaaatcaaggattcgtggtatatttacagatcaaaatgcaaacaagaatacaaatacttgttactagttcttcaacttttgtcattttcagactacaaacaacagatttttgattccttgggtaaacaagttatgaaaaaggagaaaacaaatacttatagctctaattctcctgttgattcctttcttcttgttgaatcagagtatagaacaacctttctgagattttctcttcttcttcttcttgttttttggtggctggagaacgaccttgatagccgcatcaaacactgctttcacattctgttgaacagataacagatataggaatcatcagcagattcaattggcggttttagacaggtaaagattagataaagatattgactctcaggttaatacctgttgagtttttgcactgcattcgatataagcaggcgccccaatcagcttctttagttcttcaccctgttttgataccatcaaaatatgaaacatgcagaatattaacacctaggattcagtttagaaagataatgagaaaggtacctgagcggtagagataggcacagcaccagggtgctcggcaaagaattgcttatcatctcgaagatctgtacgagactcagtcatcaaaatatcagaagagttccccaaaacagaaaacccccgataatcaggcgattaagagttgagctaagaaaaaaccaaccaagctttgttccaacgaggatgatgggaacaccaggagcataatgtctcagttcaggaacccactaagaatcaaaagcaagataccaaatgtattctatcagaatcactgaatgtaaactgaataaaacaggaaagaagtttcaggagaagaccacagatcaaacctttttagaaacattttcatagctagctttgctgacaagtgagaatgcaagtaagaagacatctgcaccgcgatagctcaaaggtcttagtctattgtagtcctcttgccctgtttcaccaagtcaaaaacacaaatgactctctggaagaggaggaaattcaaaagacaaaaaaatccaaggtaacaacttgcctgcagtatcccacaatcccaagttgatagtgttgccatcaacaatcacattggcactgaaattatcgaacacagttggcacataatcctgtcacatagaaaattccactaaaacatcagctacaaaatctccttacagaaagttacctaacactctttctaagatcattaaacagatcaacaacattgctacggtacatgaatctctgagtctctcaaatcctaaagatcacatcagtacattcactaaggtagcagaaagaagaagactttaagaaaacctaacaaatacttgtgactaaatccaactcataagcttcaacaacaaaaccaacttcaccaagctaaaatttcacgaaatcaaagtaaaagaagagaactttaaagctaaccgtggggaaagtgttgctagtgtaggagatgagaagacaagtctttccaacagcaccgtcgccgacagtgacacacttgataaaccttgaagcactcatctttctctccttcttcaaacttcaaaaaccctaatttgttcacgaattggggatttttgactaaagagagagagagtgaggttctttaaagagaaagaagacaaagaaatagctgctgaaagtctctcccagactagagtcttcctaatttttactactcatcctcacatgcacctcaatttcttggtcttcttcttccttttttttcttctttttactaaaattttataaaatagcatttcttcttagatagtgcgtttcccaacataagaccctacaaaaatttatgggatgaaaattataataataatttctatgtacttttttttttttttttttttaaacttcgttttcatctaatactatgcagcccatatactaaatgcctaaatctatacatatttagattgatctttaaatatcaataaaaaatttagctaaattttgactggtttagaggatttttccgatgtgtcattaggattatacaactatggtttaaatatcaataaaaaatatagctggttttacaatgcaatatgattggagtgttaatttttattgatcagcctcctttggatacatattcttctgttacatgttaaatgataatatttttgtcccggtatgttgaagtaaacattaaaaatgtacatacaacttctctaagaaataaatgttgagacactaaaaaaaacgtgaacttaaggtcaatatttaatatttttataaccaatcacggtataaaggcttaccttttgaatctgtctagctagttattgaccgttaattttaaaaacacttattgaccgttaaagaatctgttatggggacccaaaaaaaacgaatggtaatttcactaatttgttatgttatgtccaacataataggcgaagaatagggtgaaaccaacatttaaaaatagcaaaaacaaattaaaaaaaaaaaatcgaaaaggaaaaatg

SEQ ID NO: 4272 - DNA, 3000 bp, Unknown; identical to SEQ ID NO: 3093
  misc_feature (1)..( 3000): cDNA_ID_1823594_gDNA_ID_1620694_Annot_ID_48642 3000 nt of promoter + ATG

SEQ ID NO: 4273 - DNA, 3000 bp, Unknown
  misc_feature (1)..( 3000): cDNA_ID_1823586_gDNA_ID_1620694_Annot_ID_48644 3000 nt of promoter + ATG
ggccattaaatttgatggtgtggttgactctcacaaaatttctacacagaaaacatgatcaaaatatgcttatcgtcgtcagatatatcaatattccaggcctaatttgtgagcaaaatgatgcgaagacgaggattgtgatgtttaatccgaattatcatgtaccattgtatataatttacctctagatgattttcagtggtaataaggtatatttaataaatgtaaatcggaagtttagcctttttaattaaaaatgcaaacaacacaaggaacacatggatgaagcaaacataaccaattatgagtgactagtagatagtagatatacaaacacatatttccgatttcccaagtaatatgaatctttgtgatgacaaaatcgttacatcattcacgttgtattaagttacaactaaccatgcagtttttattttacaagtaaatgtgatttgttttctagtatacccatatagattatactcctttgctattttaaggtgatatgaaagctctcccagagactagtgaattagttatggatggttgccccgcaaaataatatcgttttgtaatttaatatggactaatggttatctcatgacatatactaattaaaattgttaaactatagaagttatttaaaaagaagattgaaaatgagatgtggttttcattgagttattatttattaattttgaaaccataaaaaaatgatgttgaaacttgaaacatttatatttgttgcataaacaattaaacatgtcaagggtggtccaccaatacgtaacatgaacagtccgtcttaagagattccaacttccaatcccaaaatattcatcaattctgtaattgtttagtcagatttgaaataattgcgaatagagatatcttaaaaacttcattcaatagcaaacatgaattgtataacaaatgtctatttcatctatctgtcaatgtttaattattgccacactggtgatgcatatataacaaaagcgacctatatagattaaagtccttttataacaggttcatatacacccagtaaccaccaatacacatacacgtacatatatatattattgccgtttgagagtcaaactcatacacgactcactgaaggttgatacaaaatatcagcatataataactaaatatatggtcgaaaactacttatagagtttggtaggtcgtattttcaacattttaaactcaatttttatgttgacaataacaaaaaaagaaaatcatatcatatatctcaacatatagagtctaacttttttcgccaaaccaaaagaaagaagaaaccaagaaacaagaaaaatgggtgttcttgatcacgtctctgaatatttcgattgttctcatggaagctccaagagacacaaaagtctacaggtaattaaattctgcatccattcataattacgtttatttataatcaaatccttattataatatgttgtggttggaaaatactagacggtggatgtgagggttttgatagattgtgaaggatgcgagaggaaagtaaggagagctttagaaggaatgagaggaataagagatgtaaccatcgagccaaatgctcagaaagtgacagtggttgggtacgttgaaccaaacaaagtggtggctcgtatcattcaccgaaccggtaaaagagcagagctatatcctttcgttccttacgacgttgtggctcatccttacgcgtctggtgtttacgataacagagccccgactgggtacgttaggaacaccgagtatgatccacatgtgtcacgtctcgcacgtgctagctccactgaggttcgttatactacggcgtttagcgacgagaacgcctccgcttgtgttgttatgtgatgttttttttttttggtttaatttttttttactgggattattttttgtgtttggatgttgatgtttgtttatgtttccatcacgaatgtatttaagataagaacgagtgaaaaaaatgtaaattgcatggtgatgaattggtggttaaaacaaagttgtcaaaaaaatatgataattaataatccggtgaccaaataatgcgagcaagggatttaatattcgacataatagtgtacaacaaaatcagaattaattattactttataacattaggaaaagaaatcaaaactataaaatgatacggtataagctgcccaaataattgtgcttagaagaaaagtaattttgtcgtactataagaattaacaaagttcacagtttgttagcccttggagctagttcggtggaattgactaataacgaaaagataatgcaaattgtgatcattagccatgcatgataaagttgaattattacttattagtttagttgtcactaattgtcacaaagggttggtttagacatcgatagcgtgttcggtccttaactttatcaatgtgacaagctagcagaggattttctctaaagtattttgtcctcaaatgtggataggattggtcgcattacgttcgagatttttgtcctcattaatatgcaaaaattcgtactttttaacgaaattgaatcctaaattttaatgtgaaaccactaaactactagatcaaagaggtttttacttttagtaaaaactaacccaacttattatgaaaaagaaaagaaaaaaatcgtctaggaggataattggttttaaatagaataattttaggaaattaaatgaagtggatccttagtgggcctcccagctaatagtccaatactatttcaatttccagcctttcagctataactttcgtaacaacaggtcgtcctgacattactgaaacacaatgtatgcggtttttcatataaataaacgtcatggcgttttcgtatagaacatcgaaaacagcattgttacccgcttcattcctcctctctctttttgggcgggaaactgtaccagaaaaaaacctcaagagtgagaactgagaagaagaacgatcgagagcgagagagagagtgatg

SEQ ID NO: 4274 - DNA, 3000 bp, Unknown
  misc_feature (1)..( 3000): cDNA_ID_1022876_gDNA_ID_1620694_Annot_ID_48645 3000 nt of promoter + ATG
agtttctcgtgcaactttgactagaaaacaggattcatcttcacctttctttttttcttcacatattaactgtatgtacctttctttatatgatacaaaattcgatgtcttcggttgtcacatttctttgaagaccaaatgactttttgattgtcttaaaaacttatgaattgtttacaaaagtcggccgagtattacgtgaagaccgttttgatacgacatagacttggcacgagtaacaaaaatttgacaaatcaagtacattatatatatacgagaattgattgatttgttttcttcgtcaaattgactagtataaatcaatggaccattttggtaacgtataataaaagctgacctagtagactttgttcatgaaagagttaaagtctttagatataatgattttagttgtcttcgatggttgtgaacttttttggtgcaataaccggatgatcggacagacgcattgaatgattcccaactttcccggtttagtttctttcggtgttgaaataaattaatattgaaaatctttagaaagcagaagttgttggtaacgtatatatctttttctctggactaattcttgtttccaagaggcttaaagtatcgaggccacgacctgtcacacacaacacaatattccatacttctgcatcaattacgtaatctttctcttttttttttggctatttattttacttatcttcctagttcctactccctcatttctttgtcccactccattagttcttcctttcttcttaaaattttatttatttaaaaacgaaccttatgaggaaaaatatttagaaaattaaatccatagtatatcatttttcatccaacgtgcactaccacggctgtgactagtagtgatttttaaagcaagaatttcaaagggatatatttagttcttttaaaagttaaccattgaagttgaattttcttaagggaaaagaattgctttttcatttcgttttttttggaccagcgtaaaacaacagattctctttcttttggattttggagtggaatccactgcatatactggctgatttttccattttctttacaacattaaaatcgttttaataaatcgtccacagttaactaaaaattataaactcatacaattctctataaaatacatcctattttttctattatttatttaaaatattcccatagttcttagttgcttcaaatggtcaccatttacttaagaaatgaatttcatcatattcctctaactatcattttcagtacaacaaactatatatatattcaatagctgccacatacgaccatgatgttccaatataatttgtagaatatgattcagaagaggtttggttcatatcaatattaagtctatacactggttaaagcccaaaaattgagaattcaaggttgtaaagctataaccttgtatacattgggcctagcagtccttgatttcactaatatgggcccattatcaaggcttactcgtctgaatagtgaattctaccgaatgttgggctttttatttccaactaatgttaggtttcaaaagagaaaagtgcatgaaaatcagtaaatcacgtttgtttggggtttcagaggaccgacactctttctaaacataacaatattcgagcaaattacatgaacttggattttggccattaaatttgatggtgtggttgactctcacaaaatttctacacagaaaacatgatcaaaatatgcttatcgtcgtcagatatatcaatattccaggcctaatttgtgagcaaaatgatgcgaagacgaggattgtgatgtttaatccgaattatcatgtaccattgtatataatttacctctagatgattttcagtggtaataaggtatatttaataaatgtaaatcggaagtttagcctttttaattaaaaatgcaaacaacacaaggaacacatggatgaagcaaacataaccaattatgagtgactagtagatagtagatatacaaacacatatttccgatttcccaagtaatatgaatctttgtgatgacaaaatcgttacatcattcacgttgtattaagttacaactaaccatgcagtttttattttacaagtaaatgtgatttgttttctagtatacccatatagattatactcctttgctattttaaggtgatatgaaagctctcccagagactagtgaattagttatggatggttgccccgcaaaataatatcgttttgtaatttaatatggactaatggttatctcatgacatatactaattaaaattgttaaactatagaagttatttaaaaagaagattgaaaatgagatgtggttttcattgagttattatttattaattttgaaaccataaaaaaatgatgttgaaacttgaaacatttatatttgttgcataaacaattaaacatgtcaagggtggtccaccaatacgtaacatgaacagtccgtcttaagagattccaacttccaatcccaaaatattcatcaattctgtaattgtttagtcagatttgaaataattgcgaatagagatatcttaaaaacttcattcaatagcaaacatgaattgtataacaaatgtctatttcatctatctgtcaatgtttaattattgccacactggtgatgcatatataacaaaagcgacctatatagattaaagtccttttataacaggttcatatacacccagtaaccaccaatacacatacacgtacatatatatattattgccgtttgagagtcaaactcatacacgactcactgaaggttgatacaaaatatcagcatataataactaaatatatggtcgaaaactacttatagagtttggtaggtcgtattttcaacattttaaactcaatttttatgttgacaataacaaaaaaagaaaatcatatcatatatctcaacatatagagtctaacttttttcgccaaaccaaaagaaagaagaaaccaagaaacaagaaaaatg

SEQ ID NO: 4275 - DNA, 3000 bp, Unknown
  misc_feature (1)..( 3000): cDNA_ID_2108207_gDNA_ID_1620694_Annot_ID_164884 3000 nt of promoter + ATG
taatccatacagatcatcccacgtgtatcgtatctggtaacggctagaacgatccataaacatctgtctttttccatccttttaaataatggtcctcgtttctcgcaattcctttttccgattccccctccaacggtcactacatttgattaccgtatgctttacggttttttttttttttttacatcaattttatggttcaattatgccttgagaatgtgcttttgattttgattagcagtatatttgtttaattagtagtgaatgcgtttatttttgtggattgttttttaattagttatcttgtcatttagtacacatatggtaaactaagcatgtttatgtacttaactaggttttaacccgcggtttaccgcagacaatcaatttatttggttcttatactaaatatttgaagaaatttgatattttaaacttataaatataaatttctagtgattagtgaagaatcgtaataaatgatttggatattattgattattgatttcgtgattgaatatactgtttttagagatgaaatgtgattatattttgatttcaaaaacgatatagattccttatttttgttgaatagcttagattaaagagaattaattttattaaacggtttagattgaattggatcatataaagcttagaaaattgttaagaccaaactacccttaataattttgaatagcaaagaataaaatccaaaattaaaatcaaaattgagaccaaattatacaaaatttcaatttgtacttctcttttaataataaagggattagcttaattattcttaaaatatcttaatattatttacactaaagaaaacatagaacatactcctttctattcattgtttttaggctatattgtaccttcatatttcatttttgaacttttcagttcagaaaatagtacatacaataactttgaaaagattcaatattaatgctgtcttagattagcactttttaaaagtatgtataaaacaagtaatcgatcatccttaagtttggtgttccctaatattcatattttagctggttgcaaacaccagctatattcgtttatggattttggtctaattattattaaaaaaacaaaaattaaccataaggtgagtttgttttgtgtatccttcttatttttaaccaagaaggaacttacatcaagattagttgaaattttcaaaaagacgacacgtgctgagaaaaatatgttcttgatccttgacattggaaatggaagtagtagctagctacttaatcgttgtatatctttaagagttgggctagaccagataattcagcccattttgatgtattagcgacaattcttttgatagcatttttgggctaagtctattcgtaatgggtttcaatcatctcattgtttcttcagcacatttttgagcctgcttattttttttcagaacgtatggaacaagatcacatgtttaattatgtatggtcgacatgtttcaatccgttggctttaaggtcttaataacgtacgatacattagttttgttttgttgcatgtaacctgtgtggttgtacttgtacgttcactacttgttggtttctttataaccaatagaattcggcaattcagtaccatgtatatgtttttcttaaccgaccatatattccataattcacatgccatctcttaaaagaaatacaagcactcatagccataggtggtggatgaagaaatatgtgtgttaaaaatttcttctattgtccaaaatcaacagcttgatcagatgaacttctgagcgagccagagggttccaaggtgggccattgggaacttgataaatctcatctcgtcacatctcccaaggggcaaaacaaaaacttaagaaataatcaattcaaaaggcatattcttcccgcttggggcgttcacactatctcatcacacgtggaatccaacaaagcagccacgtcacccaagaccatactaaaccacttaaaaaggttttgctaaaaggccaaaaaaaccggataaggaaccacagcccaatgacgtcctcatttattttattttcattgaattgcctaatatttatttcttttgtcgtccttcttccttgcttttgttaccatataaaaaaaactttttttttaagtacagaatatatatatgacaatatcgcaatcgtgggttcagcttatcttaagttctcgggaacctaaattcggatcgcattgacgatgttgatctatcaaaccacagccagttagtttataaggttcaaaattaatcgtttatcaaaaactacatgtaagttggctttgttcaacgaatttttagaaaaacgtaaaacgatataatttggcaggaccaaataaaaaccaatgccatggatttcatcttctattacatcatagaatagattcaattctgtaagggttgactttgttttaatcattattctacattctctaataataatagattttgttaaacttgttaatgtgatgtaaatcaaaagtacagttatttgctatgagtgtctgagattaaaagatagtcgcactaattcatttagattagtttataatccaattaacaaaataaaaatgagcgaataaaacaaattaaaactactttttctgaatttgaataaatagtaggtaaccggtggttggattaagaaaaatatatatgaaacaattcgtggtactgtgatcataaataatacttgacgttcctgaatttctcgccacaatatataacatttgtttttttctttccagtatttatcacatgaaaaaactaaaataaagaaaaaacgataacctttaaaaattcccccctcaaaataaagaaaaaaataaaaagctaaaaaggcagtaatacacacgccatttataaataaggcaagtgaatataaaatagtgcctcatcatcatcagtaccatctcctcgttttgataaaaatctctgaatctctccaagctctcttctcatcaaaccatg

SEQ ID NO: 4276 - DNA, 3000 bp, Unknown; identical to SEQ ID NO: 4274
  misc_feature (1)..( 3000): cDNA_ID_1022876_gDNA_ID_1620694_Annot_ID_164878 3000 nt of promoter + ATG

SEQ ID NO: 4277 - DNA, 3000 bp, Unknown; identical to SEQ ID NO: 4273
  misc_feature (1)..( 3000): cDNA_ID_1823586_gDNA_ID_1620694_Annot_ID_164877 3000 nt of promoter + ATG

SEQ ID NO: 4278 - DNA, 3000 bp, Unknown; identical to SEQ ID NO: 3093
  misc_feature (1)..( 3000): cDNA_ID_2051170_gDNA_ID_1620694_Annot_ID_164875 3000 nt of promoter + ATG

SEQ ID NO: 4279 - DNA, 3000 bp, Unknown; identical to SEQ ID NO: 4271
  misc_feature (1)..( 3000): cDNA_ID_3072940_gDNA_ID_1620694_Annot_ID_164873 3000 nt of promoter + ATG

SEQ ID NO: 4280 - DNA, 3000 bp, Unknown; identical to SEQ ID NO: 3095
  misc_feature (1)..( 3000): cDNA_ID_1823602_gDNA_ID_1620694_Annot_ID_164871 3000 nt of promoter + ATG

SEQ ID NO: 4281 - DNA, 3000 bp, Unknown; identical to SEQ ID NO: 3096
  misc_feature (1)..( 3000): cDNA_ID_2132959_gDNA_ID_1620694_Annot_ID_164869 3000 nt of promoter + ATG

SEQ ID NO: 4282 - DNA, 3000 bp, Unknown; identical to SEQ ID NO: 4268
  misc_feature (1)..( 3000): cDNA_ID_1823608_gDNA_ID_1620694_Annot_ID_164868 3000 nt of promoter + ATG

SEQ ID NO: 4283 - DNA, 3000 bp, Unknown; identical to SEQ ID NO: 4267
  misc_feature (1)..( 3000): cDNA_ID_3593514_gDNA_ID_1620694_Annot_ID_164867 3000 nt of promoter + ATG

SEQ ID NO: 4284 - DNA, 3000 bp, Unknown
  misc_feature (1)..( 3000): cDNA_ID_1823582_gDNA_ID_1620694_Annot_ID_48646 3000 nt of promoter + ATG
cccctattttacagtgatttatgaccactttgtttaatttcctaacgtctttacatcactaaactaatcaaagctacataagaaaatattaaattatataatgatgtggtcattcgtgtaattagcattcaaagatggttggtacgaatcgatgatgtttgataaagtgtatattagcaataactaatggtggctaaaaactcgtattaatactaagtttgtagaccgtatctcacaaaaatgtgaacttagctaggtctaatcagaatattaatgcacaattgttttttttttccttcgcagacaatatgcatgaagatatgtttaaacaggtagttttcatttagttcacaccacaccaccacaacaatgatctgttctagctagcgttggagatatgtgcaaactgaaagtttttaatttaagggttgattttttttatattttttttctttctatccatccgcgaagattcgaaagataccccgacctattggtgcttggagaactagcggcgtccatatatcgtccaaagagtcttgcatcacgtgtacttagtaatcagtattccctaatgtaatgaaagtgagataagtatgaaacaattcgtgactattgctaagtaagcattgggttatggatatgtggaagatgcaatgcatcgaaaacgtgtcggtagatacgaaaggtgtgtcaaatttatttattttttgcgggggaaacatagtagcacatccacctcccaagaaacaagcgacacacactcggatgataacaataatagccaacaagtgtctctaagtcatcatccattatatatccaaagcatataaaatacttgttagatagagacatataatagttgaaggatatcacatggtttgcaccattcctctagcatgaattatgacattattcataaatatggacccttctctccatgttttcttttcttaccgcccaaaagccaacccattaaattaacaaatagaaatacaaccatataataaaccgttgcactttccttctgtactatgatgattgatgaaggtgctaaaaacaaccatattatattaatacgtacggtccaacgattttcattaaacttcttgctttagcaccgtttcctcctttttctttgatccaaatcataatgcacaactaacgacacacacaatcataatggtaaattggtaagttaagtgtgtatgactattagaatgaagcgtaaccacaagaatgagtatcgcgcggaatatcgttgtagactaaaaccctacgcgtgacccaaagttctaaatctcactaaatattgactaagagataactaattcttattaaaaaaaaaaaaaaaaaaaaaaaaaaaaaaaaaatcttataaacgttattgtcaacataacgttatcattaatcctttttgaaacaattggaatctagacatttttagaaaaagtcctaaattaaatcataattttttgtgaaaaaagaaaaaataaataaacccgatttattcatacatatcgttacaagatagtttgacgtttttttctctctaaagtaatatgatggtataaaattaggtttttaacagttgtactaaaaataggaaaaatccattttctgtttaatttgccacaaactcacaataggagaacatcttataatataaattacttaagccatatttgaccagaaattttcagtggtcaactaaagcgttttggagtagtatatgatttcattgaataacaatgaacttaaatctggtgcgttttaattcattccagttcaccagacattttataaaagtcaatgtttctgaaatttgccatattgattatacacactttcttgaaaaatgcaaagaagaatccagataaaataaaagttacactgtaatatcctaattttattaatataacagcaagcaatatatactttttaaaaatatacatgtctatgtttgtctaaatgtattaatttcaaaggcagtatgatgagctgtaaattaaaatagtaatacaacttttgtttttttcccagttttgtttcttgtgcacatctaaaattatgcctatggttgtggataacaacaaaaaaaaaagctttaacgtcaataatttgtaacaatggtgttatatggctgttttcgtttccttataatggcgtaaccttttgtagaacaaaataataggtaaactaagccattgtttgactaagaaaattacaattacttttcataattagaaaaagaacaaaaaaagtggtaaaaaatagaaccaaaaatcaaataattcaggcgttccagatgacccaactgaccaattcagtaaacaataaatttcaaatcagagaaaatagaagtaaataaccaaaaaataggaaaaagaaaagaaaaaatctgtgccctgccataattccacttggacttgtataatttttacacattaccgaaaaagccgaaaagaaataattaaataaaataaaaactagtactactaataaaagacaaaacggctctggcaaaatctctgaccttggaaagataaaagatagttcagtcacataatcagcatgtgtacgtcgtttctttagtgcttaatattataaattaagaatacttaaaaccaaatctttatataatattgattgtcagataaacattaacccaacaaagtctctctccctctcctattcaactttttcagttactttactccgttcatcttttatttttcttttcgtcgattctcatcaatactacaaaaatatatacttctatatatcgtgcagaggttacatgcattgtacaattttgttgtcccgagaaacaagcggatcagagacaaaatcagagtcggtttcctgctttttgattcctctttattaatcagcaaagatcgattccacttctcctctctctctctctctctgttctttaatttagagagaaaaaataagcattcttccttctctgttttcgagcgggaaattctggag

SEQ ID NO: 4285 - DNA, 3000 bp, Unknown; identical to SEQ ID NO: 4275
  misc_feature (1)..( 3000): cDNA_ID_2108207_gDNA_ID_1620694_Annot_ID_48648 3000 nt of promoter + ATG

SEQ ID NO: 4286 - DNA, 739 bp, Unknown
  misc_feature (1)..( 739): cDNA_ID_1823660_gDNA_ID_1620695_Annot_ID_48654 3000 nt of promoter + ATG
tgcaataaagaaagacaattagttgtaagttgaaactaaacctacatgttgtctcacctactacaatccgatttgtttcgaatgttcaaagatagactaaaaaaaaaaaaatcctaatctacatgaatcgacaatcgatctccgaggatcgtgttaataagccaaaacgaaagaaagaagaataatttgtttgttgggttggcaattattttaatacagattaagaaatagcaagagatttacatttccatgatttaagtgtgtgatcgttttctatcattgtttagtgcgttataattgatgataccaaatgaaaataagaaaaaaatcgtagacgagttgcttgactcccaacttaaatctccaatatgtttactctgacaagtgacaacaaaccttcaacaacgaaacaacctagaaaacatatctgaccttattcaactacgtgacgatagagccacagaactgaccatttcgattaaaaaaaaaagtaatgatgtggttgtaaatttagtaagaggaacttgatgtgagactagtatcaacaccattcaagtgaagcctcgacaaaactttgtcgtttcatcaaactcagcaaagaagcaaatgaaagcctaatgcaggcccaagaagcccacaactcaagtttggaagcaacggtcttctgagacaaagacagaaactccagaagcttcaccaagtcacgacaagaacagagctggcacaacttcacctaatg

SEQ ID NO: 4287 - DNA, 3000 bp, Unknown
  misc_feature (1)..( 3000): cDNA_ID_1823648_gDNA_ID_1620695_Annot_ID_48659 3000 nt of promoter + ATG
ttataagcttcatgggcttaggctaggattaacattcatgggtataatttaaagttgaaaaagttgggtcataaagaggtaacacaattaaactctataaaagattatctatgaatataacatctaaagtttgtttatattattatagctcatactttttatgttatcttcgcagcttgtatcacatcattttcgtactttcaaatgttggaaaatcattttttactggcctctaatatttgtcatcaattttgactgtcgtttcactaaacatttcaaatcattaaagcaagtacctttcgagaccattattaacggttttgattcattagaaggatatattaggagaagactctaaatttgtatctatgtatcggaaaaacaaagtgcattgtaatcaaaatgtcatgtaagttaatatccaagagggataaggtgaaattggggtcatagatcattagaacttttaagcccattattggatagtgtccgccaataatcataaccgatgggtccatgcacgtagcaaacacacgcttcacccacaaccacaacaacagccactaccactaccacaaccacaaccacaaccagaacagtatagtagctagcaactcttttccttagaaaaaaatagataatacgtgtcttttagttgatttcctctcatgcatgatccagttccaggctatttagggttttgttggatcccatgcacttaattagttatctactgaaatcacaaattttcaaggttatatataaatttaatcccacattagaaaatgacacaatcttattactaaacaatacacatgatgagctaattcattcatttatatttttatatttgatcaaattttattcattacatataccaagacaattttataaataaatgaaatcgcataagcgtgaaattatgctgattagatcttggcccaacataaaacaacaaccactaattaaagagcccatatactactatatatatatggttcattttatatatgattgatatatagtgagatcaaatagattatcctactgagaagtgtgacagttcatcataccaaaaaacgatattgctggttttggtaatgagaagctttctagaaacgtggtgaagagtagtgtaggagagtaaaataatttaaggatgggttagttcgatgattccatgaacaaaattattgctttcttgcctgggttagtacccttttattattatggttgagaataataaaggataaattatacagaatatgttgcaaaaaggaatggaatataatatgaagaagaaaggtagagaaacttttgttagaaaccaaagaaggtggggaacaaaattaagaccacaaagtgaaaattttagagttgtaaagatgtagtgatgtacatcgtaataactttaggcactgggacacatatatagggtaaattaatgttatacttaaaaggaaaagcttgttcactaaataaaaggggaggttcagaattttagttagacacattccactgcatccattgaattatgtaacgaggaatttggtaaatgggttttggcttggcgtaggaagtcacaagaaaaaagaggtggcaaacaatgtcactgaatcgtaatatattcatcgcaaatgtattgacgaggatatttgtagcttatgatggttgtataatcaaacgtaaacatatgttggtaattaaatggtaatcgatgacgataatatttgttgcttcttcttcgaaatatcaatggcaaaaaacacaacgccgttagattatggactaatattaaagttgaatatcaaactcataaatgggaaaagctttaaagagtttgccgtgggccaacggaatgttgggaagagctcttgggctgtctacttagtgctatcacttggaggaagaagatgaagatgatgataataagaaagaacacatacttttattttattttcttttaaaacgaatgttttctaaattcggttgtgaagataagattccctttatgttgaatcgtggtgtgtgttgcagtcatagattcttagtatgaatgaatatactataggtttggtggttatatattgtggatttgtgtgtgcgtatgagtgggtataaaagataagggtcttttctaggtgtccccatgaaagagatttgtgtctatgtatgtaagacccaacttttcttccttttcattcaccagacatcacccaccacttcatcattgtgcacatttacgttgtatatatgcatgtatgactgtgtatacacataacacatgtaccatgtatgtatatggttatcaatgtgaatcaaagtgtcacacaacaggacgaaagtgagtataaattgatcggatttgacttatttaaagatcagtgtatcttgagctggttttattaagattaatatttgattgattatagggtatgataaacttttaggaatatttgaggttgtaacaaaactttcagaaaattttagtggctaatgatgtgtcacacacaacatgattcgtttaaagtattgaataaagtgtgggtttatggtccggcccagtaagcccagactatagcccatttagttaaagtggcacatttacgatgtgtgtgagagccttctcatctgatgtggaagaaggacaagacaaaacaaaacaaacacaacactgagcccttccgctggaaatgactattgcgaggttttttttttcctcttcccgtcttaatgaatgatgttgcactatgattgtattacactaaatcgccaaaaatcaaagcttaccaaatataataatatgtcaaaaagataaaaagttgtctgtctagtagttttccaattgtcaaaaaatatgaaaatattgacaccgtatcaaaggaaacaaacaaaacacaatatttaaaatagcacagacaaataatttaataacttatcgttacaagccaaaattacactgtaaatttggcatttcgagaagaagaagagggagtgatg

SEQ ID NO: 4288 - DNA, 3000 bp, Unknown
  misc_feature (1)..( 3000): cDNA_ID_1823644_gDNA_ID_1620695_Annot_ID_48660 3000 nt of promoter + ATG
aaatatttatgtgtaaaactaattatatgcatggtttcatttttttcattggatgtgaggaaacagaatgatgtcgaggaaagaatttactaatgggataccaattaataaaacaaaaaggattttacttatatttttcatcacggtgctcgtatttttcatgtagttctgaagaaaagagcatgaccatctcttatgatcaagattcaagattgctcaagatgagtgactaattagatttaatataagatttgaggaagaaaaactaattttgaaaacgttaggaaaaaaaaagaaagaagaagctaaaaaccaccggagatgatattaaaagttaatggtcaaaggacttaaatgactgtcggtgtctcccgccgacgccacaggcttccgtatattattattagcacaacagaaactgtgaaagagtgtggagagtacggaatttttttcttttcagaatatcgaattccaaaaacgtcctttgtcaacgttgaatattacacatctgcatccttagtgcacctgctcacacctgattttcggtggagggaacatccgcgtggcatgttgggataatctgtgtgtatgaactaaattcttaaaataaagagaatttgtaatagatgatgaccacaaaagtttcaatatttttggttagtttggatacagtcagaagaattagaggagtaaaaccaggaactgtcaatattttcaagaatgatcatcaaagattcaaaggttttttctattaaaaagttatgtattgtacaaacagagtatacacaattttgtcattttcctacactattactgcttttaatcaatgataatttacctttttcttctcctccataccacaaaaacctaatgtatggaatttacttaaaccacatttataatgttttccaaatatattattaaaaacaaatgttttccaaatgttgtaaagctaaaagatgtgcgacagttgaaactactgatatcgggaaattaaagtacaaattttctatatcaaacataatatacaaccatagagccattagtcaagcaacttaccaaagtatttgactcgtgaatacaaagaagaaattaagagtcttacgctatgtagacgttacgtacatgttaatctgttaggcaccgattttaaaccatatcagattacagcacacatcagccattagattctacataatctcaattcaattatatgtttaataaacaattacctgaagttttgagaattcggtttctctatatatagaaacaccattcttaggtatacttttctagattaatgttcgtaaacaacataacgaagcatgtccaaaacaaaacactaattagcaaaacaaaaatgctaacccatcatcaaatggctattttcacgattagtaagtttcagttacgttctagacactaaacaatatgaataatattttaatatgacaattatctaattaggctggtgagcttatctagagtttcacgttgaatgtgtttaaatacaaatctagaaaaaaagaaagaaagaagctgaaatatccaaaaatatgcgttcacacccaacaaaatgttcaaatctactcaatttaatttacatggatgatgagaaaagcaattcaaaaaaaaaaaaaaaaatcagttcaaaataaacaacgtgaaggcaccaaactagtagaaataaaataaagatcaacaatccgtacacgtgtcaacctatcaagtttggagtccagctgtctggtccccccaatatacacacacctctaaaaacttattctcgcggagatgacactgatttggccaaaataccgcgagaagttaccaatgaacgccgtttttaagagatggttttcaattttttttgtttagcttaggctattaaaaaggtttaaagttggttgccggtgatttgtgggacaacccgtacgtgattactgcggattaaccggatattgccggtttggtagtgctggtcaaccggattataccccgttataaaatccgtgcccctatcgatcgcattccctgttgttatggacggacacaccccttatttaattatcgtattaagtctgattgagatagttaattacttatattctccatgatttagattactgtttcgaataatttagattatgtagtatggaggaatgatttgcgtattttacactgagtattgcatcaaacattattgtggaattcaaattttaaaccctatgtatttaacttaattaaacattaaatcattatgaaaccaatatatatatattttagtaatatatataagttaattactccttatcatctgacgaccaaatgtctcgaatataatctgttgtcatactcgtaccaactacactgcaattataatggatacttgatgaataataacaattcaacaagtgagatttttttcatttgtaaatgcaaacaaagtaacaaactggtggttcattacaaaatcttcacaattatatatatgcttaagtcagctcaattatatgctaagtctaaaatcttcatagcaattatagtcacatggaattctctattaaagtataagaagaaagaaatggtatgaatgaagaatgatatagttagagaagtcattattattagagtagaccatctttatccatccggtacaggttttgaccaatacggaaagagagaaaaagagtcgcaatccttttttttttgttacgaaattaaaattatataattagtgcaatttaaagcacgaatagtaagcgttcacttaattcctcgattaactgattagcatattacgattatacccttcatcttccttattgtgtctctactctctactttcaccttcctttccttccattctcctctatatatatcgaccctttctctttctttcttcctcacacactaaaagcttgcaaaaaccataagcttatctacttactcatctctctcacaaatcattttctcagacttctctctttctcttaaacc

SEQ ID NO: 4289 - DNA, 3000 bp, Unknown
  misc_feature (1)..( 3000): cDNA_ID_1823640_gDNA_ID_1620695_Annot_ID_48661 3000 nt of promoter + ATG
gtatataaacaatgatgatagtcagttattttatttgtttaattactggaaatatagagaaaattgtttaagttaggttccatggaatatagtttaatatgtgtaaatgagagagacatggaagagaattgtaatgagttgctgtccagtatcttgcgtcgtgatattatttgctcttaatgtcaaccacaacgtgcctagagattatatatttgtagttttatacgtgttttataggacaaatggtggaatgattcaatggagatgcaaagttacttgtcaattggaactaaataatgcaatttaactaagatataaagaaaacatcaaacaaagtttagtggggagcttctcaatctaaagaaagtaagctcagaaagacagaaaccattgaatattcaaaacaaaaaaacaatccacagcttagcattttgttgaccgactcatataaaactaaaatgttgcgacgggctttctcgaccagacttagttaaaatccgccacgatcagtgttgctgattcagcatgtgggccggcccatggttatctgttagtaaagcttccacgtaatctaagaaaacaaaaaatgagccgcatggattaagaagataatgtacactttcaaatatatgatgaattattttcaattttgtgacaataaaataggttattatcaattctgagacagtttaaatgttacgataccttttatctgtatcttagataaacatgattcaacagatttaatatttcaatagcaaattttatttatgagaggttttaataagagcacaatggtttgtcagcattaagaagacaagctcattaagaggcaagagtaagaccaaagatatcattagccaggaatcatgatttaatgttcgttctttgaacttgactctttttttttttttaatgcattgaataagcattattgaactgcgattttcggttaaatagtacatgaatcatgaaataatgacaatggttatccaataagcaagattttggtttgattatatataaattaaaatagagacatgcaattagagaacgggcagaccaagtagtagaatattatgtcgctgcatttagttttgctgacgatgtctttgaataagggacaccaacatttgatttaatcaaataccatgcatagaaatgtcacataccaagttatagtaaatgttagtcaaacctttgatatttcgtttgtttgaagttgcaacttgcatgcaagtcataactcgaaagtcttttttttttgtttttttgggcacaactaagtcgaaagtctagaaaactgaatgtcatggataagttgatgcattccacagctatttaatttttcaaaactaactgagataaaaacatatttttgaagcaagttataacaaaacttaaactaattacacatttcgtgaactttgacaaaagtaatttgtagtagtaaatatcattaaacatacccatctccaaaaatcgaaatagtaactacaatctatactaaaaaaaactgtgtgatcaggcaaaaccagtatttgaataattccagagtaattttaagtcgagccgaccttaatctttaaagaaaaagaaagaaacatattttcgataatcaatcaaataaacaaactcaagtcacttgccgatgaaagtggtggaaatttcccataaataaacaaaggaacaaacaaacaactcctccatttccattactttactctttctatttcttaatataaacggacgattttaccctccatctctcgccgttttcacactatgagctttccacatccctttacgaagtgacgatattacccctaaaagcgaccttcctcgaagaaaccacataccaacaatctgagagattaatcgcaatttcccagacacgggaccttccctcattaatcttagctggcttccatggatgttccttctcagaaatcccaatttctcttcctttatattctcattcactcctcattctcctcctcaaatcaataacaacgataaaaaaacaaaccttccttaaccagaaccaaatttcagatttttaaacaacataagctctaatggcgtcaccaaagtcacccacaagaccaacccaacaaaacccacaacccaatttccacgattttcttcctaccatggccggaaacctaggcggtgaaggtctgatcggagagctatgcaacggcttcgagcttttgatggacagagagaaaggtgtcatcacgttcgagagtctccgacgtaacgctgcggcggttctgggtttaggagatttgactgatgaagatgtccggtgtatgattaaagaaggtgattttgactgcgacggtgcgttgaatcagatggagttttgtgtgttgatgtttaggcttagccctgatttgatggaagcgtcgcggtgtctcgtcacggaggtcattgaggaggagtttggcttcacgcgccggcattgacactggagagatttgggatcccttcctcttttatttaattcgattcatttgttacctttttcttaatttttccattaatgttaccattcacataattcttttaatcatagtacttgatactatttttacacttcagtttatatctttgatcagatgtgttgaacatatataaaataaagaaaaaaattcataaactagactggtgatgactgtatcacaatatcgatttgtagcacacacaaaaaaatcatcatccttaagcactatcaatgatgtgttgattataatgcttaatctttccatgaataaaaggagatatgttaattaggagctatctagtcaagcttttacaattaaggtggtttactggatcaaaaataagttaaggggcagaaatataaattaataagttttgggtcgttgactaaaaattctcgaagagctagctataacaacaatttggagctagattttctgcgaaaacaaaaatcagaaaagctttcagaggatcgagcgcacttcttcaatg

SEQ ID NO: 4290 - DNA, 3000 bp, Unknown
  misc_feature (1)..( 3000): cDNA_ID_1823636_gDNA_ID_1620695_Annot_ID_48663 3000 nt of promoter + ATG
tttttgttttcgcagaaaatctagctccaaattgttgttatagctagctcttcgagaatttttagtcaacgacccaaaacttattaatttatatttctgccccttaacttatttttgatccagtaaaccaccttaattgtaaaagcttgactagatagctcctaattaacatatctccttttattcatggaaagattaagcattataatcaacacatcattgatagtgcttaaggatgatgatttttttgtgtgtgctacaaatcgatattgtgatacagtcatcaccagtctagtttatgaatttttttctttattttatatatgttcaacacatctgatcaaagatataaactgaagtgtaaaaatagtatcaagtactatgattaaaagaattatgtgaatggtaacattaatggaaaaattaagaaaaaggtaacaaatgaatcgaattaaataaaagaggaagggatcccaaatctctccagtgtcaatgccggcgcgtgaagccaaactcctcctcaatgacctccgtgacgagacaccgcgacgcttccatcaaatcagggctaagcctaaacatcaacacacaaaactccatctgattcaacgcaccgtcgcagtcaaaatcaccttctttaatcatacaccggacatcttcatcagtcaaatctcctaaacccagaaccgccgcagcgttacgtcggagactctcgaacgtgatgacacctttctctctgtccatcaaaagctcgaagccgttgcatagctctccgatcagaccttcaccgcctaggtttccggccatggtaggaagaaaatcgtggaaattgggttgtgggttttgttgggttggtcttgtgggtgactttggtgacgccattagagcttatgttgtttaaaaatctgaaatttggttctggttaaggaaggtttgtttttttatcgttgttattgatttgaggaggagaatgaggagtgaatgagaatataaaggaagagaaattgggatttctgagaaggaacatccatggaagccagctaagattaatgagggaaggtcccgtgtctgggaaattgcgattaatctctcagattgttggtatgtggtttcttcgaggaaggtcgcttttaggggtaatatcgtcacttcgtaaagggatgtggaaagctcatagtgtgaaaacggcgagagatggagggtaaaatcgtccgtttatattaagaaatagaaagagtaaagtaatggaaatggaggagttgtttgtttgttcctttgtttatttatgggaaatttccaccactttcatcggcaagtgacttgagtttgtttatttgattgattatcgaaaatatgtttctttctttttctttaaagattaaggtcggctcgacttaaaattactctggaattattcaaatactggttttgcctgatcacacagttttttttagtatagattgtagttactatttcgatttttggagatgggtatgtttaatgatatttactactacaaattacttttgtcaaagttcacgaaatgtgtaattagtttaagttttgttataacttgcttcaaaaatatgtttttatctcagttagttttgaaaaattaaatagctgtggaatgcatcaacttatccatgacattcagttttctagactttcgacttagttgtgcccaaaaaaacaaaaaaaaaagactttcgagttatgacttgcatgcaagttgcaacttcaaacaaacgaaatatcaaaggtttgactaacatttactataacttggtatgtgacatttctatgcatggtatttgattaaatcaaatgttggtgtcccttattcaaagacatcgtcagcaaaactaaatgcagcgacataatattctactacttggtctgcccgttctctaattgcatgtctctattttaatttatatataatcaaaccaaaatcttgcttattggataaccattgtcattatttcatgattcatgtactatttaaccgaaaatcgcagttcaataatgcttattcaatgcattaaaaaaaaaaaaagagtcaagttcaaagaacgaacattaaatcatgattcctggctaatgatatctttggtcttactcttgcctcttaatgagcttgtcttcttaatgctgacaaaccattgtgctcttattaaaacctctcataaataaaatttgctattgaaatattaaatctgttgaatcatgtttatctaagatacagataaaaggtatcgtaacatttaaactgtctcagaattgataataacctattttattgtcacaaaattgaaaataattcatcatatatttgaaagtgtacattatcttcttaatccatgcggctcattttttgttttcttagattacgtggaagctttactaacagataaccatgggccggcccacatgctgaatcagcaacactgatcgtggcggattttaactaagtctggtcgagaaagcccgtcgcaacattttagttttatatgagtcggtcaacaaaatgctaagctgtggattgtttttttgttttgaatattcaatggtttctgtctttctgagcttactttctttagattgagaagctccccactaaactttgtttgatgttttctttatatcttagttaaattgcattatttagttccaattgacaagtaactttgcatctccattgaatcattccaccatttgtcctataaaacacgtataaaactacaaatatataatctctaggcacgttgtggttgacattaagagcaaataatatcacgacgcaagatactggacagcaactcattacaattctcttccatgtctctctcatttacacatattaaactatattccatggaacctaacttaaacaattttctctatatttccagtaattaaacaaataaaataactgactatcatcattgtttatataccaacttcgtttccacgctctctggttccacagaaccggcc

SEQ ID NO: 4291 - DNA, 2319 bp, Unknown
  misc_feature (1)..( 2319): cDNA_ID_2170409_gDNA_ID_1620695_Annot_ID_164931 3000 nt of promoter + ATG
gtctagtttattcttcctgttttattatgtgtcgactggtgtcaaaagaaacgtgttgattgtgaatttgtagacgccactctgtaaatttatttaaaataaactattttacttcacgttgagatcgggagttgccgggtttgtgtgccttatctgggcatcacccacacatgcattaagttgaaatgtatatgactttaaaaacttgaaacttcaaaaataaagaaaaagtctttagaagttacgtccacacgagcgtgatccacacttatcggtccttatattaggagcattgtaacttgctgcaataagctgctcattttattaatttgacttttggaaatcttaaaacaacaaaagtacattgtatatattaatagccggatccaagagtgtgatgcttaacatcttttgatgtcttaattaagttgggttttgaagtcagtgttcaaatagaagataacctttttatcaatttacgctaggctctaaatgattactgcgtatttggagcacaacaaaaatataatggttttcttaaggattagataatctggtacatgtaaataactgagttacaattactttctttagaatttggttcttaattaccttattcctctgttttattttgacaaacatataaattttatacgtacacaaaacataacaatatacttttaatatctgtaattcttagcaaactgagtttgtattggtaactactttctgcagacgagtccatagccggaagacgcaccacggctgcaatctaacaatgcgtatgtacttttgggcttgacagagccactcgcaacggcgggatcttcagagaacaaacaagttttgcaaacatgagagagcagagaagatgtcctaaagctatcttcacctcccaccactggcattacgactcctggtttagccggattcttaaaatcgggtctataagtgcgtcccaagattccatcgacttttggggacagattaataaacttgaactggacctcaaaatgggcaaaacagtcatctacaggtaatttgtagttgtggattctatcatcttctttggtcactggaaccacgttgaccatgatctcagctttgtctttgatagtcacgatcacactgttcttctctgtcaacctttcaatcttgatgtctttgtcggatgagtacctgataatatgcattaaaataatgagtgtttacatgaaaatctaaacgaatagacaaagatgacgtttaaaagttgaaacaatcgcaacctacaaaaatgatagggtaaaatttgagtttctatgattaccaagtggataaagtttcttgagggataattaaatcttggccgtcgatagtgaacttgaggtgatcaaggttgctgtcccaagtggcgactttggtggtctcaagggagaatttgtgggagttaaagaggaagccgagagcttggatccatgtaaagtctctagtgcggccagcaggtctatgaccagtgaacctagcattgatctgaaagtcagggtccgagacaatgctaaaatgttcattgctctttccatggaagtagaacacaattccatcaccacctatgaacctcggatctagacaaattgatccataggattcgcagttgggttttaccgctacaaaagatcatatccaaatcttaaaacatattttcaaaatctaaaattaatcaaaatgatgaaattctattaattctaattttaaactgcattggtatatcatcaattacaaaaagaaattggtggttaaataattaccccgacacacggcctcgcaaaggggtttaaagcaatcaacccaacaaattttgttctgagagttggggaacatttcggtagggcactcttcaggacagtcgatgtaccggagctggcatcggggagtcgcattgccaccacaataagtctgaccatgccaagccttgacatgcaagaaacatgaagctaccacaaaaattatcattagcaatgaggattttgggacctccatcctcgttttttttttttggctgaagtgtggaatctatatggattagagaagaaggtagaagattgtgttgggatgagttttcgattgttagtttataaggttgataaaagtcaaatatttttcttcggaagagggctacctttgatggtttctttttgttgagaacgcataaatttctaaaagtcgtatatacatccaaaaaatgaacatgggacaaatatactattacactcgatcttaatacatgtatataaaataaaataaaatcaatcggttttcatcaaactctaatgcaacatg

SEQ ID NO: 4292 - DNA, 3000 bp, Unknown; identical to SEQ ID NO: 3815
  misc_feature (1)..( 3000): cDNA_ID_1013540_gDNA_ID_1620695_Annot_ID_164930 3000 nt of promoter + ATG

SEQ ID NO: 4293 - DNA, 3000 bp, Unknown
  misc_feature (1)..( 3000): cDNA_ID_2050952_gDNA_ID_1620695_Annot_ID_164929 3000 nt of promoter + ATG
ctcaaccattctcaggtaataagatgattcttccattttttccaatttatctaagtatatctcttttcaaagcatttagcattgtgttttcttatcgtggaaaatgcagtcgtggatgataagtttgttaaggaaccagtgaaattctccaaccaaactactgcttttggacaagacttaaatgggttttcttctaaacctaagaaaggttacttacccaaatttttgttttacttctgcgcaaatcaagtaaccatatctcttgtatatcaaatggtgagattaagtgtttgaatgtgcaggaaagggttcctcaacagcagtcgtagacatagaagcagaagtaacagatgcagactgacaatgcgaaatagcgcatatatttcagtagaccgagccaaggtgatttggtagagacaacaaatcttgtgtaaagagctcattgttggatataaaagtagtatagaatacacgcccatatgtatatgtctttgacattgttatcacactttgatctttgaatgattgtttaatgttaaaagtagtagtctcgcatgtacgcctgtttctttgttacttgagatatgactttatgaagattggaaatttgttaagaaaaccagtcttgctaaagaatatattttaccatctggtcaaaatccataagcactcgtaacttctataggtcgataacttaaggagattacaaaattgcaaaagctctttctagaagaaaacataaacgttaacaagaccaaaatagacaaatcgaactatcaaaaatttataactgttttccttcttttgtagccttttaaccaaaatcactcgtacaatttcttggccgaaagagttctgagggttttggttttgtcctttgtagctttcgcttcatacttctcgctcaacgctatagctttagccacggctttcatcttccttgcattctttgttctcttcatgtttgtcctatagaaatcaagaaatatcatcacgattagaggacagcaaagggtaaagaggtccaaagaaaacataaagataagccagaatgcagcttgttctccgaacaaaatggtatacatatgttctaaaactatccaatataatcatcatgtcttggtacattccacttgaggaacgtaacaaaacgataaactagtttacaagcaaaacttatccaagattctctcatgcaccagcttgcatatgttttctaagtgttatgacagtagcaaactacatgactccaggtccaacctcaaaggaccagaacagagcaattcccaatggaaatttctaacgaacctgagacttaaataatgtaaacctagctagttgacaaattttcccgtgagaaccatgagtccataactggccaaaactactaatcgaatggctaacgagaaatcaatattacaaagctaaagccggtctcaaaacaattgttctatagaagagtacggaattgtcaaaaggcttacgggttacgagaaagagtagctagtttcaggtatccggtttccgtagctactttcaagtctccggtttccgtagctagtttcacgtcaccggtttccgtagtgtccatggctaacgaaaccaaagaagaaaaatcaaaagagtaaacacctgaatctcaaatcttaagaagatgaagaaacgaatatggaccaaaacgtgataaaagaattcgctattttactacctacagccacagctttcatattcattgcaatcttcgttctcttcatcggttttcctttcctcgtgctcatcctaaaaaaaagaaaatcatcaggattaaaggaaaacacaaagtaaggagatccaaagacaccataaaacaagtaaaaaatggagctttttctccgatcaaaatggtataatatatgttctaaagtaaccaaatttaagaatttcacgccttagtacataaatctaactaaatgataaaccaatttacaagaggaactagtcagagattctctcattcaacatgttgcataatggtctcctaagtgctaaactaatgtggaaacttgagctgcttgtaaaccattacagtagcaacctacatgactccaggtccaacctcataggacaagaacaaagcaattcacaatggaaagttggaaacttgtgaccaagagaaatacaactagagacttatgtaatataaacacaactagagactttcgaagaagcttacaagctacgagcacgagaagctagtttcccgtcaccggtctccgtagtgtccatcactaacaaaaatcaaacaagaatcttaagcagatgaagaaacgagtatgtaccaaaccaagacgcgaatttactttactaccttgaggagtagcttcagagacgctctgagattcagaaacgtccatggaagcttcctcgtctctattcttcttgttcctcttcttcgtcattgctgattaggtcagacgcacgacggcacgaagcaaagcaacgagagtagagagacggaaatcaatcgaattttagaatttcacctaatgctctgtgtcgggtcaatttactaattcgtgtctacttattgggcccatagttttggtaaaggcccatttatccactaatggataataaataaataacagcccgatgatgatcatcatctacctaattagagtttcattgtctctgtattttcaaattctctctcttatgttatgtattccgttggaatggcttctccttggcgaaattcagtttctttatttgaggtttgttgctgtttttagtgttattatttttagcccttcttgaatttctagttacatgttacaatgttgagagagattattattcaataaaattttcagattttctggtttcgagattcttctgctggcttttaaggaactcacattacgcgaaaatgggtattgattcaagacaaaaacgaaaaagtttgaatttttgttggtgggtggattttgaggtttatcggcgtctcctccgactacaatg

SEQ ID NO: 4294 - DNA, 3000 bp, Unknown; identical to SEQ ID NO: 3816
  misc_feature (1)..( 3000): cDNA_ID_2170393_gDNA_ID_1620695_Annot_ID_164926 3000 nt of promoter + ATG

SEQ ID NO: 4295 - DNA, 3000 bp, Unknown; identical to SEQ ID NO: 3817
  misc_feature (1)..( 3000): cDNA_ID_1823625_gDNA_ID_1620695_Annot_ID_164921 3000 nt of promoter + ATG

SEQ ID NO: 4296 - DNA, 3000 bp, Unknown
  misc_feature (1)..( 3000): cDNA_ID_1823629_gDNA_ID_1620695_Annot_ID_164918 3000 nt of promoter + ATG
gaagtcctgacgtgacatggctcagtcaacgcaaatactactcaacttagagacgtagctggcctgtatctaattgttttaaggcccatatacggcccacgcttccattttcttaagtatgcttttcgtagtggactgaaaccttttcttgtctattttctccaagtcgattccttgatgatcgatcgagatgaacctctatcgaacagaaacttcgtttctagaaattaaataagcctccatgaacaacagttttttcttttttttttcttttggctactagtattcaaaatctttaacatattcgcaaatttgttaataaaatgtatttcactaggaaaatagagattggaatttggaggcgaaaaaacattagtttacaacaatagtagttgaagccaagatccagagttttcctattgattttaagggtccggtttattgtaatttccgactattttttagtggaccaattatttggcaagtaagaagtttttttaaaaatatagaccatatgtgtataatagtgaccggatggcccaaactgacatgtaccaatagaaaatgaagacctaattttggcacatgaacgtaacaggtataagatcatcgttgtctctagcgagagagctctgtaatgcttacacttcaacgtggagactgtaagagatacgtgtaccaagaaacgtgaacgcaaagaaggaaaggaaagaaaaaacgtgtacaaaaagaggcccatgttaatcatcatcccttaggccttcttagcttatgcattgtctctttgctagtctttttctcacaatcgtgtcgatatattttaagggtttttaacgtgtggtttttctgtagggagcattagtagaattattgattggttttattcaaatatagaatatatatatatatatatatatacataaaacatttattgatggatcattgaatgttcatttgttcgttacaacattttcttattcaaattttatcgatccttgaatcaaagactttgacataagcgaaaccattggttacttctctaaattaaaatgaaatggtagtcttctaataaatatatatgtttaacaaacaaattggcataatttgatcgttctaaccaaagataggatttcgaatccaaattggatgggatgactagactattagatatttagatcgatcaccaatcaaacaaaataggcgtgcttttatattcattaagctggtttaaaacaacaaacaatccagcatttttaattttagtggttgaatagttaagttaataaaatcaaagataaacagaaaacaaacagctagtttttcaaattttggcgtttaattttatttggaatatttttttttaataaaacacacaaaaaaaaactcttttgacaaaaattggcatcaatactgcatatcgcatagccccatacatacatgatacatgccacatctcttaaaagatgagaacaagaagggatgtatttgaactattctgacaatattatatatacacacacattttgaatatgaatctctcttcttcaaagttctgacttgttccaaaattcttatccacacaatggaggaaaaaaagaaaaagaaaagccacaataatgagccataaccacaaccacacccactcaccagagactttgtgtatccgtggctctcatcatgacatctcatcttcctttgattcttcacaccaccgtcgatcgccacgtaggatttccccaaatcaaagcattccacataagcacaatcttttatgtggccagagtttaatcaacatttgtttttcttacaatgggttcgtgagagccacaaataaatcaactatacgattaaataaccatatctaacaaaaaaaaaaaacattaaacaattatagtccaagtaaacaaatactcgcctactatgtaccatattagaaagttttttattctcccccaataccgatatattattttgtaatttaaaaattcattgttatcttatcctcgcaagaaacacagatgttttggatcagtttgggaagcgaagaagtatgggagagaagtaaaaaacaaaacaagtggtttataaaaaaagagggaaagataattgaacaaagatacgtggggcccattaaacttgtgttatggtccagacaaatcccaggtgggctcacgtggctacgaagcccattgagaacctgattcgtccacgtaggacgggacagaatctcgctctcctccttccccggctgagatctcgccacgtcatcgactaaataaatctctcccaaaaaaatatctcgaaactgaaccatgagtttgtcgccacgtacaaacggggtttggctttggcccatacgcattaataactggttttcaaaaatcatttaaacttatttatcctaataacgcataattaatgtgttttacttaaactgtaatgattctaagtagaaaatgtgaaacagtattttttatccacaagaaaaaataaaacacaaggataaagctaaaaacaataaagaaaacattactgactcaagtaatttaaataattgcagcagatatagatctgataattatccaaacaaaaatctcaaataaaggttaaagtgataaacccatctctaaagcaaaaagatttttaagttgaaccaatccttaattgattaaatactatacgttattacaaagttaaattgaaatgaaatggatactaaccacagaataaaaaaaaaaggaaggtgctatataaaatagagtcattgtgaaaccaaagaagagaaatagattttttagcagaaggcagaaaaagacgaaactagcctccaaagaattgttgaatcacagaaaactcgccacgaaaaatatcccaaatcctgcaacttgcactttcctattcttcttcttctttccttatctctccaaggaaccaaagcatagacacaaaacgaacaaccacagaaacttgaaagagagaaagagtttgattttgattaaa

SEQ ID NO: 4297 - DNA, 3000 bp, Unknown; identical to SEQ ID NO: 4289
  misc_feature (1)..( 3000): cDNA_ID_3072959_gDNA_ID_1620695_Annot_ID_164913 3000 nt of promoter + ATG

SEQ ID NO: 4298 - DNA, 3000 bp, Unknown; identical to SEQ ID NO: 4288
  misc_feature (1)..( 3000): cDNA_ID_1823644_gDNA_ID_1620695_Annot_ID_164912 3000 nt of promoter + ATG

SEQ ID NO: 4299 - DNA, 3000 bp, Unknown; identical to SEQ ID NO: 3813
  misc_feature (1)..( 3000): cDNA_ID_2050942_gDNA_ID_1620695_Annot_ID_164932 3000 nt of promoter + ATG

SEQ ID NO: 4300 - DNA, 3000 bp, Unknown
  misc_feature (1)..( 3000): cDNA_ID_1823632_gDNA_ID_1620695_Annot_ID_48664 3000 nt of promoter + ATG
ttattttttcttgtggataaaaaatactgtttcacattttctacttagaatcattacagtttaagtaaaacacattaattatgcgttattaggataaataagtttaaatgatttttgaaaaccagttattaatgcgtatgggccaaagccaaaccccgtttgtacgtggcgacaaactcatggttcagtttcgagatatttttttgggagagatttatttagtcgatgacgtggcgagatctcagccggggaaggaggagagcgagattctgtcccgtcctacgtggacgaatcaggttctcaatgggcttcgtagccacgtgagcccacctgggatttgtctggaccataacacaagtttaatgggccccacgtatctttgttcaattatctttccctctttttttataaaccacttgttttgttttttacttctctcccatacttcttcgcttcccaaactgatccaaaacatctgtgtttcttgcgaggataagataacaatgaatttttaaattacaaaataatatatcggtattgggggagaataaaaaactttctaatatggtacatagtaggcgagtatttgtttacttggactataattgtttaatgttttttttttttgttagatatggttatttaatcgtatagttgatttatttgtggctctcacgaacccattgtaagaaaaacaaatgttgattaaactctggccacataaaagattgtgcttatgtggaatgctttgatttggggaaatcctacgtggcgatcgacggtggtgtgaagaatcaaaggaagatgagatgtcatgatgagagccacggatacacaaagtctctggtgagtgggtgtggttgtggttatggctcattattgtggcttttctttttctttttttcctccattgtgtggataagaattttggaacaagtcagaactttgaagaagagagattcatattcaaaatgtgtgtgtatatataatattgtcagaatagttcaaatacatcccttcttgttctcatcttttaagagatgtggcatgtatcatgtatgtatggggctatgcgatatgcagtattgatgccaatttttgtcaaaagagtttttttttgtgtgttttattaaaaaaaaatattccaaataaaattaaacgccaaaatttgaaaaactagctgtttgttttctgtttatctttgattttattaacttaactattcaaccactaaaattaaaaatgctggattgtttgttgttttaaaccagcttaatgaatataaaagcacgcctattttgtttgattggtgatcgatctaaatatctaatagtctagtcatcccatccaatttggattcgaaatcctatctttggttagaacgatcaaattatgccaatttgtttgttaaacatatatatttattagaagactaccatttcattttaatttagagaagtaaccaatggtttcgcttatgtcaaagtctttgattcaaggatcgataaaatttgaataagaaaatgttgtaacgaacaaatgaacattcaatgatccatcaataaatgttttatgtatatatatatatatatatatattctatatttgaataaaaccaatcaataattctactaatgctccctacagaaaaaccacacgttaaaaacccttaaaatatatcgacacgattgtgagaaaaagactagcaaagagacaatgcataagctaagaaggcctaagggatgatgattaacatgggcctctttttgtacacgttttttctttcctttccttctttgcgttcacgtttcttggtacacgtatctcttacagtctccacgttgaagtgtaagcattacagagctctctcgctagagacaacgatgatcttatacctgttacgttcatgtgccaaaattaggtcttcattttctattggtacatgtcagtttgggccatccggtcactattatacacatatggtctatatttttaaaaaaacttcttacttgccaaataattggtccactaaaaaatagtcggaaattacaataaaccggacccttaaaatcaataggaaaactctggatcttggcttcaactactattgttgtaaactaatgttttttcgcctccaaattccaatctctattttcctagtgaaatacattttattaacaaatttgcgaatatgttaaagattttgaatactagtagccaaaagaaaaaaaaaagaaaaaactgttgttcatggaggcttatttaatttctagaaacgaagtttctgttcgatagaggttcatctcgatcgatcatcaaggaatcgacttggagaaaatagacaagaaaaggtttcagtccactacgaaaagcatacttaagaaaatggaagcgtgggccgtatatgggccttaaaacaattagatacaggccagctacgtctctaagttgagtagtatttgcgttgactgagccatgtcacgtcaggacttcacctgtgggtcgccaacgattggctatatccaccagatcaataatgcaatgcatgaattttacttgaatcgtcgcaatgtacatatcaaactatcaatgatctgattctgaccactcgctcccttatatggtgactaagtcaaggaagattagccacatctatttattgcttttgtccttgctaggcttatacactcttaatctgagaaacttccaacatggccatcaaaacttaatgaggaatcatatcttgtctctggcgttcaaacaaaacaccctaataattttttttttcattctgaagaaaagttttatcattgaagttcaacatccacagacaatctgcattgaatttatcttgacttgtcgcttatgccaagttgggttgtacgaagttgacaaaaaaaataaaaaaatctgtatgtgattttcataatgtgtattataatgattgctttatttagtaaagagtcacaaaactagaaagaaaaaaggtttcattcgatg

SEQ ID NO: 4301 - DNA, 3000 bp, Unknown; identical to SEQ ID NO: 4296
  misc_feature (1)..( 3000): cDNA_ID_1823629_gDNA_ID_1620695_Annot_ID_48665 3000 nt of promoter + ATG

SEQ ID NO: 4302 - DNA, 3000 bp, Unknown; identical to SEQ ID NO: 3817
  misc_feature (1)..( 3000): cDNA_ID_1823625_gDNA_ID_1620695_Annot_ID_48667 3000 nt of promoter + ATG

SEQ ID NO: 4303 - DNA, 3000 bp, Unknown; identical to SEQ ID NO: 3816
  misc_feature (1)..( 3000): cDNA_ID_1823622_gDNA_ID_1620695_Annot_ID_48668 3000 nt of promoter + ATG

SEQ ID NO: 4304 - DNA, 3000 bp, Unknown; identical to SEQ ID NO: 3815
  misc_feature (1)..( 3000): cDNA_ID_1013540_gDNA_ID_1620695_Annot_ID_48672 3000 nt of promoter + ATG

SEQ ID NO: 4305 - DNA, 3000 bp, Unknown; identical to SEQ ID NO: 3813
  misc_feature (1)..( 3000): cDNA_ID_2050942_gDNA_ID_1620695_Annot_ID_48674 3000 nt of promoter + ATG

SEQ ID NO: 4306 - DNA, 3000 bp, Unknown
  misc_feature (1)..( 3000): cDNA_ID_1806998_gDNA_ID_1620698_Annot_ID_48720 3000 nt of promoter + ATG
tccaataattctatcagagattatcatataaattatactattacttattagtacaatgaaaattaagagtatttattatattcaacaactccttctttacgaattacgacccagtagaatttgtcaataattatattttttatatatatatttcacttatgaactttgagagttatcgtcattcaaagttataatttcatttggttttagtttcatatctctttcatgttaacttcttttgtctgcactaaaacatatatatattttttttattgtccgcgtggtctttgatatatatagtaatcattttcaaagccgtcaaatttttcacttttgattttgaatatagaggaacctgttgacccaaaaaaacagattatgaaggaacttaggaaatttcatacaagttgatcttaaaaattaagcaagaaaaaagaataaattaatgcagtcattccttaagcctacaatataaatgttcacactcccttgttctatctccaacacaacacaacacaacacaaaaaatccaacccaagaaccacagtgagatctttctcagaagacaaaaatgggaacagcgtcgtctaagtctaacatcaacctctcgcaggtcctcaacactgaggagccgtacagctccgtgatgctggccgtcgctgctctcttggccgttgtatgctacttatggattcaggggaagtccaagtccaaaaaggaacctccactgcctccgggaccttggccacttcctatcgtcggaaacctcccgttcctaaactctgacgtcctccacacgcaattccaagccctaaccctaaaatatggccctctcatgaagatccacctcggttccaaacttgcgatcgtcgtctcttcccctgacatggctcgcgaggttctcaaaacccacgacatcactttcgccaaccacgatctccctgaagtcggaaagatcaacacttacggtggtgaagacatcctctggtctccttacggtacccattggaggagacttcgtaagctctgcgtcatgaagatgttcactaccccaagtctcgaagcttcctactccactcgccgggaagaaacccgacaaaccattgtccacatgtcggaaatggctcgtgaaggatcaccagtcaacctcggagagcaaatatttctttccattttcaacgtcgtgacaagaatgatgtggggcgccactgttgaaggagacgagagaacgagcttaggaaacgagctcaaaaccctaatatctgatatctccgacatagaagggattcaaaactactcagatttctttccgttgttctcaagattcgatttccaaggattggttaagcagatgaaaggccatgtgaagaagcttgatctcttgttcgatagagttatggagagtcacgtcaaaatggtgggaaagaagagcgaagaagaagaagatttcttgcaatacttacttagagttaaagatgatgatgagaaagctcctctgtccatgactcatgtcaagtctctcctcatggatatggttcttggtggtgtcgacacatcggttaacgcatccgaattcgccatggcagagattgtgagcagaccggaagtgttaaacaagatccgactagaacttgaccaagttgttggcaaagacaacatcgttgaggaatcacatttacctaagcttccttacctacaagcggttatgaaagagactcttaggcttcaccctacgcttcctcttcttgttcctcacagaaacagcgaaacctcggtggttgcgggatacactgtgcctaaagactccaagattttcatcaacgtttgggcgattcatagagatcctaagaattgggatgaaccaaacgagttcaaacctgagaggtttttggagaattcgcttgatttcaatggaggtgattttaagtatttgccttttgggtcaggaaggaggatttgtgcggcgataaacatggctgagagacttgttctgttcaacattgcttcacttcttcactcttttgattggaaagctcctcaaggacagaagtttgaggttgaagagaagtttggtcttgttcttaagttgaagtctccacttgtggctattcctgttccaaggttgtccgatccaaaactctacacagcttaagtaagaaggatgttgaattgagttttcttgtttaaagtttacttttctttatctgtgtctggagttttgatgctttgtataaaagatgtgtcaagttacatttttgataacatttaatataacaaagttttacttacaataataacgcctaatagtcgatgccaaagctataaaactatattgtagttatatttttggcaagtcgattaaaattcttgggtcaacaaattacaaattagtatgaaggttacaaattaaaattgtaattatttaaattaattaatgtataattatatcacaaatacttcacgtcacactaaatgagtccttcttagcggcaaaatatgcgttattgggctaggcccatttataaacgacgccgtttacacagtctagaaactcaacatcgtcgtttctctcccggcgactttatcgccgtctttttcttctttaaactctctggctaatttcgttttgctttgagcttgtgagctacttctgattccggccatcacgcagcttcaggttagtttttgatttaaatcaaacaacagtacatgggttcagtgtgttgtgtctcgaatggaattggtttctgtgtttagattagggtttagggctctttcatctaaggaaacgaaacctaggttatacgaatctctttgttgggtctctctcaataccaataccaatcaacgaaaggattaattttgttcatcatcttcaacgtctaaggctataatttgtgttagttcaaattgattcagaataaagtttggatttttacttcacctagtcctgaatttgttgttctctgtgtagaaagtttctgtttttaaatcaaagaa

SEQ ID NO: 4307 - DNA, 3000 bp, Unknown
  misc_feature (1)..( 3000): cDNA_ID_1823797_gDNA_ID_1620698_Annot_ID_48721 3000 nt of promoter + ATG
gatgttggttgagatcacagaaagagcgatggcgcattgtgacaagaaagacgttttgatagttggcggtgttgggtgtaacgagcgtttgcaggaaatgatgaggactatgtgctcagaacgtgatggtaagctgtttgcaacagatgaccgttactgcatcgataatggagctatgatcgcttacacaggtctactcgcgtttgttaatggtattgaaacaccgatcgaagactctacctttacacaacgatttcgcacagacgaggttcatgcggtgtggcgagagaaagaagctgtactacttggggataagaaagttgcagcgaattgagtctgtccccatttttgttcatttttcatcaaatttgagattgaatctctctctactcgataaattggtttttgctaagtagttaagacttttaaatgtgttttattagccaaattatatgattgatatcttttggtttgaatgtaataacactttcaaatttcaaagtgagctttgtaaaaagttcaaatgtttcttgtgttgcatttcgctatttgttttattgctttaataaaaatatgatatctcaaagtcgacatttctaccgagaatggtggagagattagtgcattagtcttccttaatcatacaaaaacaactgtgaaaatacagcactactaaaaagtaaaaagtaagaactttttaatgtagaacgtatgagatggttcaattaatcacaagacacttctatggcattgcgtattaaacgaaaagtgagtaaatagaatttatacataatgatctaatcttgatcttgctaataaaaattgtaaaggcaacaacaagttgtcaaaaatttcaatttgacgtagagataaattctatctaataattttgtaaaaacattcgagatatagtgtatcatttttccatcatctagaactcatttgcgtattttcaagtgtaaatcagaaccttgacacataggctacacaaattttggtcgatatttatattacttttgtagcataatgtggatatccttctagagactagagttctagataaaacattcatacatgtaactatgtaagtaagcatgcatactaaatataaaattttcaaaagttttaaaagacatcatatagattcaaaaagacgtgggaaaaaggagaaaatgacaaaagttattagtaaaacaatcaagtaaaaggtcaaagtagttaacgaaaagataaaagtatttcaaaagtcttccttccatcttgaaatgccaaaaaataaaagacgaatgattgaagataaatcaaagttgtctgattgctattgtatacatctttttttttgttaaaactattgtatacatctaaaaaaccttgaagtaatcaagatctgaattatagccgttgataaggttttatgctttcacattgaactcgatcgtcgtcgtcaaatctactagtctcgttttttagttttaacgtgcttaattacttcactaatttgttttttgttatcattttcaccaattttattcattgtgtgaattaagttttgtccacatagtaagattcatcagtataataggacatatgataaaagtttgtatataatcaaagagtatatctaagaatatctaattaagatgaatgtttcagtccacattggattctgcttatagtcaaactgtcttgttcttaaacccaattaggttagaatacatgtaccaacaaatagcatttctataactaatcttttatcaatttactttatagcctacaaataattagaggaaaagaaaagagagttagtggaataattgtcctctaaatctcgatatcatcattaactaaatactatatttagaccatatatactatattttatagtatactatattttatagtatatataatcaactaatcatattagaccactattagaaatatggatctaaaaaaaacattctttaatcagtactattctcatccaaagacttgttttaagagactaaatatgaatatgtgtatgtgtatgtgtatgcaggagtagacacgtgcacgtggcacatgcagggaatgggaaggtggagtgttgacaaagaagaagaggatgatccaagtttcgaaatgattccaaaagttatgaactataagccaaagtgctcaatcgccaaacatgaacttaaataaacttcactcgttagatcgttttctcacattaaagccgctctacacttttacccattttaccatttataataaccaccacacatagatattaagttctatggattttattcgtaaacttaagttatgatcaaatagctaaatgattttgcgatttgcccgagttctgtttgtttctaaaatggttatccaaaaagcatatttttgttttatatagaatttgtgatatagaagaaatatactaaaaatgttttaaagtctgtctaaatcataaaccaatgcaaagaaagtgaaataaaccaagatctcgagcaatagacataataaataaacaaacacctaataacatcacatccccactaacaaatgtgaacattaactgttaaaaatcaccaaaaaagtcatcaagatttggctttccttttcaaaagcagtatacgtctctgtctcacacagacagtgtattcaatgcgttgtgttgtcttcccacttttcaccagctgaggttctgcttctttctcttcttctctccaaaacaagaaaattctgcagaataacttttcattcacgagagtggaaggttacagttttccaaatccgagaaacagacacaaaattggtccctctctaaaagttactatcttcgtttaacaaagagatagctcccaatccagtacaaaacagagtactctgctctataaatttcgttcctttattactctgctctataaaacagattattctgctctataagagagatagataaatgagctaaagctcagtaatttctaaacagagagacaagaaaattcaaga

SEQ ID NO: 4308 - DNA, 3000 bp, Unknown; identical to SEQ ID NO: 4069
  misc_feature (1)..( 3000): cDNA_ID_2051015_gDNA_ID_1620698_Annot_ID_164980 3000 nt of promoter + ATG

SEQ ID NO: 4309 - DNA, 3000 bp, Unknown
  misc_feature (1)..( 3000): cDNA_ID_1823785_gDNA_ID_1620698_Annot_ID_164968 3000 nt of promoter + ATG
ttaataaacatattgtaatttaattaggaaaaggtgaaaagttgcatgattaaatgactttattattaaactgattttcttaaacataactagaaaactagaaagtagaaatcgaagaatacattttctttaattttaattaaaatagctgaaaattcactaactcatgatttctttgatgtttttttaatagctcacgatctttttctataaatgaatagtcgagaaaaaatcacatcatactttactaatatgttgatcatcaatcaaacgtgaataagagaatctcgttaattatctggagcttccctacaagattgggaaatcttaagaataagtaataacttctcataatgaaactatttacaaaattgaaaactagagaaaatctataaattgacaattaaaggtagttgttgcacctattttttttttttttttgaacaatttaactcaaattttttgaataaaaacacaacaactatactcctaattttggtatatgatcgtgatcaggcagttagttgtcgctgtaatcatcgaattgtaaggtttatttaaatcataaaaattcatcttctacatatcctaaaaatattggctacagctgtaatgtaagaacgatataaacgtattatattgataaaagtgattagaagatgtcactatcttataaatgtgtgagtcaaatattaagaaaagtgaattataagaaattggccggttcaaatgtctgaacttacaagccaaataatagtcccacgccacactcttctctttgaaatgtctttgacaattactaattttttaattcatactcttcttaattgcgactttcactttaaataaattatctcactcattagtatcagatgtgaatgggaattatataaagataatggaagcatattattttaatttttattactgtaattctgacaagtgagaagtgagaactgttgcatgcagtgactacatgttctgtctttgaccaaatcctaatcctctctatctgttctctaatatcctcaagattttttaaaagaatctaactcgacctatatcgacggctcagatctgacactataaataaaaagatccatacaactaagtgcgttcccactttcgtggtttcaccacttactgcgacgattgcggatatttttatcctataagaaaccatatattaaagttaaaagtgagtttgacatcgaaggaaaatatagttgattaccttccaaacaaatggatccaataagaagtatgagtacttattagaaaaaaaaaaaactatgaagtatccgtattaattcttctaattgtacatccacttatacaataatttaaacctaaagctatgctttcgtcacgtacatatcatattttcttgtgacaacaataatcatacgctaaaatccatgttcgatcccggattcaagtatagataaacgcattattatgtataagaaaatattaaaacaggcgtgactccataaaaagacgaaaacgcatcggtgctacaagcactcaagaagacacgaatcatgtctttccatttaaataagtctcgaaccttcactatattttcacacatgacactctaagaaatttcaagtttatttctgagagttttttttgctttattgccgttacttaatcattatagaaataatgataagaatttaatgttataacagaacgacggttacgaattatcatcatttaagagtaacattgacggtgaatatttatgaaatatgtttgtgtatcttatgtaaaattttaaataaataaacgagctacaccgaccaaagtcgctcacatgtcgaatggtacacgtaggaccaacttcttcgacgcgccttcaactacttttaaaggtcgtttcttcttgaacacatgatttttttccagaagttttcttcatttgttcaacgcgttttaaaaatttcatatcaccgaagacttttattttctcttctcgatttcaccattaacaaaatattgtgagagtaaactaataaacacaatatgttatgctaagaattcaaaatcctgtgtacatatgacataaattttatatctaccctttaggtttcatatctttgattattatcacaagtgaagttgaaaattgaattgctattgaaatgtttttatcaaaacaacaagcatgtacatgtgagtgaaggtcaaaaaaacattcttacatgtgaaatcaaatgtttgtaaccaaaaatatctgagtgagaacgtgaaatttggcgggaagacaaccgacattccgcgggaaccgaagttatcaacggctgtttgtttgttactacgcaaatcccgtatagatcctaacggcgttaattcttttaactcttaacggcgttaaatttacggttgacaaatcgcgcgtaaaaatcttacaactctcacatgtgatctgccacgtaggatcctccgaccaaagtgttgttccctttgctttgttgtattgtacggccaaactcaattgtttttttttttttttgtgtaaaaaaaaagggaaggtgggtaagaatccaggagacaagaacggaaagtctatgaagaaagatttgtttttgaaaattctaatggtttagatttttctttctatgggaggagcccagagttttccaaagcaggaacaggtcagcgtctgtttatttttattttattcttttcccctaacgcctacttgatattttaattaggaatactatttatatatattaccatttatttcttatcctattaaattctcttatagacagacttggaagtaactctgcccctggagaaaaataaagagagagaaatagagagagagactctgtagaagaagcacatgaattgttctggttttatgatagctttctcttaagaagaagaagaagaaagataaattaaaagggtggttctgagttttaaggattattgtttgaaacaagaagcaagaagaagaagaattgaagaataaaaaagatg

SEQ ID NO: 4310 - DNA, 3000 bp, Unknown
  misc_feature (1)..( 3000): cDNA_ID_1447960_gDNA_ID_1620698_Annot_ID_164967 3000 nt of promoter + ATG
ataacctatcgttgttagaagattagttttgtcaatagtaaatcagtgtgttgtatgtaaaattaaattaaattatggggttagtgtaacgcaaaggagacaagtgggtcctacatgtgtgaatcttattgattcgtttttttattatataatctttatctaagcatgcttataaaaagacaactacatttcttcaagatgaagataacatgtgaccgatagacaaaagattaagaattatggttaaggataatataatatatttaaagtttacacaaaactattggccatggacatgtcgtctctatgacgtaaaagctacgtattattatgacaactatgctcatgactcatgagtcattaacttatggacaaaattgaagtggtttagtcatgtatgaaactgaattttaattgtttgtatatcaataatattaatttttagaaatgaaggcagcattattgttcaaaattgaatgaagtcaaacaaacatttgaaattggaaaaaatcgtacctgtacttgtatgctgtgtacagttctttgtgaactaatttagaagaacaatccaattagaagttaagagaatctaactttactgttggctttaaaaggcagagttgcaaacagctaaggcattattgaccaataaaaaccaaacacgagacttctgactttgaattttgcaccaaaccggttcttctgacatgttgccatataccgccggttaaagttgggttcgcatcatataggggttatagtatagttgacaaaaaaaagttaagtaaattaatagtgtaagtggacttttatatagggcttatgagacccaaatttataatattgggccgtttgcattagctcatggatgtttaaaactatatcgattcttgcatgttgcacagctaatcatattttatctatcgatgtttaagttgttactctttgacataattttatgactctgaaataagacacattatataacatgtaattcagattttgagatgagttttatcgtttgtaactatgtatttagttttatgttttgagtttaagattaaattttgaaattatgaaatatatctaaagacacaattcaaagtagagttttaaatagacatgatttgctgatgtagattttaaaaaggtgtactgtgaatttctaaccaacataaaactttggaggaaatgcacttcgagttataatttttgtttaaaaagcaaacgtattctttataagcccaaacaaatagattactactactaaaatgctttttcttatctaatctttattttcttaattaattttctttgttttcttggaaagttatagtatgtattaatcgctacgagtcaatgctttgtggtcccgatttatattatttttaaaaattatgattcatgattacttaccctttgtaaattattcaaacaaattaaaaggtagaccaaaccttggaaaatacatttctttgtattattaaattgtagtttatgtgtagattagcatataatgtgataaaatattattgttgacagaggaaatgatacgatatctttttcttttctttttttttgttctcaaaataagacaagttgctctataattcaaaatgacattaactagtttggtagatatcatatcctcgtgagctaaacttgagaaacaaaatgaaaaaaggatataacaggagattactccttccctttcgcaaagattatatatcgttttaagatcaattccatgacatagcttcaacaaatatcgtctattgttaaacaagcctacttgaatttattttcattttaaatatacatcttcattcatacataacactggaaaacaaacattgagaagattaacatcccaaaatactgatgaaatatcgacatctccttgcgttgtggaccgtggtcacattattaaactatcatctggttgtatgcttcgacaatatatcaaagtgtagtcacttattctgctgaaacaaatcgcattagtaatagtaggaataggatctgtcttagcttgaggatggtttaagatatatatatatatatatatatatatatatatatattatttttttcttttagttagcttagaagtgaaattacttgcttagaagccgatatttacataagttgtatcgtcgagatttacgttacttttttgcaaaaatcattttctatatatttccaaaacaacaatgatataaaaacaccttaaaagaatgacagaaaaaaaaaacaagtcttatctgcaggccacatttgtcttttaaaaaacagaaaaaactaaaagtaataataatttaaaacaaaaaaattagtatcacccactttccgtttttttttttactttctatttattatttattcttctcttttaaattattaattttccccatcggattccagcaaaaacacgaattcccatttctataatatgacaaaaagatattattttctccaaattaaaatataaaattgtgagttgtattataacgccccattaaatacatttccttttcacgaaaacaatacattttctttttcgtattaatttattcaatattaaatttaaacggacagacaaggaaaaagttaggaaggaaatgaactaaaagcctgaaataaatattaaaataatatatagaaaacgctttattttccaaatttcaaaatcaaaaatattcattgccgtcaaaaaaatatttattttcttatttcatctaaaactacacagcataaataaatctaattttcctcactttcctctcaaacatttcctaattccatcctaataattttcaaagctttaattctaagaaataatatctacaagaaaatattatctcatgtatttcttcttcctccttgatttttaatctgatttttaacctttggatttggaaaattatatcttcttctgtcccaaatctatttttaggtttgtcaaaacgattattttgtttaataatcgtaataggtatg

SEQ ID NO: 4311 - DNA, 3000 bp, Unknown
  misc_feature (1)..( 3000): cDNA_ID_3091429_gDNA_ID_1620698_Annot_ID_164964 3000 nt of promoter + ATG
ccaaacctgaaaattacattacatcaaacttaagtatattttgattgtcttaaccattcaattatgtgacaaaaaagagaggtaaatcgttaggtttagtcaccattttctttattataggttatataactcaagaattatgtgatgtttctatgttcacatgagccatgagtagttttgatattttccataaccgttggtgattaaagcaaaactagatatcatggagtatagatatttaatccaatcaatctacgtcaaactgaaaacaactgattcaaaatttcaaccaaaacatcatttgtgcttttattttattaattctatatgtaaaaacaattattatttttggataattaatatatcttacactggatgctgaaatgtgactgatgcaattcaaaggcagaatctcgatcgagttttggagttcttccttctttacagtacttgtcaacgacaattttgatcgtttcttcgacgttgcaactcagtttaaccattgctcttaccggtccaggacttccttctactgctacactgattattacttttggtgcttcttttgtattaccctgtttcgaaaaataataacaaaatgaggttctctgattttagaaatttaatagaaatgtcaatttttggtatatttatcacgatctgataacatgaactggagaactgactctagaatttgcagctgaacttaaaactctttgttcagcctatataatggttatattgaaatattttataatattaggcttaaactgtaaacttttaaatctttgtggactaaatgatgaattctcttacagagttgaaatcatgaatttgttgatttgaaaaaatagaagcaaacgactctgacctcttgattgatcggagatgaagacgagggcgaatataagttcaacaacgacggagacgaagcgaaaacctcagagcgaatcctaggcaagtaaacgatcggttttgtttcttcttccatcggtaaacctctcatcggcgatggtcgccgcaagtgattactctgtccgtcgcggtggcgattaagactcggctctgagaagcttctctcgaaaaccttattactcgatttagagcgattattcttgtcggaaacatatctgaaagctgttcgtcttgttctggagctccgacctccatttcctacaggattcgaaacttttctccggtgaatcgaatcagacatttcgtgaatgatgatctttgcttaaggaggaggaagaagaaaaaacaattgagaggttttggtggtttgcttggcaaagaagcgaattaagagttattctctgcttttgctttgctttactcttttattatcttcttttctttcatttgtatttttcaaatgtttttccaaatcaaattgtttttttttttctttttaacataagtgtggattttaacatttaaattcaaaccgaccaaaaaaaatacacgattaaaggtagtaatatagacgtggttcttgtaatatagtatttatatttcctgtcgacgatcgattcttttatagtatgatatcttgtgctgattcttacgtacttgtgtttattatagtaaaatagaaatgcgttgaattgtagcactgtattagattaaaacttctatgtaattatggagctaaaatgttttctggttagcatacggagtattttttaaaaaatctatccttattatggataaaatgtgttggaaaaaggcaataatatacttgtacaaatgaatataaatttcttgatgcattgttttagaagattacttgggagactcacaatcctataaagtgtaaaggaaacaaaactattggatttgtagaaaagttgacacgttaaacaagaaaacgagaaacccaaacaagtttcgtaaaacacaaaaaatctaaggtgatagtgagaagcacataaacaaatgaaaaaaaacacataaacaattagagaggagggagactcaactagtatcatcaattcattaaattttacgaaagtgctgagtaatggaagtaatataaaaaatttataaccaaaaacaagaattcatcaacgtcaagaaaaaacaacataaaataaaaaggagaatttgtgtggctgagattggtccgaggtttgtttccactgttaaaagaaagaacttttgggcttgatttaaagtcattaatggtgtggtcgacttctcttatgccatacgcactcatgttcacgcgtaacgcacttgttttccaccaagtatttaacaacgatcgtttgtgacccttttttatgtatacttgaaacttaaaaaatatgtattattacatttaaatatcatttattgtcatgacgaaaaaattgtaagactttataatttcaaatgtaacgtcacttttcgtgatgatgtaataccattctattacttaaatacaattggccaacagcctcaatttatttcaaccttttgctatctctatagtataatggtgtcataaaaattcatagacacattccacaaaactcgtgtatgtatatccgtgtctttatatatatgtgtatatccaagtgtataataaagttttttttcttaaaaaaaaaaacagaaatttgtatgcaccatttaaacaattaaagaaagaaaattgggcctactccaaacacaacgctactgtggagtacattttatccattttaatggcccaataatttataatgggcttttagtatgggccattttgtccctcttttttatgttgtaagcgagatcttgagacaatgttagtaattttggtttaatccggttcaacaagtaaacatcacacttgtaaactaaaccgataatgccacgtcactactccaaatattcgccaaatcataacagacaaaatccaacaacaacgacgacactctcctctctcactctctctctcaatctcaatctcaatctcacgtcaacgaccgtcgccgtcaccggaaggaaacgatttcatcatcttctacaatg

SEQ ID NO: 4312 - DNA, 3000 bp, Unknown
  misc_feature (1)..( 3000): cDNA_ID_2051061_gDNA_ID_1620698_Annot_ID_164963 3000 nt of promoter + ATG
caccaaatccgattactacctctactgccacaacattctcttcctcttcctcatcttctctctcgttcctctccctctcgttttcatcgaatcatctcaatccacctcagatttgttcaatcgctacaaaatccaaccaaaagtgaaaaactcattctcatcgatgttcaaatgttacaaagacgtcatgaagatgttcatcctcgtcgttggtccattacaactcgtttcttatccttcgattcaggttaatttctggaatttggcttctaatttcggaattgatgcgatttaggttgattttgtttttcgtgtgttgaaacagatgattgagatacgaagtggattaccattaccatcatgtatggagattgtagcacagttagtggtttacttcttggtagaggattatactaattactgggttcatagattctttcattgtaaatggggttatgagaagtttcatcatattcatcatgagtatacagctcctattggttatgctgctccttatgctcattgggctgaggttttgcttcttggcattcccacgtttcttggacctgctattgctcctggtcatatgattaccttttggttgtggattgctttacgacagattgaggctatcgaaactcatagcgggtaaggaaaaggaatggttttgaattgtttatcttagtttataatgcgttggggctatgtgggaagtttcaatagtgcgtttaccttttgttggtggggctaaggttaggcactagccttttctgatgctttattgactgtaattagctctaggtgattgtttagagactgcttagttaatcttttgtggtcaacatgagcaagaaatcattcttgagatgataagcatcttgtcttgttcaaataagtatttggacaatatgatgattgcttggtgcatgaaacttgtttctctggagataaattgacttgttttttttatttttcgttttcttttgaagatatgatttcccatggtctctgacaaagtacattccattttatggtggagctgagtatcatgattaccatcactacgttggaggacaaagccagagtaactttgcttcagtttttacttactgcgattacatctatggaactgataaagtgagtaatgaaacttcagttcttttccggttagcgtctactaattctggataaaaatttgacaatgtgggtatatgttcttattttcatcagggttaccgattccagaagaagcttcttcagcaggtaaataaatactccataaactgagactagcttatctctcggcataccgcatacccataaacgcagccatcaaattgcaagctcacataacagtatatgtggtatctagtatcatcatattgatgatatgtttcttgatgctatatcttatgagttgcagatgaaggagaagtccaagaagagcaacaagctggttaatggaggagagaaattcgattagtaaatctaaaacccctcgcgaggttgacttaccgtaagtttcaagcattctacaaatgtagtcaatacttaaaaatgaaagggtagttagttttctctgttctggtcttccctgtgtcacatgaaaatgctcgtgacgagttcctatctgaagttttttttaaaactcttttggaattggtgtgtgtcaataaatcctttttgtatattttaaatgttacatagtgcattcattggcttgtaacaagttcctactctgatagtattaagttaagttaagtataacttaagtatctaacgttaacaacaaggcccgtctagctcagttggtagagcgcaaggctcttaaccttgtggtcgtgggttcgagccccacggtgggcgtttcttttcctttttgttgcatttgagtggcatgatttaaaaggaaaatccttaccataacgatagttgcattgatgatgggggtcgatttcactctcggaaaacaaatctaatcaaagaaggctaaaacaagcgaaacacatgcatttactaaagctgtctcaccaaacttgaaaacaacagttttaagtacagtagtaggtacaataacttatttagttgttaccaactaatttatgactttaaaatcgaaacactctcttccttcctgtgttttttcaactaaacctaacaacacacagtttttctttaacacacatttccttgttctcgttgtcttagaattaccatggacacagtgaatatgataataacttcaagaatggggttgtagctgtgtgaggctatatttttttttttggtttaatgaggctatattgtaaactacttcaataagtttttactcttaaaccaattcacgaaagagttttaatgaacttgatattaagtttttgtccacacatattttgtgtatcaacgagtttttcttttctagacgtatggatcatcactcttcgtttcgtagattgttaaacaatgaagaaaggctttagctattcaaaatcatttggtgaaaagaaattactcctgatgataggtctataaatgaatttgcaacaaatatttccgaacatacaattttagatatcttctaacctaaataactactaaaaaataacaaccttagtaactttgaattttcgttttatatttttaaaaaacgaaaatgtgacccgttcgtatcaaatatagacgtaaagagataagatatgttttgttgtgttctactaaaaagtcaaaaaacaaatacattgaggacccaatttggcggacttctcaaagggtaaataatataccaaaaattggaaaaatcaaaaaaaaagaaaaatcaccgaaattaattaagtaggtaccatgtttcgacatttgtgcatctttatatagtttttcaagcatcctcatcatacattttccaaaacacattcaagacacgttttatgagtctataactccaaaacaatgctataacataaaccacacaaattaatccagacacaacactctcacaatatg

SEQ ID NO: 4313 - DNA, 3000 bp, Unknown
  misc_feature (1)..( 3000): cDNA_ID_3072997_gDNA_ID_1620698_Annot_ID_164960 3000 nt of promoter + ATG
ttgaacaaagaaaaaaggataattatccatgaaaacaaaaaaattgtcagctcgatttcatcgaaatttataaactttattcctcaattcaatttggggtttgcttcatttttttctccgaccaaacaagttccgggtgttttgaaagaaccccgacaatggcgtggaacgtgttcaagttctgcacagcacttcgcgccttgggttcgatcatgatcttaattgttatcgggatcatcggattcacatactacgccgttgtcgtcgttaattacggacctgctctactgatcggtggtgtcgattcattactatctgttctcgtcttagcgttcttccactttctggtaaactcaattcttccttctaggtcaatctgaaatttttaatctttttgtgacccttttgaaatttttgcatttggtaccctctagatctctgctaattacatgatacgctggtttggactatgctttagttacttacgaattgtaatcttttgggttctgtcagatgcaccaacttgattttgctttgataatattgagtcaaagcttgttgctttgttgtggtagtgggctcaatctagcttggcgtgtggatttacatttgtgtctgttggattttaagtaacagcaagatgagatagtgaattaggatagtataagctaagtaagcaatcaagtattcatctttttttttttggtttgatttggttgtagtgtagagtgtctttgtttcttttagttttaaagctgttggtttcttgtgtgttttaatagattatcaacatttgaactccctcgcattgtagaactcacagaggaaagagtaaggaagcaaaggactcattttttttatgattgttgttttgtttgcagcttataatgctactgtggagttatttctctgttgttgtgacggaccctggtggtgttccaacgggttggaggccagaattagacatagagaaaagcgagggaaaccaagctttgattggagaagcttcggttggagattcctcgtctcatggtgtaagatattgtagaaagtgcaatcaatataaaccgcctcgttctcaccattgttcagtctgtaagtctcttcaatgagtgattcttttctttgaatccggtatatgtgttttttagtagtgaaaaagttgtcatattgggttttcaggtggaagatgcatactaaagatggaccatcactgtgtttgggtggtgaattgtgttggtgcaaataactacaaatcatttctcctattcttggtatgtcaacttatcatagcatcgctgaacgaagttgtttttgatatgttctgttcattaatgttgccatgatcataatccattcccaatatctcaaaaatgcagttttacacatttcttgagacaacggtggttgcagtatcactattgccaattttcctcgtattcttcagcgatggagatggtgatataaccgtatcaccaggaagcctagcagccagctttgttgcatttggtgagttcaaagatatagaaatctcagtttccgtttttgtttcagaacaccttaacgttaccatctgattcaaaaacttcactctcttgctttccagtattgaacatagcatttgccctaagtgtcctaggcttcctaataatgcacataatgttggtcgctcgtaacaccacaactattgaggtaaagcaacaactctcacttggttttgctcttaacttgggttctctcaggaatctccatgtcaataaactcactgaccaaactaatggtttctttaatctcaggcgtatgagaagcatacagtgaactggccatacaacgttggtcgtaagacaaactttgaacaggttcgctctccatcttctttgtttcactcgttcttcagtgactgattcgtttccccgctacttagataatatctttgacatcgaacacaatgaaagctttaaaaagtttggtctctattcctttgttgaatcaggtttttggaagtgataaaatgtattggttcgtgccattgtacacggaagacgataagaagaagttgccagcacttggagggttagactttacgagcaggtcggagtccgagacagagccgcttcagtctctatgaccttacaaacttgaaatttttggaagtgtgtcttctgctttgtgtatgtatcaatcaaatattatatcaaacattgtcttgtgtattataaagattagtgcctattgtggaatttgtatctttttatttcgtgaaaagaaatttctcaaacttcttaaatataccattttcacatttgcttaaatataccattttcattttttcactattgataataataacatgttatttatcataaaaaataaaaaaatcacgacacgtgaatgatgtactgtaactatcaaagatttgacgtaccacatactttctgtatgtttttgatcgaatcaaaaataattatttttgtccttttttgttttattgttattttataatgtaatacttttactaaaataattttttttaaaaactaaatttctggtctatataattttggccaaatatgtacatatttaaaatccagagtcaaccatttaacaaacacttggaaatttaattaattattatgccctgtttagtagaaaatccattaaaaattacagaaatggtctgcgtgtcgcattgaaccaatcatatctcgacatctgtaaatacagttggagaagattttttcttcttctgctggccaaaaaaaaacattgcattaaaaagggttcaaagaaaaattctcaaattctctaacaaagagctctgagatttttggaaatctgaatcgttgttcgaggtatgaacttttggatcactctccttgaatctgctctttgattcgatttcgtacttgaatttcgcaattttggagttttctctcgcttcgttatactgatcgtttagggcttgaaattgaaggtttaatgttaccatttccggcaatg

SEQ ID NO: 4314 - DNA, 3000 bp, Unknown
  misc_feature (1)..( 3000): cDNA_ID_3091437_gDNA_ID_1620698_Annot_ID_164959 3000 nt of promoter + ATG
ctctcgcttcgttatactgatcgtttagggcttgaaattgaaggtttaatgttaccatttccggcaatgaacttgaagaagtctcgatcggaaaactcatcagttgcttcatctggaagtaagattgaggagcagactgagaaatcagctgaaccaacaaccattaaggtaaacctcactaaacctaaacccggtttcaattttgctttgtggtctctctttaccacacagatcttatcattgaattctatctcttaattagggttttagttgagaatcttaaggttttttttcaaccagtttcgaagacttagttactagtgttatttgacgaactgatgcagacataaaggttataactttatttctcgttgtgtctttggctgatcagttatgtataaaatttaatcaatatttatgctatttaaggtttcgcagtgacccttttcttcaaatttggtttttgattctgcatgttctcagtatcactcttttggtggtgtccctgttttgacttttgtgtttctctacgcatgttttctcatcttgctatatattaaacgatttgtagtatgattctgttgatccaagtagcttgtgagtgactgttcttcttttcaccgagattccatatttgtattgtgcaggtgcagaaaaaagccggtactccagggaggtcgatagatgtctttgctgtgcagtgtgagaagtgcatgaagtggaggaagattgatactcaagatgagtatgaagatatcagaagtagagtacaagaggacccgtttttttgcaagacgaaagaaggtgtgtcctgtgaagatgttggagatctaaactatgattcctccagaacatgggtcatcgacaagcctggcttgccgaggacaccaagagggttcaaaaggagcttaattctgagaaaggattactcgaaaatggatgcgtactacataactcctactgggaagaagctcaagtctcgtaatgaaatcgcagccttcatcgatgccaatcaggattacaagtatgcactgcttggagatttcaatttcacagtcccaaaggtgatggaagagacggttcctagtgggatattatctgacaggacccccaagccatcaaggaaagttacaattgattgagctacatagcgcttcccagcttcttatggtgttgaagttgttattggagtcagttttaggtttctatctggtttagtcttttaagggtgtcggacttcttactgtagaatgtttcttaaactcatctctttgactctgattggatctttattttctaatgaaggattatcttttcttctctttttgttatgtcacaagtcacaactacatgaatcgctctggttttcactcagtgtgtacaaacaaacacgacaaagtatattcaagcagcatgtgtacaacttcttctactccaagcgcaccctctgctatagcgtgcggtgtgcaagtcctcgcttatgggctatttatcccattcaacattgagtattggtcataacctcttgggactgagagctttatgaaaagaagccttaaacaatgattgcatatttgggattttcaaaaagaagactcacaacataactttatgtatgtttccgctcttgggttttctgaccagcccttgaagctagtcctttctcaaggttttgtgtatgtttcattagtttttgtttgtatctggagtctaccgtttattagaagtttaggttgctccttccaccgtccttactccttggtttagttgaataagcagttttctcatgtggtcttacttggtatgtaaaggctaaccttttgtgggcatgcaaagttctaaatttagactctttaggatgaagattacatggctacaatttttgattcttatatgtgattttttcttcttgttattcgtcgtatttggggtcctttttcgcgatttacatttgcctcgaagactgcttgtgagcttttgtagttctgcatctactgttctttccgcgctttctgttgactgcgagtgtggttttcacattattttgtttggtggtagcattttttcttaaacttcggtggttattttaagttatgttcaaagttttgtttgtaatttcgtggttccgaatgagtagcggcttgattatccgtattacttttgggtttgatttttcgaatcactctcgagctttgttcctaatttatgcagtttgtgttcaacttgtaactttttttgtatatgcaatctaagattaatgtttatagaattcatcttagattgcctaacgatattttgaatatggcttaaatctaagatttaaaacgtacaaaatcatgcggaaactcattttgaacggaaaaaactcgattcaactaatgaacatataaattatagaatagataaaataaaatggatttagaaaaacagtagaaaatatttataattttgccatgtttagaagaaaatccatgagtttaagacaatgagcaagagaaaattacagaaacggtgtcgaagttaacccatcagccaatcaaactgcgactcctgtagaaacacagttcgagaagattcttaaattctcttgctgcataaaatggcttaagagaaaatttctcaattccaacaaatatctctcagattgttgggagtccgaatcgttgttcgaggtatgaacttcaaattcgattacggtgaattttaatgtttgattttgatttctgattgaatttcaatttcgggttcttcgttaggtctagttcgcttcaggtctctggttttttcttcatgatatttacgttcctgagttgtttgtgacttgattgtgatcgattcatgtaatcttcctgatttactgttgaaattgctttgcagttagagaattgttatcttgctagagattgtgttgaattgcaaatttcagatttgtgtttgatgatagcgttttatgaattctgtttttgtttttgtatactttagtttttatcagggaagatg

SEQ ID NO: 4315 - DNA, 3000 bp, Unknown; identical to SEQ ID NO: 4307
  misc_feature (1)..( 3000): cDNA_ID_1823797_gDNA_ID_1620698_Annot_ID_164958 3000 nt of promoter + ATG

SEQ ID NO: 4316 - DNA, 3000 bp, Unknown; identical to SEQ ID NO: 4306
  misc_feature (1)..( 3000): cDNA_ID_1806998_gDNA_ID_1620698_Annot_ID_164956 3000 nt of promoter + ATG

SEQ ID NO: 4317 - DNA, 3000 bp, Unknown; identical to SEQ ID NO: 4313
  misc_feature (1)..( 3000): cDNA_ID_1808018_gDNA_ID_1620698_Annot_ID_48722 3000 nt of promoter + ATG

SEQ ID NO: 4318 - DNA, 3000 bp, Unknown; identical to SEQ ID NO: 4311
  misc_feature (1)..( 3000): cDNA_ID_1823793_gDNA_ID_1620698_Annot_ID_48723 3000 nt of promoter + ATG

SEQ ID NO: 4319 - DNA, 3000 bp, Unknown
  misc_feature (1)..( 3000): cDNA_ID_1823789_gDNA_ID_1620698_Annot_ID_48724 3000 nt of promoter + ATG
gttccatagatgtaatcgcagtaagtaaaaactgaagcaaagttactctggctttgtcctccaacgtagtgatggtaatcatgatactcagctccaccataaaatggaatgtactttgtcagagaccatgggaaatcatatcttcaaaagaaaacgaaaaataaaaaaaacaagtcaatttatctccagagaaacaagtttcatgcaccaagcaatcatcatattgtccaaatacttatttgaacaagacaagatgcttatcatctcaagaatgatttcttgctcatgttgaccacaaaagattaactaagcagtctctaaacaatcacctagagctaattacagtcaataaagcatcagaaaaggctagtgcctaaccttagccccaccaacaaaaggtaaacgcactattgaaacttcccacatagccccaacgcattataaactaagataaacaattcaaaaccattccttttccttacccgctatgagtttcgatagcctcaatctgtcgtaaagcaatccacaaccaaaaggtaatcatatgaccaggagcaatagcaggtccaagaaacgtgggaatgccaagaagcaaaacctcagcccaatgagcataaggagcagcataaccaataggagctgtatactcatgatgaatatgatgaaacttctcataaccccatttacaatgaaagaatctatgaacccagtaattagtataatcctctaccaagaagtaaaccactaactgtgctacaatctccatacatgatggtaatggtaatccacttcgtatctcaatcatctgtttcaacacacgaaaaacaaaatcaacctaaatcgcatcaattccgaaattagaagccaaattccagaaattaacctgaatcgaaggataagaaacgagttgtaatggaccaacgacgaggatgaacatcttcatgacgtctttgtaacatttgaacatcgatgagaatgagtttttcacttttggttggattttgtagcgattgaacaaatctgaggtggattgagatgattcgatgaaaacgagagggagaggaacgagagagaagatgaggaagaggaagagaatgttgtggcagtagaggtagtaatcggatttggtggcggagtaatcgaaccagagagtctctagccatgtgaggtttcgagataatgcgatcgacgcttcttcgattgttgcgtatgggatcattgtagaagatgatgaaatcgtttccttccggtgacggcgacggtcgttgacgtgagattgagattgagattgagagagagagtgagagaggagagtgtcgtcgttgttgttggattttgtctgttatgatttggcgaatatttggagtagtgacgtggcattatcggtttagtttacaagtgtgatgtttacttgttgaaccggattaaaccaaaattactaacattgtctcaagatctcgcttacaacataaaaaagagggacaaaatggcccatactaaaagcccattataaattattgggccattaaaatggataaaatgtactccacagtagcgttgtgtttggagtaggcccaattttctttctttaattgtttaaatggtgcatacaaatttctgtttttttttttaagaaaaaaaactttattatacacttggatatacacatatatataaagacacggatatacatacacgagttttgtggaatgtgtctatgaatttttatgacaccattatactatagagatagcaaaaggttgaaataaattgaggctgttggccaattgtatttaagtaatagaatggtattacatcatcacgaaaagtgacgttacatttgaaattataaagtcttacaattttttcgtcatgacaataaatgatatttaaatgtaataatacatattttttaagtttcaagtatacataaaaaagggtcacaaacgatcgttgttaaatacttggtggaaaacaagtgcgttacgcgtgaacatgagtgcgtatggcataagagaagtcgaccacaccattaatgactttaaatcaagcccaaaagttctttcttttaacagtggaaacaaacctcggaccaatctcagccacacaaattctcctttttattttatgttgttttttcttgacgttgatgaattcttgtttttggttataaattttttatattacttccattactcagcactttcgtaaaatttaatgaattgatgatactagttgagtctccctcctctctaattgtttatgtgttttttttcatttgtttatgtgcttctcactatcaccttagattttttgtgttttacgaaacttgtttgggtttctcgttttcttgtttaacgtgtcaacttttctacaaatccaatagttttgtttcctttacactttataggattgtgagtctcccaagtaatcttctaaaacaatgcatcaagaaatttatattcatttgtacaagtatattattgcctttttccaacacattttatccataataaggatagattttttaaaaaatactccgtatgctaaccagaaaacattttagctccataattacatagaagttttaatctaatacagtgctacaattcaacgcatttctattttactataataaacacaagtacgtaagaatcagcacaagatatcatactataaaagaatcgatcgtcgacaggaaatataaatactatattacaagaaccacgtctatattactacctttaatcgtgtattttttttggtcggtttgaatttaaatgttaaaatccacacttatgttaaaaagaaaaaaaaaaacaatttgatttggaaaaacatttgaaaaatacaaatgaaagaaaagaagataataaaagagtaaagcaaagcaaaagcagagaataactcttaattcgcttctttgccaagcaaaccaccaaaacctctcaattgttttttcttcttcctcctccttaagcaaagatcatcattcacgaa

SEQ ID NO: 4320 - DNA, 3000 bp, Unknown; identical to SEQ ID NO: 4310
  misc_feature (1)..( 3000): cDNA_ID_1447960_gDNA_ID_1620698_Annot_ID_48725 3000 nt of promoter + ATG

SEQ ID NO: 4321 - DNA, 3000 bp, Unknown; identical to SEQ ID NO: 4309
  misc_feature (1)..( 3000): cDNA_ID_1823785_gDNA_ID_1620698_Annot_ID_48726 3000 nt of promoter + ATG

SEQ ID NO: 4322 - DNA, 3000 bp, Unknown; identical to SEQ ID NO: 4069
  misc_feature (1)..( 3000): cDNA_ID_1823766_gDNA_ID_1620698_Annot_ID_48733 3000 nt of promoter + ATG

SEQ ID NO: 4323 - DNA, 3000 bp, Unknown
  misc_feature (1)..( 3000): cDNA_ID_1823844_gDNA_ID_1620699_Annot_ID_48735 3000 nt of promoter + ATG
ttaaagtagcgagcgaatcaactgagagcaagttaacaatcactatcaagtatcaaataaataaagcaaccactactaatttccccagatattattaaccaatacagtacacataagagagatctttaatatattaaaaacaaggaaaattgaacagaatctcactttaaggatttgttttgctaatacaaaaaatgtaaaaaatgaatggcgcagtgggtgttacacgattggggagacaaagattgcataaagatattgaagaattgcaaagaagcggtccctccaaatatcggaaaagtgttgatagtggaatcggtgatcggagagaataaaaagacgatgatagtggacgaacgagatgaaaagttagagcacgtgagattgatgcttgatatggtgatgatggctcacacaagcacaggcaaagaacggactttgaaagaatgggactttgttcttaaagaagctggctttgctcgatatgaggttagggacattgatgatgttcagagtcttataatcgcgtatcggtcttaagaggaggacatgaaagatatatctttcctttgaggaaaactcaataaattagtgattgttgatttggtgtttttatacagaacgacgtgtgggtgaataattgtgttgtgtgataataagtaaggcttgtttcagtatcagcagagttgttttttatttgtatttttcacatttttttatcattaatttccttgtgagtggcacctctaatttacttttttaattgttataggctatataagatagataaccttatacaatgtcaaatcttacaattacattatgaacatgaaaacaaattaaaaataaacttgctaagttttcaaaattatgtaaatttgcttgtaaaatcttgatttagtggaaaggtataatcattgatataaaaagaaactataaatatcaagaaatattcttaaagtcttaaatgcttcaatcatactttcaaacataaacaagtggtccaacgaatagacccaaatattacgtggttacgatgagagtggcagtggggtttatacgattggggagataaagacttgataaaaacatgctaagccatgtttatttgatcatttgacatttacatccaaatgatctatttgaatgattcatgtgaatgattcatgtgaatgatgtttgtttgatcatttggtattttatctaaataatgtatttaaatgaatatttctttgcttgattattttttaatttatctacattctcattctaataaaaatgactaaaaatacccatgttataattttaacaaatgacaaatatttaacatcattaccaaatatatcatttttaatctttaattttagttatattaatttaattattgctgtaaaatacatttacaacgaaataaattattattttaacataaaaaatatgatttgcggttggtggaaaatatactttgtagttttggcagaaaaatatgattttacgggtttggcgggaaaaatatgattttacggttttggcaggaaaaatattattttgcggttttggcgggaaaatatgattttaacgttttggcggaaaaatatggttttgcggtttggcgggaaaatatgattttaacgttttggcggaaaaatatgattttacagtttaggcgggaaaatatgattttacggttttggcgggaaaatatgattttacggttttggtgggaaaatatgattttacggtttgagcggaaaaaaatatgattttacggttttggcgagaaaatatgattttacggttttggcgagaaaatatgattttacggttttggcgggaaaatatgattttgcggttttgtgggaaatatgattttaacgttttgacaggaaaatatggttttgcggttttggcgggaaaacatgattttgcggctttgacggaaaacatgattttgcagttttggcgagaaaaacgaatttacaattttgacgtaaaataatagttagtgattttacaatttttagagttttttttgtacaataggtaatttaaaaaatattaaataagaaatctattaaaaataatattattaaaagagggtatatttgtcatttgttttttgaactaaatcatctccatccaaatggttctaccaagtccatccaaatgaatttcacaaattagcttaaatttacaaagtcattcagatggaacatccaaatgaatcatccaaatgagctgttaatttgtcaaaaacaaatatcatttttcatctctatctatatgatccatctggatggaaaaacaaacaggaccttaatagcgtaaagaagaggtccaactccaatccaaatcattacatttcccagcgatacaaaattttgatttggtttcaactagattcaatctctcaaaaagttcataatgaagcccaaaagcccattactaatgagggtaacttacacatgttaccttcttactgaaccaagaatcgcctctccctttttcggcgcgcgcgtacaccttacactgttacacagttacactacgctactatacactctgcattaggattcttttgaagcgcacatgacatgtctctaaagttcatatataaacgtgtccgagacaatttgacagcgtagctgatatgtgttcgtttgttgacacagcttgagattaatggcttgcggttgcgggcagtattgttattaagaggtgttgcaaggtttaaagtctaatttgactaggtctacttttaactcataatcattcagtaatggctaacttaccaatgtttttagcaaatccaaacaaaaattttttttaaaaaaaacttgagaaatacagtgatcaactaagtttgaattcttgaattactattctgtgtaagatcaatattagtatattacttatgtgcccccaaatttaaataactataaaagaaacctaattcctcaaaccccaaataacctgccttttaatttacttaacaaaatg

SEQ ID NO: 4324 - DNA, 3000 bp, Unknown; identical to SEQ ID NO: 4275
  misc_feature (1)..( 3000): cDNA_ID_2108207_gDNA_ID_1620699_Annot_ID_165001 3000 nt of promoter + ATG

SEQ ID NO: 4325 - DNA, 3000 bp, Unknown; identical to SEQ ID NO: 4274
  misc_feature (1)..( 3000): cDNA_ID_1022876_gDNA_ID_1620699_Annot_ID_164997 3000 nt of promoter + ATG

SEQ ID NO: 4326 - DNA, 3000 bp, Unknown; identical to SEQ ID NO: 4273
  misc_feature (1)..( 3000): cDNA_ID_1823586_gDNA_ID_1620699_Annot_ID_164996 3000 nt of promoter + ATG

SEQ ID NO: 4327 - DNA, 1095 bp, Unknown
  misc_feature (1)..( 1095): cDNA_ID_3073035_gDNA_ID_1620699_Annot_ID_164994 3000 nt of promoter + ATG
aagcttggcttctctttaccaaacatatatgtttgttgatcaatctctttctttgcgttatctgccccttgatttagacccacgtattattcgattcctaaactaattgaaatgattagatatgtgtcatgacgtttagtgaactaatattcacctaatatgtctttcaatcacttaagaatttgcattattcttgtgaaaaacataaattcacatgctgctagtaaaatatgttaacaaatcaattaaacatcagaaaataataactgagatcttcataaagaaagtggaagtttttttaaatatatgaagaagaaaagtgcgtagtgtgcacgggacttagttcatttaattctcgagccattgccgtacggaggaggctgccttcaaggcttaagtcgaggcgtgttcgttacgtttaacccgcaatagccggtggctacacactcacaaatcccctttgactcaccggatatcgacggtttcccgctattttttcccctaactaactttttttccttttcttgtaaaactcttaaaaacaaaactcggtgttgtctctttgtttgctcactccttttctttctctctctcgccgacactttcattctcacttgtgttcgtacgtaatgttcttgatccggtaggtttttatttgattataaactcatttcatttaacaaattgagtccatctctctatgattcacccataagatgatagaagaagatcaacatttacgtctgagataaatcatgtcctttaatgtatatttgtttattttctggtcaatcatcgatctttcttagtcgtagcagttacacaatgctgatggtacatggcggcagattttcgattcttattatttaaagaccaaatttaataatagatgtatgtacaacgagttttggtatcactatcttgtccggtaatgctcattgtttatcttttaaatctacgtcttcttctgcataattgacacaaatcacttgtttcaatggagtttttgtttgtttgatttcctctgttacttatgcagcaaaagaagaaattgagtttaaaggagaagtgtgagaaggaagtttcaggaagatg

SEQ ID NO: 4328 - DNA, 3000 bp, Unknown
  misc_feature (1)..( 3000): cDNA_ID_1823899_gDNA_ID_1620700_Annot_ID_48746 3000 nt of promoter + ATG
ttcgtggaggctttgattcaatgcaatctcaattctttagcagatgttaccgagcgtctacaagcagaatctatggagaagaagatatgagatgtgacttgagaatcttttcattcggaaaagaaggaaaaagaccaaagaagagaaataactcttcccttttatagcaatgtctatgttttttcttcttctatttccattttctgaatgtttgtatattattggaagtttgtaacgaaatgatttcgaatagctgtcaaacgagaaatataaattcaaatttgtaagtgtttatatgaaatgcttttttatttttaacatttccacatgaaaatataaataacatatcatgacacatgcaaaatcatatttatgaaagttttttcaactctctccattttttcgacatatcagcattagatagagtgacacttatcacatcaacatatgaattacatttcttatttaatttaatgtatttaagaatttataatcatgcattaattctttctaaattttttgacatgtttgaacttattaattaaataatttcaatttaattaggtacaaagtatatcaaactcacataaataacttatttaaattaaattatataaatcgtataaacttatgtataaacataaaattaatagaattttaatgaacttttagatttgattaaagtataaaaattaaataatatgatataagaatttatttcatgttttcatatactaatatatatatatatatatatatatataaaagattaataacaattgatattagttaaatttacggtttagtttaaggtaaacccaagatgctctcatctggaattctgttatgatctgtacgtcctcaaagttccagagatgttgagaaagatcaaacatcagcagcgtcagaggctttttctctggagaggtgatgttgaatggctctatgcgctgctcggagagcaaaagagtcttgaagaagactctagcaaatccatattggcatctaagcttgatctttgtgttcctgttatgaaacacagaatctagactgagactgaagttggatacctcagctttgggatggagaataccggaactcttggccggagtaagaggatggaaagcatgctgaagatgagcaagagcgttccaagaaagactatgacgaagaaaacaaatcagaaatatactaagtatgagttgtttcaaagaacgtagtaatggtttataataatattaacaatagaataaaataaatagtaatggtttaagaaaatattaataatagtgagcaaaagctaagcaaaatataagcaaaacataataacatagtcaaaataatatggaaatgacaagtatataaattatatgttaaaagttaagaaattgacttggaggtttgtgttgggattttcccttaacttaaataaaggttttaaatgtgaacaaaaaaagtttgaagttttagttgggaaaatgttttgatttggaggtttgttttggaattttttcacttacctaaaaagattttggttattattaacataaaattctactaataacaattgatatgcttcttcgtgttaaaaacaaaaaaaaaacaattgatatgcttcttctttttttgtgcacccaataaatatgaattaaataagcatttttaatagatttatctcttgatagggtatccatctaaacaaatacaaaaaagaatacatttaaccaaaatgcttatctaatgtatatttaaatgtaaaactttattgtatttgttaatttagcaaaagataaaatgtctaattgctaaatcatatttacaaaatataatatctgttaattaaatcatgattcagttgtttgggctgttaattttgttttaatccgtctttgggcttgacccttctgtatttgcctattgggctttatgaatgttatgaatgaaaatgaatagtcacaaaacaaaagaaaaaaaacagaatttgagtcggtacacaactgttaacgaggtgtacttggtggaatcatagacacgtgtcttgacactcttaaggcctcttcaccaccaaattacttccctaacaaaagaattattattattgtgaagccccaaaagatcgaacattctaattcaatggcctacttgctgaccaagcaaaaaggaccggctccgttttcacctaattccgagcttcacaacgtgccttccattggttgaatattcaactggtttaaccaaaccgaagttacacatacgatttgagtcggtacacaaatattacgagacgtactttgtggacagtttgacacgtgtatcgccactctttatccctcttcaccagtcaccactcaccaccaacttaaaaataaaataaaaagagcatatattgtggagccccttacatgatcgaaaattctcgttcaaaagcattcgttaagaccgtgtgttgtgtgtcgttttttgtcgacgaaaattagaccggctctgtttttattggctcgtttcgattgaaagcgtggctataattggtttaaccaaaccgaagtcgacgtctcggtttgttcggttaagattaagccttgtagaacattccaaaacgccgcgtcaaagcttttagggtttgattctgctgtgtggctacccactcaagtctccagtgttcctttgtggctctggtttgccctattcttctcttccccctctctctctctctctctctcttgttttctttttccctcttctccaaggaatctggaaaaaattaaaccttttttctaaatccctggaaatcagaaaacttcctattgagaaaccatagattcgatccaagcctttgattgtatcaaaatctctgcttcaccaagaatttgggttgatacagaagaaaaaagttaaatggttgaggcagagcgcgcggagaatagttggattgcttcggaaacgtctccgtcgtcgtctccggtggtaatagaaagcagtgatttttcgataactgatgga

SEQ ID NO: 4329 - DNA, 3000 bp, Unknown
  misc_feature (1)..( 3000): cDNA_ID_1840331_gDNA_ID_1620700_Annot_ID_48748 3000 nt of promoter + ATG
gacgttttgattcggtttttatatatttggatctttataaatatagttccaaatttatgtactaaaacagggaaaacaatgaataatccaagatcggttagtcctttggtttctccagcaaaccactcagatctattagaaaaccaacgtcaatccggttctggagatttctcaagattagagaaacgaatcggagcgaggaagatgaagtttcattccaagtctatgccccgaggtgccatgtttcttgatcaagaagcatctagaaacttccacgacaagaggtatgacctattcaggaccatgtccgggaaactcgaacgtcagatatcgaatttacgtgggaaacccactgagagttcgttgcaggatcataaagagattactgaatctttaaccgctgatagatactttgatgctcttcaaggccccgagcttgaaactctcaaggtattttatcattcatttttgctcatatggttgagttatacttgtgtttggttacttctatttatgggtttattggtggatgacaggagaaggagaagatagttctgcctgaggacaaaacgtggccgtttcttctacggtttccaatcacatcatatgggatgtgtcttggagtaagtagtcaagccatcatgtggaagaccttagcaaccacagaggcagagaagttcttgcacgtgactcaagtgatcaaccacgtgctctggtggatctctctccttctcctcctcgccgtttctatcacttacctcttcaaaaccatcctcttctttgaggcggttcgccgtgagtttcggcatccgatccgagtcaacttcttcttcgctcctcttatatcaatcctcttcttggcacttggaatcccacactctatcatctcacatcttccctctacactttggtacttccttatggctcccatcttgtttcttgagatgaagatttacggacagtggatgtctggtggacaaagacgcctctccaaagtcgccaaccctacaaaccacctttccattgtcggtaactttgcaggagcacttctaggagcatccatggggttgaaagaaggaccaatattcttctttgccatagggttggcttattatttggttttatttgtgactctctatcagagacttcccacgaatgaaaccttacctaaagagcttcaccctgttttcttcctctttgtggctgcaccagccgtcgcttccatggcctggaccaagatctctgcctctttcgatctcggttcgcgtctagcatacttcatctccttgttcttgtacttctctctggtagtttttgttttcattaacagagttctagtgagctagtgctgagtttcttgtggtacaagaaatgtaacagctttacttcttgtgattcttgtttcaggtttgtcggattaaccttttccggggattcaagtaagctgtttcttgaactgcaaggatctaatttaccaaaccaaataacatacatgttatctgacataattattcaaaaaatatcagattctcgctagcttggtgggcttacacgtttccaatgacggcagtggccagtgcgacgatcaaatattcagacgaagtcacgggagtggcaacgaagatactatcggttgtgatgtcgggagcagcaactctgacggtgatagctgtgcttgggttgacggtgatgcatgcttttgtccaacgtgatctcttccccaatgacgttgtcattgccataagtgcagaacaaccgaagcagaagagatggttcaaacatctcacaaaagaaagttatggaaataatgagagatgtcccaagattttggatccggaagataatcaaatagatttagaatctcctcctttagtaaatgtagatagttccacggttcagaattcaaattaacaaaaaaaaaaaatgtgatgaaaattcatgatctttgttaattaacttctcatgtacaacactatagcagtgctaataataataaattagcgaaaatcttaattattttggtaaattttagttgcataccattctttttactgatcatgataaattacttcttcatttcagcaaaaatataaaaactataatcactttggcttattctttcgttagatttagttattatagtattgtttgattcaattcaagtaaaaactatttgagttataggcaaacttagtcacaccaaccgcaaccttcacaatttgtcttaacaagttagatcatatttcgtggaaataatgtctagcttaacatctaatttgtcgaatatatcttaatgtcactgttatgttaattcatcctccatctttatactttgtcaccaaaacgaatcgtcttgtcacatatgacatatgacagtaaaaacaatgtaataatttcctacacatcacgtttttgaaaaaaaacatccttcatcaaccgctggtcaatcttgaaagcatggtaaattcattcaaattacgtcaaatgattcgttctacaaaactctcagccgtcggatcatacgacttttgactaaaccacttaaacgacgacgcttcgacgggattggaaaacatcggcgccacatgatgatgatacgaacaaccgcgttattttatatgtgccgtaggtacaacgctgagttaggcccacccaaaaaaaagtttgacattatttaaaacgaacgaatctgaaagaataaagcagcagagtccactaatcaaacgaaccagaatttacccgcaccctatttattgtggtcgcgaccacacaacattttcaacttcttcttctcttccgtttcaccaccctttcttctcctaaattcgaagaaccaaaaccaaaaacgtgaattcggagttatgattttggatcttcttcccgtctttatatataattttctgggttatgtttttcttcttcttaattcatctgaccattggattggttttcgattgcagagtcttcaattggaatttggatcgtgggattttggaaatg

SEQ ID NO: 4330 - DNA, 3000 bp, Unknown
  misc_feature (1)..( 3000): cDNA_ID_1823891_gDNA_ID_1620700_Annot_ID_48749 3000 nt of promoter + ATG
agcatggttaaaaaccgattcgtatccttcaactctccccatataggccacttgaatgcctataagatcgtcaaactcggagatgacttccacaaagtcgtatctataaggaagctcctgtagttctaggtgactgttccaacttgcattccaatcactgaaaagagcccatgtttcgccttttctcgggttcacaatgacctcttcagcagatttgatgtgatccatctcatgagcaaacatcaagtggctcttgatctctgtatctccatattcaaatctcccacaaccactgagaatagactgctcatcttttgtagttttgacatgttcaagtagtgtcacctgcaaactcaactgggactcaaaaatctccctgatctgggcatagttcctaggcatatcatctctaggatcatataaagcccatacttgatcaacagcaaatgagctcattgacttgctaaaatcattaagctttgtatcaggacaagttaatgagttaggatcctcataacttttatctgtgcagacaattccttcaatgtctccatcatttgcttcctgagacttctgtttcttggcttgaggagtacaagaatcagcgtcactatcattctttaccaacaaaggaggttcaatttcaaggttggatctcttccgagactctgcttctacaagttgtggtcttgatgtttcttctaattccatctgcttcaattcaagctctttcaatcttttttccaatgtcttctccttaatctcaagaccttttctcatcagttcagtctcctctctcaatttttcagcttcttctttcatcttcagctccaaagtctcctcctttctcttcaattcagcagtcttctctttgacagcttcctcaagtgccctgagatccttctctcttgcctcactttcctcattccgtctctcagtctcagctctttgtttcagatgaaactccttctctgccttctctaactcacacaacttctcagaaactcggcaagcctcctctttcctcccatcaaactcactcaccagctcctcaagtttcttcgtcgtcgaacggagaaacaaaccaagcttattctcctctgttttaagttgtgtcactaaatcttcactctgcttctcaagcaccaatctcatgatacttgcttcaatgaccaatctcaaatcagtttcaatctctttctcctctaaaacacttaaccttcgagatattgactcttcaagcaaaccaatctccttctccttcatttcaaccactctcagtcgttcttccttcttctccagcgaggcgaccacgtcatcaaactgaagcgaaaactcaaaaattgatgaagattttgcctgaatcttgtctaggattttgagatacccttcactgttttgctcagtaacgtctgattctactgaatccccttgcattgccatattctcagagacataaaccctactttttagttaacaaaagatgggtcataaaggaagaaacttttcatgaaaaaatacaaaaatgagaatgtacagaaagaataaataatagaaacaaaaagtaggaagagaaaataaacctctcttgagtttggtcttcggttgacaccaacggtggtttctgagccggcgtgtcttctccgggaactagtaaaactttcggtttcaacatttttttcgctgtacgaacggagcctttgagcttatccaggaatttgaagaaaagttttaaactttcttggtaagactcagaaattttggtaaagaagaatggcttcttcccatctctcttatgaaacaagaaaaaatagaatgctttatttactgaaaatggagggagaaagagaaactagtgctattttgtcttattaccttataaatacagctttcctttttggccgttcgattgtattattttaagccgttggattattgtacatcagacgtcagctttctattaactctcggacaatggggttttgttgtagcccgttgggcgttggataaagatcatgagatttgtgaaagtgaaaggatcagctaaatgggcttcgtaggatgatttttgttagcccatcaaaaggtttatgaaagaaaaaaaaggaatcaatcagcccaatattacaaattacagaacctcattttcttaaattactatcactataattctaaactttcaagatggcaaaacagtagtaggaaaaacattctataatcgattttattgacgagtgtacggaacggatactaaaaatccgcagacgcgactaaacgagagtgcaaagccgcctcttttattgactccttgactttcgagtccactaggacattccgaggaacattatctctactctatatatgtcttttttacttgtttgcatattttatccgaacgtttttgtacgattcaatttcaatgtattcttacggtcgttgtccttgtatttatggattaacagtgcctttaacaatagcctgggactaccttcagattggagtccatcacttgatcatatcggttaagatgtaactggacaaatataactcgagagacaagaagtaatggtcaaaacaaaactgctcaaataaaaacaaaaaagtgaaagacaagatactttatctggacagcactaaagccaaaacacacaatatctttggttctggcccacatatttaccaaaataccattttcagaggacttatttgacttcacatacacaaaagagtcacaccgactgatcagatcctctgttcttttcaaacactgatcagatctacattttctttttccatcactttctcttcattttctgtaagtttatatatacatttatgtatgtgtgtgtggtttgcatgttcgttttcgtaatatgttaacaataatatacaactaacccatttgcaaaagttggatgtgacgttttgattcggtttttatatatttggatctttataaatatagttccaaatttatgtactaaaacagggaaaacaatg

SEQ ID NO: 4331 - DNA, 3000 bp, Unknown
  misc_feature (1)..( 3000): cDNA_ID_1823883_gDNA_ID_1620700_Annot_ID_48752 3000 nt of promoter + ATG
tcggaagagatccaaccttgaaattgaacctcctttgttggtaaagaatgatagtgacgctgattcttgtactcctcaagccaagaaacagaagtctcaggaagcaaatgatggagacattgaaggaattgtctgcacagataaaagttatgaggatcctaactcattaacttgtcctgatacaaagcttaatgattttagcaagtcaatgagctcatttgctgttgatcaagtatgggctttatatgatcctagagatgatatgcctaggaactatgcccagatcagggagatttttgagtcccagttgagtttgcaggtgacactacttgaacatgtcaaaactacaaaagatgagcagtctattctcagtggttgtgggagatttgaatatggagatacagagatcaagagccacttgatgtttgctcatgagatggatcacatcaaatctgctgaagaggtcattgtgaacccgagaaaaggcgaaacatgggctcttttcagtgattggaatgcaagttggaacagtcacctagaactacaggagcttccttatagatacgactttgtggaagtcatctccgagtttgacgatcttataggcattcaagtggcctatatggggagagttgaaggatacgaatcggtttttaaccatgctgagcagtatggatgcatcaagattgtgatcccacctgcggaaatgcagagattctctcacaaagttgaatcagtgaaattgagcgggaaggaggaagagggaatcccatttaggtccttcaagctaaaccctgctgctatgccgagatactatcatgtgcttgaggaggtggtggaaacggaaatacaaattaaagatccaacggtcgtacatcaaaatggatccacaaaagatcttcccataataatagattgagggattcaagcctggttggtgcacctttcttatctatgcaaatatatatttaagtatgtagagtgcttggtgatggctgaggttgcaggaagtagtgaaactgtaatctttttggtttctgtatctgttttctaaactgtctatcttctgaattgtaccaacttcctttgatataaataaaagagaatgctttaggaaaactaactgcctacttgctcgcttcggcatagacctcacatgtggattactgagtgtctcaaagtttcaactttgttttcacgaattgcattaaaactaacataatgaccatcctatgttgatcaaatgcgtctgctgtaacagtctgaacactacaatctaattgacacaagtcaatacaatccccaagctttgtatatcctcgaaactccagttctattattgaaaccatattcgtgcatttacataaataacacataacagaagtaaagactgaaactttagagtctaatacatcattaccttataaatacttccaaatgctataactatagacaatataaacgccaaagataaacggaatacgatccataacctttgcatcatcactcaaagcagagtaagtagtggctattgactatcctctgctgttgttgagaatcgaacctagagttcccaaaacggcgaaagcaagcaaagggctaacgtcaagcgtatcaaagactggagggataatgttcctgaagagattaagataaggatcacacagatctctaatggctgacaaaggctgacgatcccatggaatgtttgggaaccaactgagcaaaactctgaccatcagaacaccactgtatatatcgagccatttcgatagcccggctgcaactaccgtcaacggagtgttcagataaccggcgggtcgatcacggagcgacgcgaagaacaacggacttgctgttcggaaagatgcttgaatctgtggagataggttcacaattgcgacagagagcttctgaattagagatttgattacgacgccggctagaagcacgagggtggtgatcgatctagttgagtcggagaaggggaattgagaagggggtttagaggagagtaccggagacgaggaggtaacggcggaggaaacgatggttctagcgttatggagggagagattgaaagagagtttacggggaagagagagacggggacggatgatcggaggaggtagtctagggtttgcgagaattgaagcgcgaagagcgagactgttggttgtgaaagaagccatctttgttcctcggtgccggagattactcactcctcagaatgttgtatcggaggaaataatgaacccaaaagattaaaatagaaaaataaaatatttatttttggtcaaaaatttatctctttgtataaattattttagttacgaaacttcgttgcccaaaatataaaattaaaaaaaaatacgaaactaccttctttatttatttttattcaacaaataaaattaatttaattaaggatagaaaatgaatcgaagtagtgtactagtggtatagttaaagaaaaacgttttatgtaccagcttttatcacaacagctttacattgtaaccatgtttgaataaatcaacgaagaaagtcgttaaaaaaaaaaaacgttttctgtcaacaaatataattaattaggacggttctaaaaaattaaatagaatttaattacttcccaaatttgtagttttttttttgattcccttgaaattaataatctttttttttcccacaattttattaggaattttacaacggttgttatttcccggcaaaaatattaacgaccataagagttaatggaagaagcattgctaaaaatagagggaggatcgtcccacaccagtcaaacctatatgtcttctccgtcgtccactaaaatcttatttacccctcaaaaagacattcctccactacaaaaacttgagagcaaaacaaaacaggttatttgtttgacaagaaaacacaaaacattcattctttcgtttatatttgaatatctttccttctagggaatgctaatcaaggatttgttcggcagaa

SEQ ID NO: 4332 - DNA, 3000 bp, Unknown
  misc_feature (1)..( 3000): cDNA_ID_1823871_gDNA_ID_1620700_Annot_ID_48756 3000 nt of promoter + ATG
gctgcttcattgtctaccgtcacatgcacgtacatatccgttatgcctgaaccatattcacaactctttttaaaaacttcaattgcacaagtctaaggagtttgatttaaatgttcttaccccattctccagcaactctcttagacttgtcaataagtttgtaaccaactccattacgatgcagctcttttgcaacacagacgttgctcaagtatgctctagcaaaatccacaccaatcccctataacacaaaatactcttaggctactcaatttgtccaatttcagattttaagttcagcattgttggcaacatcaaatagacaaatacctctggttttgttccagcaatttcatcaggaagccaacgacattggttaagatcaaggcttcccaccacaactctgtcttctatgccatcagagaactgagaaacagatgaaccatagcacaaatccatatcacagttttttctagaccaggaagtaacaatgacatgatgacaattccaaatgtagagcaccataacttaaatgcaacaaaccctcttgaacaggtaaatacaggatgaccaaattgagtacacagaccttacatgcagagcataaatcctcaaaagagcttgataattgcgacaatggaagggtagcatttatgcaagcgacccgcgtaaacccttccctcttccctgaagttctctccttaagcgcctcgaattcacgctctgccaagtatcttctatgatcctaatgaaacttgaacagcaaactgtaacatcagcataagaaacaaaccataaaccaaacaaaacactcactaactaatcacacaacaacaacgaagttcttcaaaactataaacacagctccaacatcaattatcatttcatctaccaattcatagtcaacggagttgacttcatgatacaacaaatagctaaaaatcatcttctaattcaccgattaagtaagaaactgacttggatattgtaagcagaaggattgagttcgttgaaggttcgtacgcggagacaagctgcagcccaaagctcatcttctgacaccgattcggatatgacgaaagtcgacttgtcgatcgctggagcacaaatgtgtgaggaagcagcgacgggacggaaccgtaacttcaatgaaggaatcgaaagatacgagcgtgatgatccatctgtgtttgggtcgccgaaaatggcgatagaggatgaacttgggagagacgaacagagaaacgccattttttcgcggactaatcacatcctcagcttcttgctaagcttcaaagctcgcatgtttgggcttttctattatttgggcccaatatgagcccatagttttctgtttgtttacgcttctttcaatttttatccgagagaaatggcagccacacaaataccaactaaatgtcataactcataaacaaaagatacgtaacaaacttttaacgttttatttcccaccaaaagaaaatcaacatgtgtcatcatcactcatcatcttttctttcaacgacaaaaaataacattgttcttatcgcaacaatacatgttttatcatcatcatttgaatgtacgtaatcaatgtatctcgattctttttggttgatatagaaaagaatttggagttgtattttgttacctaataaaaatcaattaaaattaataatagtaatctacaccctcgttaagagaagcaagtagagctagttcatgcatgatgatgtcttagtaaaagaaataagattatctcatataaagtaatagttagaaagtgtggaaggattagaatgaggatgatgatgatgtgtgtcatgagtcattgatctttgtcattatcctatgattcatatctcttctttctcgtgcatccaattcttattggtcaacaaataccaatagaaatcatttcagcaataatggacagaaacctacttacgattggtgggagggatacacaagaagacaactagagtgactaactataacatgttcacgcatatgatcttttatctattttcataattctgatgtctgtgaccaccttgcaatacacctgtacttaaatgtagaatatacgttataatattcgtaatacaacgcatcacataggacctaaatggcgatttttatggttgcatagtttcttgaaaaatgttttattttgttgatacgtattcaatcgtgattgtcaagagaatgaaatatcatacagtgaaatcaaaaggaattaactaaacaataattggtagtcaaatcttaaaatgctatacgtataattttcttctttaatttttctttttttcttttttattttgtaagagatttctttgaacaataattaattcaatctttccttacgtattaaacaatgaatagaaaaaaatcacaagacattattgaataaatgtcggattatctactatatatgtgtgcgcatgtgatatagtactgtaatagtgggctacaggccaacttcggctttccaagaacatggttgcatcgagcatatctttgctagattttaaatataactacaacttcttgcttactttgtgatgcggaaactcaaaaccgtaatcactcatgttatattttttgttgttgctttcaacgctaatatctgaaaccagttttcgctggtctaagatccatttgcaagaaatgtcaacaaaataaaaagctcttatcattcccacgagttttagttaaggtaatctattattccaagacttccacgaaccacctatatatagaagcttacatattctatagacttaataaatgtatagttcaatattatgtcactaacgtacgcggctaacaggtttgttaatccttcctatcacatgattgacatacacacacacacacacgcacgacacattatttgtattcagtattcacatatacgatatataattacaagagacgtgtatattgagagattcattttttagtgattgtagatcttaagagagagagagagag

SEQ ID NO: 4333 - DNA, 3000 bp, Unknown
  misc_feature (1)..( 3000): cDNA_ID_1013388_gDNA_ID_1620700_Annot_ID_48757 3000 nt of promoter + ATG
ttaaaacaggatcagatgaatccataaaaaaatgtagaaactatatgaacagtgaccacctacttacaattgatgaaaaaacaagtccatgagcattgtctttccagttcctactcctccatataagtataagcctttgacaggagagacagaagagtgagacacaaatttgttccagaaccaattactcctagtggactttgcagatgcagaataacgatccaatcgacaagcatcagcagattgaacaagctcgtcgtagagtctctgaagttctcttagtgtacctagctgcaaccaaaaaaaaagaaaagattcaaaaatcgatttcactgctaatgaatgaaccataaaaggaaagtacctgacataaatctccatccaataactctccagctacgattctgcgttcatactccactaacggccctgcaatctttccatctccattggaatgtggagacgaacagaaggaagaagccgagaatagagatgaagaagatgtgctgggattgatagagatcaaacaattatgaatgggagcgaaagcgtatcgttgatgcctcgagaatagagttacacggcgaagggagagaagaagcaatcgcatggtgagaatgagaatgagagagagagaaaggtaatcggaaacctcttcagtgatcggaggatgacggattcaacgaagaagaagaagaagaagaagaatcgaagcgatgcaccttcctcactactcgcacctgctcaagctcagactctctgaactaaagaaagattcaacaacaaaagactaaaccgataataaccgattgaatcggtttaaactgtaaagtgaacttaggcccattagtattggagcccaacaatgaaagcggcctcattggcttctttttcttctagtcgtcgtcaccggaggagaaaagttggcgatttgcaaacttcattttcaatcgactgcgtctcctctttcttctcctacccaaccaaagtttctcatcattcatttcagatcagccatggaggacgaggtaatcttacatcttttcgtatatatttattataaacacgatttagctctgtttttccgccggagattataatttgccggagacctttattcgagatctgattgatcatttcttatatgcctacattaactttgatacccattagatttctttttgatggaaatcgatttgatgtgaaattagctgctcgttactctggctttttccactcatcctctatagatgatctggtggagtgtttgtatagagaagaaagacatatgagttcattagaattgtagaaaagtgatggaagattttccgtcaaatcgttttctcaaaggcgtggtggtctattgttgctcgactggaattgtataatagagtttctctgtcaaaccattttggcatttttttagtagacttgggaactgaaagagaagaaaagatggatctttgaagtctaaaagaaaatgttgttattgttggtctccatcttcgtgactcactaggaaaatttatggttttatctgagttttaaatggcacaaagcgcaccatggcacagagagtcctttagtgcgctatgtgccatggctcaccaaagcgcgcgctttttggatctgtggcgttctcttaacagattctctgcatatggttttagccttcaagcttatatcgtctatggtgttctatttagaaaaattagggattttacatcttctaactggttaaaatgtcgtgggttaagaggtaagggtcaaatccgttttagtttaagataaacctaggattgatttggtttgataagctaattataacacatggttaaactttctagtcgtggattaggctaccaaaccacttaaattgaatcatgtattaaccagctaggtttagaaaatggtttatcctattcctcctagtcatttcttcgtgcaaaccctaaaatcacagaattctgttgttggtttcgaagagttttcgcctgaacacaagaggcgatcgctttgccaccttgtgcatcggccaaggctcacgtatggcgtgcgcatcatagatgtcgcctcgcctccacgtcttgttgccctattcttagagcatcggtgcgctatgcgccatggcacgccattagcgcgctttttaaaaccaagggttttatctcggtgtctaaatctgtttgttttggtgtttctattgaatttagattgaactgaaaactgctcctgctgattttcggtttccaacaacaaaccaaacgaggcactgcttcacccgttacattgagttccacaggtactcttgtgtgatagagttagtgactcttcagttcattctctaacttcaacaacaataacataaacaatatctgtgcaggtgcacaactgcaaaaggtgaggatgcaaatgaatgcgagaggttcgccaagtactaccgcgctctctgccctggggaatgggtttgtactttcattttttattatccgtcagcttcactagctactcacattcttaacaagatatgtgattatcttctcgcaggttgacaagtggaatgagcagagggagactggaacattccctggccctctttgattcacacaagaatctctctttttcattttaagtttgagaccaaaaaaggtcgtgtggatgatcatgaaatctataactcttgtctttcattaatcgtttttccttggatgatcaattaaataaattggaacaagacattctttggattcatcatgtcagaattttatttgtcgagacaattttgtcacttccaacaacttaaagggtgtaaacaataaatagcaaaagattttaacttttagttgtctagctgtcttaagaaccaattagttccgtttaagtcccaacagatttcgtaacggacaaagttcccaattctttttttttgcataataagatctgaaatcggagatagaaaaaaaaatcacatttttatttccgccggaacaaaaagcgatg

SEQ ID NO: 4334 - DNA, 3000 bp, Unknown
  misc_feature (1)..( 3000): cDNA_ID_1823861_gDNA_ID_1620700_Annot_ID_48760 3000 nt of promoter + ATG
tgctttttttgtttgtgttagcttcaaatatcttattaactttcacaatactgaaacagagcaaataatttacaaacagaattttagaccatttgagaaatttctacaaaatcaatcgagaaaagcaaattacatgaatcattgtcaaacagtacaataatgatcactacaagggagcttataaaagaagagcaaggagtaaagaggaagcagcaccaatatggaaggagcctgggaacataatagttgaggctgcagaggatgttgttgtgttgcgaggtcctctgtatttcacccttttcttcatcaccactgcgagatttcttgagccatgctcaccctcagctgaacacaaaagaaaggcctgagagaagaagaagaggaatacgatggagaagaggagtatgcgtctggctttgatcatctcacccatctttggtttttgcgttttgcttaattctgatggatgtgagtattacatatataaagattaggaagaagaaatgttctatagttattaatgattaagtcttattaggtgtgttataaacaatattaattgacgcgctccagccaagtggatttgggcagctatagtgttgcagacttgaccaatcttgatatagaaagccatttcaagcacaaaacgtggaaaaatggaaagatagaaaatgattttcagatattgaaggattaataacaatttgtggaatgaaattgcctaggtccatggagaggggaaacttgaattcaatcatgtagtcatcttaatttgaaattattgggggtaaaaaagagttgtagcgaaatataatactaggcaattggacatgtctcttctctgtttaaaattgactcatccaccttatgtgtttctttcttccagctttgatccttttgtcaatgcatatactacttgttttctttctttctttctttcttaaaatggacatttcatacacgttgggccatatggcccatatcaatgtatcattttgtgttaggttttatccactggattctatgtcaccttgaacatatattattgctttgctcaagctccccgtgtctacgttctgtcaagtagttttcccctttctcacatagatagctagatgccttatgcatatcattcaattttaggcttcatacgcgtaaaaatggattttcaaaaagagaaaaagacaaagactcaagcaaaatctagggagccctcacgtggttcgtctctactaatcatggtctctatatgctaggctttttgttagattagaaacataacgcaaagtcacatgatggcacgtgtccgatcctaacaaatgtgatacttcctaacagactcttggaaaattcctaacgattgatatcatagcaacatgttacattgtaatttataaatcgatcgaagaagaaaataattggatgtacggtatcggaaaattcgacaatacataatttgcgttgataaattaaagatctatctatatggtagaaagcttatattggatgcttagttccaagcatgagtatcaatgtatcatgcatagggaatatctttgacatgtaaacttttggtgttatgcaatgatcattgtcaaagaatgccattcacaattttacgaaggtgaagactacatatataaatgctcgctaaggttttgccaatactaatccggaaataaagtgtttctgacgaaaagatctacccaaagatgtatgttagtaagttgcagcgcacatgaatggatccaattatatgtttgtcaacgaaccaattacgatcatttcaaaaaaaaaataacgatcatttcttgaaatcgtttttaacgatgaagtgcgcaatttattttgtagacggtaacaaccatgcaaatagaattaaagaagaaaaataaacaaaaaaaagactaatctagacgaattaaaaaaaaaaaaaaactacacaaatgaaattttgaaactttttgtttataattttcttttgaaaattcaaaaatttatgcttaataatcttgtggcaaaaaaagcccaaaagagccaaaaagttcataaacacgaagatccatactgtaaaataaactaaaataaattgataataagatatgtaaagtcatgggtgaaatctcaaaaaatgatgaaaataagggggaaacattaaattaaattcaattgttcaaaaaaaaggaaaaaatcatatagaaagatagaagaaaagatgaagttggtgatgaggtgttaaagaagcaaacaaagaaatgagaggtctcaattttacttagcctcaaaacactcttaaggagaatagaagagagaatagcctcgcaccttatcctatcctttctatctctctctctatatctctatctctattttctcaatcactatttgacccctctcgtatcttatttccttttacttcctcattgtcaccaccactagtccctcatttatacacacacacacacacacacacacccttctctcttcttttttccttctatcttcttcttcctcacccttcatctccacttattcaaatacacacttcccctgccaagtctttagggatataattcaatccaaggctagcttaattttgagttttcttgatcaaattcagaattgtaagttttatgtgaattggtaatggctcctaaagcggggaaaacaaagccacacaagagtaaaggagagaagaagaagaaggaagagaaaggttctcattacaaactaattcaataccattcaaaattttcttatcttaagattcattttggtttctccacgcattatgagaattcaatttttgcttccttagctcttcttttatttgataacattaaaaaaattgcgtggttgtgcagttttgcccactgtcattgagataagtgttgaaacaccagatgaatcccaagtgacactcaaggtttgatgagcttaacactaaataacaaaacattgattgagaaattgtttataactcaaaagccaatgaatatg

SEQ ID NO: 4335 - DNA, 3000 bp, Unknown
  misc_feature (1)..( 3000): cDNA_ID_1823857_gDNA_ID_1620700_Annot_ID_48761 3000 nt of promoter + ATG
tgtttctccaccattcatatcttttttttattttctctaactcctatctttaaatttttctctttcacatatttttgctagcgttttgcgaaattaaaagccaccatgttatatacatgaacatgtaaatacattacaaatgtacatggataaatatgaactatacattatgcttagttactaatgtagacatgtagttaagaattcttagttactactagaactagtagtacaaaacaaaaagacaaggcctataatttccggagctaaacacagtttacaaagggattatagactctaaaacaaaccagaaactgccaaaagtcaggaatctcttgtttttcttccctcacatctctcttctctctctcttcacaatagtcctttggacagaacaaaagagagagaagatagtgaataatggaaggctgcttttcttcgtgaatctcagaatcttaaaagactcagatttgagaaaacgtttcaatatctaaatccatttctctccctctctctttagccatttagaatgaagaaaagtctcactctactcatcctcctcctctgttctctcctcttctccaccgtcttgagcaacctactcgtcgaaccggtccaacccaacaccgtaccagccttccccgtcgaaacccaagctcaaagctgccgacttgacctctccaacgagctattcggtggcgtcaacgaagcttgcggaagaaaccttgaccggagtcgatgttgccctgttttagccgcttggctcttcgcagctcacgctcgctctgctctccagttaccagctcctgctccaacgccggaatcttctgatcccgacgaacccatgaagcctgacgactctcagaagtgcgtcaacacattgcaaagtgcgcttttgactaaacaaatcaagatccctcagcctaattctagctgtgacgcaatcttgtgcttctgtggtattcgtctccaccagattagctcactctcttgtcccgccgctttcaatgtctcctccggcttcaaaaacgcaactccgaccgccgccgtgaagaatcttgaaaaagaatgccggaactcttcttactccggttgtaccagatgcctcggtgctcttcaaaaggttcaatttttataacttaagttcaaatttttcgcattccgtcacattaaattttcattctttatgtccctagtccctacactaaggattcacagagcatttaatgaaatttttttcttatccttaaaagcataataaatgttttgatttcatttgcgtgaagtcttcttcagaatgttcaagtagctgtcactctctatccatgagtaacatgttcaccaaactcacaataacaaattttactgttaattttagggtttatgttgaaagagacacacacaagcacattgttggtttttctttggctatccttttaggttgcaaacaattggagatgtgctttttcagaaactttcttttttcgtatagacccaaagcactgcaacactctgaaacccttcactttcacacgcaatctttttgttttccattatattaatgaatcttgttttttgtttcaaattttgatgggtggatttacagctaaaggtaagaggaggaaacaagaagacaacaacagagagagggactaagatgatgagcaaagattgccagctcatgggactcacatggctactagctcgtaacaaaacggcatacattcccactgtttcggctgtgttaagagctattatgtatagtccacacccacctcacctcaacaagtgtagtcctgaccaagagaacatgcctttagcagttgactctctacagtttcaaaagagcttctcttcatcatctcatctttttggggttttaccgtttttacccttagtcctttgtatctttctctttctactgtgatttttttctgtattttttggtcgggaggggtaaagagagtcacgtgaagctacaagacagttatgtgtatgtaaatgctgtgctctttttttggttctgcaaactcttaaccctcattttttggttttaactgtgttttgtcccatttaacactttgtacgaggtcttgaaattttaaaaaatcatcttggcatttagaaagttgtcatattggactatataagaaccatatcatgtgaacttaataaacaattacaaaagagagagagcctttggtagtcgtcgaatcccaaggactatacttactaagcatgttggtcgtgtccactaatgcgaatgtattcccccaaagtcaaatccaaaaggcattgcaattcctcttattaatctattactagtttataaagtgtggtgttatctcacacaagcttaactatatttttgacaaactatttttgcgaaaattttcttgggaaccatgtcaatgagaaccacctttctaccataaaagtttgaaggttttttaaactgatctcactggagtaaaattaactgcttaaaataatacatctcaatgaagccctgaaacaacaagtgagaatgcaacagtcaccataataggaggtctttaaatataaaatgaatatcaataataataaaaaaaatcattgagagaatcaagaagagatttgtgtctttgtatagacacttaagactctttaccacttatttaaagacactacttttcatgtgtttccttttaattggtcaatgtgtttttgacattaaaatattaaatcttttgattttgagacactcaaaatagtggttcactaatgaggatgctaatgggcttgctagataacttttttttttcttcttttacaagaaattgaatgatacacgtaataagttatttagcttattgaaaagcttcgcattagactttaaagacgtcaccgagtcaaatttcggttactacaaactccaaaactcatattcaagctctctcttctcactttttcttctttggcctcctctacattaccaaagtttcatcaagattgagtatg

SEQ ID NO: 4336 - DNA, 3000 bp, Unknown; identical to SEQ ID NO: 4335
  misc_feature (1)..( 3000): cDNA_ID_1823857_gDNA_ID_1620700_Annot_ID_165053 3000 nt of promoter + ATG

SEQ ID NO: 4337 - DNA, 3000 bp, Unknown
  misc_feature (1)..( 3000): cDNA_ID_2051189_gDNA_ID_1620700_Annot_ID_165050 3000 nt of promoter + ATG
tgaatacaaaaacaaaaaaaattctccaatcaacctttttgaaccactcttttgtcacgcatcacatgaacggatactgcggatctctggggcgatcgtgacctggagtgatggtttgatcaacacagctgtagcaaccaggttgtcaagagatgcttttagaatcatgcagcttggttctgtgatgaattgtttgcatgtgtagtaagatctatgtgacttggttataggattgtgataaggtgaaacaaatacgtagagatgtgggacaagtgaccatatacttttgacttttcttatagataagaaacaactggaatgaaacatagggatcggagaagcttctccgactgctttttttgtttgtgttagcttcaaatatcttattaactttcacaatactgaaacagagcaaataatttacaaacagaattttagaccatttgagaaatttctacaaaatcaatcgagaaaagcaaattacatgaatcattgtcaaacagtacaataatgatcactacaagggagcttataaaagaagagcaaggagtaaagaggaagcagcaccaatatggaaggagcctgggaacataatagttgaggctgcagaggatgttgttgtgttgcgaggtcctctgtatttcacccttttcttcatcaccactgcgagatttcttgagccatgctcaccctcagctgaacacaaaagaaaggcctgagagaagaagaagaggaatacgatggagaagaggagtatgcgtctggctttgatcatctcacccatctttggtttttgcgttttgcttaattctgatggatgtgagtattacatatataaagattaggaagaagaaatgttctatagttattaatgattaagtcttattaggtgtgttataaacaatattaattgacgcgctccagccaagtggatttgggcagctatagtgttgcagacttgaccaatcttgatatagaaagccatttcaagcacaaaacgtggaaaaatggaaagatagaaaatgattttcagatattgaaggattaataacaatttgtggaatgaaattgcctaggtccatggagaggggaaacttgaattcaatcatgtagtcatcttaatttgaaattattgggggtaaaaaagagttgtagcgaaatataatactaggcaattggacatgtctcttctctgtttaaaattgactcatccaccttatgtgtttctttcttccagctttgatccttttgtcaatgcatatactacttgttttctttctttctttctttcttaaaatggacatttcatacacgttgggccatatggcccatatcaatgtatcattttgtgttaggttttatccactggattctatgtcaccttgaacatatattattgctttgctcaagctccccgtgtctacgttctgtcaagtagttttcccctttctcacatagatagctagatgccttatgcatatcattcaattttaggcttcatacgcgtaaaaatggattttcaaaaagagaaaaagacaaagactcaagcaaaatctagggagccctcacgtggttcgtctctactaatcatggtctctatatgctaggctttttgttagattagaaacataacgcaaagtcacatgatggcacgtgtccgatcctaacaaatgtgatacttcctaacagactcttggaaaattcctaacgattgatatcatagcaacatgttacattgtaatttataaatcgatcgaagaagaaaataattggatgtacggtatcggaaaattcgacaatacataatttgcgttgataaattaaagatctatctatatggtagaaagcttatattggatgcttagttccaagcatgagtatcaatgtatcatgcatagggaatatctttgacatgtaaacttttggtgttatgcaatgatcattgtcaaagaatgccattcacaattttacgaaggtgaagactacatatataaatgctcgctaaggttttgccaatactaatccggaaataaagtgtttctgacgaaaagatctacccaaagatgtatgttagtaagttgcagcgcacatgaatggatccaattatatgtttgtcaacgaaccaattacgatcatttcaaaaaaaaaataacgatcatttcttgaaatcgtttttaacgatgaagtgcgcaatttattttgtagacggtaacaaccatgcaaatagaattaaagaagaaaaataaacaaaaaaaagactaatctagacgaattaaaaaaaaaaaaaaactacacaaatgaaattttgaaactttttgtttataattttcttttgaaaattcaaaaatttatgcttaataatcttgtggcaaaaaaagcccaaaagagccaaaaagttcataaacacgaagatccatactgtaaaataaactaaaataaattgataataagatatgtaaagtcatgggtgaaatctcaaaaaatgatgaaaataagggggaaacattaaattaaattcaattgttcaaaaaaaaggaaaaaatcatatagaaagatagaagaaaagatgaagttggtgatgaggtgttaaagaagcaaacaaagaaatgagaggtctcaattttacttagcctcaaaacactcttaaggagaatagaagagagaatagcctcgcaccttatcctatcctttctatctctctctctatatctctatctctattttctcaatcactatttgacccctctcgtatcttatttccttttacttcctcattgtcaccaccactagtccctcatttatacacacacacacacacacacacacccttctctcttcttttttccttctatcttcttcttcctcacccttcatctccacttattcaaatacacacttcccctgccaagtctttagggatataattcaatccaaggctagcttaattttgagttttcttgatcaaattcagaattgtaagttttatgtgaattggtaatg

SEQ ID NO: 4338 - DNA, 3000 bp, Unknown
  misc_feature (1)..( 3000): cDNA_ID_2051193_gDNA_ID_1620700_Annot_ID_165049 3000 nt of promoter + ATG
ttgaatccatgaatctcatcaaaaagctagattcacttttaaaatcccgatctctaattctaaatcacagatgaaattttttttaaatcagatcaaaattgtgaacctgaagagcattaagattagatttgtagaaatcttcaacgttaatgctggcataacgagtacgataagtggagcaaacgtcagagtacatcaaacaactcctgatccgttcccaattcttagcattgttgacacgtttctgcaaccaattagagtaatcggcgacatgatactctttataccctcgatccgatataacctcaccggcgccgcggtttgtgactgcgaaagcgaagattgtgaaacagaagccgaggagaatgaggaggaacatagcgaagaggtaaagccagaggaggcaagagacacggcaacaagcaccgacgagtccggcgattgagacgaacatgaggaagattccgagtacgaccattggtttgtcgaggaaacgttcgcattcggttgctgcatttttgccgagccagatcccggcggagagaattgggattgagaggaggaatgtgaagaaattgaggattccgaggagattgttgctacactgaaccatcgctttttgttccggcggaaataaaaatgtgatttttttttctatctccgatttcagatcttattatgcaaaaaaaaagaattgggaactttgtccgttacgaaatctgttgggacttaaacggaactaattggttcttaagacagctagacaactaaaagttaaaatcttttgctatttattgtttacaccctttaagttgttggaagtgacaaaattgtctcgacaaataaaattctgacatgatgaatccaaagaatgtcttgttccaatttatttaattgatcatccaaggaaaaacgattaatgaaagacaagagttatagatttcatgatcatccacacgaccttttttggtctcaaacttaaaatgaaaaagagagattcttgtgtgaatcaaagagggccagggaatgttccagtctccctctgctcattccacttgtcaacctgcgagaagataatcacatatcttgttaagaatgtgagtagctagtgaagctgacggataataaaaaatgaaagtacaaacccattccccagggcagagagcgcggtagtacttggcgaacctctcgcattcatttgcatcctcaccttttgcagttgtgcacctgcacagatattgtttatgttattgttgttgaagttagagaatgaactgaagagtcactaactctatcacacaagagtacctgtggaactcaatgtaacgggtgaagcagtgcctcgtttggtttgttgttggaaaccgaaaatcagcaggagcagttttcagttcaatctaaattcaatagaaacaccaaaacaaacagatttagacaccgagataaaacccttggttttaaaaagcgcgctaatggcgtgccatggcgcatagcgcaccgatgctctaagaatagggcaacaagacgtggaggcgaggcgacatctatgatgcgcacgccatacgtgagccttggccgatgcacaaggtggcaaagcgatcgcctcttgtgttcaggcgaaaactcttcgaaaccaacaacagaattctgtgattttagggtttgcacgaagaaatgactaggaggaataggataaaccattttctaaacctagctggttaatacatgattcaatttaagtggtttggtagcctaatccacgactagaaagtttaaccatgtgttataattagcttatcaaaccaaatcaatcctaggtttatcttaaactaaaacggatttgacccttacctcttaacccacgacattttaaccagttagaagatgtaaaatccctaatttttctaaatagaacaccatagacgatataagcttgaaggctaaaaccatatgcagagaatctgttaagagaacgccacagatccaaaaagcgcgcgctttggtgagccatggcacatagcgcactaaaggactctctgtgccatggtgcgctttgtgccatttaaaactcagataaaaccataaattttcctagtgagtcacgaagatggagaccaacaataacaacattttcttttagacttcaaagatccatcttttcttctctttcagttcccaagtctactaaaaaaatgccaaaatggtttgacagagaaactctattatacaattccagtcgagcaacaatagaccaccacgcctttgagaaaacgatttgacggaaaatcttccatcacttttctacaattctaatgaactcatatgtctttcttctctatacaaacactccaccagatcatctatagaggatgagtggaaaaagccagagtaacgagcagctaatttcacatcaaatcgatttccatcaaaaagaaatctaatgggtatcaaagttaatgtaggcatataagaaatgatcaatcagatctcgaataaaggtctccggcaaattataatctccggcggaaaaacagagctaaatcgtgtttataataaatatatacgaaaagatgtaagattacctcgtcctccatggctgatctgaaatgaatgatgagaaactttggttgggtaggagaagaaagaggagacgcagtcgattgaaaatgaagtttgcaaatcgccaacttttctcctccggtgacgacgactagaagaaaaagaagccaatgaggccgctttcattgttgggctccaatactaatgggcctaagttcactttacagtttaaaccgattcaatcggttattatcggtttagtcttttgttgttgaatctttctttagttcagagagtctgagcttgagcaggtgcgagtagtgaggaaggtgcatcgcttcgattcttcttcttcttcttcttcttcgttgaatccgtcatcctccgatcactgaagaggtttccgattacctttctctctctctcattctcattctcacc

SEQ ID NO: 4339 - DNA, 3000 bp, Unknown; identical to SEQ ID NO: 4333
  misc_feature (1)..( 3000): cDNA_ID_1013388_gDNA_ID_1620700_Annot_ID_165047 3000 nt of promoter + ATG

SEQ ID NO: 4340 - DNA, 3000 bp, Unknown; identical to SEQ ID NO: 4332
  misc_feature (1)..( 3000): cDNA_ID_1823871_gDNA_ID_1620700_Annot_ID_165046 3000 nt of promoter + ATG

SEQ ID NO: 4341 - DNA, 3000 bp, Unknown
  misc_feature (1)..( 3000): cDNA_ID_3073053_gDNA_ID_1620700_Annot_ID_165045 3000 nt of promoter + ATG
gattgagaggaagtgttgtgttcattttccaatttcaggtctgttgattcttcttgatagtcttcagatttgccccagagaacaatgtagagaccaaggatgatagccaaagcgcctaacaagctgcagaaacgagcaaaacagatttaaaaatgtgaattgagctacagaacgaagagaggatagtaagaaaatggcatacctcccgaggtaagtctgttcttttagatacagagcgccgaagaaagtgacgatgactgcagaaagagggttgaagagggcagagaaaacaggtcctttctgtgatacgatccaagcttgtagaaagaaagatatcgccaactggaatccagagtatatgcagcaagagagcttcaagaaggaatcaagcttccagggcggtaaatgagtgttgcctaaggcgagagccacgaggaaagaagctatggtagcgatgaaacatgtgcaggcagaagtgtacaagtggtcaggacagtgagaggcaataggaacctgaaggatcaaccaaagagaccaagcaaatgtgctaataagaaggaagaagcagccgagtaaccaagctgtgttgtcttggttgagcaaggcattgagcaattttggacctctgagaaaagtcattgccatggctcctcccacacagacaccagttcctattacttttgcaacacttttcatacttctcctctttatactctcgaacctgaaacaaacatccaatatcaataataaataaccaatccatcaatatagaatcttagaacatatatgttgatgatacatacccaacaatgatggagataatgaaggtgacggcaggaataagattagtcatggcacaagccatggatgaagaagacaagtcaatccctttgaaataagcgttctgattaacagtcacaccaataacagccgtcaaagccacccaccaaaagcctcttactcccagagaaggtttgttttctttcctcctaattaccattcacatggaaatgagtcagaattcatgtgataaataatatatagattggttcaaaaacactgaacttaccaagcggaaatgaaagagatggggcagatgaagagagtggcgatggcttgacggtaaacaacgaagacggtgggattgagaccttccatgaaagcagctttcgtgaagagtgcaactccggcggacgtaaactgcaacatcactaacgctagcaccgccttgtatttcgatatctccatctctctctctctctcttaagatctacaatcactaaaaaatgaatctctcaatatacacgtctcttgtaattatatatcgtatatgtgaatactgaatacaaataatgtgtcgtgcgtgtgtgtgtgtgtgtatgtcaatcatgtgataggaaggattaacaaacctgttagccgcgtacgttagtgacataatattgaactatacatttattaagtctatagaatatgtaagcttctatatataggtggttcgtggaagtcttggaataatagattaccttaactaaaactcgtgggaatgataagagctttttattttgttgacatttcttgcaaatggatcttagaccagcgaaaactggtttcagatattagcgttgaaagcaacaacaaaaaatataacatgagtgattacggttttgagtttccgcatcacaaagtaagcaagaagttgtagttatatttaaaatctagcaaagatatgctcgatgcaaccatgttcttggaaagccgaagttggcctgtagcccactattacagtactatatcacatgcgcacacatatatagtagataatccgacatttattcaataatgtcttgtgatttttttctattcattgtttaatacgtaaggaaagattgaattaattattgttcaaagaaatctcttacaaaataaaaaagaaaaaaagaaaaattaaagaagaaaattatacgtatagcattttaagatttgactaccaattattgtttagttaattccttttgatttcactgtatgatatttcattctcttgacaatcacgattgaatacgtatcaacaaaataaaacatttttcaagaaactatgcaaccataaaaatcgccatttaggtcctatgtgatgcgttgtattacgaatattataacgtatattctacatttaagtacaggtgtattgcaaggtggtcacagacatcagaattatgaaaatagataaaagatcatatgcgtgaacatgttatagttagtcactctagttgtcttcttgtgtatccctcccaccaatcgtaagtaggtttctgtccattattgctgaaatgatttctattggtatttgttgaccaataagaattggatgcacgagaaagaagagatatgaatcataggataatgacaaagatcaatgactcatgacacacatcatcatcatcctcattctaatccttccacactttctaactattactttatatgagataatcttatttcttttactaagacatcatcatgcatgaactagctctacttgcttctcttaacgagggtgtagattactattattaattttaattgatttttattaggtaacaaaatacaactccaaattcttttctatatcaaccaaaaagaatcgagatacattgattacgtacattcaaatgatgatgataaaacatgtattgttgcgataagaacaatgttattttttgtcgttgaaagaaaagatgatgagtgatgatgacacatgttgattttcttttggtgggaaataaaacgttaaaagtttgttacgtatcttttgtttatgagttatgacatttagttggtatttgtgtggctgccatttctctcggataaaaattgaaagaagcgtaaacaaacagaaaactatgggctcatattgggcccaaataatagaaaagcccaaacatgcgagctttgaagcttagcaagaagctgaggatgtgattagtccgcgaaaaaatg

SEQ ID NO: 4342 - DNA, 3000 bp, Unknown; identical to SEQ ID NO: 4329
  misc_feature (1)..( 3000): cDNA_ID_1840331_gDNA_ID_1620700_Annot_ID_165037 3000 nt of promoter + ATG

SEQ ID NO: 4343 - DNA, 3000 bp, Unknown
  misc_feature (1)..( 3000): cDNA_ID_3092135_gDNA_ID_1620700_Annot_ID_165035 3000 nt of promoter + ATG
atttcgttacattcggagacgatagacggaaaaacagggacattggctatagaatcgttcgtggtggatgtgccggaaggtaacacaaaggaggagacatgcttcttcgtggaggctttgattcaatgcaatctcaattctttagcagatgttaccgagcgtctacaagcagaatctatggagaagaagatatgagatgtgacttgagaatcttttcattcggaaaagaaggaaaaagaccaaagaagagaaataactcttcccttttatagcaatgtctatgttttttcttcttctatttccattttctgaatgtttgtatattattggaagtttgtaacgaaatgatttcgaatagctgtcaaacgagaaatataaattcaaatttgtaagtgtttatatgaaatgcttttttatttttaacatttccacatgaaaatataaataacatatcatgacacatgcaaaatcatatttatgaaagttttttcaactctctccattttttcgacatatcagcattagatagagtgacacttatcacatcaacatatgaattacatttcttatttaatttaatgtatttaagaatttataatcatgcattaattctttctaaattttttgacatgtttgaacttattaattaaataatttcaatttaattaggtacaaagtatatcaaactcacataaataacttatttaaattaaattatataaatcgtataaacttatgtataaacataaaattaatagaattttaatgaacttttagatttgattaaagtataaaaattaaataatatgatataagaatttatttcatgttttcatatactaatatatatatatatatatatatatataaaagattaataacaattgatattagttaaatttacggtttagtttaaggtaaacccaagatgctctcatctggaattctgttatgatctgtacgtcctcaaagttccagagatgttgagaaagatcaaacatcagcagcgtcagaggctttttctctggagaggtgatgttgaatggctctatgcgctgctcggagagcaaaagagtcttgaagaagactctagcaaatccatattggcatctaagcttgatctttgtgttcctgttatgaaacacagaatctagactgagactgaagttggatacctcagctttgggatggagaataccggaactcttggccggagtaagaggatggaaagcatgctgaagatgagcaagagcgttccaagaaagactatgacgaagaaaacaaatcagaaatatactaagtatgagttgtttcaaagaacgtagtaatggtttataataatattaacaatagaataaaataaatagtaatggtttaagaaaatattaataatagtgagcaaaagctaagcaaaatataagcaaaacataataacatagtcaaaataatatggaaatgacaagtatataaattatatgttaaaagttaagaaattgacttggaggtttgtgttgggattttcccttaacttaaataaaggttttaaatgtgaacaaaaaaagtttgaagttttagttgggaaaatgttttgatttggaggtttgttttggaattttttcacttacctaaaaagattttggttattattaacataaaattctactaataacaattgatatgcttcttcgtgttaaaaacaaaaaaaaaacaattgatatgcttcttctttttttgtgcacccaataaatatgaattaaataagcatttttaatagatttatctcttgatagggtatccatctaaacaaatacaaaaaagaatacatttaaccaaaatgcttatctaatgtatatttaaatgtaaaactttattgtatttgttaatttagcaaaagataaaatgtctaattgctaaatcatatttacaaaatataatatctgttaattaaatcatgattcagttgtttgggctgttaattttgttttaatccgtctttgggcttgacccttctgtatttgcctattgggctttatgaatgttatgaatgaaaatgaatagtcacaaaacaaaagaaaaaaaacagaatttgagtcggtacacaactgttaacgaggtgtacttggtggaatcatagacacgtgtcttgacactcttaaggcctcttcaccaccaaattacttccctaacaaaagaattattattattgtgaagccccaaaagatcgaacattctaattcaatggcctacttgctgaccaagcaaaaaggaccggctccgttttcacctaattccgagcttcacaacgtgccttccattggttgaatattcaactggtttaaccaaaccgaagttacacatacgatttgagtcggtacacaaatattacgagacgtactttgtggacagtttgacacgtgtatcgccactctttatccctcttcaccagtcaccactcaccaccaacttaaaaataaaataaaaagagcatatattgtggagccccttacatgatcgaaaattctcgttcaaaagcattcgttaagaccgtgtgttgtgtgtcgttttttgtcgacgaaaattagaccggctctgtttttattggctcgtttcgattgaaagcgtggctataattggtttaaccaaaccgaagtcgacgtctcggtttgttcggttaagattaagccttgtagaacattccaaaacgccgcgtcaaagcttttagggtttgattctgctgtgtggctacccactcaagtctccagtgttcctttgtggctctggtttgccctattcttctcttccccctctctctctctctctctctcttgttttctttttccctcttctccaaggaatctggaaaaaattaaaccttttttctaaatccctggaaatcagaaaacttcctattgagaaaccatagattcgatccaagcctttgattgtatcaaaatctctgcttcaccaagaatttgggttgatacagaagaaaaaagttaa

SEQ ID NO: 4344 - DNA, 1207 bp, Unknown
  misc_feature (1)..( 1207): cDNA_ID_3073065_gDNA_ID_1620700_Annot_ID_165033 3000 nt of promoter + ATG
cttccctcaaagatggagtaaggaaattgaagtaaaacaaacaatttggactaatgaaattttataaaacgattcaagttggaaaatacaaggaattaacaaaacgtgttttggacgtcaaaatttagacaagagtagtcaagaatccaactatggaactaaaccatcctcactgttaaatctagactctagtgattagcattcaacaaaaacaaattatacttttcgtacggaacatattctgaaactattcacatgtcagttttgtcatttcctcaaaactcatattcattttttttttaaatggacatcacgggacctgagttcctggccataaaggctaaaaagcagatccaagaattgattgattatatgaatttagttacaaagtacaaccagattgtattctatgaacatattaattgtttccactattcatggattcatgatagagaacaatatcactcagaactagttaatgtcgcgatttacaaaaatcccacagcaccataacctcgcaatcgcatgacgtaatggaaaatgtgagagagagtcacaagaacataggacctacactaaacatgtgtagtgtctacactctacagtcacctactatacaagttgctaaatactactacgtacgacttgtttagttagaactgcaaaaaattaaacttgtttgtcctctaatcccaacagattttgtttttatatactgattaaccactgctttgttacaacaacttacaacttgaaaggaacgttacatgaaataactcttctcattcatgaatcatcttctctacataagaaaaagttgtgcataagaaatatctacactgaaaaaatggcagtgggggttacatttttgatttctctaattctttatttacatttatttctattttcatgttaaacatttatttcaatgccaaaataataaagaaagtaaaatctataaatgggattcagtgcaccaataattcttacacataaaaaaatatcagtatcaggcctctcaacatcacaatagggcaagaggaggggccaaagtacacaactttctcctcagggtatgctccaaattcccaacttggcctctctttttcatcttttgggtttttatgttcactcttctctgcttcattcctctttctacttccaggaaataaaaacttctaatcaaagagcaagagattaagaaatg

SEQ ID NO: 4345 - DNA, 3000 bp, Unknown
  misc_feature (1)..( 3000): cDNA_ID_1823978_gDNA_ID_1620701_Annot_ID_48765 3000 nt of promoter + ATG
tctagtgtatgagtggtgagatttatagggtttttgagggtagaattgaattgttttgtggacaagcaattttggaattgttctcttgtcggagtagaataaacagatttgacacatagaactaagaaaagaagaaatagatacataaaaagctctctcatatctttttctatttttggtttcttgtgtttgaagtctcagacaaagaacaagtagtgttcttgatcctttgtcttgtttagaaagattcgttgagaaactgattgagtttcagagagaagaagagttcaggaggctatatagatttttcatttttggggttatttgtttgatcatgatattaaatcaacgtcactattatgaatataataagattattttgacgagtagctaaaacaaagacggtagcttcgggtcaaaagtagactatttgcgagttgatgtggaatggtgatcaccatgtatacgcgtttaacaaatattgcaatttttcaaacgtggagataattattacttgatggagaatactttggctcattattagatgtagacttccattgttacaaaaagccaacaaaaaataatttcaaaaataaataaatcagaattaaagggcatttccttttacagttatatccattttaagtatttttgtcaactttagagcttaacgttggtttgtcaagagtcatggtgtagatggatattattacacaaaaatgacttctagctaacatattagaactactaataatagtagatgtttcggaaaaaataaaattcataaagatagatgtctatatttgaaatttgtgtaacattttgtattttgtccttgttagttattagaatgaagaaaacattataaatataaattctaataggatttggtaaaaactaattttagcatgtgtacaaacccttagaaatctgtttttgttttttgtgccaacaatcttcaattaatatacataaactttataaaacagaatgagtaacacttacacttacaagtttattgggtctttcactcttctggataacaatattttctagattaacaatctgacttacgcttaaaacctacacaaacggtgtataaattccacacttttattcttaaaatacatagttttccttgtataaaacttgtaagcgttatatacatagctggagcaaattaaaatatataatcaagttgctagtatgaaacaaagaaaattgaatgtcccatactcttgtattcaaaggattttaaaaatgacgtcttatattaatacaattttatctcacttaggaggaagattataaataagttttaaaaaaagaaatgaagcgttaacgtcgtcatgcttgatgtcaactctatggcattgctcaaaaaacgtgtcaacgttcttacattctggaagtctttgatttggtgatgcattgaatatttgaatgatatagtgttacaaatagattcgtagttgtacttctctcacaaccacaaacacctaatccgaatcaagatttttgcacttgttttggatatatatgtcataccaaaaaaaggcaacgagaaaaaatagggtcaaaattttgattagatatagctgaagctagaaagcaaacccatgatgagaagaacacaataaccgtccaatttttctgaacgtgagggatctgagtaagcaagtttaaaagattcaagaagctttctaataatatcaaatttatcaaccccactgatccctgttaagattcagctgtgtgttcgaaactcccattacaaatgcatgcatatacctatgagcaatatctataaggttttctttaaagcaacaacgattgttggtagagaccgaaacacacacaaatcttataatatgcttcatgacttttgaattttgctgtcatcaaatgatgctatactatacccccattttcagggattcttcagatatatccacatgacataactaacacaagttttagccatttcaattagtctgacagatcacagacctcacataccgtataagaaaatagttaattacaaatcaaatgtggtagtcctaactttatcaaataagttatgctattgctcagtctaatcatataggaacaaagtgtgatcaactgatcaatctctagtctctacaagactacaacaaacagataataaagtacaatattcaaaatgtacaaacaacacataacaaaaaaattaggaaaattcagatgagtgaatgtaaagtttccatatatattgataatattatctaccatatttggaagcaaagaaataatgttctccacaacaaccaaatcatccctcctccaattatctttaagaatattgatcgagatatccgcaacgctatctcgggtagaaggcataagaaaagatggcggaagttcatgcttctttggattcgatagctcggtcttttctttgttgttcttgaatatattgtaatcttgtttttttatcttttttgccaagattgcactatcattaggtaaagctctttgtaataccttcaatttcattatatgatatttacaagtcagcaaaaacatatatatattatcatatgggtggtatcaaaatcagatgttcagtcctaaaacaataaaaccagctcacaaatctactaatcatatttttagtttaattctcaccacgaagaattaagctaaagacaacaacaatggagaacaatctcatacacgagcgaccaaaaacccaagaagcaatcagattaaggttatgtccaattataaaagtcaaaacaacaattaaagactatgtaactaagaaattaaatctaaataatatcgttatctagatagagcaagcgaaagccaccagttggagtaagccaccaccaactccattgacacaacaattcacaacccaaaagacctctaacgagtgacacgattcggtgcatcgactcagctgttatttgaccaaaatacccctgttaattaacacacatcccgaagatg

SEQ ID NO: 4346 - DNA, 3000 bp, Unknown
  misc_feature (1)..( 3000): cDNA_ID_1823976_gDNA_ID_1620701_Annot_ID_48767 3000 nt of promoter + ATG
ggtgttttgttatggcgtatgtctcggatttgtcatcgtgcggcttttagcatttctttttgacaattctaaatcaactttcgaaattggatccaattccgattgaagaaacttttaaaaagaggatgtagaaacattggtattcatttgtaggtggtttgcaaatgatgcatcacatttttcaatattcaagttcatcttaattagaagaaaaaaacaaaacgtttatgtcaaagttgcattagcatgagtgcatgactattctaaaaagattgcatgtaacaaaattaaacaacaaatttggagcttatgttaagaagactacatattccatggggaatcgaatctaagacaagtatcttagttgtggactatttagaagacaaaaacaaagtctttttgttgttaaagtgtttgaaataagtaatgttgtatatgaaagaatgattaatatttcaacctaattgaaattttgaaactctcaaagtgcataatgaaaactattatttatatagtggaaagcctcattgctatatcatggctatcattaaggtttttggccatgtctaattacttttatatgaatagttcccaacagatgtaaaggggctaatatctattctagatgcgtgtccatatatgtattaatttgttgatataaagtaataaaacaacacatcacatccatatctacatcattcatatgtattaagcatttttattgtaagaaggtactattgaatttttatttatgacttcattgttagctaaataaaatatatatatctccctttccttttatgtgttcagaaaaatattaaaatcttcaattttaatttaagatatcagaatctaattatctataatggatgtttgattattttctttatgaacaatgagaaatgttacaaacaataattttgttattaattttttttttcaacaaacaataatttcattagtaaatttctcatattataccattttgtaaatctacaattctatttttgttagttttattattgatttaaaacttatgcataactttatcatttgtgtatctatctatccggattagtattacggtattaccacaacaaacacgtcgaaattgatatttactttgtccttggttaagctaaggttcttcacttccttttagctccccattacatttacatcttcaccttaggtatttctatctctcttttctaagattttaacaccagcccaacattctaacattactctactccgaaaaagaatgttagattcttatttatttataagatcaaatatgtagatatacaattttagtatagatctcacttatagcagctagagagatgagtaataagaattatctgcagaatttattcatctagtctttggttggtgatacttaagcaaaagtcccttactcatagactcatagtcataggcgcatagacgcatagtagtagtcatattagacccatactccctagagaagagaaaaaccattctctgaaagtgacaagagataacttcatattatcaatggaccgaccaaccatctgatcaatgttggctagccatacattcttgtttttattttccatttccaaatcaaaaagcggatctgtgtctgtgatttatgctgaagaggcttttagaaaattagaaaaaaaatgtaatttttgttttccaaaatttaaacatcttttaatagcaaaacaatttatatttgtctacatatacatggcgtgttactctagaaacaacacaaatttagaaaatactattttttttattctcatttagaaaaaactattttaattttgcaactttttagaaatagtaaataaaatattattttaattcagaaaaagatatgagatttttatttctctacaaaaactatttttagttttgcaaaaatagcaaataaaatattgtttatacaaaataaaagatatgaccttatacaaataatattttaatggctaaaacagaacaaaaaaaaaaaggtaggaaacgtgggccgaacattatcagaaggattcaagcgaagcaaaatcccaccctttcttctgtgacagagtgtctgtatttgttgtttcccttcaattggagagagtaagcgagtctcttacgcccagagagagagagagagagaggcttgtttgttttctctcctctaaggtaaaataatcctcagatctctgagtctcattctcttcaaattcttccgatttcttctctcagattctatgtttttctcattatctcttccccgatttatagatcttttctgcaaaaagttcgggattttttttcgtgaatttcgaagaatgttggcttttttcttcgtctaagtttctttttctctcgtgggatttgatgatttgatgttttaatttgattcatagctgaaagttttgttctttaatacattgtcaaggttctcttcgttgattggctctgtctttaggtaatgctgagaatgttataatcttataatgtctcccttatgttggatcattgacccttgattagatttcttctttggatgtgttctcttttgcaaatcgagctttaccaaatcctcagatgccaaatgcagtcttttagttttagattgcctttaaagcaatagatttcctagtaattgacattgaatttttcagtttggatgatcaacagatttatgttcttgtcagatgaagatgttgtcattttttttctattgatatttgtatttgaatgagtactgtttcatatgagcagaattttgcagcacagtaggattatctttttattgttttgggatcaatttggttggaatttcttttatgagctagctagaacttaaatcttctaacactatcgtgaattttgtttcacctttaatgatatattgttcattctcaatgtttgtttctcaacagtactgcatttaagatttttggttttggatttacttgcagaaacaatcagtctcataaagtggcaaagatg

SEQ ID NO: 4347 - DNA, 3000 bp, Unknown
  misc_feature (1)..( 3000): cDNA_ID_1823964_gDNA_ID_1620701_Annot_ID_48771 3000 nt of promoter + ATG
tagttctactatattatttggaaagtacattttaaatgtaaccttaatttttgtaattaattacatgacaatgccattagaaaaatttaatcaaaaacaaaaatctttaatgacgtcattaagattaccaaaatcatttaacaacaatattcatctcttaattataaggtttattggatctaaagacgggtcatcaaagatttcctaaactgaagcaaaatacactaaatattcaaatatctatctgttaccaaattataaacaaataagttcgtaaaacaatttaatattttatatacgaaatcaattaaatcttaatcacataaaaattagcacaaaaaaagtattcaacaattaaacaattatcaaatctctgtgttatataagttttgatactatattcgaataaagtgtaatatatcttttcaatttgtattctttaactaatttaagctacctaatatatttgctaatcttatacctatcaaaaccgactatcgtttcttatctctacagtatttttgcaagacttttttagtggatttggataaaagtgcattcgggtcatatggtacattctcctattaaataaatatggtgcactcctatgttattagctaaaatattcagattataattcagagtcatatcataaataaaattaatattaataaaataaatggctttttggcaagacggatttggagagacgggtttttgaatcaacattaataaaaaaataaaatataattaatccactgtttgaatacgggttaaatctttaatttattattttttaagaccactaatattaaacatatcaaatcatcctaatttagaaaagattatataaaaccaaaaatgttatgtggtatgtataatgttactatatataaaattaaactataaaatataaatgtgttagagaatgatacaatttgcaaaacttttatatataataaataattcttaaattttaaaaattattactttaaaaaaatattacgggacgggtaaaggaattacagaacgggttttattttggaattgggttatatggtggatgtatttgaatcaatatttataaaattttaaaatattattaatatgctgttttacaaggggttaaacttcagttttttaacaattgtctcatggattcgtggtatagcgttacttaataacaattataaactgtaaaatataaatattttataaaaataaaatttgcaagttttaatagatattactttaaaaaaataaatcatcccgcggtataccgcgggttaaaatctagttctgtttaaaatctccatgtttcttccttaatcacacttttacttttggtcatatgatatgactcatattttagtgttatgcattcattacatgacatggttttcttcaaattttggctacaaagcacaagaaatgtgagaataccaaacattaaggttatgattcgtaacattgcataatagcataacggtataagttgcataataaaatatgtagaatgaaaaaccgtagaatcaaattacttaaaaatatatgttgattggatacattttacagaacgacaaataaaatattatatcaacaatatatatttatactaataaaactgtttttaataaattttaagtaatatttgataataaaaatataagattcttaaaatctattaaagagttgtgaaaatgctgattagagattttgaaatgaagtaagtaaagatatggttagttatttggttgttcggatttttagggaatattatttcgtgtaatattgaattagtagagattcaagggattaatgtgtgcaatttatgagggtagtgcaaaataatatttttgtttaggtaagtaattagtgcaaaacgtgaataattgatcaaaaatttggtcattgtcataaagaagacaatcttgtctgattgattttgtagggactaaacatacaatatcgaaattgaaaaatgatttttcgacacaaatcttccccaaaaatgtatatgtagattattaataacataatttttgtgtaaataattatagttttttattgtttaaaattgttagtatttaagatgcgtaaaataataacaatttcttatgcgaataaaaactatatacccattttttgcataatgaatttttacttgtaaatttaaacaaaaatacaaattgtgcgtttttacgttttcttatacaattatgcaaattttcttaatatgagaatttttttacataattacattaaaaaacgccttaccaatcagagccttaaacctataataacttcacacgtaaatggtatttattttcttctagaaaaagagaatggtggataggggaataaaataaaaagttggaaaaagaaacgattctacaacatgtaatgaccaaaacaccctccttcctccctctaaaaccccattctctctctcccactctctttttctctgttgctctctcctgagttcttcttacatgaaagtccgctgaactctttaggttcgttgtcgattattcttgctttatgtttgtgtatttattttttgaacttctgggctctttctgaaattcaatttcattgacccatcttctctgttcatgacaattcgtttgtcctaatgttacactcaaaacccttttttgttgtttatacccaaaccctctatctatctgtacttccttggaacgaaatttttttgctttgactcaatttctttcttagaattagaacattgagaatgttggaactcaaatagatgttggttcgattttgaactttttgtttatttattaatgttttctatggctctgatttgaattgtcaagtttaagacattcttcttcttctcttagataccctaatttcaggggtatgcacattttgcataaaagttccaatctttcctgatcgttgacaatatttatgtgtacccttttgtttgtctcagtgtgttaaagaagctacattgtgtttgtgatg

SEQ ID NO: 4348 - DNA, 3000 bp, Unknown
  misc_feature (1)..( 3000): cDNA_ID_1823956_gDNA_ID_1620701_Annot_ID_48773 3000 nt of promoter + ATG
tgaaatggttctggcttagatcaaggtactctatattctcccattttgaccatcttgtcagatttccttcaaactggttgtttgagagatcgagtaaaacacatcccccagtcaagagaggaagctccccggtcagtgaatttgaagaaagatcaagggtgtgaagagtagttgacatgatagaacttactggccctgaaacacaaaaggaaaaccaataaaaaaatattagatttctagttttcttggtgccaccgttaacatataacaatttccactatgtagaagataaagccaagagcatacctgagagattgttgccacttaaatccagcgttgttaaaagcaaagagtcaccttttaacaaattattgggaagggaacctgagaatctgttgttgctaagcttgagaacttcaagatcatagacataattgaaacctggtaattctccagataacatgttgtagctaagatccaagacttttaagttctgaaacaactgaaacccactagtcaatgaaccttcaagctgattatggctgagattcaagtgcttgatactctcagaaacaccaggtaacagtttcccagacgtcgtcaccaatctgtttccactgatatcgacatagctcgcattcgttaaaaggaaaaactccccatcaagattaccatcaattgaattaccatgcaaatcaagcacttcaagacttgaaatcaactcaaagccccttggcattttccccgtgaatccattagaagacagattcaagtacagcagatcgttcagccttgtcaaggactttggcaaaggtccagataaggagttgctactcatatccaacgactgaagtgaaatcaaaccacccatagactctggaatctcaccagaaaagttgttaccagataaagaaagattcctcaagcttactgatctaccaatctctttaggcaatgaagaagagaacagattatctgataaatccaggaactggaggcttttgaaactgcctaaatcatttggcaacacaccagaaagggaattgtttgacatagatagcttgacaagctttgtcaagttggagaacagactgaaatcagcatcagcagtcaaacccaaattatccaaaacaacaccagccacattaccgccattgcagacaataccattccatgaagaaggacaaccattgaagtcaatagactcatcgttccatgaattaaggacaaaccctgtagggtcatgtttgatgcctttcttgaattcaagcaatgccatgatgtcctgtgatggaagttgccccattgcagatagaaaaaacatggagagtaacaaaatcctagaaagattcatccttccttgacttcaaatcttttcccccaaaaagctacagtttttgaagaatcccaacaacttttccagctcaccaacgcagaaaattcatggaaccccaagtaaatctgacataaaacataatgaaataagacaaaacccatcaatgttaccaaaaaaaagtttaaatctttctgcaaaaatcaacaataccagaaatttcactctgataaaaaaaaaaacagaagctaaagaaagaaactttacctaagatgaacaaatcttctgagaaaccccaatcaaacaaaatgcagtaatgctactgagtgagaagagacaatcttcactcaaagggaatcagctgaaaaaaacattaaatgaacaaatgggctattcaatatttgggtcccattccgagatctaacctaactccaaagcaaagagataaatgaaaagtgaggatttttaaacttacggggatgaaaaaagcttctcactgcaagaacaatgtcgacagagttgaagaagaaggaagacaaaaactttaaagcagaatcattttgttcattagctcatgaactgcacggggttttggattaagctcaacagtgttgtagactgagtcactgagctaactgagggaaatctttgtgggtcactttaaaaattaaaaacccttaaaagattgtcactgtttaagaacaaaagaaagaagccaaaacaaaattaaagatagagaaaatgttttgctagttttcacgttcgacagtgacgaacgacaaggaccttgtaaaagggtaagtcttgaagcgtgtgaacggacaccaaatcaaaaaccctaaataaaaagtaaaatagcaagaaattattttcatgggttcacgagaagaaaattatatattaatttactttttcatagtcttttcagtgaggaaagatttaaaatatagtttaattacccgcctggaatggcccgggaaaggaatccaaaaaaaatgaaaaaagctacttacactaatgtttttagtgagtgtgaccatggtggacgtgaaagggtttatccaatatggttatgagtctatgtccttgcctttagtgagagagatttacagcattgggaaaataagcgaaaattgcgcagtgttctaataaattttggtagaaacttgcaataaatgaatttacataaataaataatagggaaaataaaaagagtaatgagagttcggagtgaatgttatttacaccaaaatacagatattaaaagcttgcaaggaaaatgtgtagtaaatgaaacatgattttttgaacaatccagaaaaaatagtaatgaatattcggacaaataaatatttttgaagttgataccacattaattagtaggaaaatgtagaagcgaaataaataccgcgtaggaaaatgggtcccacatgctgactacgttgactagggaagaccggaagagacaagggcatcagaccaattatttgggttctactgataatgttgaaagtaaatgtccgggttcagaataaattaatagttaaggggtcataattcaaaaaacaaaaatctgagtgttttgatgagattacacacttacgtctaaaactcactctcatttgctaattgttaacttgctctgagtttgaagaaattcatcaatg

SEQ ID NO: 4349 - DNA, 3000 bp, Unknown
  misc_feature (1)..( 3000): cDNA_ID_1823952_gDNA_ID_1620701_Annot_ID_48774 3000 nt of promoter + ATG
gaagataagagagtcgtcaacataccatgaaagtaagtgtaccagcttctgcagcaagaacacctccagagacgggagcatccaacatgactggcttttcccaattatctacatcaaagatgcttgaaactagtgaaaatgaaacaatctcgacttgttcacaagaagaacaaaatgaagctgttgttaactcataagaagaaactaacttccttccaaatcctatctaagctttacctctcttttctttcaaattacaattagaaacagcaagtgagatttttcgagttgtttgtggatcaatagtggatgaatctataaacaaagcaggtcttatatcattttctccaagaagcaacccatttgttcctgtgtacacatccatcacctacatcaatcacaattttttttccttcataaaaatcatccaatcaattgaagattaacattctttcagtaccaggagtaaacaacaatactatctcgtagactaggtgcagctaatcatacagctaacaggacgatctttcaaactgttttcatataaaactattgctaaaggtaaataacttacatgagatgatgaaggcaacattgtaatcacaacttcgctatcttgtgcaacttcataaggagtttctctagaagagactcccatttcagtgaacattttcataacatcacggtttctgaaaattcaaacacaagtatatgcacaagaaagttaatcaaaggaatcaacattaaccaaatatgaaaattgataggcagcaaaacgcactcaaagtacattacatgtcatgaacggtaactttatatccagctctaattagattattcaccattctgaatcccatatttccaagtcctatgaaaccaacattctgacaaaacagcaaaaatgagacttcatttacataaattttgggtactgaatcagacaaattttgctgttaaaaatctaatccagacaactttttttgcagaactgatgaatttagataagtggtcaagatcaataagcaatttggccactaaaattcttattaactatgctcgagattacaaaagttaagatcttttattccaactaccttaaggatcatgttttagaacgtttcaataaaattctaggtgacttatgaggaaaagagattatgttttctgatcatgaagacaatttaaaaagcagaacctggaattgatttgaattttgagacgaagaagagaaccggtggagcgacccagacacgaaattggttttgaatttagaaagacaaagtagagtttgcgctctgcgaatcgccattgatgaatttcttcaaactcagagcaagttaacaattagcaaatgagagtgagttttagacgtaagtgtgtaatctcatcaaaacactcagatttttgttttttgaattatgaccccttaactattaatttattctgaacccggacatttactttcaacattatcagtagaacccaaataattggtctgatgcccttgtctcttccggtcttccctagtcaacgtagtcagcatgtgggacccattttcctacgcggtatttatttcgcttctacattttcctactaattaatgtggtatcaacttcaaaaatatttatttgtccgaatattcattactattttttctggattgttcaaaaaatcatgtttcatttactacacattttccttgcaagcttttaatatctgtattttggtgtaaataacattcactccgaactctcattactctttttattttccctattatttatttatgtaaattcatttattgcaagtttctaccaaaatttattagaacactgcgcaattttcgcttattttcccaatgctgtaaatctctctcactaaaggcaaggacatagactcataaccatattggataaaccctttcacgtccaccatggtcacactcactaaaaacattagtgtaagtagcttttttcattttttttggattcctttcccgggccattccaggcgggtaattaaactatattttaaatctttcctcactgaaaagactatgaaaaagtaaattaatatataattttcttctcgtgaacccatgaaaataatttcttgctattttactttttatttagggtttttgatttggtgtccgttcacacgcttcaagacttacccttttacaaggtccttgtcgttcgtcactgtcgaacgtgaaaactagcaaaacattttctctatctttaattttgttttggcttctttcttttgttcttaaacagtgacaatcttttaagggtttttaatttttaaagtgacccacaaagatttccctcagttagctcagtgactcagtctacaacactgttgagcttaatccaaaaccccgtgcagttcatgagctaatgaacaaaatgattctgctttaaagtttttgtcttccttcttcttcaactctgtcgacattgttcttgcagtgagaagcttttttcatccccgtaagtttaaaaatcctcacttttcatttatctctttgctttggagttaggttagatctcggaatgggacccaaatattgaatagcccatttgttcatttaatgtttttttcagctgattccctttgagtgaagattgtctcttctcactcagtagcattactgcattttgtttgattggggtttctcagaagatttgttcatcttaggtaaagtttctttctttagcttctgtttttttttttatcagagtgaaatttctggtattgttgatttttgcagaaagatttaaacttttttttggtaacattgatgggttttgtcttatttcattatgttttatgtcagatttacttggggttccatgaattttctgcgttggtgagctggaaaagttgttgggattcttcaaaaactgtagctttttgggggaaaagatttgaagtcaaggaaggatgaatctttctaggattttgttactctccatgttttttctatctgca

SEQ ID NO: 4350 - DNA, 3000 bp, Unknown
  misc_feature (1)..( 3000): cDNA_ID_2107199_gDNA_ID_1620701_Annot_ID_48776 3000 nt of promoter + ATG
agcgcggagctcggcttaatctgtcgtccgacgaaaccaaagttgtcgaaactattgattccgtcaaaacggtgcgagcgcggagctcggcttaatcggttgtcagacgaaaccaaagtttgtcgaaactattgattccgtcgaaacggtgcgagcgcggagctcggcttagcactcccttaagtgtaggttttatccaagaccgttttaccgatacatggcatacttaaaggggttcgtgcgttcgtttatcgatcgaatgccgggccaggacaccgatgtaaattagctcgatcgctacgaggtccagcggaaccctttttaagaataatgatgaattgaattacgacaaaaatgaaaattttacttatctcaacgcaagagtttgtggtacgatcgagttttgacggtcgagttcgttgatacaattatcgaaaagacgatgctcaatgtctgccctagttcttgtcagttcgttcgtccgacgtgacgttatgctaagtggcatcgttttcttcgttttagtgggatggcgttggaacgagatctccgacgttttgagtgacgatgtgaatttcgctgttgaggagagtttggcttttcttcagttcgcctagctccagcgggtgctgttactttcactttgcaagatggcgcaaatggcgtttggttggttgcgtcgttgtgtacgtccagagccgtctggttctttcgtttagcttctcgtagcctgccgacatgatgtgttttgttagtcgttttggtgtggtcattgctttgcggtattcgcaaaacattggcgtcagtgtcggatcgtcgatatctcttatggcgcgtccgacctcatggaccctggagatggctcaattgatttgggcgtgaaggtcttgcacttggtatctcgtttatagcggtctgaggaattgccgagctgggtttgtttaagacaacctgaatttcttcgcgtaggtcgggtatgcgaataacgactcatgtgcatgcggctaattttatcttgtatgtgctcttgggcggcggttaataatcgcgtcgcgctgctttaaatgatcgatgatgatgttgattagttcttcgccgcgttggttggctttagccgtatcgtccaggcgatgaaatcagctaagtgaagcttctccttggtctttttgcaacgctaggtattcaggcgtgggcgataacgaggtcggtacaatagatgacgccgagtagtattctttatttgagttttcccgtgcgctgacgttatcgtccgagctgccgagctgggagtgtcatcgtcgaggttctccaagtgacgtccgcctgatgacttctcctcttgttcttggttaggcgtgagtgataacgaggtcggtatgtttattgaggttatgggatgttcctctttgatcggtggcacttcctcgtcggtcagtgttattgtcctgactgcccggctggaagtgtcatcgcctaggatgatggggtcgatagttccttgaagtccttttcttgtcggagaacatgctgcgatatcgaatgaagaggtcgagtgactggctctcccggggatcgacgttgtcgttttacttccagagcctgacgagtcggtatcgaatgctccatgtagtctgtttgttgtcactttgcttcgtcgctgggtcgtagttttgagagatatcttcgagctatccccctacctggcgcgccaaccgttgatgcacgaatcacacaagtacgaaaatgggatctctagggaaggaagaagaatcgttctattaatgacgagcccgcgacttaggcgaattggacggattacaaaggatgatttcttcaacaagcataaatggaaaaagaacgagccgattgtagatgaaagacgagcttgaggccggaaaacgatcttgatatccgaggaagaatagagtttattcgttttatagctgaaccttgtaaaaggctgcctacgtaccctcagaaagggatcaagccacacgtagttcatattagaataagtgagctaggccgtcattggaggtaggtcggcaggtagttgacgagccggcaaatgtgcgacgagctggatgaaccgtggtagagagacttggacaaaccgagttgtttgctggtgtagacgagctgggcgacgagataggtggactatgcagtcaatggacgaactgccgctaggcgaggaggtagatgagttttgcagtcgagggatgagctgatagctagacgaggagttggtcgagctgaggaagagcttgaagacgagctgaggagcttgatgacgagctgaggagcttgaggacgagccgaggagcttgaagagcttaaaggcgatctgaagagcttgacgaagaggagcgagctaacgagcttcttgagaagggcgagaccccaattcttgagaagggcgagaccccaaatacaatcaacaatgtatgcttttttccgtttcttgcgttttgggtttctttatttcttatctctattgagacaagtctgttggcccttgagaccccaattcattggtgtttcttaaaccggatatgtataactgtctaaaacaaaatttaaaatagcctagtaaaccgatggttatgactgttacggtttccggttagtcttaaccgactctttcaattacaaatccaatcttctcgtcgtcgtcgtcgtctctatttctctaccaccgttgatgttagggtttcggctgtattctcaccgctgctgacggagacggcccgaatccgcaatttaatcttcgaggttcgattttagtgaagaacaagattcaatagtgatatgcagatctcatgtctcccaatttcgattccttcgatcactcctcgaacctcaattccactcttaccatcactctcctcaaatcctcgccgcattttcaacctcacttcacttcagagcccaaatcactgtttcttcaaaagattacataaatctcagactggtttcagcaatccagttttggctgcc

SEQ ID NO: 4351 - DNA, 3000 bp, Unknown
  misc_feature (1)..( 3000): cDNA_ID_1823946_gDNA_ID_1620701_Annot_ID_48777 3000 nt of promoter + ATG
ggctgccatgagaagagaagaagatgttgaagtcgatgattcgttttatatgagaaagtgtgtggagctagcaaaaagagcaattgggtgtacaagtcctaatcctatggtaggttgtgtcattgtcaaagatggtgacattgttggccaagggtttcatcccaaagctggtcagcctcatgctgaggtaacaaaaattcaatctttctttgttgggttactgaaaatgagcaaactttaagtcttgcttgtggaattgttgttgttggcattggtatggtaggtgtttgctcttagagatgctggagagttagctgagaatgctactgcttatgttagtttggaaccatgtaatcattacggaagaacaccgccgtgtacagaagcattgattaaggctaaggtgagaagagttgttattgggatggttgatccgaatccaattgttttttcttcgggtattagtcggttgaaagatgctggaatcgatgttactgtgagtgttgaagaagagttatgcaagaagatgaatgagggattcatccatcgaatgttaacagggaagccttttctcgccctcaggtaaagttcattgcttctcttgagtggagacaaatccgagtcaatagattgtttttaagttttgaaaatctttgcaggtattctatgtctgtcaatggttgtttgctagacaagattgggcaaggggcttcggatagtggtggatactactcgaagctattgcaggaatatgatgcgataatactttcttcctcgttatcggatgaactctcgagcatttcttcacaagaagctattaatgtttcgatccaacctattcagatcatagtagctagcaatgcacaacagtctcatatccttgcttcttcccacactgtggaagaatcgggtccaaaagttgtagttttcaccgcaaaggaatcggttgcagaatccggaatcagtagtagcggggtcgaaaccgtagtattggaaaagataaacttggattccattttggattattgttacaaccgtggactatgcagtgtcttgttagatttgagggggaacgtcaaagaccttgaagttcttctgagagatggatttgagcagaaactattgcagaaagtaattattgaggtcttgccggaatggagcacaaaagatgagagacagatcgcgtcgatgaagtggttagaatcaaagcatgtgaaagatttgcagtctaagcaattaggtggaagcgttttgctagagggctatttttgatgttttcatgtatgaatgaatacaagtcatgatatttaccttttttaaagcatagtattattaaggttttacagatcctattattaatagattgataacagatttttgagaaaatgttgtattttcaaaagaaaatattttcacatgttgagaatctgattcgaccttctatggcctacacatgatgggtatcctaagatgagatgttttttcttaattggagttcataaaccaaaacccataaaaaaaattaaggatgtgtaatagaatgtgaagtacattcaatgagaactgattgttgatgtcgattgcgttacaaatttgacaattctttttggattttggtggaaatgtgaactaactgacaacaaacatcaaccatgttggatttgtttttgtcaaaaccgatatatctagagatattcgaaagaaagaacgaaataaacactatacaatagtcaattttaaatcactttatgatttaacaatcctaagttcctaacttcaaatttaagatttacaatagcatgaattttagtctttcttattgtttcatagcattattgtattaaaaaattactctacagttacaccatctctctttataatggttgtttcaattgagttaatcatttactattaatctgaaaatttgtagtatgaatgttattgttggtacacaaattggtgatggaacaaaagattaagaggatatcttttatgtcgacaatggtcgagtggttcaacaaaatccacgcaatcgcctgagcgaaaaagttgaccatactcagccccaccactctccacttcataacctttttcttttatccttcttccttttgcatttatacaagtattttccaatgacggaatgcagaaagaaaaaaatttgttaagcaaatgtcataaaatataaaaatatctatagcaagtgactgtaactacgattaactcaaccgattggagaattgagtaacttatatcgaactcaagttcgaacatacgctatatatgagagtcaaaattattgatcaaaatatgcaatgtaatggtccaaaattcaaaatattaccaaaaagaaattctataagttaatgttggaattatgataataaaaaaatactaattgatagatatgaaacaatttaagacgatccatttgagacccgggaaatagattagtttatcaagtattaatttataaagattttactttggactatttgttcaaaaaactacgtgatgatgagttttctatgcaaaatcaattaccgatatgtggatgattcttgtcttttgtagtaatgttggttatctttcactcttaatgagaggtttaatatcatgtgagagttaacgagcttcttatttgagtcaattgtagataaatagcttaacatatgcccttataaactagcgttgattctcaatccaatttgaaactattaacagaaccattaaaaactatatatgaacacataaaatatataattgaccataacgacgagtcaagatatatatttaaagaacttacttttttccactttgttttgctttttttttttttagtctttggtacatatatattacaaacccttttccagtaaatagttagcacaaactaattatcagatgtcacttaaaccaacctccttctttatataagcttggttaacattgagtttgttatcatggtctatgtgaaacaattcaggaataaaaaaagaa

SEQ ID NO: 4352 - DNA, 3000 bp, Unknown; identical to SEQ ID NO: 4351
  misc_feature (1)..( 3000): cDNA_ID_2173389_gDNA_ID_1620701_Annot_ID_165079 3000 nt of promoter + ATG

SEQ ID NO: 4353 - DNA, 3000 bp, Unknown
  misc_feature (1)..( 3000): cDNA_ID_2107199_gDNA_ID_1620701_Annot_ID_165078 3000 nt of promoter + ATG
aagttgtcgaaactattgattccgtcgaagcggtgcgagcggggagctcggcttaatctgtcgtccgacgaaaccaaagttgtcgaaactattgatttcgtcgaagcggtgcgagcgcggagctcggcttaatctgtcgtccgacgaaaccaaagttgtcgaaactattgatttcgtcaaaacggtgcgagcgcggagctcggcttaatctgtcgtccgacgaaaccaaagttgtcgaaactattgattccgtcaaaacggtgcgagcgcggagctcggcttaatcggttgtcagacgaaaccaaagtttgtcgaaactattgattccgtcgaaacggtgcgagcgcggagctcggcttagcactcccttaagtgtaggttttatccaagaccgttttaccgatacatggcatacttaaaggggttcgtgcgttcgtttatcgatcgaatgccgggccaggacaccgatgtaaattagctcgatcgctacgaggtccagcggaaccctttttaagaataatgatgaattgaattacgacaaaaatgaaaattttacttatctcaacgcaagagtttgtggtacgatcgagttttgacggtcgagttcgttgatacaattatcgaaaagacgatgctcaatgtctgccctagttcttgtcagttcgttcgtccgacgtgacgttatgctaagtggcatcgttttcttcgttttagtgggatggcgttggaacgagatctccgacgttttgagtgacgatgtgaatttcgctgttgaggagagtttggcttttcttcagttcgcctagctccagcgggtgctgttactttcactttgcaagatggcgcaaatggcgtttggttggttgcgtcgttgtgtacgtccagagccgtctggttctttcgtttagcttctcgtagcctgccgacatgatgtgttttgttagtcgttttggtgtggtcattgctttgcggtattcgcaaaacattggcgtcagtgtcggatcgtcgatatctcttatggcgcgtccgacctcatggaccctggagatggctcaattgatttgggcgtgaaggtcttgcacttggtatctcgtttatagcggtctgaggaattgccgagctgggtttgtttaagacaacctgaatttcttcgcgtaggtcgggtatgcgaataacgactcatgtgcatgcggctaattttatcttgtatgtgctcttgggcggcggttaataatcgcgtcgcgctgctttaaatgatcgatgatgatgttgattagttcttcgccgcgttggttggctttagccgtatcgtccaggcgatgaaatcagctaagtgaagcttctccttggtctttttgcaacgctaggtattcaggcgtgggcgataacgaggtcggtacaatagatgacgccgagtagtattctttatttgagttttcccgtgcgctgacgttatcgtccgagctgccgagctgggagtgtcatcgtcgaggttctccaagtgacgtccgcctgatgacttctcctcttgttcttggttaggcgtgagtgataacgaggtcggtatgtttattgaggttatgggatgttcctctttgatcggtggcacttcctcgtcggtcagtgttattgtcctgactgcccggctggaagtgtcatcgcctaggatgatggggtcgatagttccttgaagtccttttcttgtcggagaacatgctgcgatatcgaatgaagaggtcgagtgactggctctcccggggatcgacgttgtcgttttacttccagagcctgacgagtcggtatcgaatgctccatgtagtctgtttgttgtcactttgcttcgtcgctgggtcgtagttttgagagatatcttcgagctatccccctacctggcgcgccaaccgttgatgcacgaatcacacaagtacgaaaatgggatctctagggaaggaagaagaatcgttctattaatgacgagcccgcgacttaggcgaattggacggattacaaaggatgatttcttcaacaagcataaatggaaaaagaacgagccgattgtagatgaaagacgagcttgaggccggaaaacgatcttgatatccgaggaagaatagagtttattcgttttatagctgaaccttgtaaaaggctgcctacgtaccctcagaaagggatcaagccacacgtagttcatattagaataagtgagctaggccgtcattggaggtaggtcggcaggtagttgacgagccggcaaatgtgcgacgagctggatgaaccgtggtagagagacttggacaaaccgagttgtttgctggtgtagacgagctgggcgacgagataggtggactatgcagtcaatggacgaactgccgctaggcgaggaggtagatgagttttgcagtcgagggatgagctgatagctagacgaggagttggtcgagctgaggaagagcttgaagacgagctgaggagcttgatgacgagctgaggagcttgaggacgagccgaggagcttgaagagcttaaaggcgatctgaagagcttgacgaagaggagcgagctaacgagcttcttgagaagggcgagaccccaattcttgagaagggcgagaccccaaatacaatcaacaatgtatgcttttttccgtttcttgcgttttgggtttctttatttcttatctctattgagacaagtctgttggcccttgagaccccaattcattggtgtttcttaaaccggatatgtataactgtctaaaacaaaatttaaaatagcctagtaaaccgatggttatgactgttacggtttccggttagtcttaaccgactctttcaattacaaatccaatcttctcgtcgtcgtcgtcgtctctatttctctaccaccgttgatgttagggtttcggctgtattctcaccgctgctgacggagacggcccgaatccgcaatttaatcttcgaggttcgattttagtgaagaacaagattcaatagtgat

SEQ ID NO: 4354 - DNA, 3000 bp, Unknown; identical to SEQ ID NO: 4348
  misc_feature (1)..( 3000): cDNA_ID_3073090_gDNA_ID_1620701_Annot_ID_165074 3000 nt of promoter + ATG

SEQ ID NO: 4355 - DNA, 3000 bp, Unknown; identical to SEQ ID NO: 4347
  misc_feature (1)..( 3000): cDNA_ID_3073094_gDNA_ID_1620701_Annot_ID_165073 3000 nt of promoter + ATG

SEQ ID NO: 4356 - DNA, 3000 bp, Unknown; identical to SEQ ID NO: 4346
  misc_feature (1)..( 3000): cDNA_ID_1823976_gDNA_ID_1620701_Annot_ID_165069 3000 nt of promoter + ATG

SEQ ID NO: 4357 - DNA, 3000 bp, Unknown; identical to SEQ ID NO: 4345
  misc_feature (1)..( 3000): cDNA_ID_3091158_gDNA_ID_1620701_Annot_ID_165067 3000 nt of promoter + ATG

SEQ ID NO: 4358 - DNA, 3000 bp, Unknown
  misc_feature (1)..( 3000): cDNA_ID_1823915_gDNA_ID_1620701_Annot_ID_48786 3000 nt of promoter + ATG
cttgtcgagagcatgcgattaactcaagtcgctcacacattttttttttttgttttctcagaaatcattattaaatcccgaataaaactataaaagtaattataaaattaatttaagtaaacttggtattgggtattgttgtttactaaactttttatgttcaaaccattttgtatatatgtaaagatgaatctttataattaaaaagaagtaaataattacgcatatatcatgagcacacatgttttgacatagagcttgagcacacatgttttcacatactctctctaatagtaaatttacatgcaatatatgcttggtttgactttaattaattgccattatacttttaatatatgtccctagattttttttttctgtttatatgtgattttctcatttaatcatatctacttgattctacaaaaattcacatacagacaagagttaaccattggtttttgactacgcttagcctaaagtttatggtgtgtagacagattttcagattttattacaccacaatttttaacacgttttgcttataatctcactctcctaaatactgaaagtacagtttcttaaatgtccacgccccaagaacctataagaatacaccttccacaacacaaaattagatcataaaaacaacaagaacttataatttaagtcttctctttctacgaaaaaatcaagaacttcttgaaaaaaatggataacttgaatgttttcgctaatgaagacaatcaagtgaatggtttgaagcgtccacccccgtcacgagtgtgtccaaggtgtgattctgataacactaagttttgcttttacaacaactacagtgaatctcaaccgcgctacttttgcaaaaactgtcgtagatattggactcatggtggagctttaagaaacataccagttggtggaagttgtcgtaaaccaaagcgtctgaaggtagatcaatcttcgatttctgagatggtttctgttgagaaccaaccaattaatcatcaatctttcagacaaactcaagaaaacaatgagtttgttcgatcttttgacgcttcttcttctgctactgttactgccgttccgaaccattttggttatctaagtgaacttcatggtgtaacaaatttgcttccaattcaaagttttcgaacaatggactgcttagatttcggtgatgaatcttttcaacaaggttattacgatgttggatccaatgatttgattgataaccctttgataaaccaatccatcggtgggtatgttgataatcttacaagttattgcataaatcaagtggaaccaaagcttcaaccacgctatgaacatgaatcataaagccagcagtagtggaagcataggatcttgagacactcagaagaacaatatgagaaacatgtttgtttaggtcttcttaacattcggaagttaatgttccagtccatcgtttctacttcttttttttttattagtttcgtttatgcatggtttatgttgggtctttttttagttataaaagtttgcatctttgtttaagtcccaaaatattcagacataagttgtttaattcccaatttctttgatgcttgtaattttttttttaatctcgcgaaagcaaaattttaggctgatgccttggcaaaagaggtctcctcgcttgtatgaactcaattctctaaatcgaatgaaaacaaggttgtccaaaaaaaaagaaagttgtttgatcctttttcctttttatatatacaataagaactagagatatttctcgaacaatctcaacacgagttcgatttccgttgtgagaattaattgattaaaccttagtctcgattgtgaaatgttcagaattaaatattatcaatattaattctccaaaagaaatcctaaaatgttagtagccaactataaagtagatatgtgaaccaaaagaaattgagattatttattaaatatatgacgaatcaacaatgatgtaattaatacttagaaattcgttgaaatctatgttttaattaatacaacatttatagtctttaatgaatttctagattttaaaattttaattaattattgaaaaatgtgtttcttaataaataattttattttataggtaattatgactatatggttaaagacctaataaaaacataaatgaatagttacaacttgctctctcagattttcgagagccaaaacggccactttcatagacaaaatcttaatgaaattaaagaaaatctgatataacaaggacattgacaaaacgtccagattgtgttagtatagacgtggattatcataagaccgccggttaatgcaagggaaaaagctagattttgtcagtcatcgattccgacagagatagagatgaggtcttccacaaggaatttgaaacgtgctcactctttcctttttataataagctttcttaacttcattatccctatcgttttcaaaagttggcaaatgcattatcaccatatagtgaattagctatatggttacatgaattttttgagtgaattaactaaccatactgcatttccttctaatttttgtttacctccgtttcattatatactgttttaaaatatttttaacttttaattatatcgttatgaaatacacttataagggttttttttttctattgaataagctgaaataataacaataaaaatgattacgatcgtaaatttggtgtaatttctatgtaatgcttttaaatttttgagacaaaataaattgatcgcgacaaaacaaataaagacttacactacacgtgtctatacattaaatagcaaaagctattgacggtgcaaaacgtcaaaaacaaatgccctacgtcgcgggtaattaacaaactcatccacatatatatacgagtttcgtatctcaaacatttcataaatcaaaccatcatatacctctcaaatcatttctttgatttctataaacactattcttgttaatgactgaccataaaaacaa

SEQ ID NO: 4359 - DNA, 3000 bp, Unknown
  misc_feature (1)..( 3000): cDNA_ID_1823911_gDNA_ID_1620701_Annot_ID_48787 3000 nt of promoter + ATG
agtttgaattaccttagcttcttttttattgctgtgtagttatgtttctttttgttttctcttcatctaagtaaatgtacttttccagttgacggattccgaagatgtgaaaagtggacgcagaatgacataattgacatggtggactcaaaggaatcaaagacaacatcatggttcaaacggtttataggacgtgaacaaaaaccagaagtcacttggtcattcccttttgcggaaggcaaggtctttgtcctaactttgcgagctggaattgatggtttccatattaatgttggtggaagacatgtgtcttcattcccttatcgaccggtatgtgatatcagatgagcattctacttgtatatggctttggtctcagcactcaatagtatcatttgttcaaaccaagaggattcatctcgtccatgtctgataactttgtaaaatattttgtgatgtctggcctctcagggatttaccatagaagatgccacagggctggcagttacaggagatgttgatattcattctattcatgctacttctctttcaacatctcatccgagtttctcaccgcagaaagctatagagttttcttcagaatggaaagctcctccattacctggcactccttttcgccttttcatgggtgttctctctgcaactaaccatttttcagagcgcatggcagtgagaaagacatggatgcaacatccttctattaaatcttcagatgtagtagcccgattctttgttgcacttgtaagttcttacaatctttccttattttaaagcatgatctttaagaagtttaatactgcaggtcgatttaattgaaacattgagatggagatttgctgatttgaagttcttatgctttggaatactgagcagtttatgtgtttttgttgatttgttttgtgtagaatccaagaaaggaagttaatgcaatgctaaagaaggaggctgaatattttggagatattgtgattctgccctttatggatcgatatgagctagtggtccttaagacaattgccatttgtgaatttggggtattgatcatttctctcatgactccatatctgtttaagtctttgaacaatctctgataaggatcagtaaatgaacagtttccctcattgtagttactttacacaaatctaattatgagagtctgaatatcttccattcaggtccagaatgtgacagcgccatatataatgaagtgtgacgatgataccttcatcagagtggaatcaattttgaaacaaatcgatggagtctctccagaaaaatcactttatatggggaatctaaatcttagacatcgtcctcttagaactggcaagtggacagttacatgggaggtacaatggcttctgttctttacctgcatatagtctgtatgattcagaaatcagaagcagcctcagatactaaattttctcttatactgtaacaggagtggccagaagctgtgtatcctccttatgccaatggacccggatacataatctcaagcaacattgctaaatatattgtttctcagaattcaagacataagcttagggtctgaccctttatcatcgtcttacgttcatctccatcttttactgtcatgaacataagagtctcctaacattttcaaactatttcgactttgttgtcacagctattcaagatggaagatgtgagcatgggattgtgggtggagcaattcaacgcctctatgcagcctgtcgaatactcacacagctggaaattttgccaatacggatgcacactgaactattacactgcacattatcaatctccgagtcaaatgatgtgcctgtgggataatttgttgaaaggtcgaccacaatgttgcaatttcagatgaccaaaacatagcactagccggaagatattacaggattacagatttggcaccaccttaacccattttgtaatttttcctctttggtgctagttgcttacatttacacattcaagataacaatctcttattgtacattgattaggattttgtctaagaaagagatttacactgatatctaaacaaattctttcaaaacgtctttgccataacactatggggctaccaagaaagagaagccaaggtcactgtattatacatttatactactctgctggtctttaagttcttgagtcatgttatcaagattttggctttcatcaagtcgcatttccttaatcatctgcatttcttgcgcttcactgaaagatttccagcttttgcaagatggggaaatggaagagggcatccacaagatccaggtagatgtcactgagttgttttcttcagtgtttgccataatcctcatccggtagatgtgacatacccatagagacaacaagtttggttagtatacagatgaattgatcagaatcctgattgtataaacagaacatctaaacatcaatcttaagagtgtgcaggtcaatagcagaagcaactgtaatgaagaaaactcgaaagacggattgattacaacaaaaaaactgtggcgcaaagactaccaatttaatcttttcatgatcagatggatacagccaaatgtgcctttagaattttgtttagcaccatgtttaatccgcacgccaaaaccttacggctgtgaagttctgatacacggtgcgtgaatcaatcaagaagagaaaaagagaggcatagagaaacttgcacggttaagatatccagatgaactacacagtgataaagtttcactttttatgtctttgaagaagcattatagattgatagagaatcatcagagcttaacctgaaacgaaccatctttctccggacagagaatggcggcggctgtctgaagttattttgagaaagtgaagatttttagggttctgagaagtttccatcacttgaagtcttttaaattttaatagtatatgataatggaattgcctcgattctaatgcaattgacgacaatgcccacaagaacagagcaaa

SEQ ID NO: 4360 - DNA, 3000 bp, Unknown
  misc_feature (1)..( 3000): cDNA_ID_1824006_gDNA_ID_1620702_Annot_ID_48790 3000 nt of promoter + ATG
ttagattaatgtagatcatactaagcaactttggttggttctgagtaaaccgattttgtccctggggcagatgaagaagaagaggatgaaaacgacagtccaatcgaagaggtccgtttaaccgtaccgataaccgacgatccatctctaccagttttgacattccgtacatggttcttaggaatggtttcttgcgtggtactcgcgttcgtgaacaatttcttcggttaccggtcgaacccgctcacggtatcttcagtcgtggctcagatcatcactctccctctaggaaagctcatggccacgactctaccaacaacaaaactccgtttacctggtacaaattggtcgtgttcgttgaaccctggaccattcaacatgaaggaacatgtactgatcactatattcgctaataccggagctggaggagcttatgccaccagcatcctaaccatcgttaaagcattttatcaccggaatctcaatcccgccgccgccatgttgcttgtccaaaccactcaggtatgtatacacaatatacaatataattcaaaaattacatagtttttgtttgtaacagttacattatttatctgtcatgtagttgttgggatatggatgggcgggtatgttcaggaaatacctagtggactcaccttacatgtggtggcctgcaaatcttgttcaagtctctctctttaggttcgtgtttttttctccaaatcattcacatttgtaactgtcacgaaattttactttttgatggattagagccttacatgagaaggaggagaagcgtgaaggaaaacaaacgaaacttagattcttcttgatagtcttcttcctgagcttcacttactacatagtcccaggctatcttttcccttccatctcatatctctcctttgtctgctggatatggacccgctctgtaaccgctcaacagatcggttcagggctgcacggtctcggcattggctcatttggtcttgattggtccacggttgcaggtttcttaggcagtcctttagctgtaccgttcttcgctatagccaattcctttggcggatttatcatcttcttctacatcatccttcctatcttctactggagcaacgcttacgaggcaaagaagtttcctttctatacctctcacccatttgatcacactggtcagcgttacaacaccactcgtatcctcaaccagaaaacattcaatattgatcttcctgcttacgaaagctatagcaagctttaccttagcattctgtttgctctgatctatgggctcagcttcggtacccttaccgcaaccatttctcatgtcgccctctttgacggaaagtaagattcttttttttttctttttttctctactctgcgtctcaaaatactgtatagatcaatttatcagtttccatgaaaaatatttttttgttgttgttgtggttgtttacatgaaggtttatctgggagctgtggaagaaggcaacattgacgacaaaggacaagtttggagatgtgcatacaagattgatgaagaagaattataaggaagtacctcaatggtggttcgttgcggttctcgctgcttcctttgtgctagctctttatgcatgtgagggatttggcaaacagcttcagctcccatggtggggacttttactcgcttgtgccatcgcctttaccttcactttgcctattggagttatcctagcgaccacaaaccagcgaatgggtcttaatgttatatcggaactgatcatcgggttcttgtatccgggaaagccacttgccaatgtggcttttaagacttatggttctgtgagtatagctcaagccttgtactttgtcggagacttcaaacttggccactacatgaagattcctccgagatctatgttcatcgttcaactcgttgcgactattgttgcttcaactgtctccttcgggaccacatggtggttgctttcttcagtcgagaacatctgtaacacagatatgctcccaaagagtagtccgtggacttgccctggggatgtagtgttctacaacgcgtcgatcatttggggaatcatcggtcctggaaggatgttcacaagtaaaggtatataccccgggatgaactggttcttcctcattggcttccttgctcctgtcccggtctggttctttgcaaggaaattcccggagaagaagtggatacatcagattcatattcccttgatcttctcaggggctaatgtgatgccaatggccaaggctgtgcattactggtcgtggttcgctgttgggatcgtgttcaactactatatcttcaggaggtacaagggatggtgggcaaggcataactacatcctctctgcagctcttgatgcaggcactgcggttatgggagtgttgatctactttgcgttacagaacaataacataagcttaccagattggtgggggaatgagaacacagaccattgccctttggcaaattgcccaacagagaaagggatcgtcgctaagggctgcccggtgttctaaaaccttgttgcagtttaacattatctctgtagtttctcatacctgcaggtgagggacagttactgcaaagtcgtttggtggccataataataataatgcgtaaagactttgtgagagtttaagtgataaagtaaaaaatggtttgcaaattaagaacacccaaagatgatagctctaacacaaatttcaatcaaagagagtataatttcaggacaaagcaaaacaaggctaaaagtttccatctttttctaattgaataacactaagatctgtgaacaacttccgttcctgtcaatttcaagcaatcaagaaccaaatttgtcaccttctattgaactcaggaaaactcctaaattgtgcaatttaacgtacatgtcaaacgtaatcagatcctaagattcatagttaggtttttcaaaccttcgaagtcatcatgagagagatctccagaggaggcaggagatg

SEQ ID NO: 4361 - DNA, 3000 bp, Unknown
  misc_feature (1)..( 3000): cDNA_ID_1824002_gDNA_ID_1620702_Annot_ID_48791 3000 nt of promoter + ATG
ttcatcagactgttcattctcttcttcttcttcttcctcgtctgtggaaacttcaggctttttgaggggcttcttctccgaaatacatttcctctgcttcttcaatggaggcttctgggttttagccgccttcttcagcggagacgccttagtctgcttattcagtggcggagtctgtgaattggaacccttcttcttgttacgcgtaagagcagccatggatacggtttttacaacttagggtttatcgccgtgagggtttagcagaattgcagaggtaggagaagcaaggtcgaagaatctagtaaagatggaggatgagcaaagttgcttaatgggcttgattgatactaactaatgggcctgactaatactaactaatgggctgtagtcgaacttattttttgtcagcctaataaattatcgagccactgaattcataaaacctataaaaacataattcaataagttatttgatgtatgcgtttaggggtttcaaaatgggtaatccaactcaactcttaatcaaataagtttagatgttaaatgagttgggtcaacccataactcatttaatttgatggattgaattgttaaatgggttaacccatttaaataataatttaattaattattattataaaacaataataaataattaatattattaattcattatcatcaaacttaaaatatttacggattccactttttacgggtttacgtttttggcggaaaaatcacaggtttatgtttttggcgagaaaattataggtttacgtttttggcaggaaaattacgggtttatgtttttggtgggaaaattacgggtttacatttttgacaggaaaatctcgggtttacgtttttggcgggaaaatcacgggttaacgtttttggcgggaaaattacgagtttacgtttttggcgggaaaattacggatttacgtttttggcgggaaaattatgagtttacgttttggcgggaaaataacggatttacgtttttggcgggaaaatcacgggtttacgtttttggcgggaaattacgagtttacgtttttggcgggaaaattacggatttgcgtttttggctggaaaattacgagtttacgtttttggcgggaaaattatggatttacgtttttggcgggaaaatcacgggtttatctttttagtgaaaaattacgagtttactttttatcaatttcatcgcttgtatatttaagaaatttggaaaaatattaattttattaaattggtttaaatgtgttggttaaacttaaattggcattggtttagaaattttagttggtttaattcaattttacaaaacttgatgggttaattgggtaaaccattgaaatcattaaccattacaacccaactcattttactcatcaaaccaattgactcatcaactcatttgacccattaactcatttgagtcaaaattttcaactcattagagttcatgggttgaattgagttgagttaacccatgaattttaacccattttgacatctctacctgcgttacatgctcagcccatgcatgattgaagctagtgatgttgataacaaaaactgaaatgaatcacgtaattttctaaaatcagttctaaacgattctgtttcttctttaagaatgaaaacacgaatttatttttggtgaattttaattccaactaccaaaaataatttgattgattggttgaaatttcttgtaaaattgtgttagaatttgaaatattatcatttgcaggatatatatgtagtttggctgtcaaaaaaaaatgtattatgtttttggtgaagttgcaagttatttataacacatagaacctagtcatagacgttgacatgaaacagattgaataagacagtgtgtgtcttagaaacagaaacttgaataaaagtggaaatatgcgtttcatattgtataaccgatagattatggaaacaatgatgcatattggcaatcaaaacaaaaacaacgatacatacaattgcgaccacaagcaagaccgaaagacacacctgtgacgcgcgtccaacgcacaaagagtccgagtcaaattcggagtctattaagcggtgcaccagcaagtatacacgtacgaaccaattacatgcataatgcattaagactgtcactatcgctaaaaattttgtttttagctgctgcaagtgatcgccaattaaattgcaactcttacctcacaaaattgtctcttgctagttcaattatttcctttttattatcaacatccgctaattattgtaatgctcaatttctttttgtaatttactctctatcctaatcttttactttgaatgagagtgtatgtataaactatttttgataagttctttctcttttttctatatagaaagtctactttctgtaaactgatttttgtctctttcaaaccagagaagtaaagtgaataattgaaagctatagacggaatacactacaaattgctagatccagtatctctaaatgattaaatgccaaaaattgctatatttatgatctgtttattcttttagtttaagtacctatttcaaaaacataccagatgtagaatctacattcatactcgaaatcaagattttagctttttaccccgaagtgaaagttttttttccactgaaagtgaatcaacaactttagttctaatgagttcagtaaacttgtcgatattaagaaattcgtcgagaaatcatgattctttcagtcttcactccaatacatattagaggaaatactctcttgtatcttctctaatactagtacatcctctcaaacatcttaactaaaacagaggtctaactttttcctttttcctggaaaaattgcagagaaaatttatttttaatgtcaggtcattaacacaggttgcttacaagaacattacttctacagcaagttattcagaactctggacattatcacccgagtcgatcgacgtcagggccgcctaacagaaaatg

SEQ ID NO: 4362 - DNA, 3000 bp, Unknown
  misc_feature (1)..( 3000): cDNA_ID_1823998_gDNA_ID_1620702_Annot_ID_48792 3000 nt of promoter + ATG
aaccaaccaaagttgcttagtatgatctacattaatctaaaggaatcgagttgtgtttaagaattatacaaatagagcatcagccataacggtacacaaggaatcaaaccacatcgaaccaagattggtcaaaacagaatcgagattttatttaccggctatgacgatcttggactcaaccttgtgctctggaggcttggatacttcgagagagcctaccattttctgttaggcggccctgacgtcgatcgactcgggtgataatgtccagagttctgaataacttgctgtagaagtaatgttcttgtaagcaacctgtgttaatgacctgacattaaaaataaattttctctgcaatttttccaggaaaaaggaaaaagttagacctctgttttagttaagatgtttgagaggatgtactagtattagagaagatacaagagagtatttcctctaatatgtattggagtgaagactgaaagaatcatgatttctcgacgaatttcttaatatcgacaagtttactgaactcattagaactaaagttgttgattcactttcagtggaaaaaaaactttcacttcggggtaaaaagctaaaatcttgatttcgagtatgaatgtagattctacatctggtatgtttttgaaataggtacttaaactaaaagaataaacagatcataaatatagcaatttttggcatttaatcatttagagatactggatctagcaatttgtagtgtattccgtctatagctttcaattattcactttacttctctggtttgaaagagacaaaaatcagtttacagaaagtagactttctatatagaaaaaagagaaagaacttatcaaaaatagtttatacatacactctcattcaaagtaaaagattaggatagagagtaaattacaaaaagaaattgagcattacaataattagcggatgttgataataaaaaggaaataattgaactagcaagagacaattttgtgaggtaagagttgcaatttaattggcgatcacttgcagcagctaaaaacaaaatttttagcgatagtgacagtcttaatgcattatgcatgtaattggttcgtacgtgtatacttgctggtgcaccgcttaatagactccgaatttgactcggactctttgtgcgttggacgcgcgtcacaggtgtgtctttcggtcttgcttgtggtcgcaattgtatgtatcgttgtttttgttttgattgccaatatgcatcattgtttccataatctatcggttatacaatatgaaacgcatatttccacttttattcaagtttctgtttctaagacacacactgtcttattcaatctgtttcatgtcaacgtctatgactaggttctatgtgttataaataacttgcaacttcaccaaaaacataatacatttttttttgacagccaaactacatatatatcctgcaaatgataatatttcaaattctaacacaattttacaagaaatttcaaccaatcaatcaaattatttttggtagttggaattaaaattcaccaaaaataaattcgtgttttcattcttaaagaagaaacagaatcgtttagaactgattttagaaaattacgtgattcatttcagtttttgttatcaacatcactagcttcaatcatgcatgggctgagcatgtaacgcaggtagagatgtcaaaatgggttaaaattcatgggttaactcaactcaattcaacccatgaactctaatgagttgaaaattttgactcaaatgagttaatgggtcaaatgagttgatgagtcaattggtttgatgagtaaaatgagttgggttgtaatggttaatgatttcaatggtttacccaattaacccatcaagttttgtaaaattgaattaaaccaactaaaatttctaaaccaatgccaatttaagtttaaccaacacatttaaaccaatttaataaaattaatatttttccaaatttcttaaatatacaagcgatgaaattgataaaaagtaaactcgtaatttttcactaaaaagataaacccgtgattttcccgccaaaaacgtaaatccataattttcccgccaaaaacgtaaactcgtaattttccagccaaaaacgcaaatccgtaattttcccgccaaaaacgtaaactcgtaatttcccgccaaaaacgtaaacccgtgattttcccgccaaaaacgtaaatccgttattttcccgccaaaacgtaaactcataattttcccgccaaaaacgtaaatccgtaattttcccgccaaaaacgtaaactcgtaattttcccgccaaaaacgttaacccgtgattttcccgccaaaaacgtaaacccgagattttcctgtcaaaaatgtaaacccgtaattttcccaccaaaaacataaacccgtaattttcctgccaaaaacgtaaacctataattttctcgccaaaaacataaacctgtgatttttccgccaaaaacgtaaacccgtaaaaagtggaatccgtaaatattttaagtttgatgataatgaattaataatattaattatttattattgttttataataataattaattaaattattatttaaatgggttaacccatttaacaattcaatccatcaaattaaatgagttatgggttgacccaactcatttaacatctaaacttatttgattaagagttgagttggattacccattttgaaacccctaaacgcatacatcaaataacttattgaattatgtttttataggttttatgaattcagtggctcgataatttattaggctgacaaaaaataagttcgactacagcccattagttagtattagtcaggcccattagttagtatcaatcaagcccattaagcaactttgctcatcctccatctttactagattcttcgaccttgcttctcctacctctgcaattctgctaaaccctcacggcgataaaccctaagttgtaaaaaccgtatcc

SEQ ID NO: 4363 - DNA, 3000 bp, Unknown
  misc_feature (1)..( 3000): cDNA_ID_1823994_gDNA_ID_1620702_Annot_ID_48793 3000 nt of promoter + ATG
atcgattatgctctgaaaaacagggatgttaaactcgttccatgtggacttgattttggccgaccagggtaatatacattttcatctgcattgaaaaatttcatgattcgtcatctgaacacaaatgttttgctgcatatcttcagatttagcagttttagagaacaccggttccacccttctttagagaagactagacgtttctatcctcacgtgcacaacatggatggattctttgttgcaaaggtatacacttggttaacctatgaatagcttttccctgcaaaacagatgttttataaaatatgaatagtgattaaaccaacgaggtatttactttttcctttctttgttctgcagctgaagaagatgagcaatgcaatgcagccttcaggaaatgatgagccagctgtaacaatggagcaagctcaggtgtcgtctagtgatgatgatgatgagaaagctgaggccattgaggagttggagaagccacctgttgccagtgggcaacccaagagagagagtaacactaaagaagacacgaacaaacgaaaaaatccaaggtcaaaggaaattcacaaaggcaaaaggaataaaaacacaaaaaccgaaagtggtaatgtggaagaacccaggaagcaaaagaagaagagatcacaatggaagaatgagattgctcaagctaggtaaaaaaactaagtgtttccttgacagacaaaagagaaaaccttcttatgtacattgttgtatcatacacccatttacccataaatggttgaatatgttgcagggaagaaaaaagaaaaaccatgagagagaatgctaaggagacgccaaagcacaggggataagaataggtttgagatcgtgatgcatcttgaagagtagaatatttcggtgttctggccatggcgaaggacacaagaaaagaggcttcattggctgaggccaaggtatctatacaatggctttctagttttgattaatttactgcgtaaagaaagggtgacacccacatggattagctgttacatgtccaaaagttttgtatcaatcacataacttgatttttgtgagaggctgtttctattttccgttttcaattggagttgtaaaatttattgaaaacaaaaacgagtccctactttctctcacaagtgtgtttgaaaggctattcatttttctgctcctagcaattatttaataaaatacataaatcttggagggttgggtccataccaccacataaggatagaatttctcatagtattgatttgacgaaaaaataagggaattgggagtgagctggtcattgttagggagagatgtgaaggttttctgaagtgggacttgagtgttggagaaacatgacaatccaattcaactcttcttcatccatctttatcagattctcctccgttggggaccttacatttacttctctcacactaatcttcttgtttctatttttagattataagcccatattataactgctagtgcttgtagccttgtatacacaaactcacatgcatcacatataacatcgtataattgctgtattcactttatatttggatatccaagattatagaaaagagattcctttgcaggacccaaaagatacagcttttaaaagcaaatgagttcattttaatttcttgctaaccaaaatggtaagtaattttgtggacttatggtatggataaataacaaaatctcaataaaccattgaaaataggaaatcaaaaaatatatttctgcatataatttgaaaagaaaatttgcatggaaataactatgtttttgaacaaactaaacatggaaataattattaccgcaaagtacaaggcattacgataagcatccttgaaagctttgtctttttttttgggaactcgaaagctttttgtcttccagttgtaagaaaaatacaggaaaaaagaattgaaaagccctaaataaaaaagtcgaaaactttagctttgaccaactctttcctctcttttcatggtagacccaactctctcatttcttactctctgattcatctctctctctctcttcatttccatggaaggaaggtgatgagctttctcaatctctctttactgattcttaatgaaagtcatctcctttctctttggtatcccttttcttcttctctgcttaattcctgaccaaaaattgtgacaagatctttcaatccaaaagctatatacattaaggtaacgatttatgaagtatttctcctcaatttcatttcttttgtttctacgagtctgcatagatccagaagagctttgcttgattgttcttactttcctgagatctgtttaaacttagcaaaaaaaaaaagtctactttgcatgaaatgtgtgattagggtttatgctaattttggttaattggagaatcagagagtgttccctgatgtggaagtagtgaattactttgggttgagtaaatgtatgtctctcaattgattgtcaacgagatttgagctcgagatccgtaaccaagttgagctaaagcttctttctttcgacttgttctctatatgaaaattattttttctttgactcagttatttttcttaatttgatttctttgagctcgatcttatgattcatactgcaatgattgagttgtggcatcagctctgatggtatcttctgtttttaaaaaatagcaactttttagtgtttttctgctcagctctatgttaaaggatgtttcttcattacggggagaaatgaatgagagctcttgtttattgatcttcccatgattctagttctaaacgagccttctgttatctgaatttgaagtgttttaagcttttttattctaataagccgtcttcttctctgacgctatgttttgctcactgcagagctcaggtcactatctgacgggatccgtgacaatagtggttactggagtcaaaagcagctccttgaatcttgagtgttaagtagataggtaaggtaaccgttc

SEQ ID NO: 4364 - DNA, 3000 bp, Unknown
  misc_feature (1)..( 3000): cDNA_ID_2993867_gDNA_ID_1620702_Annot_ID_48796 3000 nt of promoter + ATG
atttatgttattaacgactttttcatattttctattaacaaattcacattctacttatgataagacctttacatttttaatattttgatttgtctacgttttgtttttcacttgtgatatgcctacgttgacataattttaaaactgggtactcgatgctatctttttatatcacaaagatagaatcatatgccctacatgaaaatatacaaaataatatttttgcatcaaatttaatcattttaatattatgttccattgacattttacctttacctataagggaaaatattctgttgtgtggtgttttttttatcctctcttgcgtgggcatatttcttatatatgacgcctaaaacaatatagtttttatctatatactatagttttctataaaattatgagaaggagaagataggatctgtagacagctgagcttctcttgtgtagaggaaaaagtctacctctaatgttctttttgggcataatgatgtttatgagtatccaagggttgcattatatccattaattaatttgtagacggccaataatagaattcatatttggcattcgatgacctcattgatcccatagttgtttacttgttctagtaagaaggtaatactagtttgcgaagaaaaaaaatgtaatatgagtttaaaatactttttttttttttttttttttttccaaaacatcttagtttatttcagaatacttgtgtataagcagttaatcatatgccgaattcctgactaatttcaaacatacaaaattggattaaaaaatgtttttgaaatcttcaacgtgatcaaatagaaaattgcaaattgaagagaatttcactcctaaaaattaaaggtctcctccagcacttgagtacaagatcaccattcttcgaggtatatgccaatatatcgtgaactttaaataattcaaaatcttaagtacaccaaactaaaatagtgaaaccacccctttttcttggtcaaatgtttgatcaaaattatgatgatggtgtggttatgtgaaggggacaacacctttttgaactttggaaattttcatgcaaacttttccgtttctagattttcttagagttttttaattaccaaaaaaaaacagttatcgagtttttccttatttcttctgttaatctagacattaaatttaatatgtaaaaatgacaagactatgtatatgatatgagtgttgcaccaagaaaaaattactatctaaaatcttcactagtcacatatttttgaatagttatgatatattttctgttgctttatcattttaccgagttacccactttcgaattatcagtttttatcaaaacatggattgataattatttaaaatacaagtaaaacaattgttggtttagaaaagaattacatagttttattctgaaacggcattgaacagtattgagagatatatacacatattcttcttatcttttacacattttggaagttttacaaccaaagaaacatgtttttttttttttttgaaaaattctctaacaagatttgaggtggaccaacttggatccagaatgtcaccactcaccattatatatcctaactgttatccacgcaaatagaacacaaccgctaccccacaagataaaccaatagcttaaatttttaacaaaaaaaattcgattcaactcccacataatttggtaggtaatttgactcaagggcctaggcccatttaaaccaatgaaagaaactgagaacggcccaaagatatctcacacatatcctctctatataatacataatcatagcatatcaatttcattatcaccgatcaaattagggtttctctttcgattacagagtttcacttgtttggagccaacaatcatactctgcaaccaaaatccaaaacaagaaaaaaatggcctgtctcaacgatgataagaagaagaagtttcacctagtccttgacttggaccacacgcttgtccactcggtacttgtttcggacctttccgaagagcagaagtatctaatcgaaggagctgattcaaggtcagatctgtggagaatcaacagagatccactcccagcgaatatatgataaagctacgaccttttcttcatgaatttctattagaagccaacaagcgtttcatcatgcacgtatacacaatgggtgattctagttacgctcagaccgtgttgaagtggattgatccggaaaaaaatatactttggagatcgagtcctagccagagaacaaagtccttatgagaagacactcgatcttcttgctgttgatgagcgtagagtggtaattgtcgatgatgcgattgatatttggcctcatcacaatagaaacttgttacaaatcagcaaatacatttatttcagcgtcggtattgaactattgataaacatcgcagaagataagatagacgagagtcgaagcaacggatcattggcgcacaaaagattcaaaaaggtaagttttaaaagacctgagactgttgatacctgatccttaattatcatcaacaatactgcttctgactgtgtcaatctaccaatgctacaacactcttactttgagatttaggatgtttctggttccaacaactctttaaacaagcaattttgattacactaacttttttatcttttacattttgacaaatgtacatgagaaaaaaaaagaggattgtttacatcttctaattgtttttgtcaactttaacgtttgttgttgttgctttagaaattgataaagctaaataaaggagaaaaagaagaagaagaaaataaattattaaaaaaatgaaaaggaaaaacaaagaattaagagaggtgtgaagtcaatatcgttctttcatctttcactacaatcttcactaacgcagagaccaaaatctctctcatttcgccatagctgagagcttcttctactttcccttagcttcttttttccttcatttttgttctacccttgcgaatctctgaaatg

SEQ ID NO: 4365 - DNA, 3000 bp, Unknown
  misc_feature (1)..( 3000): cDNA_ID_1808391_gDNA_ID_1620702_Annot_ID_48797 3000 nt of promoter + ATG
aagattttgaattatttaaagttcacgatatattggcatatacctcgaagaatggtgatcttgtactcaagtgctggaggagacctttaatttttaggagtgaaattctcttcaatttgcaattttctatttgatcacgttgaagatttcaaaaacattttttaatccaattttgtatgtttgaaattagtcaggaattcggcatatgattaactgcttatacacaagtattctgaaataaactaagatgttttggaaaaaaaaaaaaaaaaaaaaaaagtattttaaactcatattacattttttttcttcgcaaactagtattaccttcttactagaacaagtaaacaactatgggatcaatgaggtcatcgaatgccaaatatgaattctattattggccgtctacaaattaattaatggatataatgcaacccttggatactcataaacatcattatgcccaaaaagaacattagaggtagactttttcctctacacaagagaagctcagctgtctacagatcctatcttctccttctcataattttatagaaaactatagtatatagataaaaactatattgttttaggcgtcatatataagaaatatgcccacgcaagagaggataaaaaaaacaccacacaacagaatattttcccttataggtaaaggtaaaatgtcaatggaacataatattaaaatgattaaatttgatgcaaaaatattattttgtatattttcatgtagggcatatgattctatctttgtgatataaaaagatagcatcgagtacccagttttaaaattatgtcaacgtaggcatatcacaagtgaaaaacaaaacgtagacaaatcaaaatattaaaaatgtaaaggtcttatcataagtagaatgtgaatttgttaatagaaaatatgaaaaagtcgttaataacataaatgtgtataatatgtatcgtgggttcgtatattagatagaagacaagtcacctacgaacaagaaaatgtactatgtagtaatcttggaatattaatgtaatttctctctaacgctcaattaatatataacgttgtcacttgactcactttatctcttaaccattcattttctggtgttttgtgtaccgaataacatactgattaattattatgtatccgtccacttgttcgtgattttgtaaggtaaagtccaaacattttgtaaatagtctgaaaagaccaaaaaaattctaaaacataacgctaagtaattcacctaacttaaattatatgagacactaataatttcggaaactttgatgacgattttagctcaaacattatgtaactattttctaatgtttgtcccagtgattatgatgatatgaatatatgataatttttagatatttaaattatttcaatacttttgtagatagtgattgaatacattataccttacctaattagaaattaactcattcattcacctatagtttttacaaacacattactggtttacaaactcatattattatacgctgatgacatttatataaatcattaaactacaatgtatgttctaaaaatcttccaattttaaagtaaatagtataaaattaaatatatgcataaagtttaaacttagtttgtttccaaagcaaggaataatgtgcagggattcagaactttggaaattcttgtgagtttttttaaaattataagaactttggaaattaaactttagaagaaaatcttcatacaatcataaattcagctacaattgaaaagttgtagaagaacaaaaatagacaatgaaattagtgtttcttcaaataaaatggaacattttcttttgatgatattaattagcctttagaaaagttgtgatactcataaattgaattactcattttttctagagactccataaattgaatttaatctcataagaaatgtaaaatctatttttcaattgtttttatcacaaataaattattggttagaaagtgaattattgagatgaatatatatatatttgtgggaaaaaataaaatttaaaaataaaaaggagctatcatcttccatcatctgtctttagggcctccctctaagtctaacaaccctaaaataaaagattctaacaccaaaagagagaagcaaatctcaaattcttcccctattattatatgtgactgttgttgtttttctctcttttaccatctttggcctgaagaaaaaaaaaaggaatccttcttaatggatttggtaaatcaattaagaaagcattacacaaaataaaaaaggaaagttttttaataagcttcattgagagagagatatagagagagaaaagagagagaggccatattttgataagagaagaagaacccttatagagaaagagaaagagagagacagagagagtggatggatgtcttatagaatgaacaaaacatcctctgtttctcttgtccttgtccctttttccagatcttaaggttttccacattttatcatctgggtcctctccttaatggtgaattctccatctttacaagtttgatgtttttgttcatcaaatctggcgtttttttttctcttctaatatatattgtctctgctcattttccgtttctcttcccattgattgttctgtttcatttctgttttttttttttcaatagttttgattggatgctttgatgatccattgtcagatttgaagacactcaattcctatttgatcggggactagaatttggattctgtttcagacaaaagtagatttccctgtctctttcccgtttgattttcaataagatgaatccggaggtaaaacattgaacaattcttcataaatctcagaactttgagcttttttgaatcttaaaacacgatcgaagtaaaaaatcgaattgttagatgaaatgggcaatcgtcattttcgcaaatctgatccgtatttgtgagatcggattcattggatcgactttggggttttgcaggagcaaaag

SEQ ID NO: 4366 - DNA, 3000 bp, Unknown
  misc_feature (1)..( 3000): cDNA_ID_1823982_gDNA_ID_1620702_Annot_ID_165123 3000 nt of promoter + ATG
tgcatcggatctgggcaagctcttcattggcgggatttcatgggacacagatgaagaacgactgcaagagtattttggcaagtatggagatttggttgaagctgtgatcatgagagaccgtactaccggacgtgcccgtggctttgggtttatcgtttttgcagatccttctgttgccgagagagtcatcatggacaaacacatcattgatggccgcacggttagtattcttggatccattgcttgacaattcatctaattatcagtcttgagtaatcgagtgttctaaagtctcgatctttctgtaatgattctgtcttagaggtcttattggtctcgctgctcgttaatgagcaacggattgttctataatctcgatctttctgtattcatgctctcttagagatctgtttggtgtcatccattaatgagttttaagcagcaacgtttagatctttctgtaatcatgctcttttcgaaatcttctgttgtcattagcttctggatttgctgttactgttataacttgtgagaatgtgttgttgctttgtgttgaagtggcaatgttagtgttagatcaatgagaaaagaatgaaagatctttttttatttctttgttgcaggtcgaggcgaagaaagctgtcccgcgggatgatcagcaagtgctaaaacgacacgccagtccaatgcaccttatctcacctagccatggtggtaatggtggtggagcacggacaaagaagatctttgttggaggtttaccgtctagcattactgaggccgagttcaagaactactttgatcagtttggtacaattgctgatgttgtggtaatgtatgatcataatacacagaggccaagaggctttggcttcatcacttttgattccgaagagtctgttgatatggttctccacaagacctttcatgagctaaacggaaaaatggttgaggttaaaagagcagtgccaaaggagctctcctcgactactcctaaccgaagcccacttattgggtatggtaacaactatggagtagtccctaataggtcttctgctaatagctacttcaatagttttcctcctggttataataataataatctaggctctgctggccggtttagtcctattggtagcggtagaaatgctttctctagcttcgggctcggattgaatcaagaactgaatttgaattcaaactttgatggaaacactcttgggtatagccggatccctggcaaccaatacttcaacagtgcttcaccaaaccgttacaactctccaattgggtacaacagaggagactctgcttacaacccgagcaacagagacttgtggggaaacagaagcgattcctctggtccaggttggaacttgggagtttcggttggtaacaacagaggaaactggggactttcttctgtggtgagcgataacaatggctatggaagaagctatggggctggttctggactttcggggttatcattcgcgggtaatacaaacggttttgatggctctataggggaattgtatagaggcagctcagtttatagcgactcaacatggcagcagtcaatgcctcatcatcagtcttctaatgagttagacggcttgtctcgctcttatggctttggtattgacaatgtaggctcagacccatcagccaatgcctcagaaggatactccggaaactacaatgtcggaaatagacaaacacatagaggtacactcatcgatgtcaaacttttttccttttgcatctcatctgctacatttatttttgcctgttgaaaagtaattagattgattaacgttttcaggtattgaagcatagaaagaaatcgacgaagagaagtgagaattgtagatcaagaagaacagccatttccgttgcagagtttgaagagttgttatttcgatatcaagtagagaaagaaaccaactttcttcatcacagtgagtttcttgttttgtttttttcgtcgttagcatcacaaacacaaaaaagagaagtttatttttactttaaaaattcttacataagataagatcagattggtagctgcaaagatacaacatggatgataaaaaaagatttggtttcgtctccatagcaataaccagagatcgttgattctcgatcactattctttaggtttctctccttcttcttccatgatttcttgatgttgtgtgctctgtttgtaactctaattgttaaaattttttatgttacagattttttttttcttttggtttttaaactttggattcgaattgttcatgggaacttttggatttttctattagcgtgagagaaaacacattgtgcaaaaggctccaaaatgattattttgttacatttcatactttttacctttgggtttcttttctcttctgcttacagtataatctatttattaagtacatgtggttaattcatgattttaaggtaaaaaagtaaacaagcttatcttccaaattggatttgtttccaagaagacattggggttgttaccaagaatttgagaaagcctgaattattggatcctttgactaaaccaagacacatttgggtccaggaagtgacaatcacattcacacaaataattaaccaatcttaaaccatgggacattgtgattaagagctacaacatcagttgaacttgaacattatgagactacatcttgagcattagcactagcattggaagttaatgggcttcaggcccactaagtaagttttcagcctaagcaatatcttcaataatgattttttatttatttaggatatttacttttaaaaatgtaaaaacaaaaagacaataaaagtttgttgacaaaagaaaaaaaggttcaaaagtcccaacggtcgaatcgaaattcagacagttcaaaaagccgctctccatctccttctctcttacagaacataatcagatctctcttgctctctcaccctcactctcactctcactctcattgtctgaaaacc

SEQ ID NO: 4367 - DNA, 3000 bp, Unknown
  misc_feature (1)..( 3000): cDNA_ID_1378280_gDNA_ID_1620702_Annot_ID_165117 3000 nt of promoter + ATG
aaatgcaccaaagagaaactgtgggagttttgtgatgtgttggacatacacattaccaaggctacaacaaagaaggtcattatggttatcaatttctaagtttttgttcttgagattcatttttttcctctgtgaatagatacatgtgaaggtttaaatttctgtctttgttgagcagcttgattagccatttctggttgtccaagtttatgcttattcatttccccatttaatcgaatctggcaacttcttgttgcatgctttttcaacacaggaagatattattacaaaactgtttgagtttttggagaaacctcatgtgacaggtgatgtgaccggtgacactacagtttctgagaaagagaaggtaatgtggtgttgggaaagttttgtttgctttaataactattgtgcatcttacattctttaaaaacattctgttgaaacagtcaagtaagggagcaaaacgcaagagaactcccaagaaaacttcacctacagctgggagttcatcctccaaacgatcagcaaaggtaatgcatagcttagagctgagggcttgcttgttcattaatcttgttattaactctgaaaagaacgtgtaatctcaatgtagcttatttgcaactgtccatcactggtcaacccgtcaatgtttctggctaagtattttaatctgattatattattctgcacttcctttgcagagccaaaaaaagtctgaagaagcaacaaaagttgtcaaaaagagtttagctcattctgatgatgaatctgaagaagagaaagaagaagaagaaaaacaagaggaggagaaggcagaagagaaagaagagaaaaaagaggaggagaatgaaaatggcattcctgataaatctgaggatgaggcgcctcagccttctgaaagcgaggagaaagatgaatctgaggagcattctgaagaagaaactacaaagaagaaacgtggttctagattgtcagctgggaagaaagaatcagcagggagagccagaaacaagaaagcagtggtcgctgcaaaatccagtccaccagagaagattacacagaagcggtcatcagccaaacgaaagaagactgatgatgacagtgatacaagtccaaaggcgtcctctaagaggaagaagtctgaaaaccctatcaaggcctccccggctccttcaaagtctgcatcaaaagagaagccaggtttggtcattatcctgtttttttcttccagtaagatggtcgcttaggtagaataaaaacatgttgggtgtagtgtatgtcagatgcattggagaatcttattccttatatcttcattttcagaagcgaaccaatatacaaccactaatgttttctgacaccatgtttatctctgtttgtgtctatatgctaaaagtaaaaagggctggaaaagggaaagacaagccgagtgataaagtgctgaaaaatgcaatcgttgagatcttgaaaagagtggactttagtacggtgagtaatttctcaaccttttatatgcgatacacttaactacttgggatgtgtgtggaataaaacaaaattggattctgccgaacaaacttattggttacatgaaataaccttcgttttctgaaagctgatttgaagtttgttgtgcaatatctattcaaactgtgaatttccttctatacctagataacctaataagagcattgttgttcttctgcaggctacgttcacggacatccttaaagaacttggtatgaacagattggtttcagtcatttgtttttccagtgattcctggttatatataaaataaacacattgtttcatccatctttcagctaaggagttcacagaagatctcactccaagaaagtcatctataaagatgataatccaagaggagctcaccaaattagcagatgaggaggaggaggaggaaaagaaagaagaggattcagagaaggaggaagcaggagggtctggtggtggtgaggaggtgaaagcctaaactcctttctgatcacatcgcacatattgagtctctctgtcagatactgttgcctaatgcctagtagtcatctggcaaatgtgtaagttaaatctgtggatgtaatattttgttgttggagtctgaactgcgtaaagcagctttacttttggtagagacaagaggaagaagctgcatagccaaaggataggttgcttgtatgtctatagcatttaacataaaagcctccttggattgtctttgatttgtgaggctcccttttcgagacattgtcaaggtttcttttgtttatgtcttttggtttgaaggaggccaatggtaataaatgaataatatgtttctcttgattccctttaagactttgaatattgcagaaggaatttatgctcatcttgtatccttgatctatctctaacatatctgcaaatctaccaacgcaaatccagtctaagaaatgtaggaattggtacctcataaacatatacaacaaagattaacattgatgaagaagagagtctgtattcttacaggaccaaaatatacagaaaagaatctgtgctcttcttctacatccccttttcggacaacccaaacacaagttccaaaagaatgtaattgctgttgttacattcagagtacctaaatagattgcaatggagacactgcaaatacatagaattcaaagcagatggctaaacatggttaactataagcataagcaacacttgtccaggcttttatcattctggctgcagctactattatcttatttgatgtactagattcgaaaagacctgtcacacacacaaaggcaaaagtaccggtccgattgcaaaatagaatatcgattaaggagtaaaccggaataagagtaacggaatatacttgacagacctctctcagtagaagaatcactgagaaactttcacttcttcttcgtctccgtagtttcagtttcgatctgtaaagtttcaaacttgtggtcgaatttttaaatg

SEQ ID NO: 4368 - DNA, 3000 bp, Unknown; identical to SEQ ID NO: 4363
  misc_feature (1)..( 3000): cDNA_ID_1823994_gDNA_ID_1620702_Annot_ID_165116 3000 nt of promoter + ATG

SEQ ID NO: 4369 - DNA, 3000 bp, Unknown; identical to SEQ ID NO: 4361
  misc_feature (1)..( 3000): cDNA_ID_1824002_gDNA_ID_1620702_Annot_ID_165114 3000 nt of promoter + ATG

SEQ ID NO: 4370 - DNA, 3000 bp, Unknown
  misc_feature (1)..( 3000): cDNA_ID_1824006_gDNA_ID_1620702_Annot_ID_165112 3000 nt of promoter + ATG
agaaggaggagaagcgtgaaggaaaacaaacgaaacttagattcttcttgatagtcttcttcctgagcttcacttactacatagtcccaggctatcttttcccttccatctcatatctctcctttgtctgctggatatggacccgctctgtaaccgctcaacagatcggttcagggctgcacggtctcggcattggctcatttggtcttgattggtccacggttgcaggtttcttaggcagtcctttagctgtaccgttcttcgctatagccaattcctttggcggatttatcatcttcttctacatcatccttcctatcttctactggagcaacgcttacgaggcaaagaagtttcctttctatacctctcacccatttgatcacactggtcagcgttacaacaccactcgtatcctcaaccagaaaacattcaatattgatcttcctgcttacgaaagctatagcaagctttaccttagcattctgtttgctctgatctatgggctcagcttcggtacccttaccgcaaccatttctcatgtcgccctctttgacggaaagtaagattcttttttttttctttttttctctactctgcgtctcaaaatactgtatagatcaatttatcagtttccatgaaaaatatttttttgttgttgttgtggttgtttacatgaaggtttatctgggagctgtggaagaaggcaacattgacgacaaaggacaagtttggagatgtgcatacaagattgatgaagaagaattataaggaagtacctcaatggtggttcgttgcggttctcgctgcttcctttgtgctagctctttatgcatgtgagggatttggcaaacagcttcagctcccatggtggggacttttactcgcttgtgccatcgcctttaccttcactttgcctattggagttatcctagcgaccacaaaccagcgaatgggtcttaatgttatatcggaactgatcatcgggttcttgtatccgggaaagccacttgccaatgtggcttttaagacttatggttctgtgagtatagctcaagccttgtactttgtcggagacttcaaacttggccactacatgaagattcctccgagatctatgttcatcgttcaactcgttgcgactattgttgcttcaactgtctccttcgggaccacatggtggttgctttcttcagtcgagaacatctgtaacacagatatgctcccaaagagtagtccgtggacttgccctggggatgtagtgttctacaacgcgtcgatcatttggggaatcatcggtcctggaaggatgttcacaagtaaaggtatataccccgggatgaactggttcttcctcattggcttccttgctcctgtcccggtctggttctttgcaaggaaattcccggagaagaagtggatacatcagattcatattcccttgatcttctcaggggctaatgtgatgccaatggccaaggctgtgcattactggtcgtggttcgctgttgggatcgtgttcaactactatatcttcaggaggtacaagggatggtgggcaaggcataactacatcctctctgcagctcttgatgcaggcactgcggttatgggagtgttgatctactttgcgttacagaacaataacataagcttaccagattggtgggggaatgagaacacagaccattgccctttggcaaattgcccaacagagaaagggatcgtcgctaagggctgcccggtgttctaaaaccttgttgcagtttaacattatctctgtagtttctcatacctgcaggtgagggacagttactgcaaagtcgtttggtggccataataataataatgcgtaaagactttgtgagagtttaagtgataaagtaaaaaatggtttgcaaattaagaacacccaaagatgatagctctaacacaaatttcaatcaaagagagtataatttcaggacaaagcaaaacaaggctaaaagtttccatctttttctaattgaataacactaagatctgtgaacaacttccgttcctgtcaatttcaagcaatcaagaaccaaatttgtcaccttctattgaactcaggaaaactcctaaattgtgcaatttaacgtacatgtcaaacgtaatcagatcctaagattcatagttaggtttttcaaaccttcgaagtcatcatgagagagatctccagaggaggcaggagatggaggacaagcttgatgtactcattatgggagagctcaaacttgagctagtagagctacgccattatttcccaagctcacctttgtttgactcgatcacaaaactcagtgagtcagactcagttcaacgaccctctaatttggatacccgtttacgcggcccaacccggcccaatactggattttgaatttttttatgtttaatgattttcttataaatatttggctttgcgtagagggagagagggagagagggaggagagatggcgttgtctaaccaaaaaaaaaacgagaatagataaagcagcagcggttgctgtcggagttttgcttcgaagacaaaaaactaaggttgttaggttttataggccaacggtttatgttctcctacttctctgcttcttctgcattcttcaatcctaagcaaaaatccatttgtggacgtcactatcaaacggccaacttcaccttctctgacaatatcactacaccttcctttcttcttcatctcttctatcttcactatttttttaccaaaatcttctccatctgctgggttcacaccaaaacctacactttttggtatgttgctctgtttcgcagagtgaagataaggtatttgatgaaaatgcctcactgatatatccatccatgtctttttttttacatgtactttaattgcatattttaaagacttttcatggctttttagctcaagctttactctgtttctctttgctcttgttcaggagatcaaatcaaagacctctctgtttccgatatg

SEQ ID NO: 4371 - DNA, 3000 bp, Unknown
  misc_feature (1)..( 3000): cDNA_ID_3073133_gDNA_ID_1620702_Annot_ID_165109 3000 nt of promoter + ATG
tgtaacccatgaaatatcactaacagttaccgggaacattgttttgcagtttcgtttcagctatatgatcttaagcagcaaggtttcatagagaggcaagaggtgaagcaaatggtggtggctactcttgctgagtccggcatgaacctgtcagacgaaatcatagagagtataatcgacaaggtgtggttccttcctaccctgctcgatactatattcttgttccactgttgtatagccaactcatgatagcagttgagaataaagtaaagagtggtttctaagtttcttctttcacagacatttgaggaagctgatacaaaacatgacgggaggatcgataaggaagagtggagaacccttgttctcaggcatccttcccttctaaagaatatgactctccagtatcttaagtgagttcctaaaccaagacttatccgaggtttaggcaatgcaacttccaattttttctgtgttattattaacaccgatctctgatattgtgtgcagggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctactcctgattttgattgctgattttctcctcgcatctgtagatatactactaaccttgagacatgaatcctattaataaagagcaaactgatgaagtgataatagagagcaaaaaagagagaacccaacaccaaatgatcgggtatgctctagtctgaattctgaagtcaaaattgaaatcaccgatttgatcgaaccggatgcaacattacaacaatcggatttgttagtcttgtggttgactttgtcagttagagttgacaaagtaattagcaaagttagtgacgattgtgttctgcataaacacgtttactttgaggaataaattacttactctttcggtctttcctaatatatatgttttccctgtctcaaagatctgaataggtatcagagcgcgttgacaatctctttttttgatcatcgatttgttctctctttcttggctaaaaagtttctatctacacgactctccatggattcaacaagaaattcagcttcttccaactccacgggatgctttacggatcagaaaaagcgaaaggcactctatgaggtgtttaagaaactcagcggtgttgattgccaaagaaacgaggttcgtataaattatatgtaactttcttgctaagtacgcatatgatataaatctgtgtttcttcgttcagggtaacgttgtagaaggcgtaacgtgttattatggtgaaatgaacaaggtatttggaattatatataaatatatatgtctttcttgccacgcactccttcttttcaacaagtcttacagattttccataacgtgtcctgttgtatttctgttgtatcaggaacagtttcatgtagccatattccagactgacaaaaatgagagcttgttttcagagagggtattttatttttgttctcaacaaaaaaagtctttgtaatccatttgcaaacaatgacattaccctatcacacaggtcttcgatttgttcgacacaaatcatgatggattacttgggtttgaggagtttgcccgagctctctctgtctttcatccatctgctcctatagatgataaaattgaccgtacgtctctgatctcaaaaactagacccgatatattaaccatctacaaacaaactgttcacatgctacctatatatattccatgaaagcttattaacggttacctggaacattatttggcagtttcgtttcagctatatgatcttaagcagcaaggttttatcgaaaggcagggggtgaaacaactggtggtggctactcttgctgcgtccggcatgagccagtcagacgaaatcgtagagagtataatcgacaaggtgtgttttccttccttctattttttggttcgactctagtctatagtatagccaactaagtttaagcagctgatgaatatgaagtgaagagtgatttttgagtttatgaggcagacatttgtgcaagctgacacaaaacatgaagggatgatcgatgaggaagagtggatggacctagtttttagacatcctcttcttctgaagaacatgactctccagtatctcaagtgagctcctaaaccaaagactaacccgaggtttagccaatgcaacttcaaatttttctgcatcacgtattattaacaccatgatatctgatattgtgtgcagggatatcacaactacatttccgagctttgtgttacactcgcaagtggaagatacctgagaaaaacaatagcatattagcagaggagactgtttgggaattgtgtttgttttctgattatgtatcatgtttatttgttttcaatctctctcaacattttcaagattttgttgttcctttgtgtggaaaaaaaacaaatccgttgatgattttctcctcgcatctgtagatctactactaatcttgagacatgtaaaagcaaactgctagagcattgaaagggcaaactgctagaaaaaaaagagagaagaactcaacaccaatgatcggctatgctctaatctgaattctcaagtcaaaattgaaatcgccggtttgatcgaaccggatgtatttaacaaaataaacaaaataaacaaaaaaagaaggaaaaatagatcctcacgcgttaccgtagcgcgtatttttttcacaacaaaattcataagcagtgtgggtcccacaggtccactaagtttagtggtgggttgctccgtagctaatctcatctctcactctttttcttatccactatccatagaagaagaagaagaagactgttgacgacgacggcgatg

SEQ ID NO: 4372 - DNA, 3000 bp, Unknown
  misc_feature (1)..( 3000): cDNA_ID_2170256_gDNA_ID_1620702_Annot_ID_165106 3000 nt of promoter + ATG
atgaaatgcccacttctgttcacacttctgcactactgccactacattcttggactgcttctgccgctatattcccaccacaagggaccattcttttattattagacaaaacaagttaaatccgattgaaaagtatacagacaaaaccttctactatagaaataaataacccatatcatattctagattagatccagcgtaacaccctttattaattctcacttaatataatttattggagcagatcaagccattcaacaaagcctctctctcatgtgatgagatctctgacctaattgaatcgtgattagatctagatcttgttacattgtcttcgtcaattatccgcacttaaacatttcttcgttattttacactattagtatacgttgtaacacatatttcatctttctgtactaataaagagtacccacccataaactactctttcataaacaaatgtcttcatcaacaaatgtcttatataacgtgaagtttcatatccaaaccactggttataaagtgttttgtaacgttaactttcactattagactcatcaatgtttgcctatgtaatcatacaacagtagtagttgtataaattataaattggtgtagagaatttaggaataatgtttggatgaaagggtgttgtcacccaacaaggagagggaccattaataaccgataatcataataagatttgtgaaagaaatgtttcactgatttggcagaagtacagttggaggttctttgtcttttctcttctgcaccttttgttctctttacttccttcttgtttgttggtttttgttcttttcttattttttttccctaccataaatggaccattaccattcatttctctctttttcttattatttgctgtatttagttgattttgttatatccgtttaaatttgtgtacatataaacaacgacgtctataagtttttataacaaaaaaaaggattatgttaggtgaaatttcgattcgttttacgtgtaggatcaacgtgaaagaaagtcgttgtaggtatgaaaaatatggaccgactacgatacggctgcttgagaaaattagatgtataacgtaaagtgaaatagtgaatgttaaggcaattagggaaactaaaattaaatattcaattggtatgtagggaaacgactttttatttattcacatgcacatgacctctctatgtcatgtgccttaagttgccgtgttcgatctttttataatttgttcgacccgttaccctaaatttaaaaatcatttctatttttttattattatgtccaaatctgatttctttttcatgtgtcatatatataaaactcattttaattaaattacaaatttgaaaaaatatttttttttgggaaatttaagaccgacaagatgagcaagggacatggttgtaaactaattatttctttaattaatcagtcacaaaaattcctagcttgcatgtgcaatttcactctccaagattccatgttttacttcaacttttatcactagtttatactatcaaagactcaaagtagatgatctgtattctacgctaatagtaaataattttaatataaccactatttacccacttctgttttctctcaaaataaaaacagaatccacattatatacatggtttcttgtggttactagttacacaatgtactagctacaagaagtgcttctgattaaaccatgtacagttttctagttcaaatacacatggttcctcgttactagttacacaattatgtcgacattcatgggaagttcaagggatttggatacttcaattcttactatgagaaaccctatttaaatgtaactactaaaacacaagcactttttgtcgtggatataattggttaaaattatcggtgcgtttaatgtgttgagaattcgttgaacactttattacctattattaaaccaaaaagaagcattaaagttcatcgtgccgctttaagatccacaagttttgtttcttcgattcttcgtggtgaacgttgcagccatctttgggctgtactattgtcattatatttaacgggtcttttcttttgtaagttagagctagtatatatgaattaatgatatagttaaatttaaataacttgtaatgctcggtctaactcttaaaaaaacgtttgaatgtgattgaacctttcgtaacagtttgatactagtttaatggtaaaactggccacatggaacaagacgtcaagacctataaatgatcgcaaccttttatcgaagtggagaacacttctcgttcacatgttataagatcatgatacgatgctctctgattagtggattggagtgaaatttcgacaaaattcgtacatgcaaatgtcgtaaaaggcaattacaatatagcagcggaaaagagaggaggactatttgacatgtcggtctcaaaaccatgaaagttggtgccattgtaagagggctattgttttgacatgtcattcttgattctcagatttcgattttcatataaattatagcatactatttttgttgcataatatttgattattttcttactttcaaaaattttggtggtcggccataatatgtttttccaataaataaataaaaaaggtttatctatgtaaggtatattccttgaagtcaaatccaaatttaattacaggattatgtttcaaaacgttatctaaaacttgatccagctatttcaagagtgaactactttgtaacttaattaggactatttagggtaattgttttttcaattttacaaaaatcaaaagcaaagattaaaataatactaaagggttagtgatagaaactttgttgggatcaaaaaccttcctttgctacttctctctctgctctgtgtttatttatatatttcctataaacaaaataaaaccaaaaccgatggattggttcttcgctttacaatcccaacgcacttctctcattcttcttcctcatcttcgtcttctccgatg

SEQ ID NO: 4373 - DNA, 3000 bp, Unknown
  misc_feature (1)..( 3000): cDNA_ID_1388618_gDNA_ID_1620702_Annot_ID_165104 3000 nt of promoter + ATG
ctgaaccaccagagaaaagaattaagaccaaaagcaaaagaggtacaagcattagatgcctatgttggttccctttaggacttaaagtaatcaaaatcagtaaaacacacaagaagaagcttaaccattttttagcatataccaacacagaggattttaatattcaaaatctcaactttgatcaaaaaaaaaaaaaaaaaaaagatacaatggtctcaggaaagaaaagttgcagaaattggttggctaaaaccacagctggtttcactagacaggtatgtaaagctgattgtatataaaaccccacaagtctcagctaatggggctttaagaaacatcacatgtctaacggtagactgaaacagggatcatctgaaactcctttcacattttttacttattttatcagaaagaagtaaagcaaccaaatctctttctttttttctgtagtccctcaaaccaacttgcatcacttgattagacaataccaactttgagtatctagattctagaagaattaaaaaatgaacaagaaacttcgcatgtctaatggtggcatgaatatagtaccatttttctccccaaattcctttttcgctttccctaggtgctgtgatctttctaacgattcaaacttagccaaatggacaacaaccttgagcattctctctattcatctctcaaagcgtaggtacaaaacttaatatcaggaaaccatatcaaaacaaaaaagaccttgaccctcataagataaagggaaatcagtttgaaaatggtgaatcatgtggcgattggcgaaaacattatttatatccttcaatatctatctctcatttaacacaatcctgatcgagctcttaacattattagaaggtccagagaacaatatccaaagcaaatggaccaaaagaagtaaaagaatcaggacctgacttcttccaatgttacaccctcaaacctcagcaggagtctttgccacaatagagagagcatgtaacccgctcttcaactcatcttgcaacaagtcatatatcagcctatgtctcttgaccaagcttttaccttggaaagcatccgaaacgattcgcaagttgaaatgtgtttccccatcatcaccagcactacctctaacagcggcatgtcctgcgtgctggtaagaaacatcttcaacttctaactcaacaggatctagctccttctccaatttctctcttatcctcatccctctactccctaaagcaacaacatttgacccactctcagaatcatcaatcttttctgttcccaaatcctcaactagatcaggtttagactccaaatccacctccggaacattagcttcgtccttagtctcaggaatagacacaaagctggattctgaactctctccagaacttgaatcttcctcacctttgacttccaaatgaagagcctttttctgcatcagcttaagcatattaagtaatccattgtttctagaaggagacagactctgctgcaacccgagaagaacagcgaaatcaggtgttatcctcaaaatctcagggacaggtcttccagataaacccttgactaatagagcagctaaccctttagtgagaaccgaatcagaatcagcttcatacacaacattacgttcctcatcaaagaaagccctaacccaaacctgagaaacacatccttctactttattctccctcgtcttgaattgagaatcgagaggtgtcagattcttcccgtagaacataagctgctcgtatttagcctttggctcttgtaccgattggaaaagcttgacgatctcttgtagcttcggtggaagctcttcgattggttgaaggtctccatagctcgacggagatgatgaagccgatggtggaggaacaatcccggttgaaattttctggaaagtgatgatcgtccggcgaaaggaaggaacttccgacggttttagtggtcgtagaagaagggttttggccggataatggattgaagaaaacaaggtccgtttgaatgggattaaacgaagcgaggaagcgcaacaagaagaagacatcgctgctgccatagtcgcgaacttgaaacttcgagagagactgagatgatgatgaaagctctccttcttcactttttctgagtcaaaaaccaataccgccaattaggtagtaaccgggaattaaaccgggaatgtaccaaaatccaaaaattagatgtaaaatcaattgtggggttgattatgaataattagaaagtatacgactcttttcataaataaggaaaagaaaaagatatctagattttttttgttttgttttgaagcatcgtcttcctggttcttcgttctcttgcgttcgtcacctcaaacacgctccgccattattatatatcaaatcaatcatgtccgaatccagcttttaccaatgtaagcaattaaattaaattaaataaaaacacttttatcaaatttaatcaaattaaaaaactgtccctttcttatctgagattctattgtttctgtctacttccacagaaagaaactgcatctccgtttttttttctgatttgaggctttccttagatccttgagagcaaaactgaatctgggtaattttaaaaatctcatttttacgacttatctcttttgaacgatctgttttttcatgtaagtacgatttcacctcgagatgatcgatcattgctcttctggttcttccatgtttgattaaatgttataacttgagggttttgtttcttttggattgttctcgcatttgttgatctatggttatcaaaagagtttggatttacagtttttggttgcagctgaaatttttcactcttttcttctctgttttgctggataaagttggatttgattcacattgttgtttagaatctagatgaagttgtaagattccttgtattgtgtttgcttatgcatgattgtgataaagatttaagttattttaccaatgtacaatgtccagaattgtcgtcggg

SEQ ID NO: 4374 - DNA, 3000 bp, Unknown; identical to SEQ ID NO: 2998
  misc_feature (1)..( 3000): cDNA_ID_1819223_gDNA_ID_1620702_Annot_ID_165127 3000 nt of promoter + ATG

SEQ ID NO: 4375 - DNA, 3000 bp, Unknown
  misc_feature (1)..( 3000): cDNA_ID_1010729_gDNA_ID_1620702_Annot_ID_165124 3000 nt of promoter + ATG
agaggaagatgacgacgactcattgggtgatcagattcgtgaactaaaggtcttgttttttgttactgtcatatagctgcaaatatcatctgttacatatttgatgtgagtttgttgtatatactgacatttgaggaatcaatgttttgtaatttggttggttacaggaagagctcataagaacaaagtcggatgggtacaacaaagctgatgcaagtaagagtggacactttgcacgtgacagtttaagtcaattgagagtcagtatcaacaaatctttactcatgtcgtgtccaaaaagagatgaatctgagggaaaagaggtgatcgtggatggtgaagatgtgctggaattgaataaacatattgagaagcttcacggttcttatgattctgttcactcctcatttgcaagtgcttcatgctatgaagccgactcgatgagtggagatgatgaggatgtctgctcagaagacttggagaaaccaatgcatggaaaccataaagatgttgactttgtagataatgatccaagccagctcgacaatgttgaattcgatacaacgggtagtggcatttcaatcagatcacagcttcctagttgcgttctagaagagccaattttctcagaatctccaaagtttaagaatgttcagaagagtgtagctgcatcgacaaagttttcagcaaatcctaggaatgtgtctgaaagctccaacattggagacatgaaagtcaatcagattagcccgtgtatgtcaaagaaggtttcaggtcctacagattctctagctgctagtcttcagagagggctgcaaattatagactatcaccaagggagctcactatcaaaaagttcatctgtttccttctcttttggccatatggcattgaaaccttgcgcagaaggtgagaatcttaatgcttcagtccaatcttttagaaaagataaagcttcagaaggtggattgtcgtcgattctcctatgtctttcatgtagaaagaaagttgaccaagaagctgaagtatgtccacaaaacctgagatatttgcctactttctctatagctttaattttggtaattctgtttcgttacttatcttataatctcttctatatcaggtaacagaagaagctggttcaaacgaaaaacatctcaagaacatgtgtatggagcaagcagctaaaattgaggagctaactctcctggtaaaaaccttgtaaactttaaagaatattagtgttataaaaccttgaatcagattttcaaaaattagttttgataattcttaacttagaccaatatacaacatagctgtggaagagcctgtgaagttaccagttgagtttcattgacgatatttgacaagaatggcaatctaaattgaataaactgtgttgtggccttgtttgcagcttaggaaatcagatgatggagaagatggaacagagttcatcaaagaaacatatgagacgaaacaaattagtgaagagtttggaaaaacaaactttgaggtaagtgaaaaggaagctcttctcaaggagattgcagacctaaagagcaagctgcagcctactaagtccacagacaatctgagatcctcgttactactacgatccattcaaatgcgcaaaagcattgatgttagcaggaatggtgagaacagtgatgatctagcgaaagaaagggagatgtggacagaaatggagagtgagtggatatccttaacagatgatctcagaatggatatcgataaccatcgcagtcgagctgagaatctagagtttgagctcaagcaagagaagctagccactgaagagttgaatgacgcgctcactagagctgtgcttggccacagtagattcatagagcagtacacagagctgcaggagacgtacaatgaacttggggagaagcacagtgtgatgatggctggaataacagatgtaaagaaagcagcatccaaggccgctatgaacggccgccatggaaagcgttttgccaaagccttttcagatgagctttctgccatcagagctgagaaagagaaagaaagagagctcttgaagaaggagaacaagaacctaagaactcagctgcgagatacagctgaagcagtccaagctgctggtgaactacttgtcagacttagagaatctgaacaggccttacaagtctctgaggtaaactaagctcattcataagatcataacactctcatgtggaaaatcttggtttcattaaatggctaaacttgaactcaaaccatcattgcaggaacgattcagcgtggtggaagaagagaaagagaggctgaagaagcaaatggagcaactaaagagcaaacacaagacagaaatagggacaatgaagcaatacttagcagagagtaaattaccaggatctgcattgttgcagccatggtacaaagatgaggaagatgaaatagaacaagtatcagaacatgaaaccggagctgtcagtttcgatgactacgaggatgatcaggcttggagagcagagtttggagctacatatcaagaccaccattactagtctttgtttcagacaaacgacccttctcgggtcatttactatgatcctccttagtacttttgtactgttatctttcattttgttgttctattgtatctgccattattgaaccgctaaaaagatttgtaacggttggaaacatttttacatgtattgattgattcatcttttcctgaattccagtgaaattcccagaagaacagaaatctaactgaaaccgcaagaacttactgtaagcccaattctgttaatgataatgttaaatgggctataaaatgagccccgtcatcagccgctgaagtgaaacgcatcgtttagtatcgtcgtcttctggggaaaatatctttttttttaaacactatcaattcgactggaaaaaggatatttccagattaggtagagagagagcaaaagtactttcattcagacttcagtttaagct

SEQ ID NO: 4376 - DNA, 3000 bp, Unknown
  misc_feature (1)..( 3000): cDNA_ID_1815368_gDNA_ID_1620702_Annot_ID_165099 3000 nt of promoter + ATG
ctataccgaattaaaggtaataatttgaagtttcaaatacgatatttaagatcctaattatgagtagaattgaatgtgaaacggttttattagtacaagaaaagggtatatgaaagggttaagcaattaggttcgaaatataaacacgcacagaactcgaagagccgaatttaacaatgaacccaaaattaaacgacactgaagcaacctttgtgttgtgactctatatgagtgtatatatatatggtttatagaatacaaagtcttcagatatgtaatggagatttcagaaaaatggataagacactatagtagcacacacaaaatccttctagttggagaaggaaacttctcattctcactatgtctagcttcagcttttggctcggccatgaacataactgcgacctctctcgattctgaaggtatgtaaaacccattttatatgaacatttataatatacatctatcgatcactagtcgtaactaatgtattgacttaaatcaataaaattttacatgtagatgaactgagcataaaatatatggatgcggtggataacataaacatattgaagagatacgggtgtgatattcagcacgaggttgacgtgcacacaatgagcttcgataatagtttgagtctgcaacgttatgaccgcattgtcttcaattttcctcacgcagggtctcgtttctttggtcgtgaattgtcctctagggccatcgagtaacgaaatatattctttcattttcttactataatatatagtttatgatttggactgatgtaatgataaaatgctgtgttttggatcaggagccacaaagagttagtgagaggatttcttgagaacgctaaggagatgttggaagaggacggagagatccatattacacacaagacaacgtatccatttagcgattgggggataaagaagctgggtaaaggagaaggtttgaagctgcttaagaaatcgaagttcgagctgagtcattatccgggttatatcaccaagagagggagtggtggacgtaggagtgatgattatttccctgttggtgaatgttctacttacatgtttacccaatcctaactttgggaaatcttgcttaatttttttttggtattatgataactaaaaaaaagaattgggcattacaacatcaacaaggtaacaataatttggtccgactggacacgttcattcagttccttctgaaaactcaaaagcaattggtatataaaaagatcaaaaagttatatgaactatgtactttgaaaaagaaaaaaaagaagaagttatatgaactatgttaataataaagatctttaaactttttaatctcatttttgtttataatacatcgatttttattgagcttatacaagttcccgtaactgactttatatatagtttcatgtattaatttatacataattggccaataagtaggccttttttttgttgttttctcatgtaagtataattaagtgtgtaatcatatgaatctctataatctatatgcatacatacatgtatatagaatatatctatttttcgccaacaagaaaaaggacgaggaaactaaattggttgagattaacactttagtttattggttggtccaagagttggtagatttctttgtcgtttctctatagttggaacatgcatttatgtgaacttcgattatgacgatatgcatccatactacatgtaaaatttattgttgttttccgccaacaaaagaaaaacgaaaaagctaattaaattacgtacgagtaaattgaacacttggagaatcacatggatcctggagctctgctcatgcttaggagtgctcgaggccttagatctttcctatatgtagacgttgatccttgtgatctaaaaggtttcgaggtcttggaaatctatcacccgtccatgtctgatggctttgtgaactcggtaatggtcgcacgcaaactcactgatcgattaattaagtacgagtggtgtactggaactcgatcactaaattcattaaaaaaaacaaggcaagtgatgattccctaagaaattaggtcaagattggagccatacttgtggaacaaggcagatgatgatttccctaatgaggctctctgactctcccttactagttcaatattagttctgtcttttgtcaacgtgttgacgaaatcaaatctatattattagttgttgttttctctctatgcttattgtgattatgatgtcactagatcaaatactcggtttgaatgtttccttataaatgtatcagcatgaccatttttctcatattttacgaaatatttagcctgacaagcattaagcagttctgttaaacataaaacatacaatatccatgaaagaaaatcctcaatgtacatgagtcattaccaaatgcaagccatttgatcagaagtaagctgtggctgaaacacaatgtacagatgagtcatctttttgtttgtttgcttgaatagaaacgcagcgtttttgactaatcgagtaaccaattttttttttacaagaccgaaccggatcaattcaacaaacgtgaaataaatcgaagcgggccaggtcaagtaggtagccctctcaatgattaagagggaaccagctgtatccagagaccctctgagtcagtaagaagcttctaagagggacaggaaacggtaaaaaaaacacgagttatgtccggtaatatcaaaatggcaaaaatcattcatttcaagaaagaaaagagtagagagagtctcacacagctataaaggcccaaaaacaccaatccaccgacgagtattgtagatttagaggtctacaactaaaagcctttgtgtgtgccagattagctccctactaatccgccgccgcacctcctcgatctccgcccagctcccttcttttctatctatctattcagttgtttctccggtaacaaccagctgaggaagaagaagaagtagtagccgtgatgatgatgatg

SEQ ID NO: 4377 - DNA, 3000 bp, Unknown; identical to SEQ ID NO: 4366
  misc_feature (1)..( 3000): cDNA_ID_1823982_gDNA_ID_1620702_Annot_ID_48798 3000 nt of promoter + ATG

SEQ ID NO: 4378 - DNA, 3000 bp, Unknown
  misc_feature (1)..( 3000): cDNA_ID_1824077_gDNA_ID_1620703_Annot_ID_48800 3000 nt of promoter + ATG
ttaaagggtagtgatgatatagctaaagttgtagaggaggagaaaaaagatgatcttgatgatgagttctctgttaagatggtctttaaaggagtctcgatattcgaaagaggagatttgggttctggttattcgggaattggtgttgtgttggagaggtcaggagatttggagttgattcaggttcagaagaagttggatttttatgtcgaagagtctgtagctaactatttagctcttatggatggtcttgaagtagctttacagaacaatctcagctctgtggttgctgtaaccgactccgagttgctctataatcaggtaaagtctctcttctttagcttgttgaagagacttgctttcatatggttttgtatctctttgtaggtttgagctcacgttttatatgaattgactttgcagataactcgtgaggagcagctcgagatccctcttttagtagctctgagagaaagggtattggagaaaacaagtaaccttaatgggtttgttctaaagcttgctcctttctgtgatcttgatgaagctctaagcttggctcaagtagcggtaggaatcgtgtcttctaatcttgatggggataaaccgatcgagaactgctcgatctgctgtgaagaccgtcagtctgagatgatgctatcattgaaatgcactcacaaattctgttcgcactgcatgaaaacgtacgttgaagggaaagtaaagacttcagaggttcccatcaggtgtcctcaagtgcaatgcaagcattatctctcagcagcggaatgcaaatcgttccttcccgtcactactttcaaatcattcgaggaagcaaatgtgtgtagtaaaaacaatgggaagatttactgcccatatcccaattgctcttttctgttagacccgcaagaatgtctatcatcaggaagggctagctcaagctcgtctactcagtcagagaatagctgctgtgtggagtgtccagtctgtgagaggtttgtgtgtgtggactgtggtgttccttggcatgcttctatgagctgtgaagagtttcagattcttccagttgatgaaagatacccagatgatattacattgcatcgcttggcaaggtataagaggtggaggcggtgtcagcaatgccgtataatgatcgagcttgctcaaggctgcaaccacatgacttgccggtaagacacacatatatatctatggctacacattgttttccgtatctatacatatttgaaccaccaaagttaggtttttgacttccaataaaatatagttagtcttgaccctttaactgcagaatcacggtatcgtaataaccatatgattctaaggttttttttttctcgcctacgtttaaatctagtattctagagcaagtgtttcttttgcgattcttacgcatataaatgtcaaaactctctgtgttttccgcagatgcgggcatgagttttgctactcgtgtggagcagagtacagagaagggcaacagacttgcacgtgtgctttttgggacgatgatgaagaagaacaagaaaacgcagtagaggaaaacacaattcaagaagttgagcaatggccttgggacacatttaactcaattccaactgtaatggacgcgtactcagagcaagaaagatctcagcttgctctgatccaaaggttcttagcaggtggagggtttagtctcagtgatcaccatactacttatcagtcaccgccgcctccatgtacagagtcatcatatgttgaagccgcaatgaaagatcttcatcagcttccttggcttgagaggtttgtgtctgttataagtgatgattactatgaagagtataatagccagtgaaagtagtagaattgtaatttaatagccttgaggatccggcttggtttggttcagagaggccaaacgagagtatctcactctcgaaagtaattgttgggagggttttagattcttgatgaactcaaacaaacgaattgtgatgaaactatttgcaattataagaagaagagtttgctcatctccattctacaaatcctgcaagaaagattaacactcttttatattcagtgttatgttatgatatttaatctaccaaaatttggttgaagaactaatcaaaatgaacttggttagcatcatcatatatataccaactaccaagtaaagaaaaagtttgataaattcaattattcatgctcttcaaataaaatacagaacccattaaaaagggtccacttatcatcaatctactcttgcattatcttgagtttttgtgtagacataacataacccattttataagttatgaccttattagaaagggtccacttatcatcaatctacttagcattttgtgtatatttctcaaagctgacgttatttaagacgtcatagacccacttcaccacaactcaagtcgtcttcaattgctgacgacattgcttacggtttttgaatcgtcgtcacaaaatttaggagattggattaggaattggctctttctttactattctccaaagactttactatttggtcagtcttcttatttctcacctttagcttttagataaacctctgatttttttctcccatctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaaatg

SEQ ID NO: 4379 - DNA, 3000 bp, Unknown
  misc_feature (1)..( 3000): cDNA_ID_1807647_gDNA_ID_1620703_Annot_ID_48801 3000 nt of promoter + ATG
cttcttcacatttgtaaaatctgcctgttaacataaattatatacatatgaacgtaaatttctaattgatataagagacataaactatatagtatgaatgtatattcgtacctggaggatgcagccaccaagacctatgccttcgaacaagtgatggaagcaaagagctatgatgagtcctttaatggtacatgaatcattagttgctcctagagatagtccaatgaccacagaatgaaataaaatgccaacctccaatacctattcatggtattcaaaaatagcttgagtatggttatacatattaatttatgatttgaactcaagaccgttttgtagtattttcatatgtactaaccatggcaatgacttggtagcgcaaaagctgtccatcatctttagttgctagcactacaccatgaccgtgactatgattgtggcctaccatgtgaatcgctttctcttgatcaatgccatactcttcatcaggcactggtccgactgagttcttaccggtataaaggctggtggtaatggagtcaatggctagagtgactagaccggacatcatagcgacaaaacccgcaaaagggaacttatgccacggattatcactaagacatttcgatgacaacatctcgaaagagtcaggcaagacgtgcatgaaaccggttccaaggatgattccagaagaaaaacatttgacgatcatgaaaccattgccatcgggacggaggaacgaaatgtaacggctgaaaagaggagaggtcacgcctatcaagcttgttgtaagtatggcaacaatggctacgattttgagtggtaaagccttagctttgttgatgcacgggttatcaaagccgctatcacaatgttccggggccgttgagatcgccggagatacggtgaaggtgaataggatgaggagaatgtagacgagcttggtagtagccattagtattgagattgttttataatatatgatgtttgaatttttgatgagataaattgttttgtctttggttgtcttatatagaagatttgccggcttgttctcggtgctgctgatttggaaagtcaagttatgactaaatcaatagaaaaaagattacactagagaatcggaatcctgattttattgattgtgtatgtacattatcagatagaaaaaggttttaaattgtattttatattatcctatagttttgtttaatcgaagagaagcctggaaggtgtggatcatgccaaacgatacatgaaatgtcgtattattttactgtcaaaatgtattgctaaattggtttaatgttgaattaaaattgaactaccgacatcgctgaattgaatatgttacaatttacaaactgttaaaaaactacaaaatttgtcgttttctttgtcatatccattggtaatatatcgttatttcctacttcaaaatttgtttatgttttcattattagcaaattaggaattactaattagttgtgttcaaaggaaaaatctgagtaggccatctattgatattgggccacattgatatgtctcagtaggcccatatattacaaattaaaattagaaatgatgtacaagattcaaatgagaagtgttattcaaattagaaatgatgttcaattgtttgttctgtgtttgctccatttatttggttaattcattagtaatcgcatttgttctgtttatttcctctgttaattactgtttcttcagatgccacaaacactgcaataaaagataagtccatgttcacatttcccatttgaattaagattataaacaattaagctaatgattgctgtctccattttcaaacttcctgctgccataaactgtcctcgagtgtcttctattgcagaaatacaattattaaaaatttcatttttgtacttctttttgctaactttattcaaagggaatataactattggatgttaaaagtcagagaaagatttttttttaatgaagttacagctttttttctcaatgagaggagacaaagtccatgtgctaactttggtttcttaagctataattcttcatgctcaggttctaatccaattccattattacagtttcaattatttaaactatatattttaaattaaatacttgatgattagtaatgtgaaaataattatttcattgtgggaaaatataaaacattgtacagtacgagaatgacagcaaagtgaagccaaaaactcagaaaaataaaataaattaataaataaaaaaagagagaataaagaaacaaaacaaaaaaaagtaaaacttttctcttacgccattcgaagagagagcaaaaccagaagaaccgatgattcttcttcttcttcttcttctctccacaaaaactcagtagaaacatccaaaacaatgcgtttattttcttttttttcctggaaaaaaacagagattttgaagatgttattatagcttagagttttcttcttaattttagtttccaagtgtaaatctccttccactggtaagaaagcttctggatttctgttcttgcttaatgatactttaatttcaaccgatctcgttttattacaaaatctctggtgatttctgctacttaaataaattagaatttttttcttccttgaaatatgtaataattgagggtctggttggtgtttagtgggtcaacaaatcgagctgcttcttttgttatcttctgtgtactttcaaatgatttggtctctgatttatgctgatctgtttatgtaacttcatcaagcttagctgttttgttgatctgtaatgcaaagttcattttttttgttccctttcctctctctctcagtatatggtataattgagattagatgatatctaaaagaattagctttatctcatttttattcggttttgtttcatgaaatttgcagatccgatatgggtttcattggtgtgttgctaagttaagaaagtttgtacctttttgtagtttagataggtttgtttccagacatg

SEQ ID NO: 4380 - DNA, 3000 bp, Unknown
  misc_feature (1)..( 3000): cDNA_ID_1824073_gDNA_ID_1620703_Annot_ID_48802 3000 nt of promoter + ATG
tgtttttactacacacatttgcttcctcgaatgatttgaaagtagtgacgggaaggaacgatttgcattccgctgctgagagataatgcttgcattgcacttgaggacacctgatgggaacctctgaagtctttactttcccttcaacgtacgttttcatgcagtgcgaacagaatttgtgagtgcatttcaatgatagcatcatctcagactgacggtcttcacagcagatcgagcagttctcgatcggtttatccccatcaagattagaagacacgattcctaccgctacttgagccaagcttagagcttcatcaagatcacagaaaggagcaagctttagaacaaacccattaaggttacttgttttctccaataccctttctctcagagctactaaaagagggatctcgagctgctcctcacgagttatctgcaaagtcaattcatataaaacgtgagctcaaacctacaaagagatacaaaaccatatgaaagcaagtctcttcaacaagctaaagaagagagactttacctgattatagagcaactcggagtcggttacagcaaccacagagctgagattgttctgtaaagctacttcaagaccatccataagagctaaatagttagctacagactcttcgacataaaaatccaacttcttctgaacctgaatcaactccaaatctcctgacctctccaacacaacaccaattcccgaataaccagaacccaaatctcctctttcgaatatcgagactcctttaaagaccatcttaacagagaactcatcatcaagatcatcttttttctcctcctctacaactttagctatatcatcactaccctttaaccaaagttcttcatcaccacaacaacttctaaactcttcctcatctcctaagtgattcaatggaagctcctcacattcacaagaatcctcttgattttccatgtctggaaacaaacctatctaaactacaaaaaggtacaaactttcttaacttagcaacacaccaatgaaacccatatcggatctgcaaatttcatgaaacaaaaccgaataaaaatgagataaagctaattcttttagatatcatctaatctcaattataccatatactgagagagagaggaaagggaacaaaaaaaatgaactttgcattacagatcaacaaaacagctaagcttgatgaagttacataaacagatcagcataaatcagagaccaaatcatttgaaagtacacagaagataacaaaagaagcagctcgatttgttgacccactaaacaccaaccagaccctcaattattacatatttcaaggaagaaaaaaattctaatttatttaagtagcagaaatcaccagagattttgtaataaaacgagatcggttgaaattaaagtatcattaagcaagaacagaaatccagaagctttcttaccagtggaaggagatttacacttggaaactaaaattaagaagaaaactctaagctataataacatcttcaaaatctctgtttttttccaggaaaaaaaagaaaataaacgcattgttttggatgtttctactgagtttttgtggagagaagaagaagaagaagaagaatcatcggttcttctggttttgctctctcttcgaatggcgtaagagaaaagttttacttttttttgttttgtttctttattctctctttttttatttattaatttattttatttttctgagtttttggcttcactttgctgtcattctcgtactgtacaatgttttatattttcccacaatgaaataattattttcacattactaatcatcaagtatttaatttaaaatatatagtttaaataattgaaactgtaataatggaattggattagaacctgagcatgaagaattatagcttaagaaaccaaagttagcacatggactttgtctcctctcattgagaaaaaaagctgtaacttcattaaaaaaaaatctttctctgacttttaacatccaatagttatattccctttgaataaagttagcaaaaagaagtacaaaaatgaaatttttaataattgtatttctgcaatagaagacactcgaggacagtttatggcagcaggaagtttgaaaatggagacagcaatcattagcttaattgtttataatcttaattcaaatgggaaatgtgaacatggacttatcttttattgcagtgtttgtggcatctgaagaaacagtaattaacagaggaaataaacagaacaaatgcgattactaatgaattaaccaaataaatggagcaaacacagaacaaacaattgaacatcatttctaatttgaataacacttctcatttgaatcttgtacatcatttctaattttaatttgtaatatatgggcctactgagacatatcaatgtggcccaatatcaatagatggcctactcagatttttcctttgaacacaactaattagtaattcctaatttgctaataatgaaaacataaacaaattttgaagtaggaaataacgatatattaccaatggatatgacaaagaaaacgacaaattttgtagttttttaacagtttgtaaattgtaacatattcaattcagcgatgtcggtagttcaattttaattcaacattaaaccaatttagcaatacattttgacagtaaaataatacgacatttcatgtatcgtttggcatgatccacaccttccaggcttctcttcgattaaacaaaactataggataatataaaatacaatttaaaacctttttctatctgataatgtacatacacaatcaataaaatcaggattccgattctctagtgtaatcttttttctattgatttagtcataacttgactttccaaatcagcagcaccgagaacaagccggcaaatcttctatataagacaaccaaagacaaaacaatttatctcatcaaaaattcaaacatcatatattataaaacaatctcaatacta

SEQ ID NO: 4381 - DNA, 3000 bp, Unknown
  misc_feature (1)..( 3000): cDNA_ID_3073168_gDNA_ID_1620703_Annot_ID_48803 3000 nt of promoter + ATG
accgagttcatggggtcaatgctccaaggtagcatcaaacttcagatcaagtgcttcacggcggctttgcttggctgcgccgtaatgtcggtcgtcgccgtgtgggcttaaacactctttcaacataatcaataaattatttgatttattattcaaggcgacaaatactttcgcctttgtatatttgagtttttgtttttaagtttgattcatttattagtttgtatagtgcatgtaagcgtttgaaagaaatttctttttatgacattgtaaatttatttttatgaatgcgatgtttactttcttctttggaatgacatgtatttaattattggagtttgttgattgtcaatgttagttagaaaaaattaggtccgaaatactagtgacacggaaattaaagctatatgaattaatactatcaattatatttaaaattactctcttcaagaaaatgtacatacagtctcttgttttaataaagaaaaatttcttactttggttagatttaaattacacaatatttcatgacaactatttaaccataaaaactcgataatgtactatatctaacacataatttgtaggtgtgaatggcttaagctaaaaagcttataaattctatgtatttcattccatttcatggttttttggttgaaaactttaagtacaataacagacttactaactaatttgtaaatttccacacatgttttgattccatacacctggaatcatatcaaatacttgtaaattctgaacctattgaaacaagttgaaccatttctttctaaagattaaatgcattatcttgaagtataagttcttagaacatactattaaataactttgaatagtcttcaattttactaatgccttaatcaagttttgaaattatctttttcaaatcatacacacttcatcctgacaattgtaaatgtttatagtttttagaataatttttactattttttttaatttgtgtcaatatctgatttggtttgattctagacttcgtttgttttctcaaattgtgcaagtaaaaaacacgaatatatctattttttattttatgttcagaaaaaaaaaaatatatatatatatatatattcgtgttttttacttgcgcaatttgagaaaacaaacgaagtctacaattaagcgaaatcacacattgacacaaattaaaaaatatttcttttctcgaccgaaaaaagaaaattatttcaccaatatggaaaatctccccaagttcattctattttctgtatcaaagttaacgaatagacatataagcattttgtcacgtcggtggagtatgagtttggcacgttttgtttcgtgctcgtccaaccatatgaaaacgtgggaggtaaaccactcaactaataatattatacctttaaaaaaactatattataaatccagtttgatgcttattttattaatcattcttcaaagaaataaaacttaaatagtgaaaattataaccgaagttgactagttaggaggcatgccatggaatattggatacatactcggcatggacagtattgaatatacaggataatgtagataactatattttctataatttattttgtgtcaactattttttctatgattctgatgattaattgcatgacaatcaatcaaattaattatgccttcttctatataaccatgcaaaaccaaaaaaaaaaagattatttcgaaacgacatgagaatcaaaagaactcataaatcctaatagacatgaaattatgtatacagttataacattgaaatatcttaataccttacctaaaagataactagattaataaccataaaaccaataatcattaagtcaataaccccataatcttataaatgaagtcagtgactatatgttcatgtaaaaatgcgtaagttcatagctagatgtcccttttttaggagcacatggattgacacattaaacattcatacccgatttcatggaattctatttgtcattatcctttcccaaaaacttagttgtttcttagttattaaaccttgaaaaaaaatcaattcaaaaatgaaaaatgacttatatgtatgtcatttttgaaaactagacatcaagctatgaaaagaggaatctatttaccgaataaaggaggaggaatctacattcatatgtagtgtttttggtgactggattgcaaccatacactgagcacaagctgtcacgtgtgatgttgtgctcgtagcataaactataaagtataaacctaattaagcttaaagttaaaaatagtacaagattaaaaagtaaacgtttgtgagagttgactaacagaactatagaagacgcatggggttgacttcaagcggtctgcaaacggcatgaacaatgcattcaaacgataatataaaccttaattccaatatagcctttttcaaatttaaaaactcgaatgtttacgaaactataacttgataaaactgattgaaataaaatgtacttacatttttttaataaaatatacttaaattttttaaataaaatatactttaaaatatacttaattttttaaaatcatactatggattttaaacaaaataaattgtcactgagtcatatttctttggataaaagaactttacataagtgattggtacaatataataatatgcaaatttaagacattttattaagtttatattatcgtttaaatgcattttctatcaacttaataaaatctagctaggtactttcataattctatcattattccttttgaacgattaattactttattttctcgtttcacactggaagcaaacgagtaatcaaataaaatttcgtcatcatcgacaataaatggcatgaaaacaaccagcacacattactatataaaccgattcatctagtaagtccaaagtcacacaaacattaaacaatctaaacacacaacaatccaaaagaaaaaagaaaaaaaaaaaaaatggcttcaaattcagcacttctc

SEQ ID NO: 4382 - DNA, 3000 bp, Unknown
  misc_feature (1)..( 3000): cDNA_ID_1807497_gDNA_ID_1620703_Annot_ID_48804 3000 nt of promoter + ATG
gttgtttgattttaaaaagttaggagttttcatcttgtcacgtttccttcatatatagcatgaactcggccacgtacgtccacatctatcttgttcgtttgtctaacttacgaaatcaatattaattagaaatccacatatagaatataaattgaaaatgaatttgaaaacgtataatgggacaaataagtagtctattctaaaatgataaaaagctctgaacaagtgatgatgttaggcttagtttctgacattggagcaaaatcgataattagacaaacgaatatgtcgacaaaatatatatacaaatgaagttgagaaagaaaagacaaccgaagttgtctttttcgacgagtctggtttatcctcaaagttgttcagtactgttacttttaaggaaaataatcgtggtttggtcttctaaattgatttttcttttaatatcatatgtggaaaaacttctattacaccaaaaaatgttgttgagttcaaaatagatatgatgtatcggtaaagaaagactgaaccgatatttacacaattctcggttgtaaaaagagattgagatcgtccactttaacgtaagtattaggggtgggcgcaaggctagtacttgctattttagggatacttgttactcgacttgccttgtacgagtaatcaaataagtaattgtatttggtttattgaaaacgagtacttacaatttcaagtatttgctaaaatatgattgccttgcgagttacttgccttgtcctgttacttgctacttgcgagttacttacatgtacttacgagttactacttgatattcacgagttatttacaagtatttacgagttattacttgctacttgcgaattacttgcaaataaattacttgcaagtaacactttcgaattacttaaaattacttattattttatttatcatattttttacttatttaaaatttactttacttctaatatagttttaaaatgtgtctaacactaaaacaatacaatatatgtatagaaaatggtaaaataatgacgagtatcgagtcaaacgagtcgagtattagttttttttcattacttgttacttgatttgtacttgcaagtatctaaattatactacttgttacttgccttgttaaaaacgagcatttgttttttcaaggcgaatacgaatcaagtagcgaatataagacgagtaacgagtacttatgtctagccctaataaatatatatgtgttttttcaataactataacaaaaataatcgattaactcttttgtgctcaagttactatgtaaaaattggtatgaacaacattagatacgcatcatgataatgtttgtttagtggataaaaaatcgattaacaataaaaaaaaatagagagaggcatgaaaacgaaaataaggaaaagaaaaagactattcgtttggtgtggtcgacctgtcccacaccgaggaaatcacacttttatgacaagacctacttgtccgtactatataacattatcgaatgattccgattttctctttccttttttttttctttaatacggaaattactaattaaaaattaaaaagcgaccagacgacaattcaagaagcaaacaaaattggtggtaccgaaacaataaatcttttttatttatttctaaacaattattaatttattgaaaatttcacgaagaaatgaaacagaaagtttttcttggtcccacttagacgtggcctcaatcttcacatcatggccccacacgcttctcacgtgcaacttaaccagttacgacaaaacaaaattaagaaacatattaactttagaaatgtatttacaatggttaaattattgttttgtgccatttcgtttaatacaatgcaccgctacatgatcttaagatagctcacggaaaatttagaaaagtaaatcacaagtcccaaatatgccacggtggaagatgacatggcagatataaagcggagctttgccacattgaataaaattacgagagtaactttatagtttgtaaaattaaaatcatgggaatggtttaaattttaaataaaataaaactgaagaaatgaagagtatgcatatttaatactatcttttgatatgaaatttaattacagtaatcacaaaataaggaaaagttaataagaaaaatatgggttgactaaagagaggttaatttggaatctttttacagaagagaatacagtgaactaacataaaaattttattaggaaagacagctttacacatttttaaaaatgcatttaaggaaaaaacagctttgcacctttttttataggatttgcatctttaaattttagaaataatacaaaaaaggatggacaagaacataaaatctaatagttttttcaacaaaagaaaaaatcgaatagtttatgctaatatcattaacatattagcaaaaaaaaatttattgattttataatggctctttgactagtcaagcttgcatatgtttatgtggatgttgctaaggaaacatgcatgagtgcatcaataaataagaaagaaatattacaaaaaaaaaactttttacacgtcccaatatttgcaaacttcaagaaagatagtatatattgttgaataaaaacttagtatattttatatttctctagattatattccttttaagttcataaaattggttgtttctttttctttttccttttacaaaaatcaactgtattttactaacatttaatttacaaaaactttaattactaaacacaattggtaatataccatgaaagtcaatatctaatttgaattcataattattctaaatatctaaaatatttaaatagtaaaagtaataaatatgtatttatagaaaattaaaaaaatattgacttttttctctcccttaaataaaagccaatcccatagatttcttcaccagtcgccacaactcctccctcttctctctctctttgtttcagaatctctaggagcttttttcaacaacaatg

SEQ ID NO: 4383 - DNA, 3000 bp, Unknown
  misc_feature (1)..( 3000): cDNA_ID_1824065_gDNA_ID_1620703_Annot_ID_48805 3000 nt of promoter + ATG
tgacaaaaaattttgggcttttatttatctgtgtactattaaattaaaatgtgaatatatataaggacaaaattgattagacgttttacgagggtcttctgtttatttttggcttttgattgtttctatcacttttgtggaccaattcatgttttcttataaactaataaaggataaatattcgaacaatcaaactacttttatttaggccatgagagttataattgtattagtctaaacaaattagaattcttttacttaagaaatttgtagccacaatcaacatagtttcttttgtaacatctctactagaacaataatattgacattttacatatgatttgagaaaaaaaaatgaagtagaacaactaaaaagaaactatctagctaatcaaacaggggacacgcacacgatatattagccgtaggcgacccaactgagctaatgctaatggctcccaccacactaatagatcagtcccaaccaaaaacctatgtggtgtttggaattagaggggctattaaaattttagttatacccgaaaaggaataaaaaatgcgtcaatatctttaagcagccccaagattctaatcttaggcggctatgatgactaaaaaaaccaatcaaaggaaatgtgatttggataatttttagttaaatgtcaatatcagtcccaaccgatacgttgatgagactattactatatcattcctcgatatgcatgcatacattcaagttacagcaaattgtctcgttactaaaatattcattatttactctttaagttatgaaatgattgaaaaatattcatttttatatctaaataagtagtatatatataaaagtagtaaattaataatgtttttttttaatcaaaattcaagtatgccacctagtacaacaaaaactatactcctgtatatttgtaacaacaattcatacagtcaaaatttcatttgttaaaaacatgagatataattaataaaatacaatttcttgatttctagctatggaaactaatattctcccttgagttggattaaccgcatgacacatttatagatccaatacggtagtatgcgttgtcaatctaactattgacagtttacgctcttgctcattaaaaccaaatagactatcgtagattttgtctaagagttgcacaaaatgtcttctatcctttcttttcacaaggattgcatatgtttgactttcttcctcgtaacatcaacgcctacttcgtaaatttttattttattttgtctcgataaataataaattcatatttcatgacaattgttagatcctcagaaatctgaaataccagtatgctagaaatgccacatatttgtaacttcttttagattcaacttgttgtatttcagcttttgcttcttagtaaaattaatttcggtggtttatttttgaaaaatcacacatacgacatcatttgatacaagtgtaaaaactgtttagtacaatttttcaattccttgaaagctaaaagggtttcatattctaaaacgcataacaaatacgatacatattcaaatgcacgtagatgtatataccgagatacatgtggtttaacctgctcaatggtgaaaaatccaactctacaaacgttaacaccataattaattgttttcatagtctaaacgcaactaatttcctgtaaaaagtatcagtaccaacatggcctatatcaagtacacaaaaacatcattaactgttattccaatttcattgagcattgagttgtatcagcatcatccatgttggttcatgtgggtcattcacgagaccaatggatggtgacagaaaacatgcattttcaattagcaggtgagttaataaatgaactaataccacttttattattataagcttaatgagtgtatttggatattttttgttttagttaaagtaaacatacataatgatgacaaaaaacaaacgatattttattttgtcaacatttcctatacgatgcatagacatgatcaatgcagtgagatattttgtcaactaatcatatcaatgctcaatgaaatcaaaatggatattttgacggttcacggtttgattggtctaacacaccggtccgacaaggctttggaaaccattttttatatccatctgattaccaagaaaatatactgtataagataaacacaatcaatcaatagtatataagaccattctctaaacactatctttaattataatgtgagtggatcactcgtatctcggatttcagcccaatttgttttaacatgataggcttgttaaacgagaggctggctcatccatcgaattcctttgacatgatccaaagttactcttatcgcaaatagattagactacggttcaagccataacacttaaatccacacttcatagtctcttgaccaaacaacacacttatgcacactatctttttaaataaaacaaccgtaatttgggtcgatacatatagggttccttatgtaagcccaaaatgtaaattggctttaatcagccattaaatgggccaacaaggcctttaaatcaaaacagtataacgacaaaaacgtacttggacgtcaaaaacagatagacacgtggcagtttattgttgatagacaaaaatcgtgaagccgcttcttggaatggagattcttcactttggtggactagagactctttgaggtctcaagttaactctttaaagtttaaaccttttgacttaattcaaagccgtacaactttttttgttcgccgccgcgtcgccggaaaatcatcaccgttagtcttcttctcttccttggtttatctttttgctgctaaaatcaaatttagggtttaatcacttcactgttgtaacaattactgattcttactcaaattgattcgttgaggcattgtcttttcgaatttgatagttttaactgaatcttcttgtattagcttcaagcttatatactatgtgaatttggtagcaggtatatgcgataaac

SEQ ID NO: 4384 - DNA, 3000 bp, Unknown
  misc_feature (1)..( 3000): cDNA_ID_2138832_gDNA_ID_1620703_Annot_ID_165172 3000 nt of promoter + ATG
gttgcctgtggtgggaaactcttacttttatgggaagggtacatgaagcataatcccaataataggaagaagatttggtgcgcggttatcgcgttagaaaagcgtgatggaggtaaggtttggggaattgttgagtgggttgatgttgtgcatatcgtccccacatcatgcaagctcttgcattgtctcgttgtctcggtttgattaacttgtatgatacaagttgtatccaggtatgtcagtccttaactccatctttggatcccttgtcttagttaatttgagttcatttagttttataaaaagttcatgcttcttttttttttccctgtacatatatgatgttagtatgtataacattatatatatatgaatggattgttgaccagttggaaagaggagaaggaagcaaaggcaaaaaggagtgcaacatggattacctttcgcctcatgatcaacacagtgtcttctcatgtagatgatctaaccatctttcaaactttgtgtagagtttcgtgacttctgacttcagtttgttagaaatatcctcctcatgagttgtgtctttaacatctttcaaactttgttttaacattgtaacttcatcatgaattctttgttttgagaaaagaaacaaattctgtttaatatgttacagtttgcaatctccacggttaaaaacaatgttggttagaagtatctacatattaagggacttctgtgatcgaaaacaaaagtagggaacacattggtaaaacaaaaaacactagggttattttgttatataccaaagaggtcctcttttttttttttttggtcctcttcatattttctcatttgacccattttagtcaagatcccgtcactgccgctgattgtaatcacagtggctatgaactttcaagtggaaccaccggagaagaagaagactaagaactcgtctccaccacattcacctccgtcgtcgtcatctccgtcgctttctctacttccagaagaaatcgtcgtgcactgcttagctcggatctcaagattgtactacccaacgctctcactcgtttcgaaaagcttccgctcaattctctcttccacggagctctacgcaaccagatctcacctcggaagcactgaacagtgtgtctatctctgtctatgggatcccagttatcaatttccccaatggcttagactcttagttaaccctaaccgaaccctagccaactccatcattaagaagagaaggaagaagaagaagacaactggacaaatgttagttccgcttacctcgtctaagtttacatcagtatcaaaagccaccgttgtagttggttctgagatttatgtacttggcggtccagtcgactccgccgtgcgggtgcttgattgttgcagtcacacttggcgcgatgcaccgagcatgaatgtatcccgaatgaatgcctgggcatgtttccacgatgggaaaatttacgtaatgggaggttgccaaggattaaaggacgaaccatgggctgaggtgttcaatacaaagactcagacttgggaaggcctccctgagccgggtagtgaggtacgtaagtgttccattgacagaagcggagtgattgaaggaaagattgagtttggaaatgtaaacgagatgtgtgcttacgacacgaagctatgtaaatgggagtattgtgtaaacaaaagtgcagctttgaggtcagaatgtatgattgagaatgtttcatatggcttctggaacatgcgcttgttgtggtatgacaatgacatacaaaaggattattggaaaagattggaagggttagagtcactagatgataagtacatgaggaatggtggctcaagtggtaatacgactaaactagttgcatgtggtgggaaactcttacttttatgggaaggatatatgaagcataaccccaataataggaagaagatttggtgtgcggtgatcgcgatagagaagtgtgatggaggtggagtttggggaattgttgagagtgttgatgttttgtatactgtccccatatcatgtcagctcttgcattgtctcgttgtctcggtttgattgacttgtattcaggtatgatcagttcaaaatcagtttgtaggatctaactgtagtataacatagtatgaacgatggattgttgaccagttggatagaggagaaggaatcagaggcaagaggagagcaacaaagtgtatgagattaattagttaaggttaagaggcacattttgtcaaactagctactatggcatattagtgtttgtctaatcccttgttattaatgaatctgatttgttgtttgagttatcatgctatgaattgagtctttctttactaacaagtagggatggcttgcaaaactaaaaatccgtaggtatgatcttttggattaaccctttctgggtcatccttcacgaacaaaaacattgatttctcttcgcctcatggtcgacacaattctctcctctaaatgagaatcgcaccaatgataaaatctttcacacttgagttgagttatgtccttcagaaagttataaccatcgtcaattcgtcatcaataaaagagatgctgagttctgtttggagtatgggcttctgtaatgagaaaaacaaaaggtagagaacaaattggtaaaagaaattacaacttggttttaatctaaaataatgtgcccatgtctataaataattccaagtattgaagtatctcgaaactttagagttaaataatattttatattattgctttttatgtctcaataattcaattgtcactcttgcgttatccatttgaagatggatccatcactatgacaattatttttctgccaccttgacttgtacggcttatattccaaaaatttcttttattgttcacctctttttcttcaatccttcaatttctctcaccaaccctaatttccccaaatttggtaatacgatttcgtcaatttacttcgcaatcgattcaattcaattatg

SEQ ID NO: 4385 - DNA, 3000 bp, Unknown
  misc_feature (1)..( 3000): cDNA_ID_3073161_gDNA_ID_1620703_Annot_ID_165158 3000 nt of promoter + ATG
ctatatataatacagtcttttattttccacttttcagaggtatcggctttatataaaattttacaataattgtaatcacagaaattttctaataaaattgacacattcaaataaaataaatatatacaaatatacaatcatatttataatgtgagcataaataataaactaaaaaggtcgtatttgaaatattaaacttaaatttaaatcaagtgtcttagtaaagtggttgacggtctacttctatggcttctctaccagattttgactttaataaatcacgttatctcgtatagtagggattgtggtattgatcatacgatccaaatgatgtaaaatatataatactatcttgaaataaattttttagattatttcaaagacagaaattgtgaacatctattagaaaagcaataaatttctatcataaaaaagacttacttaaaatcgacgttttttttttcaactaatgataaatttccggcaaatgcaaaagtttactatttcttttgttttaatattgaaaatatctcttctcaaaagggtaaaacaatatctgcgattgtgcgaaatgtttgcttgtaatttttactttattttgtaataatttggggggactttagtcacccctcaccctaacaaaaaaaaaaaaaaagtaaaacaatattttcttttcaatattacacacacatacatatatatctacatgtataattaattactagcaaagcataagataaaaaagttttttttcagtatattttaaaacagtataagtttcataattccagatattaaccgtaaaaaatatttcactagtagtttacaaaaaaatgccaagaatagtaagatttgtagttgatttcacacatatatttttggaaattttgaagttgaatgaaaaagtatatatactatccaaatccgaatactaaaaggcgacattatccgatgactagcatgcaatgtatagatacctctacatataatttgttacatttggtactctttaatcattgtaatatattgtttgacaaacagacttgttatatggactatatcgaagtcttttttatctctgcttaattaacagcagactttcttttgtaagctagtattaattttatgtcggacaacctacaaaaaaaaaagaatccgcactatatacatatccaatattaataactagatgtctaatttaattaacaaagcttaagatgtctaatttcggatatatttaaatagtaaaatttaataatttgagatattaaccgtgaagtagaatgaaaaagtatactacccaaatcgatagtaaaagttgacaaaaaatgaaaactgtacgtgaaaattcaaaagtttgtccaacacctagcaatatatatatatatatatatatatatatatatatatataccgattcttatccaagttgatttgtaatgaaacgtttttccaaaaacttttaaaatgaatcgaagaagtacatttttaaaattgataaataaagtaaattttataattttaaaaacaaaataagagaatttaaatcattcttttttttttttggccaaaagagaatttaaataattcatgtgacaactctggtattttataataagaaatcattaaacatatctagtgaccaatatatacattgttagccaaatagacttgctagatatatcattaaacatatctcgtgaccaatatatacattgttagccaaatagacttgctagatatatcattaaacatatctagtgaccaatatatacattgttagccaaatagacttgttagaaatatatatatataaaatcgagttatttttttaattaaaagcagattattgtttggttctctaagcttagttatattttcatattatgataaacctagttggaaatcatattatcataatatacgcgtataagaagtcttttatatatactattagcaaaatcaaaatagattaaataggagttttgttgcactaagtgaaaaactacacaattgacttcgcctaatcagagtcgcaaacaagaaaacagtaattgcaaatcaaaatctccgtccatgaacttttttaaaaatacccaacgtttactagatttttcggttacaattcaactttttcggttactatatatatatatatatatatatatatcgtttagaagaacaaaacaaatttcttcaataactcatgtgcgatagtgttatgtttaggtaacaaatttaaaattacattaccggaggctcttgaaccaaaatataatctaatatgtgatctagaaaaggaaaaaagctaattcaatccaaagacatgtatgtacgggtaacctatataagaccatttccatcgctcatattatgagagggttttctcaccattaaaatataacatgtaaagtttcattttagtgtttgggtgtctttaaatttaatagtaggatgttttaaatatcctgatagagatattttggtgtctttaatttaaagacctttcatctttatttattaatattttgtaattttagttttaaagacactttccaaaattatgcaatatatgtgctctaatgttcttgccaaaattggttaaaatcataatgagagtagtcgaacccaaattttcatacttattatagtatatgttaaaatctttaaccacttgactgctataaattaaattcttaaacttataaggatatgtgaaataaagatacatcaactatgacaaaaatgagcttttaatggtgtcacaacatttagcaaagacttttggctgtaaaatataaacaaaaatccactaaccaataaaaccctcctaaattcaaagttgaatttgtcttttgttttattattcaagatatctactcccaaaatctctataaaaagagaaagaaagcaccctttcagtttgtatcactactaaagcacaacaaacaaagaaacacataaagcataattttgctaaaaaagagtctcgaagaaatg

SEQ ID NO: 4386 - DNA, 3000 bp, Unknown; identical to SEQ ID NO: 4383
  misc_feature (1)..( 3000): cDNA_ID_1824065_gDNA_ID_1620703_Annot_ID_165155 3000 nt of promoter + ATG

SEQ ID NO: 4387 - DNA, 3000 bp, Unknown; identical to SEQ ID NO: 4382
  misc_feature (1)..( 3000): cDNA_ID_1807497_gDNA_ID_1620703_Annot_ID_165150 3000 nt of promoter + ATG

SEQ ID NO: 4388 - DNA, 3000 bp, Unknown
  misc_feature (1)..( 3000): cDNA_ID_3073168_gDNA_ID_1620703_Annot_ID_165148 3000 nt of promoter + ATG
atggccctcgtcgaccttctagctaccgagttcatggggtcaatgctccaaggtagcatcaaacttcagatcaagtgcttcacggcggctttgcttggctgcgccgtaatgtcggtcgtcgccgtgtgggcttaaacactctttcaacataatcaataaattatttgatttattattcaaggcgacaaatactttcgcctttgtatatttgagtttttgtttttaagtttgattcatttattagtttgtatagtgcatgtaagcgtttgaaagaaatttctttttatgacattgtaaatttatttttatgaatgcgatgtttactttcttctttggaatgacatgtatttaattattggagtttgttgattgtcaatgttagttagaaaaaattaggtccgaaatactagtgacacggaaattaaagctatatgaattaatactatcaattatatttaaaattactctcttcaagaaaatgtacatacagtctcttgttttaataaagaaaaatttcttactttggttagatttaaattacacaatatttcatgacaactatttaaccataaaaactcgataatgtactatatctaacacataatttgtaggtgtgaatggcttaagctaaaaagcttataaattctatgtatttcattccatttcatggttttttggttgaaaactttaagtacaataacagacttactaactaatttgtaaatttccacacatgttttgattccatacacctggaatcatatcaaatacttgtaaattctgaacctattgaaacaagttgaaccatttctttctaaagattaaatgcattatcttgaagtataagttcttagaacatactattaaataactttgaatagtcttcaattttactaatgccttaatcaagttttgaaattatctttttcaaatcatacacacttcatcctgacaattgtaaatgtttatagtttttagaataatttttactattttttttaatttgtgtcaatatctgatttggtttgattctagacttcgtttgttttctcaaattgtgcaagtaaaaaacacgaatatatctattttttattttatgttcagaaaaaaaaaaatatatatatatatatatattcgtgttttttacttgcgcaatttgagaaaacaaacgaagtctacaattaagcgaaatcacacattgacacaaattaaaaaatatttcttttctcgaccgaaaaaagaaaattatttcaccaatatggaaaatctccccaagttcattctattttctgtatcaaagttaacgaatagacatataagcattttgtcacgtcggtggagtatgagtttggcacgttttgtttcgtgctcgtccaaccatatgaaaacgtgggaggtaaaccactcaactaataatattatacctttaaaaaaactatattataaatccagtttgatgcttattttattaatcattcttcaaagaaataaaacttaaatagtgaaaattataaccgaagttgactagttaggaggcatgccatggaatattggatacatactcggcatggacagtattgaatatacaggataatgtagataactatattttctataatttattttgtgtcaactattttttctatgattctgatgattaattgcatgacaatcaatcaaattaattatgccttcttctatataaccatgcaaaaccaaaaaaaaaaagattatttcgaaacgacatgagaatcaaaagaactcataaatcctaatagacatgaaattatgtatacagttataacattgaaatatcttaataccttacctaaaagataactagattaataaccataaaaccaataatcattaagtcaataaccccataatcttataaatgaagtcagtgactatatgttcatgtaaaaatgcgtaagttcatagctagatgtcccttttttaggagcacatggattgacacattaaacattcatacccgatttcatggaattctatttgtcattatcctttcccaaaaacttagttgtttcttagttattaaaccttgaaaaaaaatcaattcaaaaatgaaaaatgacttatatgtatgtcatttttgaaaactagacatcaagctatgaaaagaggaatctatttaccgaataaaggaggaggaatctacattcatatgtagtgtttttggtgactggattgcaaccatacactgagcacaagctgtcacgtgtgatgttgtgctcgtagcataaactataaagtataaacctaattaagcttaaagttaaaaatagtacaagattaaaaagtaaacgtttgtgagagttgactaacagaactatagaagacgcatggggttgacttcaagcggtctgcaaacggcatgaacaatgcattcaaacgataatataaaccttaattccaatatagcctttttcaaatttaaaaactcgaatgtttacgaaactataacttgataaaactgattgaaataaaatgtacttacatttttttaataaaatatacttaaattttttaaataaaatatactttaaaatatacttaattttttaaaatcatactatggattttaaacaaaataaattgtcactgagtcatatttctttggataaaagaactttacataagtgattggtacaatataataatatgcaaatttaagacattttattaagtttatattatcgtttaaatgcattttctatcaacttaataaaatctagctaggtactttcataattctatcattattccttttgaacgattaattactttattttctcgtttcacactggaagcaaacgagtaatcaaataaaatttcgtcatcatcgacaataaatggcatgaaaacaaccagcacacattactatataaaccgattcatctagtaagtccaaagtcacacaaacattaaacaatctaaacacacaacaatccaaaagaaaaaagaaaaaaaaaaaaa

SEQ ID NO: 4389 - DNA, 3000 bp, Unknown; identical to SEQ ID NO: 4380
  misc_feature (1)..( 3000): cDNA_ID_1824073_gDNA_ID_1620703_Annot_ID_165146 3000 nt of promoter + ATG

SEQ ID NO: 4390 - DNA, 3000 bp, Unknown; identical to SEQ ID NO: 4379
  misc_feature (1)..( 3000): cDNA_ID_1807647_gDNA_ID_1620703_Annot_ID_165144 3000 nt of promoter + ATG

SEQ ID NO: 4391 - DNA, 3000 bp, Unknown
  misc_feature (1)..( 3000): cDNA_ID_3071717_gDNA_ID_1620703_Annot_ID_165138 3000 nt of promoter + ATG
ttcaaaagactactcaacttctcctctttacatcccactttatcaagaaactctattgtctccagaattctgcgccagctatatgttttccggtcagacaagtaccgcccaagccaatcacatcctacttgtaaccctttcaacttatcaactacagaagaaaactcagcatcaatcccaccaaccagtagcaaagggcaactagtaactaacttaataactgtagccttactaagacccaaattctcataaccccttagcttcatcgccaacatcccagattcatatctaaaaatctctctcgcttctttatacatacggccaatcttaccacgcgggatcccatagttgcaaagagcatgaaagttctcaaacatgataccatcatcactcaaaaacattagcttccgtggaagaaacgtttcaaactcataaggacacaaacccaaactctcgaaaaacggttcaaactcgtttatcggattgtacctaaggaacttagtcaatcccttggatacatctttctgattatcatcaatcttagacaacaaagtcgacataaaacaaggagaattcttacttatatgctctgcatcagtaaaagtaaagcttctagtataatgcaagtaatcaaaaagagcttcttgagcttgattcctactagcccttgataccggattaacgaaaaacctagttggtaagtgagacgagtgttgttgtaacttagatttatcctgacgaacacagctttcaatctgaaaactccgaaatggaactgaaacacgagaaaggtcgaacctttgaactgggttttgacgaggaatagatgagaaagttatacagtagttgagatttgaaatcatattcaacagtttatgaactcttctctgatttctggataataacatcgcaacctaacaacaaagagaaacaggtgaaagtcacaatcaaatagagagctatgaagaattctcaatgcttactctttcaagtaagaaatttacctgaaattagggcttattaagcatttgaatcaaccattttcccaagattcttagggttcatagccaaatctcagttactttgcttaaaccttgttctggcttcaaattaaggtggaaatttcagagaagcccctaaacgtttataatatatccgaaacgaccataatcttatttttctatacttcaatatgtgcctaagagtttccgaaatatcataaaggtaccaattagtgcatcatcaacacttggccttaaaagacttgacgtgagatattattattcctcttttgataccgaattaatagacttgtcaagtttagacttgtcaaaagtgataaacatatcacacgaaatcgtgttattatcacgagcgttacaaattcttcaagtatatcactataaaacgacttcaaaacccaaccaagtggtgatttctttgagctgactatatgtatgcaagataaaggcagcaagaaacggtgagttttcttcacgagcataaatggtttgttcgtctttctgatttttgattttatagatatgtaacttttttattaggtcaatttcaagtggtccatggtagattcaattcatgttaggtcatcatcttcaagctaaaacgcctaccaaacatataataacaagtattcttttaatcactagttttagtttcaaaatatttctgactatcttaagtgcatttagattttagttcaacatgatggaaaaagataacttgactcttgtttaacttgcatatgttttgtttgactatttgttatgtttgagaggaatgatttttctttgtaaaacagctttatataaaacttgtggcttactcggatgaattttatatttgttttgattatttttcaaatgttgtttttttcaaaaccttttgacagtaaattacaatataaattattttcaaagatcttaatatgtcttatttaagtgaatttttaattataattataagtaaattattaaatatagattataacaatgaagttaaatcttattcactatatctttaaatatttttttctcttatttttttaatattttattcactatttgtaacaaaattataaaagccaaaattaccaaatttctgcaagaaaaaacaaaaaacaaatccttggctcctcctaaaatccacctaccttacccttttatatataagatacaaccaaaaacaagatgatttggtgctttcaatataaaagatataatatttcataattaacatattctcccttaggttttcctgcacactcgatttaaatcgtctaacaaggtcagaatccataatttatacaaccattttctgcttcctttgtttcctccctaattacatgttattaactattaagcatatccttaaaacaaaacccaaactgaattatctttgtcaatagttgtcttctctctcgattattcttaagataactactttggtagttttgtttttttaattactactgcaccctcttgcgcttcaagttacttggtaaaaaactctcttaactttggataatttctcgaagtctctgaagaaagaaccctttttttcttctctcataatcgtctctgtaacgtccttctccttcttcatcttctttgcgtttcttctgcagccttttgcggttcacgtgttgattgcttctgtctctactttttgtccgttttaaagtttaaacttattgttacaaaattggattttctctgatcaaacgataaaaacagagtcttttagtatcttcttcttgggtataacgaagatttttgtggtttcttctgatgtaattcacaaaaccatttgtataatccttgaaaagactttttgttcagaaatgaagtttcttactttgctctttcttttctatatttcagtaatgatgatgataaagcttgagagaagtgattagtctgtagaagaagaagagttaaaaccattcaccaaagaagaaattgagaactagagacagtcatg

SEQ ID NO: 4392 - DNA, 1560 bp, Unknown
  misc_feature (1)..( 1560): cDNA_ID_2138836_gDNA_ID_1620703_Annot_ID_165173 3000 nt of promoter + ATG
cttctcggtgcgtagactcaaccctttaacactgcttattgttatgtagaatcataccatttcctgatggtattgatcgaattgttctttgtttgatttccatcagtctgtaaaacccatttggggaagaaccaaagaaaccgatgaacatatgggatgggtctttccaggttcagataccgaagttccaggagctgatcctgaccatcttaatggtgctaagagtgtaagagaactctatgagattgctagcccaaactacaccgggaagtatactgttcctgtaagtcttttggcttctcaatgtcttttaagtctctttcagtcggaagtagttactagttagtcatgagttttggtttttatgttaggttctgtgggataagaagctcaaaactgttgttaacaacgagagtgcagaaataatccggatgttcaacactgagttcaatcatattgcgggaaatcctgatcttgatctttacccttcccatctccaagctaaaatcgatgaaactaatgaatggatttacaatgggataaataatggtgtctatagatgcgggtttgcaaagaaacaaggaccttatgaggaggtaagtgtggaagccatgaataaagctattactgtatatgctaattgatcccatgagaatgtaaagtttatggttcttatatgtaggcagtggagcaagtgtatgaagcattagatagatgtgaggagattcttggaaaacatcggtacatctgtggtaacactttgactgaaacagatatcagattgtttgtcacccttataagatttgacgaggtaagttcatactttcaaagcaagaaaaagaagtacaccatatgtgaacgaatctctaatgttgaaacgttgatccaggtttatgcagtccacttcaaatgcaacaagaaactcataagggagtatccgaatttgttcaactacacgaaagacattttccagatccccggtatgagtagcacggttaacatgaatcacatcaagcagcattactatggaagccacccgtcgatcaacccttttgggatcatccctcatggaccaaacatcgattacacttcgcctcatgatcgacacagattctccaaatgaaaaacatctcatcaaagatcaaatctttgacacatgagttgagttctgtcttcagaaagttaggaccatctttaccaaataagcttaagtcgtgtctttaacattgcaagtgatgttgagttttatgttatgagaaaaataaaaagctttctgtttgatatgttacagtttattgcaatctccacggttgaaaacactgtttgtttttactgcaatcacattgaaacttcgaaggtcatgtggcggattagggtcttttatgtaacctttgaaccttggagttcgattctacttttcctcagcattttgtggtctcttatgtaactaaaattttaattaggggctgttttgcaattaacaaaactaaaaccaaaaagtgttcatatgagaattgtttttctcatttgacccaaaataaagtcatcactgcggctatg

SEQ ID NO: 4393 - DNA, 3000 bp, Unknown; identical to SEQ ID NO: 4385
  misc_feature (1)..( 3000): cDNA_ID_1824054_gDNA_ID_1620703_Annot_ID_48808 3000 nt of promoter + ATG

SEQ ID NO: 4394 - DNA, 3000 bp, Unknown
  misc_feature (1)..( 3000): cDNA_ID_1824036_gDNA_ID_1620703_Annot_ID_48814 3000 nt of promoter + ATG
tgaccggtccaccagccgctctgtttgatccttcaaacgcaggtacaacaatttattttttggtacagcattatatgaactaaaccaattaaatcccaaactttaggtcgcgaccatttttttgtttggctaaaataattcacaacttttttgtttcatgaatcttaagaagtaaagatatattcaatataattacagttagtgtaatttatctaaaatatgaaattttgacaaatttaatttatttctttcgatttttcttggtttacttgcacgaaatttggtcttgttacagcacaagtttagcttttaaaatattcggtatgcaaattttggttcggtttataagggtcaacattaaataaaacgatcgataatgattaaacccggttttgtataatgattaaatccggtttgtgataataggtccaagcggagacgctggaacaaggtcatggattcaagctggactcccagcgaagaaagctgtcttgggatttccatactacgggtacgcgtggcgtctcacaaacgccaacagtcatagctactacgcgcctaccactggagcggcgatatcaccagatggttcgataggttacggtcagataaggaagtttatagtagataacggagcaacaacggtttataactccacagtggtcggagattattgttatgccggcacgaattggattggttacgatgataatcagagtattgtgacgaaagttagatatgccaagcagagaggtttgcttggttacttctcgtggcatgtcggtgctgacgataattctggtctatctcgtgcaggtttgatttgataccaaattctaaatattaatattaattgaaaatgttatgatttttgacgattttggggatttcacagcttcacaggcatgggatgctacgacggcaaccaccagaactatacagaaggtttaagctgtccacagtttcgacaacagcaagtgaagaagtttttttcgtaattatacagaaaataaactttatctgcttattatatatattgtccaataaaactataagtttattaattgcaatgcttcttttcatttatagaattacaaatcattttgttttgttaaaaagaagaatcaaacaattcaaatcaaatccaaggaaccctttctattggtacagtacatgtttccatatatagtagtctaactacgaactaataagtctatgatttttacaacattcacgtaaatgttataaccacattctactttaggaaattacatattaatagaagagaatcctggttttggtcaggcgattggtcaccatttgggagtctaatgaattttctcaaacgcaccggaggataccttatatcgggaactactgtaacattggactgagaagagcaacatgcttcatcgagatatacccaaatcagcagtacaacttctgaaattgatagtctctaccatcaaagaaaagcctctcctctagcatgccacctataacaaattaacaaccctgaactcgcctgttctttacttcagatatggtttgctaagaccgcttgacgagtccactaacccggtgcttcatcagggtatcatagattctcgtcgtcgaagatgagtacggattctgcatggttcgattcgttcgtatcccccatgcacctatggactctgtcgtctaaatgttttttctttttgtattgggctgttaagattaggttccagatatgtattttttttctttctttatcatgcttcatatagaaaaccattttccaaaaacactatatgcatacacaactatagatccaacctaacgaaatatctctaattagatacatatatccactcaaatcttagatcaatacatggttgacaaagttattgctagaccaacatactatacacattatttcttcatcttatatttagcagtttttcaaacatataattcgaaaatttaaccattttgttggttcatgcgcatatatgttcgtttctcttcttagttcgatcaataatgttgaaatagaccaatcctgtacgtttccaaaataataaatttaattgagatttgaaaatttctaactatcatggttttctgaactaatctttatagtttttattaacagaaagattacaatgatcaagtatgtatatctttataaatcggttatccactttcactagtaaatgaaaccactagctaactatatacatatataccccaaacaggctaataaaatagctctcagactctatctaaatttttagatatatagaagttgacccagaaaaaaaaaaatgttagactcattcatcaaaatttggttttagaattatccagaccacacacttttgaagttgctgatacatgtaaatctccggatttaatatcaagccatagaagatggaaactttaaataagaaaatcaatattataataatgttttaatatggggtattttcataaatttcagcctttcaggtcaagatcacaagaatgttaataacaaaaaaatatcataagaatgttgctgttacatgtaaatttcttaaattggtaaagtggattaaattgatcaatccattgaagacgaacgatacttatatctagttctacactggaactctcatcttcgacattgaacttgtcaggaactagaggccttaacaattaaatttcgtatacttgttattttcttgttgaataaggtatctaatagaaatatccactttggaagtatctttgaatatgtgaacagaatgtttcaattttaatctaaacgagcttgtttgtggtgtcccactcacatcttcaccagagacattttcgtttgtcgaaattataaattcaatgttgagtttgtttatgttcagaaactaaaaatatctttgccctaaatcctctataaatagataacgaacccatcctcagtttattactacaaagcacaacaaagcattcttttaaaagactctcgaccaaaaaatg

SEQ ID NO: 4395 - DNA, 3000 bp, Unknown
  misc_feature (1)..( 3000): cDNA_ID_2993676_gDNA_ID_1620703_Annot_ID_48815 3000 nt of promoter + ATG
atataaatgaagttgatcatgtgtcacttggtccctgctttcgcattcgtataacacgtgtgtagaaaaaaaaaattggttgataaatacataatcaacgaaaccatgctcgtttttctcacagtaactcgcaacaatgtcttccacaaaactcatttccatcactttcttcttatctctcctcctacgattctcctccgcccaaacagtcgtgaaagctacctactggtttgcggagagtgaatctccgttggcccaaattgactcatctctcttcactcaccttttttgcgctttcgccgatatcaacactctaacctatcaagtcattgtctcctccagaaacaaacccaaattctcaacatttacacaaaccgtccgacggagaaaccctaccgtgaaaacccttttgtctatcggcggtgatttcacatataatttcgcgtttgcgtctatggcaagtaaccccacctctagaaaactgttcattagttcttctattaagctcgctagatcgtgcggattccacggtctcgatctaaattggaagtatccgagcattacgacggagatggacaatttcgggaagctacttcgagaatggcgattggcggttgaagcagaggctagaagcagcggtaaaccgcgtttgcttttgacggctgcggtattctactcctacagttattattcggtcttacacccagttaatgccgttgccgatagcttagattgggttaatcttgttgcctacgatttttatgaatcgggttcgtctagagtaacttgctcaccagctcctctctacgatcctataaccacaggtacaaaaaaataactgaactaagctaagataaagtaataaaacctatacatatataacgtgttgaatatgtatataggtccaagcggcgacgccggagtgagagcgtggactcaagctggacttccggcgaagaaagcagtcttgggatttccattatacggctacgcatggtgtctcacagacgccaagaatcataactactacgcgaatagcagcggaccggcgatatcaccagacggttctatcggatacgatcagataagaaggttcatagtggataacaaagcaacgatggtttataattcgaatttggttcagaattactgttatgccaagaagacttggattggttacgatgataatcaaagtattgttatgaaagtgaaatacgctaagcaaagaggtctacttggttatttctcgtggcacattggagctgacgataattctcgtctatctcgtgcaggttcggttttattccaattctaaataaaataaaatattcgttagttttcttatcagaaacgaaaaggtaatgttttaatgatttattttggtattttttggatttttacagcgtcacaggcatgggatgctaagaggtagcaacgatggtaatcctacagaagtattaatgttgaaaacggccagtgaagaagttttgtttttgtaaaactatgcgaaaacaaacgttgtttgcttatttattgccaaagcaacaaggaataatatgatatgaatataatagaagcaagaaccaatttgtttttaatttagaaaagaaaccatatttaatttgtttctttttaaagatgtcattgtcacccttctcttctcagtgtgttatctcaacccgaaaagtcaaatattattttggagtccacgtcattgattagctttggccttagctaatcttaagctagttttggaaagtttgggggtagactggcttattggtcagccacgtgatcctcatacaatgacggactagaaaggagcaaacgagacaattagcccaaggcgacggtattaatgtgataagaacagaagtggaaactcaaacattaagaagaaaacactcataaagaaaaactagttgggagggatttggttcttgagagtccctcgtgctgtcccccaaaacgccactattatattgcagccacttgttgtcccccattcatactcaaaagtggtatccacttgaacatgtagttgacaagatttcatggagtacactggccacacatcagcatgtgtataatgattgggagcaaataattaggagaatatatattgacttttgtttttacaataagtaggagaggatatcaagtgattaagggattggtttacgcatgagagagtttggcatgctaatagaattcaccttaagatatctatactccgttctttggtttctctcctcttttgattctctgtttaccattagtttcatatataatccgatacgacatgctaatttgattgccgacttgcagtggcctatgagaccaaaactccttttattccgtttaacgagagagattgatagaacgaattatatatataacccatacttgaagatgtgattcttcaaaaactaaatagtatcaaaattgtttgaagaaaaatatattatcaaaattggtaaaaaacatattaaaaaaatggcagtactctgtagacagagactctccacaaccattattaacccaacacgtcacatgcatggaacttggcagcaaccatacactttcactaatgagtcattaccgctattagtagccattggtttcttgttagacaagaaatcatataatatacgattaaaattgaatataaacaaaatctttcgtaagcaattggatattctataggatacgtgagctgaatattcaactttgatataaatgaagttgaatatgtgtctcttggtccttgctttcgcattcatattacacacttgtgtgttgacaaaataaaatgcaaaattttgccccaactaagactttttctcgtttagcaaaaaacaaaaactaagacttttctctttcgtaagatattattcatagatttctcattttcaaagttgaattacgtaagaaagtaaatatactttttcaataaatagacaacaaaccatctctgtttttcacagcaactcgaaaatg

SEQ ID NO: 4396 - DNA, 3000 bp, Unknown; identical to SEQ ID NO: 4384
  misc_feature (1)..( 3000): cDNA_ID_1808321_gDNA_ID_1620703_Annot_ID_48820 3000 nt of promoter + ATG

SEQ ID NO: 4397 - DNA, 1560 bp, Unknown; identical to SEQ ID NO: 4392
  misc_feature (1)..( 1560): cDNA_ID_1824019_gDNA_ID_1620703_Annot_ID_48821 3000 nt of promoter + ATG

SEQ ID NO: 4398 - DNA, 3000 bp, Unknown
  misc_feature (1)..( 3000): cDNA_ID_1824155_gDNA_ID_1620704_Annot_ID_48824 3000 nt of promoter + ATG
acattaacccaaagacattcaacagatgagtctttacctgaaccgtgattgtactgctctaaaatgctcaatccagattcggtcattattacatggtcgccagtgaataatgccttgagggacttatggaacatgcacactgatccctgcaaattgtacgaagctcttatcccaagatcatgatggaattctttttaacaaaaattgaacatttgtttttatgtatgttcttgcagttggacaaacttacttctgaatgaccaggagtgtgtataagttcgacatcttcatagatactccatggtccacttccttccagctttaactccacatcagaggtcgaaggttcaacctaacaaaaaaaaaattcccttaatggtcgatcagagatgggtttagtaacaaaattgtttgcgtggctagtttactttttacttttatccaacctcataatctttttctattttctacagagcatataagcagcccaaggttcttgtaactatgtaagcaagctttttcatttttcacgaaatctagatgttgaaaaaacctatcaagaatgtgcagagaggtgtgaaaaattcaaggacatacatcatcagaatgcagaattctggtagacttgaatctgtctgcccatttcttgtgatctgcaacatcatccctgaacaatgaaatcgcttatcctgattaacagagattacaagagaaaacacggattttctcctttaggtgttatcaattctacctgtgtgtcaaaaacatgtagcgaacaccacccttcatctcgatctttccagcaagtttctccacgtacctaggactgcagcaaacagcaaaaccttggtttaatcagttgtgtagagttaatagccacaacgaagtatatcaagaaatacattgcatcaacaatgtataagatactaaacaacaaagaaaataagaattcatgatgcctcctcccaagggtatatacctatcaacaagtatatttccctcacgatgaaggatcaggtaagaagttgctccatacgatttcttggaatgaaatccacaatgaaaaacgccctgagcataatgcaaatctcaaactttataaacctcaaggacagcagacaacatataagaacaaggtagtaagagtcctcagtggagctaaatcagttaagaacttaaggtcattgtatctaaatctattcaaaacctacgtatgcttacaatgatctaatcagagttagttgacttgttaataaccatcctaaaaaaatgaaagcttaagggattaaaaagtacaggaagtgtgtctttgtccactacaagtggaaaggtctcttgagcttcccctatgtcagcaggtggagtttgagtgcgaatagagcccgtcggacaagatagtaaggcctgaaagaatcaagaaaccatgagtaatcaggacaacctcagaaattttactcactaaaatatttttcttcataagaaatttctcagtctatgacatcctagcagacatttccacaaaatttgtctatctgttttataaggtaacaataaaagctatcaaagacaaaaaaacaaggagattcaaaaacatcctcaatgaaatgtcatcagatattaaatagaaagaaaactaaaatcgacgtagttaaggcacctgaagagcattcagtctttcctccttacaagttggttgctttgtaaccgcagacatgttgtccactcgagtgaataaatcctgtgaagataaatcagagaaaagctgtttacgaattggctgaaaaaaatgtaaagggaaagtaaaatcctgctctcacagctgcattggcctgctaacaaacaactataacatgaacattctaacttcttgttctcatataatgactgtgatcaaatcagattatattctaatgttagtatatccttcttcgagatcaatcctaaggcatcaacttcccaatacccaaaatgaaaaccccccaactactttaccctaccaaccaatagacccaaaatgcttaaatcaattcatcaatttcaaaggaccaccaaaagggtccacaagacaggggaaagagcagaaaaatttaggagctttacagatttcagagaagaaaagcttaccggaaccatccaacgacatgtatcacaatcaatacaagtattgtctgcaaaaaaatccattgaaagatagacagagagagggcgttaatgatctctctttgttttcaatttgcaataaaaagtaaccagactttatttaccaacaaatatatctccttcgacgttctgagttcgtcttctaggattctcatggcttgtcacttgagctgctttgatagatccaaacactctccttcctgataaagccgtcgagctaaaacaggaagctttcgatgaaaagatcgcttcttttgaacggaattgatacgagagcgaagaaaccgcagagaaagaagctgaagccatgagaatggtgattgatcctcgtctcttctcttctctttttgtgagctttgatgagtgtagtaactcatcttgaacttcgcccctatgaaaattatttgactattaaaaaatctatatttgactacttgtggacccagctaaaatccggtttacatacggttaagcttgattaaatcgttcaatcctgattggacacgtgtaagcttcttctcattcgtgccgggtcctgtcctcctttgtagatcgtctctctcaatctttcaaaacgagaacccggttttttagcggttaagcctaatttggtctggtttgtttttccttaaaccgtgagtctcgaatccaatcatgattggacacgtgtaagcttctttctcattcgtgccaggtcctctccagtgtatgtagatcaatctctctcttccatctctcaatctctcaaaaacaccaattccaatcctgtttccttggatcagagatacgaatctgaatcacaatctcgagatcttcagtgttttccaacggtgattgatg

SEQ ID NO: 4399 - DNA, 3000 bp, Unknown
  misc_feature (1)..( 3000): cDNA_ID_1824151_gDNA_ID_1620704_Annot_ID_48825 3000 nt of promoter + ATG
atgctacgagaagaaaatattaccataagcgtttccaatcgcgaagatatttgaggtagagcagacaacgatcagacacaccaccagaagggaccagttaagaaccggtatataaatctgtccaatgaatttctttgaggtgtgaatgattttaagacgtgggaaacagcctagtgctattgactgtttgatgcatgtaaatgtggctgttgtcattgcacgactggcaattaaagcagcaacattagaaatgagaaagactggccagaacaaagaacctgaaaataaaaaagagtgataaacagttagaaacgtgaaatgagaggtaaaatcaagccagcaaatgaaggaatacccttgttgatcttgacgtactgtggaagctagtggatcttacttggaactgacgaaaagaaagcatccccggcagcgctggaagttttcagagaggtatgcggcttgacccaaataacccagcaagaggcaaggtaacaccagaaggataaaagtaagctgcagataaacaccagtactgaatcaaaagttcagatgactctaagaaagacaactatcagaagagcaataaatgagtatttatctccttaaagtacctggatagagtgaacagagaaatagctaagatctgcaaacatggcctccgatcctgagacaagatccacatgtatagaaatgagcaatgacatttagtcaaaaagtcattcaatgtatttaagctttctaaaatatttcccagaatatgaaacttaccagttgcacataaaacgcaacccccaagtgcataccaagcatttacagagtttctcttgaaaaagaaatagatatatgcaggattgaacgctttaaaaacgctgctgtcatattttacgaggttgtaaattccaatgcccgctagacaaaaaaaccacagaagtaaagcaggacccaaaacaagccccaatttgctggttccatatttttgtacactgaacaagatcacaagaaagctgactgatatcacgaccacctgatctgcaaatgaagccatagtcagaaactttacacaaaaaatagtcactaatcactcatcaagataagattatgttttttgaaagctttgtacaatcattagcccctattcagggggcagaagagtttaccctcttctttgttgtatctataatctaattgaagtcaagggacccaggatgcaaccattaaagacccataaaaagttttctggtccaaggaatacatatatccaaggaacgattacaagttttgaaagccagacgaaatcatgctcgtgaccatacataggcgctaataaacgtcaactagaattagttaccttgttctataacaccaactccaaccttcagaccaccgatagcagacattactgtgtccaaaaaagagggtaaaatttagctgcagattattcatgcaacgataatgctcacatgctttttctctatacttgatatgtgacataggaacaaaaaatgtagcctgacagcatataagtacctgacattgctggcgtaacaacagcatcagcaatcaccatagcagtgccggcaagaactaaaatcagaagaagctttttcaaggccattgacgcctcaagtctttctttaattatcaatgatctttcaagttctggagacggaaccttcaaaccaaagcctgatatgcgagcatctgatggaagttgatttgggataaggctaacatttgcatgccggcagatcaacgaatacaaagcaaacgtcccacctgcaattcatttccaaaacttaaacctttaaaccttaaatgaacttcaatctacaccatataaagaggaagagatataccttcgccatcgtcattggcccaaagaacaaaatgtacatactttacaagaggaatcaatattaaagtgtatataaccaatgacaaggctccaataatatcttctttgtcgttaattggagatcttctgaacatgacagtgaaggtatacaatgggctagttccaatatcaccaaatacaaccccaagtgtctgcaaagcaagtatgagtttctttcctataccagtgtcctgaaaaaacacattaccaagttcaacaactcaatcagatcgaaaagtaaacaacatgaagaagaagaagaacattcacacacaaatgctaacctcgatttcgtttttctgagttccaggaatctcaagagcatctacatcgaaagagtcaacggcagggctagtgcgaatcaaacgctgctccacattgtcatcctcctcatcggaatccatttccgggtgattatgctcatcatatccatcatcgtcgtaatcttcattaacctcataatcatctttctcatcgaacacccatcgcgacaatgacgtcgttgaatcgtctccgccaaactcctcatcaatctcagacccatcgcctccactgctttcttcttccacgtgaaacatcaatcaccgttggaaaacactgaagatctcgagattgtgattcagattcgtatctctgatccaaggaaacaggattggaattggtgtttttgagagattgagagatggaagagagagattgatctacatacactggagaggacctggcacgaatgagaaagaagcttacacgtgtccaatcatgattggattcgagactcacggtttaaggaaaaacaaaccagaccaaattaggcttaaccgctaaaaaaccgggttctcgttttgaaagattgagagagacgatctacaaaggaggacaggacccggcacgaatgagaagaagcttacacgtgtccaatcaggattgaacgatttaatcaagcttaaccgtatgtaaaccggattttagctgggtccacaagtagtcaaatatagattttttaatagtcaaataattttcataggggcgaagttcaagatgagttactacactcatcaaagctcacaaaaagagaagagaagagacgaggatcaatcaccattctc

SEQ ID NO: 4400 - DNA, 3000 bp, Unknown
  misc_feature (1)..( 3000): cDNA_ID_1386598_gDNA_ID_1620704_Annot_ID_48826 3000 nt of promoter + ATG
gagcaggattttactttccctttacatttttttcagccaattcgtaaacagcttttctctgatttatcttcacaggatttattcactcgagtggacaacatgtctgcggttacaaagcaaccaacttgtaaggaggaaagactgaatgctcttcaggtgccttaactacgtcgattttagttttctttctatttaatatctgatgacatttcattgaggatgtttttgaatctccttgtttttttgtctttgatagcttttattgttaccttataaaacagatagacaaattttgtggaaatgtctgctaggatgtcatagactgagaaatttcttatgaagaaaaatattttagtgagtaaaatttctgaggttgtcctgattactcatggtttcttgattctttcaggccttactatcttgtccgacgggctctattcgcactcaaactccacctgctgacataggggaagctcaagagacctttccacttgtagtggacaaagacacacttcctgtactttttaatcccttaagctttcatttttttaggatggttattaacaagtcaactaactctgattagatcattgtaagcatacgtaggttttgaatagatttagatacaatgaccttaagttcttaactgatttagctccactgaggactcttactaccttgttcttatatgttgtctgctgtccttgaggtttataaagtttgagatttgcattatgctcagggcgtttttcattgtggatttcattccaagaaatcgtatggagcaacttcttacctgatccttcatcgtgagggaaatatacttgttgataggtatatacccttgggaggaggcatcatgaattcttattttctttgttgtttagtatcttatacattgttgatgcaatgtatttcttgatatacttcgttgtggctattaactctacacaactgattaaaccaaggttttgctgtttgctgcagtcctaggtacgtggagaaacttgctggaaagatcgagatgaagggtggtgttcgctacatgtttttgacacacaggtagaattgataacacctaaaggagaaaatccgtgttttctcttgtaatctctgttaatcaggataagcgatttcattgttcagggatgatgttgcagatcacaagaaatgggcagacagattcaagtctaccagaattctgcattctgatgatgtatgtccttgaatttttcacacctctctgcacattcttgataggttttttcaacatctagatttcgtgaaaaatgaaaaagcttgcttacatagttacaagaaccttgggctgcttatatgctctgtagaaaatagaaaaagattatgaggttggataaaagtaaaaagtaaactagccacgcaaacaattttgttactaaacccatctctgatcgaccattaagggaattttttttttgttaggttgaaccttcgacctctgatgtggagttaaagctggaaggaagtggaccatggagtatctatgaagatgtcgaacttatacacactcctggtcattcagaagtaagtttgtccaactgcaagaacatacataaaaacaaatgttcaatttttgttaaaaagaattccatcatgatcttgggataagagcttcgtacaatttgcagggatcagtgtgcatgttccataagtccctcaaggcattattcactggcgaccatgtaataatgaccgaatctggattgagcattttagagcagtacaatcacggttcaggtaaagactcatctgttgaatgtctttgggttaatgtttttgaatattcattcaagaacgtagaaagattgatctaaatgttttttttttgtgtctctggcagtgcctctccagctcgagaacgtagaaaaattgatcaacctggatttcaattggctaataccgggttagtgcactttggctatatatatctgctttactactgaaatggacattttggatgttgatggcggttttgtatatcaggacatggaagaagagtacatttcaaagatggagacgagaaggcgaagaatctggaagcacttgttcagaagcacagagagaaacaacttgtttcctttagcaaatccgggaaagcttaagatatgtatgctgattctaaaccggttaatcaaactaaaccagaccgaatgtctctacggcctgactggtctatgtgtcagttagttcccacgcgagtgatgtatttatttctacgtaacattgtgaacctgcttaaacgcttactagattgaaacgaagaccgtgagtaataaagtctcctctttcctagtgcaagtatgtcagctaaagtgttgctgtgtttttttacgatatttttcatgttattcggaatgtcttaaatcacaaaaaatattcgacttttcacaagcatcggatgcatagttgtttatttgataagggtatctcccatagctagttaaaaatgttatttaatatattcgttttggtaccatatgctacaataatcatattatgcagagatcatcgaataacatcacataaggtaagaaagttcatgtaaaaagaaaatgcactaataatcattcacaaacttagcagtagattagcgatcgaaaattgatgtcaccaaatttaacaatctttaaaatgacatcttttaattaacgacgttcattcggagacaaaatgaatttcatcaaaaatgagtcactaaactatttttcaaccactccactaaaaaagttaaacctcattcaaaaactgccacgaaacattcccaccaacaaaagataacaaataatatagactccctcgccttgttgcttcccactacaaaagtaacaagaaaaattgttacaatactaagcatagtattaacgttatgctatatatacaaatctctcgtcggaccaaatattcgcattcatagatttcattacaaattaacgaactattcacagaaagaaataaaacgag

SEQ ID NO: 4401 - DNA, 3 bp, Unknown
  misc_feature (1)..( 3): cDNA_ID_1820105_gDNA_ID_1620704_Annot_ID_165178 3000 nt of promoter + ATG
gct

SEQ ID NO: 4402 - DNA, 3000 bp, Unknown
  misc_feature (1)..( 3000): cDNA_ID_1824143_gDNA_ID_1620704_Annot_ID_48829 3000 nt of promoter + ATG
aagcgaattcgaagaagaagagacgcttagattgttaccaaagtgtaaacatgcttttcatctttattgtattgatacttggcttagatcacacaccaattgtccgctttgtcgtgctcctatcgttgaggccaacacaatgattgatgatcatagtgaggggctagaggagataagtgtgatgattccagaagaaaatggagatgataccgatgaagaaatcgaggaagaaagagatggctttgttagtaatattagtagagatcatggtgagtcacaacaacagcgagtgagacgatcagtgtcgttggattcgttatcgggtttaagggtaagtgaagttgttgtgggtagagaaaaggagaagttgaagagaggcaataatattggatctgggaggtcaagtttattgaagagatctatctcttacagtggaaagtagtactagctagcttcagtgctaataataaaaacaagaagtccataaagtaagtaagtttcttgaagaagaaaatcaaatcaaacccaacaagatatagattgtattcatatgtatgaaggtgatataagattacgattatcaaagctagtcactcttgtaaagttaaaagagagttttgacaacttctactactctgcttagatactctggatttgtggattaagtataaatatacaccaaacttcgttttgtatgttacttatttattgttcctcaagaaataccatctggattttaattatttttagattcaactgtcttatgtgaatggatttacatttggcgttgtggatctctaacactaactatatgaaacgctgcgtttcattaaaagaaggtaaaaacgacaaagagaatcttcgtcttcatcgatcattgttgtgtaaaactcttgttcctcttcctcttcaacgtgaacacttctatttctcagagaacattcacctatatgtctttcttcaaggagaagtcttcctctttccagatttaggttagattcatgttataactttttctaagatttctgatttccgaatttgaattttgtttatgatttagtgtcggtgtagaactgaatgatactaatgcaaatgattgagatcgatttgatgtaaaattatcaccttctcgtgtaatttaaaggtcgaatcgtccggggtcacattgtcgcaggtttatgtttatcctctaaattagggtttcttttgtgaaattggggattttttttgtctgcttacaaatcatgctgttttatttctcttgaaattaacttcatgctgtttttgacatagaatacaacagacaaactagatttaacagaactgttaagatgaacggaacataagatgacttctaaaaatggataaattttaggtcaatttttctttccattttcagttttctgaccctaggtgagatttgttttggacttttcatgtattgtacatgtgagttaatcaaataaaatctaggttcatgcatttacaaacatagtttaggaagtaaaatcacatgttaagttttgatcttaaactcttgttgttattcttgttgttgtttgctacttgttagaattatgaatctttgacctatagcaaatttccataaaatcaatcatgttaacccttaatccaaatcctccatcaaagagtttttttgcattagttagcttctcatgaagcgaatttggttttgggaaaagaatttgtggggtggggtccaaaactgacacgacacaaaaactttggtttctccgtctttgttggagaaatgcattcacatccacttcttaccaaaattaaataaatcaatatttaatttttttaaggccttcttgttttttcagatgaacactcttcagatgccttgtgccttattgatccagattcgaagtacccaactttactctctagacctttttcatggcagccactcccacacacttctctgtctcccatgatcctttttcttccacgtctctccttaatctccaaactcaagcggtatgttgtcaattcttcttccccccctccctatcacactgtttcatctaattctgactattggttttcttaactctgttgcattttttatttcagatctttggtcccaatcacagtttaaagacaacccagttgagaattccagcttctttcaggtaatttcttggctttactaacttttcagtttggaattgggataacgatccgtaattatgatatagttgtgagagaatctatgataagaatcttagagaaatcacttggtgatgcattgtactttgttgaagaccctttttgtttgtacagcttatgtttttgtttcttaggtttctataagtagtgtgtcttttataagatttgaaaagaagagtcttttttgtgatgcttcaaatggcaaaatctcagtgaagatgtttttataataatcaaatgttcagatttagtatgtttttgtggtgtttgcagaagaaaagctacaaacttgcaagtgatggcttcaggaaagacacctggactgactcaggaagctaatggggttgcaattgatagacaaaacaacactgatgtatttgacgacatgaaacagcggttcctggccttcaagaagcttaagtacatgtaagttgcagagtaccaccaattgtcatttttcaatggttaatagattacttatttcctttcttcttcacctgatgatattctcttgagcagggatgactttgaacactacaaaaatctggcagatgctcaagctccaaaggtagctttactcttcaacgaaattttattgttcatggaaggcttgagatatcttctgtggtttgaattttgtctggagaaaggaattgttactaacagtttaagcaacagtttctggtgattgcttgtgcagactctagagtttgtccttctgctgtcctgggattccaaccgggtgacgcattcactgttcgtaacattgcaaatttagtacctccatatgaggtataacattta

SEQ ID NO: 4403 - DNA, 3000 bp, Unknown
  misc_feature (1)..( 3000): cDNA_ID_1824127_gDNA_ID_1620704_Annot_ID_48833 3000 nt of promoter + ATG
ccaattccccatcttgaacctgagttctccccaatggtataaaacccatctttgaggattttcgcactggtgtcttaagctccaagcaacaaatgggaccatggcggacagtccatgccacatattaccgtaatcgtaatgattatacgagacaaatgtcaatccctcctggagactggcattgacaggaagagcttgaggccaagccagtgcataagtagttccatatgatccatcatgctcatcaacccctttcaagcacaaaagccttcctttcgaagattccgaaggaaattcttgatattgaacctcaccttttgtttggttatcgtagagagagctcataaaccaagtatgaccttcaagtggtttgtttgaaaaacgaaggtctttcaggggaaggaatgttaccgactcacgtagtttctccaccaagtaagccgtctcgttctcagattttatttgttcaggttcttgttgttgttcttttagatatgtgaatagtgaaggaggaagtaaaatgggttgttgggtaatgtgaaatgaccagatttgaagaagaacaaaaactgtgacgacaagacacaagacgttcaaggagaacttaggggaggctaagcaagtaactagattccttgaaacgctgcgtttagtcatgttttgaatgggaagagtgaatgaatgtgaagactgaagaaagagaatggtttttatcagatgacatgggtgaaatgaaactcgtgaggcaaaataaagctaactttatttgccaaagatgttgatgcattgcatgtttgaaaaacgaacgttatcacatctgcgccaacatttgtggcagtttttagcatcgactaacacatgcgtcttgttttattttctaaatttgttcagaaagtttttaagaaagaaatatgtatttattttgataaattgacaacccgaaattttcatataaacttaaagaatttagatagtgttttactgcaactttaactaaaaatcatgcacttataccaacttatacgtgtatatatcaaacgtcaccaatttttttatatattactatgagtaaagaaccaagtaagcactttaacaaaccacaaacaaatttaaaatacaacatattaataatcaaaaggaaattaaaggtacaaaatacaaatcatcaaacgggggtatgcgtaattaaacaaacaaaaacacaccacaatgaaacaactaattacaacaatcttataataaaatatacatcatcaatcacatgaagtgatgatagttcaaggactcgaagtagttgcagaaggcgggggagagaagaacggaatggatgggagactagtcggcagagagggaatggatgggagattagttggaagagaaggaatggatggaatattagtcggaagagaaggaattgttgttggaaatgaaggcaaagttggcattggaggcattgccgtgggaatggtgggaagatttggttgtggcaaagctgatggcattggaaatggagacattgcagtgggcattgtggggagagttggtaaagacggttgtggcaacgtcgatggcaatggaggtagtcccattgttggaataggcagatttgggatttgaggaagaggttgttgttggagaaggcggcgtgaggctgagcaagtgttgatcatcatagaggaagagaggcacactagaaaagcaatgcggaagagcttgtatgatgccattttgctttggttgtgaatctctaattatggttaagcctttctaattgcttctcttgtattgcttgctttgtgttgatgagaaattcaaagatatgcgattgagtttatatagcggcaagagtctctatggataacaaagaccttttattcaaatatcatatatggtttggttaggtgtactttatggttggcttgagctattgttagttcaacttaatgtgtgtttaatagattattttgacaattcaaggatttttattgaagttagttcaacaatcaaaactatctaactctaatacacatgttaagtctataaccaaacttttaaatgtcattttaagcttataaataccaattaccaccgtaagtatattataaaatctgatgtaacaacataaattttgtgtaaagctatgaaatatgaaataatctccaaaacaccaaataaaacaaacaaaaattatgatcattattttgtcacagctgtaccaaaaactccaaaatggaatttcccggtcaaaccggatacatggtttgccaaataaaaaaccggaaagacgaacaactaatggtttgacggatatgaccggtcgaaccggatagacaagcaattgaattttgaaaatctgtggtcattcccgaaaagtcaacctaactagacagaatcgaaattcaaaattccgtctctttggtacagaatacgctttggaccttctcgagcccgtcggaactgtaactcagtattattctggcgccgatgactctccggtcagttcaatcccgaagtaagcggaaaccgattgatgtatttgattactctgacgaggatgaccgtgttgaagaggagtcgaagaaactccttcgcaaattcgattccccagttactaaaaaacaccactgcgccatcgataagtatgaattccttcgatgctgtgagtgtttcttctctgaatttctcattgaattttgtttttggctgtgtcctgcaaaatatttgggaaggaagatcttatttctcattgaatttccccaagtttaacatggtaacacaagagaaggaatatgttattttttgtgttaatatctttctattgcagttgcgaaggatacccaaagcgagagtaaagtattgcaacacattgttattgatgttgaaggtaatagtaggaaaattatatcttggagaacagttctcaactacaaatgatgaaaattgtgtagaattccaaattttcagatgctagtgtgtgtggtagaatagaaataaccaatt

SEQ ID NO: 4404 - DNA, 3000 bp, Unknown
  misc_feature (1)..( 3000): cDNA_ID_1824123_gDNA_ID_1620704_Annot_ID_48834 3000 nt of promoter + ATG
actatttggatctttttgtggctcaagctcctgctaaattcaatccatccctcatctcaagatcggcaaattttgtaagtagtcttgtttccatctcttgaatatgatgaagttgcatctgacatactgaatttactatgccatagtaagcagatcgttgttagtttactattttcttaaaattaaatgtgactattgaaacatgcatttgagaatactattttatctgtttcacaaatgatatttaagaaaattgaaacaaatttttataatcttatttacaacttaagttttcttatgatatgaaagcactccaccgagaaacagtgatttgaatgagatggtttaatttattttctgcttcttttcagctaactaggaattggtttcctgcaaaggaagcttcacttaagcgtagaaacatcttagaattgctttacaacctccacaaaggtcatgatccaagtattcttccagctaattccaaaagtgaaccacctcattgtggagtttccaacaggaatgatcaagaaactgaaagtgagaatgtgattgagtgctgtaactggataaaaccatttgatggttcctcatcaaccgttacagacatttcccaaacgaagacttgctcgccggatctgattcttagcaaagaagtttcttacagcggaggttatgaccctccgtcttctaagctccgaaaggtcttcatgtcacctattgtggtaaaatttcattttctatatcttcagtttagattctactgctaagtatcttatgttgataatgtttctatacaatttctcaaaccaggaagaagtgcaagaaagttgtgagaaaaaggaccatttggaaatggacatacagaaatccactggtcatgagatagaaacattgcgaaaagagggatgcatgctttatattgaggacagtgatgatgaagaagctgtttcagtagaatacgtctctgattctcaagattcatatgaagttgagatgaaagtagaagatgatgatgacgatgagcttatagttactggagaatcttcagggattcatggaagcagagaaatcaagtctgattcagcatcgatcgaaagagtgaacaaaagtagagattcaactgctgcctcttgttataatgactttcttcttgtgttatctgatgatgagaggagctcagacgacaaagaaaacatcttaataagttcaaatgtgatggccaagccaaaaacttgatactttaatgaagatgaatatcgccaatctaatgcgattattatttttatggttttctaatctctttgcccataatgaatatcatgtcaaattttatattcaatagtgctcgtctcttatacgaccagtatcaaagctttgtttttcaacagacaaaaaacaaaagaatctgctgttattatccaagtgggaggatgaaaaccgagagctcacacaatgctttaatacaaaaagaaactgatgtcgtcgtccattcacattcacacgtcttcgtctctactctgatgctccaggagcaattgttccaactcttccttgcgtcgggctatctcctgcaataagggtcaatgacttagaaaccatttgagtgatgataataatgatgcagatagactatcaattgacacttgcctcaagatccttgactgcttgttctcttgaaacttccttttgctgtcgagcacgcttcagaaagccgatgcagagaactccctgaagttcagacaacgatcaaagattgacagtgaaaacataaacgggaactcagatattgaaaaacaaaggaagtgattgcccaagaagctcatttttcaagttagaaatagccctacagattcgctaaccaccacatcaagcatctattgttcagagttgggagttatccaagtgatcctaaaggtctggggacaaagtgtcaacatgagttcttacaacaaaccaagaatcgttttcaagtgaaatgcattcttataagcaagatgcaaccacaaggcacaaactaatacgaaaagattcaacaataagcgagagcagagagggaataagcagatgtgatataataggatgaatggtgatagcgtacagaaatgacatagataacaccacaagcaagaagcaagtagcttgcgatgttctgtagaagcaggagatccttcttttgagtcatatagtcagggaaagctcttgtcatcacagcaacactgaaatgaacaaagtaaagatatatacataaaacataaaatcatacagcaaccaaggaatggtctcatttttgagtacctggcctggaattagctgaagcagcactcaaaaaacacatcataaaagaacaacacgatccattccaacacaagaggtacaaaagaaggttactaagctgtatagatgtacttacaaaatttgaagcattcctctaccagcccagtattcaagaacctgtaaacagatttgcaaaattagaatcaattcatgttagaaaatcaaaggaaagagatagcaaaagatacgaaaccttggaaaatttgagaatgaaaccccattcagtctcaacgagaacaacaaaacaagcaatcaccacagcataacaccggaatattccatcgaagagctgctcggagaggaaaagataaaagctttacacagagatcatcttcaagtaatctaatgcctgcgcagcgagagaggaaaaagagagagagagagagagagattatacatcgtggctgtcacggaaggagcgaacggcagcgagaacgttaacgacaacacagagaatggcgatgagagaggtaacgaggctgaagcatctacaaacaacaaggaaaggatctgctctgtttccgagcttcaatttcgcggatccggaagaaggtccggcgggggattcttcgatttcctcagtcctatccatctaaaaccaatttcccggtgagaaaatccgccgtcttaagtggaatttggaatcgagacgcgaaaaacgaa

SEQ ID NO: 4405 - DNA, 3000 bp, Unknown
  misc_feature (1)..( 3000): cDNA_ID_1824120_gDNA_ID_1620704_Annot_ID_48835 3000 nt of promoter + ATG
aacaactcatagagatgaagcaaaaaaaagttaaaaaagaagtacccattggccaacaacctttccctacaaataagaacacctttaaatgctaattctacgacttaaagatattttttttgtagtctaaaaacaaaaaggctttacgaaccctgagcacatacatgagaaaatagtctggacgagcaaaattgtattcaaatgaaaagactgagcaaatcacaccattaaatggaacaaatggcaatgtaccaaagccaataacaaaacaatgaattcgataaatagatggcaaattgagcagtaaaatacatacccttgattctgttaattcaccatagctctgatgctcttttgctgtagcaaccaaagcattacttatccgcgacttcaaatccggaagcaagaccttgatatgttgaacaaggatctaaaaaaatgcaacagaaaggccatcttctatcagacattttctaatattaaagtatcttaaagtctgtaaacaaaaaaagatatacatgcaaggccaaaaaaataagctagggtagaatccgcacagccatgtaagtaaccttaaaaagtgaataatgcatttaaactccaccataatcccatattagatatttcaacatagagaaagcgtctcccttatgccttactgaacaatgattgacataacgaaaaaaggaactcccaattcccataactgcagaaaatacctgatttaacttctttgctagctgaggaacacccaaacgatcggcaagaccatggtaaacctgtataggtaccaaaaagactcagctttaatcagaaaaaatagcaagagtatcagaaagtgaatcaacaaaatgatgttagcataccgggtgactccggaagaacttctcctctgcgagaagtgcttccttgactgtgcggtttagcaaaatatcctgtttataaaatataaagatcaaaacactgtagatgcagacgccacaaaaagtagacaaaaaataaaaattctgtcacaatagcatcgaagtgataaaattagaattaaaaaacaagcacagccaaaggtagaataataaaaaaaaaaaaaaaaaagaagagacagcctactatatgatagcaagagaatcataagaaaaataagtacagaacagaagcaataaagctcaagtcacataaaagaagagccacactaaataaattaaaaagcaatagttgtgagcaaccacaggtttacctcctggcaacgatttacaactcccacgtatccaagtcgaagaggaacaacatttccaagaaggagttttcgagcatcagtacctttgtccataatatccaactgaaaacatgataataacatatagtaaatcacatgaaagacagggacgcctatggtgatgaaataaaacaaatgtctggactgggaatatgcacctttgtgattacacctatcgttctgtgacctggagacagtatagatagatgaaagggtgaagatgagtaatgtcaaatacaacccattaaactagtcattggacttgtgagtagaacttaccatcaggatctacaatgctagcaatttgaagggcatcagagtttgctagatcggtattagcaggggtaacagccaatatcaagcaagtatcttgcttgatgtaagacaagatcatcgttcttatacgtgcttcaatgtcggatggctggtcaccaactggcaccttggtaataccaggcagatccacaagcgtgatgttcaatacattaggtgaagaaattttaagacgaatctgtgtatctgctacacctttgttctctccaactaatctattcgtctcagcctacaaagatgttgcatttcatacattaatacaaacttggaagagcaatagagtatcaaataaagcaaggaagggaataaaaaacctcaatttctcgacgaatctcagagaaatcatagaaacgagtttcaggaaggtgacgaaactccccccactcatcatcggatccgccattagcgcggcttttagtctggaggagctggagaacaagaggacgacgcgtgcagatatcattaccacgagggagaaagtcacggccgacgagtgcttcaaggacgctagacttgccactgctttggcttccaacaacaacaacctgaggaagcgcgatcgtagactggcttccgagctgagcgaatatgtcttgtagcttgtttacaatcggaatcacagaggatcccaacggcgcggcgttggtggtggaggaagacggagaaggcgtagaagaagaaggaggcgtagacggaggagtctcaccggaaacttcttcaatagtcatcgttggatcggattttgaatgaatcaaagttgctagggttttgaaaaaattaagttcgtggagaagagaagacaacactgggaagaagagaaggtcaattactcgggattttcgtgcttagctctatctctatcgaagagaggaggatctttttattagagtcgctaaataatttttacttgctcaagaattttaaaaacgtgaagaagaaattgaactttaatcacaacttaacaaaataattcaaattaattttatattcacttaacctttgttaatttataatgataacaactaaataatttcaccttaatctccatggtccaaaagaagcgaataaacattttcatttacctaattacattagtttttaatttataaaaactttttttctttctaatattagcctgtgcttttattaatcaaataagtttagaaaaaatctatagatacagttttagtgaggaactgaagttctgttctgtctttaaatattcgttgttaacttaaacgcaatcttttgctatttcatcagtaattttttgtatggataaactaaaagaaaaaaaaaatagagaaaaatcgaatgttaaaatcgtggtaaaccggctgatgtcgtatcatttattaaggtctcaaaccggaggtgtgtgttaattttcaatg

SEQ ID NO: 4406 - DNA, 3000 bp, Unknown
  misc_feature (1)..( 3000): cDNA_ID_2147516_gDNA_ID_1620704_Annot_ID_48836 3000 nt of promoter + ATG
cgatagaatactttaaattttgtaacccttacctgaaatacaaattttctcacagtatgaattggattttaattatctttgtacttatctatccaggactttatattggcgcacatgggctatatacatcagaagtaatccatttaaaacgcaaatttggccagtggaaaggtggaaaggagtctaagaagccaacagatatcgaattttatgaatatgttgaagctgtgaaattaactggagatccgtatgtgcctgctgggaaggttagctttatgtttgttctagtatgaggtattaagacaaatatgaaaacttgttgttttcatggtcagtgtcaaaaatttgcgtactcaaacgactgtgttaccaatctagttaaaaaaaacgctgttacttttctgcctacacaggaaaggagtattatcatgcaatagtcacttggatctataaatgcacactcgcttattttcgatatctttcttcttccctaatactcttttgttgcaatatcatgatgagtgccttaccacagtcttatccatgacaggttgcatttcgggcaaagattggtagacgttatgagctcccacataaaggactcatccccgaagaatttggagtggtgtgcttaccttacaacactaattcaagtttatcattaagctcggttttcgtttagagttgttgtttgtgtcgcttcatagtagagttattcttacaaaatgcagattgccagatataaaggacaaggtaggcttgctgatcctggatttcgtaatccgagatgggtagatggcgagcttgttatcctcgatggcaaggttcctctcttcgtctctcaatatactaaaacaaacttgtccatggattcaaactcaaataaatgacatgttttgtgtgattgttgaattatggttttaatgcagtatgtaaaaggaggacctgtagttggattcgtctattgggcacctgaatatcactttgtgatgttcttcaaccgcctgaggcttcaagcctagttgtattctgctctacaatcgaggaagggttttcttctggctgtaaccattgtgtacgtatactcctagatacacagtagatatgaagtcggtactgagaaaggtataactgaaatggtttaattatatgcagattcatgagatcggttgtgcctaagataagattacttcaagttcaggtctttctggaccagtatagagatccacggtctcgctttttcttctggagcttggataaaggtacctaaattgggggaagatttaacacgccagagagtctttgatcagaaaggaaacttagattgtaaagcttgacaagtttatagatatatatatatatatatatatatatatatgtaaattaatgtatgtttctctgagattgctgctatattgggtagaaacgtggtaagagctgttgttgtatttcctttgtgtattttcagtttatatggcagaaaaagagaagaaatctttcttgttaatagtgactttgttactacatgcaacaacttaaaaatatagctcaagcaatgtgatcatgacaatagagaagcaaaggaatcattgatcttcaagtttatcatttcattacactcaatagtataaagattaaaagcagaaatgggaacttaggaggaggctgcagtagcagcagcagcttgcggtggcggtggtgttggtcggagagtgatctcaaccttatcgtgaacgccttgaagcaaaagttcaccttcaaatgcgactattttgcgtttcttggcagctctcagagtcccaaccaatgcttcaaagatgttggcacatcgatcgtcattgaacaacactccaaacgtcacctgtattcaaaaggaacaaatcaatcctcatgatcaagaatcaatcaactgtgtttgttagatctgagcgagagaaaagagtaaatgttacgatcttgattcttcagataagagtatttgttgattgaaaatgaaataatacagatttattccagatatagggagatccaacaagatttgaggagaaagagagagaccttgtaagagccatcggtctgacgagaaccaagacgatggatctcttcttccagtttctgaatctcttcgtctacgttcattctttcttcttccttagagatttcaggtctcaacagcctaatgttgtaaaaagattggattgaagaagagactctttctgtttctgacgaagacagctcgatggactcattcttgtccctcctaatccggttgaaaagaccaaaatgcgcacacttaaccggtttgaaaaccttatcgtaccgatttttcttcaacattgaaaattaacacacacctccggtttgagaccttaataaatgatacgacatcagccggtttaccacgattttaacattcgatttttctctattttttttttcttttagtttatccatacaaaaaattactgatgaaatagcaaaagattgcgtttaagttaacaacgaatatttaaagacagaacagaacttcagttcctcactaaaactgtatctatagattttttctaaacttatttgattaataaaagcacaggctaatattagaaagaaaaaaagtttttataaattaaaaactaatgtaattaggtaaatgaaaatgtttattcgcttcttttggaccatggagattaaggtgaaattatttagttgttatcattataaattaacaaaggttaagtgaatataaaattaatttgaattattttgttaagttgtgattaaagttcaatttcttcttcacgtttttaaaattcttgagcaagtaaaaattatttagcgactctaataaaaagatcctcctctcttcgatagagatagagctaagcacgaaaatcccgagtaattgaccttctcttcttcccagtgttgtcttctcttctccacgaacttaattttttcaaaaccctagcaactttgattcattcaaaatccgatccaacg

SEQ ID NO: 4407 - DNA, 3000 bp, Unknown
  misc_feature (1)..( 3000): cDNA_ID_2107920_gDNA_ID_1620704_Annot_ID_48838 3000 nt of promoter + ATG
atttacttggaaatttcaatcctttggtttttaagtcgatgttggatggtgttgtttggccagagaacagtgcatttgcttgtgatgatcattgattcatttttttattggtttgctttcctttttggcttcagaactcgaaatgcttgcttacccatggcaaaacgggtcaatacttgcaaatgtgttgctacgccgcaagagaagatcggtaatgttcctactccatgttgtttttgctgtaatgattagtaacatagttaatgatttatcgtcttttagctgtttatctgtttcttacaatacatgattttgttttctgtatgtagagtataagaccaaagtgtcacggaattcaaacatgtccaaacttcaggctggatacctattcccggaggtttgttacctgttactctcttggtactactatttaagatttcaaatacctaaaggagtggcatttcaagttaacatttttgaaagcttctagtgatctgaaatattataactatctgtgtaataagttaatatatcctcattgattctgtatataatgctcctctctcttatttttttgtgtggatgcaaacagattgcaagaagaaggtctgcacacttgttgaaatatccagatgcacaagttataagtcttggaataggcgacacaactgagccaattcctgaagtgatcacttctgctatggcaaaggtacctccttatcttaacttagcttcatgtgctctttgcccttctctgggctctagcatattttaaactgattttactaacactgccctaacatgtattatttcgttcattttgacaaaaatgtataacatattttctgttttggcgtatttggattattaaacgagaacttctctgtaatctaacaatgaaaattattctggtagcatagtttttttgtttgctatactattcacacaggcatgtaatctctagagattaatcatgttttttttctctgacagaaagctcatgagttgtcaacaatagagggatatagtggttatggtgctgaacaaggtgcaaaggtcagtgcacccttcatttccaccttattgcgttgttatcatttctttattatctgcctttgcacgtcacttcaattttattatggatagtcttgaactgctgctaaattcaagagaagatggatttaaacctgtttcttacatgtaaaatcttaaagcttaatctgttaagtttttatccaaactaaccttgatttcacatatgtgaaaagccactgagagctgctattgcgaaaacattctacggtggccttggcataggggatgatgacgtttttgtttctgatggagctaaatgtgatatctcacgtctccaggtttgttttattgctgactattcatctgtaattgatacaagattaagaaatatgaacagctgtttcttgattccacttcttgcaggttatgtttggttccaatgttacaattgctgttcaggatccttcatatccggtaattgggcatatagaaaccaaattgcagttgtagtcttctctacttttgctccattttaacgtggaactatgctgtctcgttttttttggattatacaggcttatgtggactccagtgttattatgggtcagactgggcaatttaacactgatgtgcaaaagtatggaaacatcgagtacatgagatgcactccagagaatggcttctttcccgacttgtccaccgttggcaggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtaatagactgattgattataacattaaaaggtccatttttcaacatctttcttcatgtgtacaaccgcttacaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggttagcttagctaaagagagatctcaaaccagttcccactagttcagatatgcaaaatgatttattttgttgtcttttgaatcattgcaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgggtttggaccagggggtgaagggttcgttcgtgtcagtgcctttggtcacagagagaacatcttagaggcatgtcgaagattcaagcagctttacaaatgaagaaccttgtttgtaatcgttcctcatcatcatcaccctctttaatgacatgatttgagttaaaataatgtcgtttccattgttttctggaatttgtagaagacacttttgacaccagtgtttcaagcaatttggcaaagtattttaacaacgaaatcaaagtgcaaataagtgaactagtgtggaaaataaaatatttaaattggactgaggaagaacgtcaaaaaaatataaaattggattggttaaataaatctaaaattggaccgggatgggtgttttcgtaatttaggcttgttgagccaccgtgtgggcaaaaatatccaaaaacacaacacaagtgttgtcttctcgcgtctctcatcaacgagaaccagtttttttgttgatcctatcaacaatg

SEQ ID NO: 4408 - DNA, 3000 bp, Unknown
  misc_feature (1)..( 3000): cDNA_ID_2993740_gDNA_ID_1620704_Annot_ID_48839 3000 nt of promoter + ATG
ttcaggtgaagaacttattaactatcaacccagatgaagaaatacctgtcaagaatgtcacgataagaaggattccaaggtgaaacttccaaatctaagtaactaagccccactgaatgtgcttcaaaagctgatttcttgctttgttttagagttccagaaatcttgcctttatatgacatattgaacgaattccagaaaggactcagccacatggctgttgttgtaagacagtgtgacaaaatccacccattaccttctaaaaatggtaaactgcttcattaatcgacaaaacaatgtcttgctgagttacaagtattgagaatctttgctttggtttctaatagggagtgttaaggaagcccgagtggatgtggatagtgagggaactcctactcctcaggagagaatgttaaggacaaaaagatcgcttcaaaagtggaagagctttccgaatcgagcaagttcgtttaaaggagggtcaaagagcaagaagtggtcaaaagacaatgatgcagacatcctgcaattgaatggcaatccgctgcctaaacttgctgaggaagaagaagcagtcggaatcattacgatggaggatgtcattgaagaacttctgcaggtaaggaatcttatataagttaaaaacaaaaattctttttcacggattaattattgcttggcttgtggttgcaggaggagatctttgacgaaactgatcaccattttgaagactcctaacacagagtgcatgaccactgaactggttatgaatgtcgaaaactttagtctttgttttcaactttcaaactgtcacttgtccggcgaatgtgtatcaatgtaggcatgaacaacaactttttctatggtttcaagatgttttctctctatatatatatcattggtctctaagatatgtcgctctctcctttcttcaaagagttttaccaaatctgaaccctcataggccacaccaatagttgtctctactacctatatatcattagtctctaagatatgtcactctctaccttacttcaaagagtttttattcgcattttactaatacaagaattaatgaaatatgatcatcttatggatacaacatcactgccggtgtaaaaaggcaattacttttgtccggaaagatctagtccctaccatattttctcttcttcctatcccttttcttctcttttgacttgtgtttcttactaagtttcttcttatgctcctttctctttctatgagcccgtttgtaaacttcctcctcgtcggaagaagaagaatctgtcctacgtctcaataaaggtgatcgctctggctgaatcactagcttccgatctcctgtatcagaagttcttgacaattccctctcaggaagacagggtagcggttcatccatcatagcaccaacagaacctctgccacgcttgaccctatcatagaccagaatcacaagttttatcagcaaaagccgatcccaaattcgatcattattgtaaaggaaataatcaggcagcatctgagtataatggaaataccttgattggagaaaagtcttaacctcgacatctcctaagccttcatcatcatcatcctctgattgccatcttttgcttctgctccggcttgatgatggtgataaactagtagtagtaacattctcatcaactgaagtacatctctttaaaaaatccctcctattgttctgctcactttgaccattgctgctctcatctcttgattttcttttgagcctttcaccaaactcaatctctttactccgaagactccacatctcattggtttccacagctttgtttgctgaatggaataaagaagaaacaaataagagataaactaaaaaaaaactagattttgttggatagaagcaaagtctgtcaacaaaagattataccttgctgaacaccaagaactgtagcagtgagaaatctagagttaggtcgatgccttacattaggcttctcaagatatgctctgacgccatctttctcagcttgtctcctcaattctgctgcttctcttaaaagaatggaagctattcgattttcagtttccagatccatctactccaaggtaaaacaaaaaagtataagcctaatcaagttatgtgatcaaatcaatctgggtagatcaaacaaagatggagttgaacttaattcgaccactacagctatctaaatcattgcttcttaatcacagaacttccactaaagctacgttctttcgacaacgaaatcaacgaagcaaaacaaacaaaattacgtaaacacacaacaatcgaaaaggggatttttggagaaccctattggtcgagattaattaccacgaaatcgaattgactcagatacagatatctagtagcagcttcacgaaatcgtgcgattcctcggcgttttccagcaggcgcagagcaaaatcattgtccgagccagagagagaaataaataaattgaactgaattggaaaattcccaaaaatttctagtaaaaccgaaccggaacaaaccggattaatttcctctcagaccaaaccgaagaagaaccctagttttatcagtctcaccaactatctcccatggttcatttgctctgcaaatttgtctgaaaaaatctttgtgcgaagcaggaaaaatgtcgtcgacccatcagttagtttcttcgatgatctcttcttcctcatccactttcttagccccttcaaattttaatctcaggtgcgtcgttttgttttcttttactctctgtttgctactgatataatctagtgaggatgaatatgaaattggattcatttccagaaattaattgtatgttatgaatttacttggaaatttcaatcctttggtttttaagtcgatgttggatggtgttgtttggccagagaacagtgcatttgcttgtgatgatcattgattcatttttttattggtttgctttcctttttggcttcagaactcgaaatgcttgcttacccatg

SEQ ID NO: 4409 - DNA, 3000 bp, Unknown
  misc_feature (1)..( 3000): cDNA_ID_3073222_gDNA_ID_1620704_Annot_ID_165212 3000 nt of promoter + ATG
caaggaacaaagatctatcttttggttgcgtttacatagtgtttacgttccatgttataattattagctcatattagaaacccagacgtaaacacaaacaaataatcatgtcactatacagaatttacctagtatagaagtccatgatttttgttctttttaccttttaatagaaaagttttgttctttagttttttgggatttaacattcgttttaatatatcttgtagatgttgcagaaaagtgttggtggtaataagatagagcaaacctttccagaaagtacattggattactcacaaggcttctcggctactcagtttcaggtttctctctcttcactatctctctgttaggttctgttgagtacacgtgacttgtctcaagaatctcactatatatgtctttgggtgttgaaacaagcaggacaaaacagcattccaagagcagtgtggttatttgcatatggaaaccagattctaaataaccagttcagtaattttttattattatttctgtagatgttcaactactttgtttattcttactttataaagaatatatcaaatctgactaaaattaactttgaaattcgctggtgaagatcaaactgatgaagagcagcagctattttggacatttgtgaagcttttatggattcaacttgaaatcatttcaagcagtgattaaagtgaaactttaacgtcccagatgtgaaaaataggaaggagttttaagcaaaaagactgatatagaacgaaaaaaaaaaagggttctcaaatctcaactggactgattcttttctctcttttgctttgtaatttcgtcacaaacaagttttccttgtagccgcctttatgtaactcgtggtttacaaattacaacacttcacttccattgcaattttctttcatagtataacaaatttcaatgcctgaataagctttttttttgtgtggggaaaaaaacttccaagaaatatctagcaaaacaaatgatcttaatggttcttttcagagctgctaaattctcaaaagaataattcgaagtagatgacaaagagggcatattcaaaacttataaagaaactaataaaacgtattactttaaatagagcacgaaaacctatatataaccaaaatgctaaccctaaaagtaacacttgaagaatgcgtaacactaacgcaataaaaggggaaaatagaaacttatcaaaatctggttatcggcttgtttttatagtcactcttcatatgcatcagtgtttgagattctgcagattgttgtagcagatcatgtttaaagtccgttatttgtagctcttttgagttactagcgattttggaggtgttaaccggcccaagcatgaataggcctgatggtattctggtccatctgagcttggccgaagttaattgcaaaattaaaattaagtttatattattatgcttttgtctatctcttgactttaattaatcttttaaggttaattggttattggtagttgagggtgtttcagttaaccttaaataaaaaacttaattgacttaaattatagtaaaaaccaaaccaaaccaaatagagatccaaatttaaatgtacataatctaccactttcataatgtaaaaatccaagtgttatcagctgccgcatttgttctgtcttctatatgtcgaatacgagtacataaactacaactttgataatctaattttaggattttaatatgctaggctgttttgcgtttgtcatgagtagggtcgaatcatgccttagccagtcgtactagtatagatggttgtaagttggatttgatgacaactgctttggatttgatgacaagtaactacttaaaagcaatggttaggcagacattaaataggtggtgatctaatgtctaacatctaaaacgttttaattggaatttaaacgagtttagatggtctaattaagcgtttattatgtacataatagaacgtataaaatatcatgattcacagaagtaaatttaaaatgttttaattttagaagtaaatttaaaattcaaactacatcaaaaattcaatagaaatcaacttaaagataaccataaaatcaattcaattgacatcaaataatagaagccatctactttttatgttataaaacttataatgaattttatgtcattataaatcgaaaaactacactgaaatgaacaaaaagtcaaatgacaacagattaatgattatgtaaactgtataatgtcgattaaaaccacataatgccatcaattatttagcacctatcaaataattgtcacggttgtatatatggcgcgcctagaccgccacttaaagcgctatttcaagtattgttacaaacgaagaaggtaggcggtctaatttttaagtctaaaattagatatctttggacgcctcatattacttattgttttactctgtcggatcctatctcacccaaccatacatttgtggcaacagaaattgcctccaaatgcaaaaaaaaaaatcattctttctactgttaatacttcgaaatatacaatttttaaagttaatatgtgtttaaataccattttgatctaaattttgtgttttgtgtttctttctatatatatatgtacgttttccattatatcagaatcgaatcatatctaaccatatatgaattagtctcggtagttgtaatttggaatatttatttcgcttttcaacgttggtaggttcaaaaatacttaagttaagccacgtttaatttaaatacgttcatatttagaatatgtagagttgaaatttataacttaagtatatgttatggaatttgttgacagctattttaaagtagttgggacaaaacaaaaatgtaggtaggtgctcacattaatttcaccttgtaaagcctaaaactataaatcttagtaacacatatgtgatatgtcagttgtactctgttgcattatttctctcactcaaacgtatatacaaacataaattatg

SEQ ID NO: 4410 - DNA, 3000 bp, Unknown
  misc_feature (1)..( 3000): cDNA_ID_3093131_gDNA_ID_1620704_Annot_ID_165198 3000 nt of promoter + ATG
ttgatatcaatgccaaactagacaggttttgtgttgtgattccttggagacctaacttatcagaaacacacttgcctggagtctttatacttctcatgctaaacacttttcttttctttgttcctctggtatagagacttgatgaacttgattcttgagaaagggcatagcagagttccagtatactatgagcagccaactaacataatcggccttgttctggtaactcccagtctcatgcattacttccacaatttgactcgcttctctgtgaagtcatttttcacaaatattttcctctttagtgttatggttccacttctaaccattcatatctattatcttcaggtgaagaacttattaactatcaacccagatgaagaaatacctgtcaagaatgtcacgataagaaggattccaaggtgaaacttccaaatctaagtaactaagccccactgaatgtgcttcaaaagctgatttcttgctttgttttagagttccagaaatcttgcctttatatgacatattgaacgaattccagaaaggactcagccacatggctgttgttgtaagacagtgtgacaaaatccacccattaccttctaaaaatggtaaactgcttcattaatcgacaaaacaatgtcttgctgagttacaagtattgagaatctttgctttggtttctaatagggagtgttaaggaagcccgagtggatgtggatagtgagggaactcctactcctcaggagagaatgttaaggacaaaaagatcgcttcaaaagtggaagagctttccgaatcgagcaagttcgtttaaaggagggtcaaagagcaagaagtggtcaaaagacaatgatgcagacatcctgcaattgaatggcaatccgctgcctaaacttgctgaggaagaagaagcagtcggaatcattacgatggaggatgtcattgaagaacttctgcaggtaaggaatcttatataagttaaaaacaaaaattctttttcacggattaattattgcttggcttgtggttgcaggaggagatctttgacgaaactgatcaccattttgaagactcctaacacagagtgcatgaccactgaactggttatgaatgtcgaaaactttagtctttgttttcaactttcaaactgtcacttgtccggcgaatgtgtatcaatgtaggcatgaacaacaactttttctatggtttcaagatgttttctctctatatatatatcattggtctctaagatatgtcgctctctcctttcttcaaagagttttaccaaatctgaaccctcataggccacaccaatagttgtctctactacctatatatcattagtctctaagatatgtcactctctaccttacttcaaagagtttttattcgcattttactaatacaagaattaatgaaatatgatcatcttatggatacaacatcactgccggtgtaaaaaggcaattacttttgtccggaaagatctagtccctaccatattttctcttcttcctatcccttttcttctcttttgacttgtgtttcttactaagtttcttcttatgctcctttctctttctatgagcccgtttgtaaacttcctcctcgtcggaagaagaagaatctgtcctacgtctcaataaaggtgatcgctctggctgaatcactagcttccgatctcctgtatcagaagttcttgacaattccctctcaggaagacagggtagcggttcatccatcatagcaccaacagaacctctgccacgcttgaccctatcatagaccagaatcacaagttttatcagcaaaagccgatcccaaattcgatcattattgtaaaggaaataatcaggcagcatctgagtataatggaaataccttgattggagaaaagtcttaacctcgacatctcctaagccttcatcatcatcatcctctgattgccatcttttgcttctgctccggcttgatgatggtgataaactagtagtagtaacattctcatcaactgaagtacatctctttaaaaaatccctcctattgttctgctcactttgaccattgctgctctcatctcttgattttcttttgagcctttcaccaaactcaatctctttactccgaagactccacatctcattggtttccacagctttgtttgctgaatggaataaagaagaaacaaataagagataaactaaaaaaaaactagattttgttggatagaagcaaagtctgtcaacaaaagattataccttgctgaacaccaagaactgtagcagtgagaaatctagagttaggtcgatgccttacattaggcttctcaagatatgctctgacgccatctttctcagcttgtctcctcaattctgctgcttctcttaaaagaatggaagctattcgattttcagtttccagatccatctactccaaggtaaaacaaaaaagtataagcctaatcaagttatgtgatcaaatcaatctgggtagatcaaacaaagatggagttgaacttaattcgaccactacagctatctaaatcattgcttcttaatcacagaacttccactaaagctacgttctttcgacaacgaaatcaacgaagcaaaacaaacaaaattacgtaaacacacaacaatcgaaaaggggatttttggagaaccctattggtcgagattaattaccacgaaatcgaattgactcagatacagatatctagtagcagcttcacgaaatcgtgcgattcctcggcgttttccagcaggcgcagagcaaaatcattgtccgagccagagagagaaataaataaattgaactgaattggaaaattcccaaaaatttctagtaaaaccgaaccggaacaaaccggattaatttcctctcagaccaaaccgaagaagaaccctagttttatcagtctcaccaactatctcccatggttcatttgctctgcaaatttgtctgaaaaaatctttgtgcgaagcaggaaaaatg

SEQ ID NO: 4411 - DNA, 3000 bp, Unknown; identical to SEQ ID NO: 4407
  misc_feature (1)..( 3000): cDNA_ID_2107920_gDNA_ID_1620704_Annot_ID_165197 3000 nt of promoter + ATG

SEQ ID NO: 4412 - DNA, 3000 bp, Unknown
  misc_feature (1)..( 3000): cDNA_ID_2105071_gDNA_ID_1620704_Annot_ID_165195 3000 nt of promoter + ATG
ttcattcattgctgccagattgtgagtgaaacaattcctgctcttcagaaactgaaacaagaggggaagacccggttcattggtatcactggtcttccgttagatattttcacttatgttcttgatcgagtgcctccagggactgtcgatgtgatattgtcatactgtcattacggcgttaatgattcgacgttgctggatttactaccttacttgaagagcaaaggtgtgggtgtgataagtgcttctccattagcaatgggcctccttacagaacaaggtcctcctgaatggcaccctgcttcccctgagctcaaggtttggcattttacaaaagaatgtgattcttgttaacatttctgtagcacttgtattgatacaccgtataagagactagtgttaaaacgccattcgtgcagcattctctcgagcataggcaggttaaattctatagatgctatacttctgagactgacaatctttgtttcttaactcgtacaatcattgtgattagtcttcataggcaagattagagacacttcagatagttcccaatgggtattaacatgttagttggtctttgatgagtattcagtagaaaattaaacagattcacatggacgctggtatttagttgaattgatgtttggaagagtaggggatgctcttgagttagttttggtttgttctctgtttgatattttgatttagtgagaagtaaacgaagatactgacttcttaacaaattgttctcaaatatgaaagtcataacccgttgctgcttttattgtcttatgtagtctgcaagcaaagccgcagttgctcactgcaaatcaaagggcaagaagatcacaaagttagctctgcaatacagtttagcaaacaaggagatttcgtcggtgttggttgggatgagctctgtctcacaggtattcaagcttggtatttccttgtcaagtcccaaattatgtgggaagttggagttaaatatgaaagaatttgtgtgtttctgaaacaggtagaagaaaatgttgcagcagttacagagcttgaaagtctggggatggatcaagaaactctgtctgaggttgaagctattctcgagcctgtaaagaatctgacatggccaagtggaatccatcagaactaaaagaagctctttgtgtttctggtaaactcttgtcttgcttcttgtaatgcttatgcattcgttgttgtgtcattgtgttaataagagtgtaagtttggttggtatgattaataaagtttcttagatatcaaaatcagtcggaacatctttgatcgaattgattattagataaattacagcggagggtgagacttgggaagaaattacaatatgtccatttaaaaaacacaagaaaaagactaggaaaaatctccaaatctccatcacaagcaactaagttcaatagcttcttggaacctcttgtcatacgtagcgggattgccaaatagccaaagactaaacttcgaacgagcagaactttccgatgagtttctcgccggaaaaaggcatttaactatggaggctgacggttccggtgtggctgtagtctgcagagtattgtttgttgttatctgctgagttagaggaagagggagcatgaacatcgcagctgatgaggccattgataagttgattcgaagaaattgggtgcaaattggagagattgcatttagatgtatatattatgagtggagaggatagagaatgaagggagtaggtgtgcgtatttttctttgggaccaaggaaggctgaaacagaaatttccgttttatatttttatccaaacataaccgacgggaataaaatatatccaaatttgaccaatcagttcatgacacgtatgtagcacaacatgctaacttgcgcaaagacggtggctaacttgtgccaatgataaggtaaagaacttgtgacgacgacgataccgtgaagtgcagaaactctctattgtcgtggacttgggaccaacgcagagagctgcatgcaataaacccacatggccacactacatcttataaaatcttattcaaataagaaagagttgtaactggtctctcttataaattaatctgcatacaagaagtgagcagcaagtaacaaaaaaacatccgaaaattaactattgctaaatctcaagatcaaagataattgtgaatgatcatcataacaaccgtactcaatcaaattcctgataattacgctctctctttatccatttcatgaaaattgattttttcgtttttgtttgattttgtggcatgaagattggtgttttcgtatttttttatgtgtcctaatattagttaattaatatcagttcttcttcattaagcaatgctcttgggctcatttaggacttaaaaatgtttcttgtaatctcaatgttcgtggggtttttggttttctagcccatgtgtgggttgattaactttctaaaagattttactcttatgggattttttaaaattaaagccaatgactaacttgttggattatgatttataacctattggtgcataattatgatgtgtgaacaagtttttaaggaatcttggcgaatgacaaaactttggaaagaagagaagaataaggaactccaaaaccaccgatgcttcctctcctctctcgaatcttctaccgaagcagattcctatacttttgtcaacactttttaagtgttttgcgtttccaatgtactttgaagattattctcaaaactccataaaattcttactgaaacagagaatttttttttttaattttaatctaagaattatcttgaagctgtgttctttggcaaatataaatacacgtcgactaggacaacacttgcgctctaaagattgcaaatccgtgttctatctctctcaacaattatttcccctgcttccaaagctttgacaacatttctattcaaaaactttagttttgagttttttttttcttgtatacttctccccaaaatatg

SEQ ID NO: 4413 - DNA, 3000 bp, Unknown; identical to SEQ ID NO: 4406
  misc_feature (1)..( 3000): cDNA_ID_2992369_gDNA_ID_1620704_Annot_ID_165194 3000 nt of promoter + ATG

SEQ ID NO: 4414 - DNA, 3000 bp, Unknown
  misc_feature (1)..( 3000): cDNA_ID_1824120_gDNA_ID_1620704_Annot_ID_165193 3000 nt of promoter + ATG
caaatgaaaagactgagcaaatcacaccattaaatggaacaaatggcaatgtaccaaagccaataacaaaacaatgaattcgataaatagatggcaaattgagcagtaaaatacatacccttgattctgttaattcaccatagctctgatgctcttttgctgtagcaaccaaagcattacttatccgcgacttcaaatccggaagcaagaccttgatatgttgaacaaggatctaaaaaaatgcaacagaaaggccatcttctatcagacattttctaatattaaagtatcttaaagtctgtaaacaaaaaaagatatacatgcaaggccaaaaaaataagctagggtagaatccgcacagccatgtaagtaaccttaaaaagtgaataatgcatttaaactccaccataatcccatattagatatttcaacatagagaaagcgtctcccttatgccttactgaacaatgattgacataacgaaaaaaggaactcccaattcccataactgcagaaaatacctgatttaacttctttgctagctgaggaacacccaaacgatcggcaagaccatggtaaacctgtataggtaccaaaaagactcagctttaatcagaaaaaatagcaagagtatcagaaagtgaatcaacaaaatgatgttagcataccgggtgactccggaagaacttctcctctgcgagaagtgcttccttgactgtgcggtttagcaaaatatcctgtttataaaatataaagatcaaaacactgtagatgcagacgccacaaaaagtagacaaaaaataaaaattctgtcacaatagcatcgaagtgataaaattagaattaaaaaacaagcacagccaaaggtagaataataaaaaaaaaaaaaaaaaagaagagacagcctactatatgatagcaagagaatcataagaaaaataagtacagaacagaagcaataaagctcaagtcacataaaagaagagccacactaaataaattaaaaagcaatagttgtgagcaaccacaggtttacctcctggcaacgatttacaactcccacgtatccaagtcgaagaggaacaacatttccaagaaggagttttcgagcatcagtacctttgtccataatatccaactgaaaacatgataataacatatagtaaatcacatgaaagacagggacgcctatggtgatgaaataaaacaaatgtctggactgggaatatgcacctttgtgattacacctatcgttctgtgacctggagacagtatagatagatgaaagggtgaagatgagtaatgtcaaatacaacccattaaactagtcattggacttgtgagtagaacttaccatcaggatctacaatgctagcaatttgaagggcatcagagtttgctagatcggtattagcaggggtaacagccaatatcaagcaagtatcttgcttgatgtaagacaagatcatcgttcttatacgtgcttcaatgtcggatggctggtcaccaactggcaccttggtaataccaggcagatccacaagcgtgatgttcaatacattaggtgaagaaattttaagacgaatctgtgtatctgctacacctttgttctctccaactaatctattcgtctcagcctacaaagatgttgcatttcatacattaatacaaacttggaagagcaatagagtatcaaataaagcaaggaagggaataaaaaacctcaatttctcgacgaatctcagagaaatcatagaaacgagtttcaggaaggtgacgaaactccccccactcatcatcggatccgccattagcgcggcttttagtctggaggagctggagaacaagaggacgacgcgtgcagatatcattaccacgagggagaaagtcacggccgacgagtgcttcaaggacgctagacttgccactgctttggcttccaacaacaacaacctgaggaagcgcgatcgtagactggcttccgagctgagcgaatatgtcttgtagcttgtttacaatcggaatcacagaggatcccaacggcgcggcgttggtggtggaggaagacggagaaggcgtagaagaagaaggaggcgtagacggaggagtctcaccggaaacttcttcaatagtcatcgttggatcggattttgaatgaatcaaagttgctagggttttgaaaaaattaagttcgtggagaagagaagacaacactgggaagaagagaaggtcaattactcgggattttcgtgcttagctctatctctatcgaagagaggaggatctttttattagagtcgctaaataatttttacttgctcaagaattttaaaaacgtgaagaagaaattgaactttaatcacaacttaacaaaataattcaaattaattttatattcacttaacctttgttaatttataatgataacaactaaataatttcaccttaatctccatggtccaaaagaagcgaataaacattttcatttacctaattacattagtttttaatttataaaaactttttttctttctaatattagcctgtgcttttattaatcaaataagtttagaaaaaatctatagatacagttttagtgaggaactgaagttctgttctgtctttaaatattcgttgttaacttaaacgcaatcttttgctatttcatcagtaattttttgtatggataaactaaaagaaaaaaaaaatagagaaaaatcgaatgttaaaatcgtggtaaaccggctgatgtcgtatcatttattaaggtctcaaaccggaggtgtgtgttaattttcaatgttgaagaaaaatcggtacgataaggttttcaaaccggttaagtgtgcgcattttggtcttttcaaccggattaggagggacaagaatgagtccatcgagctgtcttcgtcagaaacagaaagagtctcttcttcaatccaatctttttacaacattaggctgttgagacctgaaatctctaaggaagaagaaagaatg

SEQ ID NO: 4415 - DNA, 3000 bp, Unknown
  misc_feature (1)..( 3000): cDNA_ID_3073242_gDNA_ID_1620704_Annot_ID_165192 3000 nt of promoter + ATG
gctgtttcagtagaatacgtctctgattctcaagattcatatgaagttgagatgaaagtagaagatgatgatgacgatgagcttatagttactggagaatcttcagggattcatggaagcagagaaatcaagtctgattcagcatcgatcgaaagagtgaacaaaagtagagattcaactgctgcctcttgttataatgactttcttcttgtgttatctgatgatgagaggagctcagacgacaaagaaaacatcttaataagttcaaatgtgatggccaagccaaaaacttgatactttaatgaagatgaatatcgccaatctaatgcgattattatttttatggttttctaatctctttgcccataatgaatatcatgtcaaattttatattcaatagtgctcgtctcttatacgaccagtatcaaagctttgtttttcaacagacaaaaaacaaaagaatctgctgttattatccaagtgggaggatgaaaaccgagagctcacacaatgctttaatacaaaaagaaactgatgtcgtcgtccattcacattcacacgtcttcgtctctactctgatgctccaggagcaattgttccaactcttccttgcgtcgggctatctcctgcaataagggtcaatgacttagaaaccatttgagtgatgataataatgatgcagatagactatcaattgacacttgcctcaagatccttgactgcttgttctcttgaaacttccttttgctgtcgagcacgcttcagaaagccgatgcagagaactccctgaagttcagacaacgatcaaagattgacagtgaaaacataaacgggaactcagatattgaaaaacaaaggaagtgattgcccaagaagctcatttttcaagttagaaatagccctacagattcgctaaccaccacatcaagcatctattgttcagagttgggagttatccaagtgatcctaaaggtctggggacaaagtgtcaacatgagttcttacaacaaaccaagaatcgttttcaagtgaaatgcattcttataagcaagatgcaaccacaaggcacaaactaatacgaaaagattcaacaataagcgagagcagagagggaataagcagatgtgatataataggatgaatggtgatagcgtacagaaatgacatagataacaccacaagcaagaagcaagtagcttgcgatgttctgtagaagcaggagatccttcttttgagtcatatagtcagggaaagctcttgtcatcacagcaacactgaaatgaacaaagtaaagatatatacataaaacataaaatcatacagcaaccaaggaatggtctcatttttgagtacctggcctggaattagctgaagcagcactcaaaaaacacatcataaaagaacaacacgatccattccaacacaagaggtacaaaagaaggttactaagctgtatagatgtacttacaaaatttgaagcattcctctaccagcccagtattcaagaacctgtaaacagatttgcaaaattagaatcaattcatgttagaaaatcaaaggaaagagatagcaaaagatacgaaaccttggaaaatttgagaatgaaaccccattcagtctcaacgagaacaacaaaacaagcaatcaccacagcataacaccggaatattccatcgaagagctgctcggagaggaaaagataaaagctttacacagagatcatcttcaagtaatctaatgcctgcgcagcgagagaggaaaaagagagagagagagagagagattatacatcgtggctgtcacggaaggagcgaacggcagcgagaacgttaacgacaacacagagaatggcgatgagagaggtaacgaggctgaagcatctacaaacaacaaggaaaggatctgctctgtttccgagcttcaatttcgcggatccggaagaaggtccggcgggggattcttcgatttcctcagtcctatccatctaaaaccaatttcccggtgagaaaatccgccgtcttaagtggaatttggaatcgagacgcgaaaaacgaaatggagaagcttgttggttaggattcagaagtggttagtgcggaaagctgaattctttctttcaccggacgttcaagccttgtcttttattcttcttctttcttctttgggaatatttaactctgcttactatttttatatatcagatcattaagtgttgtacaaaaaaacaaaaaaaacgtcattgttgatttgttgtaatgtttagaaatatgctatttttctagatatttttgcagtaatgctaacaggtatgcgatttctatcagttagtattcatgaccacatcatactgctctctctaaataattcagggctccacattacgattttttattataaaatctactagtacttataagaaagtagagttaatgaagtcgatgggaaccacttgggagagtggttacaacactccagtctagtcacatgtaacatgttcatggatacgacctagcttcctcttagtgaggttaaataatcctatagagcccattagaagtcaatgggctaacaaatatatgactggctctagctctagctctagctctagttctaaaaccaaaacccaagaccacaacaaacaatttttgccgtaacacactactaattttcactttcatctacaataatctccaaaattttgtattatgtagagatttgagtctgaatacgctaaaattttactcaaaaactggactataaattagaaattttggtctttttggattagcattccgttcgaattgatccgcataccaaaaataaaataaacgttgcggtttggttggttaataaacggacatgaccacataacacataagtcagtcacgagtcacatattccttttggtcaatcaaaagcccatatcatcatcatcgtccacacaacacaaaactatattcgatttcttccaccaccacacgctctcacatctctccggcg

SEQ ID NO: 4416 - DNA, 3000 bp, Unknown; identical to SEQ ID NO: 4400
  misc_feature (1)..( 3000): cDNA_ID_1386598_gDNA_ID_1620704_Annot_ID_165181 3000 nt of promoter + ATG

SEQ ID NO: 4417 - DNA, 3000 bp, Unknown; identical to SEQ ID NO: 4399
  misc_feature (1)..( 3000): cDNA_ID_2147485_gDNA_ID_1620704_Annot_ID_165180 3000 nt of promoter + ATG

SEQ ID NO: 4418 - DNA, 3000 bp, Unknown; identical to SEQ ID NO: 4398
  misc_feature (1)..( 3000): cDNA_ID_2147481_gDNA_ID_1620704_Annot_ID_165179 3000 nt of promoter + ATG

SEQ ID NO: 4419 - DNA, 3000 bp, Unknown
  misc_feature (1)..( 3000): cDNA_ID_1824094_gDNA_ID_1620704_Annot_ID_48847 3000 nt of promoter + ATG
ataccgtttctattaatgtttgggactcttgcttccggcgaaatcgaaactgccagactgaaccgtaatttggggattacgtccaatttaggggtttcctgcggtggatttgaagactttgctatgagattcgaaggggaaaacatggtgccatacaaaggtgaagagcaggaggaggaagaagaccaagtggtggtgaacgaaacgacgccgttccagtttcaacaacctttgtttctgcagcagcagcagaagctcgttgttgggtatgctctgacttctaagaagaagaagagtttcttgcagcccaagcttgaacttcttgctaggtaaccaataacaaacccaaaatgcttctttggagttataaagttttgatttttcattgcaaagtttccaaatttgttgaacaatcttttttggttctgctttttctttcctgagagacgactgttcctttgttggcgtttaaacataaccgacaaactcttttctactttcaaaaagatctttaggactttgacattttcttccagatttggttcttgtttccttactcttgttttggtacctattattggtttgcctgattctatgaggaccattgccacttgccatgtcttgtcacctgccatgtttttgtccttaatcggctcttttgcttagggttaggcttacactagtatactctacttgtggtatcaggatgtttctatgggaatattccttgtgtaatccttttggattagtctctattgaggtttgactctggcttttaaaaaataaaatacttagatgttttgccttttctgtggcttggaaatcttcttcaaccacatgggtgtttttgttaaagcaatcactggttctacttaatatgtcatcttctagaatgtctctaataggtcagagagaacatttcttattggtttagtttgacgtctggtctctgttttgcttctttctaatcaacccatagctttcattctttttcttctttcagcagtgttttcaagaaaatgctagtaatactttttgtgtctgtcaatttcaggagaaaaggcattttctttgtcgccatcgatttgaaccggcccctatctgaacaagggccatttgatgttgttttgcataaggtttgtgagaactaagaactctctgagctttaatctgtgtttttgctggaagtctaatgaattatatgattgttctcttgtagttgttgggaaaagagtgggaagaggttattgaggtttggaaaactgactacttttcttatatgtttctggttttagtttcttgcttgaagatggtaaccaatctggttttgagtttcttagtttgaactatgtaaaggtattaacccttgagtggtatttgaaagacttctgttaagctggggcagtttttcagtctgtggaaattatatgttgtcaaatacaatctcatgttgtttcaccgtttttgtaggattaccaacaaaaacacccagaagtgactgtgcttgatcctccaggatcaatacagcgtatatataatcgacaatcgatgcttcagggtatggcagatttgaaactgtcagattgcagtggtaacaatcctcaataagttcttttgacatcgaaatttaagaccttttctaagtttctctagaagtgattttttgcttttggtaaatatttgtaggcagcctttttgttccaaagcaaatggttgtcttgaaagattcagcagctagtgctgatgcagttgtggaagctggtctcaaatttccactaggtacagttgaacatattatcttggcattgaatattcttgtatgtataaatgatgatcatgaatttaaacttgtttatttcaaatttgtcccagttgcaaagccgctctggatcgatgggactgcaaagtcacatcaattgtacttggcttatgacaggcgctcgcttgcagagcttgatccgcctttagtccttcaagagtttgttaatcatggtattggttaatatgacacttcaatacgcagttgtcccatgtatatgtgttttcaaaaaattcaatgcatcttttttggtgcctgaaggtggagttatgttcaaggtatttgtggtgggtgatgttataaaagtcatgagacggttttctctaccaaatgtgagtaattgtgaaaaagccaaagttgatggcgtcttccaattcccaagggtttcatcagctgctgcttcagctgataacgcagacttggaccctcgtgttgctgagctacctccaaagcctttcctcgaggcgcttgtgaaagagctaagaagcttattggtatagttttagctgcctttctccacattttactttacaaatccggttttgattatcataatttctaactgcttttctattattagggacttcggcttttcaacatagacatgatcagggaacatgggagcaaaaacgtgttttatgttattgacatcaactattttcctggcaagtttttcccttatttttgaagcttttgtgtagttctctcatggaagcagagaagtgaacttttctctgtttgatatcgatttgcaggttacggaaaactgccagactacgagcaagtctttgtagatttcttccaaaatctggcgcaggtcaaatataagaagagacaacattgtaaatgaaagaaaatggcggcagtttttagatggtctactaagaagcgacaaataataaaatgtctaattatggatttgtacagaatttagctctcccttttggaagcagtatcagataaacaagttttgattactgattttgaattttcagtgaaataaacgtctcttcatccaaagttgaccaaacgatatctgaattcttattttgaccatagcggttcgttatataaaccgaatcaatcttaaccggttcgatcgaattgatttcgtcgtctctaaaaacgcaatcccttaaaccttttctctctttatctaactctcgtcccacccaacaatg

SEQ ID NO: 4420 - DNA, 1577 bp, Unknown
  misc_feature (1)..( 1577): cDNA_ID_1571642_gDNA_ID_1620705_Annot_ID_48854 3000 nt of promoter + ATG
aagctttacatctgaataagtttctctgattttgccttcctttcaggctgttctggatgcacataattctgtaatctctgcgatgaagccaggagtaaactgggtggatatgcacaagtaagtcttactgagatgctatatagctctgttctactatgcatgcagatgcagtaattgggattgacaatgtaagcgtaaactcagttgctttggtccattttgatttatcctcttgttagggagataaattgaaatacatctccatatggttattcagctttctttgtcgactgaagcaaattaatgtacaggttagctgaaaaaatcatccttgagtcactgaagaaggggtccatactcactgggtaattctctctgtgttagacatttcaatactcttctctaaaggttaattcattctcatggtttcgttctctgttcctagtgatgtagatgacatgatggtacagcgcttgggtgctgttttcatgcctcatggactaggtcacttcatgggcatcgacactcacgatactggtggctacccaaaggtacatcaaatcttttttcaacccaatagtatcatcacgtaaataaaaccacagtccctgtgtcttacccgttgctttgatctttcattcttttagggagtggagagaccaaagaaacctggattgaagtcattacgaactgcaagagacctacttgaaggaatggtaagggccgattgtttcaagtagaaatgcttttggttcttctcatttatcgtctctgttcattgtcctaatcgtatttatgtcaggtaataacggtggaaccaggatgctatttcatcaaggcattgctgttcccagccatggcaaacgcaacaacctctaagttcttcaaccgtgaaacaatagagagattcagaaatttcggaggtgtcagaatcgaaagcgatttggtaatgtcaaattcatattcactacaacgtctacaagttaaaacactctcaagagtaatgtcatatacaataatctcattttgttgtatatgtgtgatttcttttttaggtcgttactgctaatggctgcaagaacatgacgaatgttccacgagagacatgggagatcgaagctgtgatggctggagggccttggccaccgaccaagtgatcgtagctactcttaggcagcttatggaaattaaaaacttgataagtaaaactcaataatacaacctttatttttgttaatgggaataaggaaaaattgcctgtgttttactaatcttgtacatgtagtttattttgtttcagtgtcttgtttgtgtggttggatattaaaccgattgaatgttcaagtggacagataaaatctaaccggtttggtgcttgtcgacgaaaaccgaaccggtacagaaaatatcttgagcacaattttagttctaatataaaattcattaacaagagagaaaaaaaaaacttcaaattaaaagcttcgtgtcttcataaaaccctaatctcgcgacttcgtctctatccccaaaaaccctttcctctcttccttcttgtgtgagaccgagaaaaaaagatg

SEQ ID NO: 4421 - DNA, 3000 bp, Unknown
  misc_feature (1)..( 3000): cDNA_ID_1715104_gDNA_ID_1620705_Annot_ID_48855 3000 nt of promoter + ATG
aacaggtgataagataacgtctctcacacaccttgtacttcaagtcttgacatttaacaccaaccacggcgtggtgaccgataatgttattgcatcctatgaatgtatagccaggaagctcatcgccaacaacagcaccactggctgacaaaaattcaagacagacacatagcaaagatcaatcaatcaatcaataaattacagagtataatctaagagatggaagggtttttacgtcatgagaacacaagattcccccaactctgtgtttccaaagacatggctagaaggatagagtttgcagccattgcctagcttcactgaagagccaatagtacagtatggaccaactgaaactccctgttagccaatgtttctggttaaccacagtctagtaagctcaaatctcaaacaaagcatcacactttgaccaggttagatcaaattcaccatcttgttctactaatttgaaaattgcaagtgttaagctgtttctagtcttcaaatgagcagagaagggttcaatttctgagtaaagtccaaattcaccaaatataaaggttcttaaaacaactcagagacctcaaagcaatgtcagtaaatgaatcaaaccttgccaatcacagcatttgggtggacgacagcactcgggtgtattaagacttcagaatccctcgaatcttcacgagaatctgctccaaaccacacaattattcacagcttagagtagagatacaaattcagctaaacatgcccacataaagcagaagcgggaatagagaaagacagatttacaggagaggctagaggagagtcttcggatagtggaactgacgagaggagagagaagcttctcgcgagctttaaggagagaaatcatggcgggctacgtcgaccaaaaccacaccccttccaattgcatacatggtgttcgacgaaatgcctcaaagaacgatatagtgatgaaatttcacacgtgccaaggatcgatcacgtgacttagttttttactgttggtatataaatttcttttgaagtgatagttccaactttttgcaaaaaattaacttcttttttggattttcagtttcaatcaatatctgatacattttttcttttgatatacactaccaaatataaaatcgaatgagctttagctaaattccttcatttttaatgtagcttttgagtttaaacgctggtagcaattaatttccattaccatgacacaaagcaatgcctttatcaatttagtgaagaggaacaaacaaatgttctttcatcacctttgcattaatcagtaacacttattatcgactctaaacaaagcctagtgttattgtgttatgaatcttcttcttttgttattgtgctgacaagttgcagcaggattctctgttgttcctctgcactactccattccttgacttctgctttgatcagtaagggattgtctgagatcttcttccatagcggataattcgttctcggcatcacaaaatcacactctctcagcttcaatgtcgggcagaagtcacctcctccatctccaaggtagataaaccttcttggaatttgatcattggaagaagaagcacgtaaatgatccattactaaaccctgaaagaaccaatgaagtttcactagtcaaaatcctacaaaactgaatccaatctaagggtaatggatatagcaatctctatttgtacaacgctagaattgaagatttcagcttttggactcggaactaatcccaaattctaatggacaagatcataaacaaattgcaagtctaactacaaggcaaacatggagggcttcttatatagttaaaaaagatagataagagtaccttgcatagatttgaagggcaaagattgcagctatgtggaggcaatgcatcactatgataaggcaagatccgcaagttcccattatcatcaagagaggttggatttgtgtaaatctcagaaaagcaatccaccaaatcatggtgctctagtatcttctcaatgaaaaactgatttgcatcactcacaatctttaaatcacatctgcaaatttgaaccaaacaaacaacactcaagactcaaccaaaaaaagaaactgagaccatctaagtgaactgatcattgttcataccctgaagatttagctgatttgatagcttcaataatatgagaatcaataggcattttcttcaaacaagatttaatgtcatcaatcgatctaccttgtgattgtagctccatcatcatcctatccttttcaaaatccaattcaaattttgatttcaatatgcgtaaatcataagaagaggatgagattttggatgctttaataaatgaaataccataagacgattccatggtaaagtgaaacggagctgatggaagatctctgtgagtcccatttcagtgacaacccaattgtcactatctccgtcgatcaaagtccgatcgaaatcaaataatatcacgatttttgccattttctgagatataaacacaacgccggagctctgcttctcgccggagctgcaaatcacttctcctctttcttaattggtcgacggcaacatccaattgtccgacgccacttttcgtcttgccaatgacaagtttaccactctccatcctattaattacatttgagccatccagtcgtattaattaatgggccttactgcttggcccattttgtgctgtgatccgaataatttaccacacatacaaaaaaacaaaacagtaattatctaacatggtcgagaaagtggacccaagttcgtgtcagcattccaacagccaataagattgcaggaaacacgttaacaagcgtaacatcgattccacttcatgaacacggcacaggatcaaaacccagagaattctttaaacccatgatcttctatatagaacccgtgaaagaattttattaaagtcccaaactttaccatatttaagagagatagagaaagcttctctgcttctgacttcaatg

SEQ ID NO: 4422 - DNA, 3000 bp, Unknown
  misc_feature (1)..( 3000): cDNA_ID_2992562_gDNA_ID_1620705_Annot_ID_48862 3000 nt of promoter + ATG
ttatatataacacgctttcaaagaaatacagacgaacataaataataacataaagaatcaaatcacatgcgtacccaagatgacgtggacagaacagagaaatcacacttctatgtctcaatcaattctcaaaaatatctcaacattataccaaaaaaagaaattctcaaaaatatttcaacctttgactatatttaccaaaccccacttcctggaacctcctaacttttaacttatgtattgtaatgatacacctttatacttttgcaagtagactaatctcatggcatctattgcttgctaatggtcggtctaagggaaatgatatatacagcattatacttctgtaattagacaatattaggagttcagaaagaagttgttaccctcgtttacgaaaaaaatgtttatattcaattatgaaaccaactcttctgaaattctgtgatagttttattgttcctcaatggtccacttattccccaccttgatatttttgcaaatgaggcttttgtcttactcataaagaagatccattcgaagacatatttttgtttctttccgttttttcaaaaacaataaaaaagtttttgttcacattttagaagagaagcaattcaccaattaatttcgtaaggtaacatgaaccaaagaagcaaaacaaaacatcattataaatatatttatactgacaccactgaaaggtaacttgaaccaaagaagaaaacacaacataaatatgattctgtgacattatcaaaaggtttaacgaacccaaccaagaagtaaacaaagcataattatgataggataataaaatagttaaataacgaaggccagtgtaattccctactggctattattttccttactagtagtatagatttttcttatctatcactattcagtaataaactttttttggagatccacgtagcaatggaaaaccttgaaatcgcagttcggagctgctatagtgtctaaaatcatcttcgccgtgcgctcttgactcaccctcgcgttattcttttccacaagcaccgcttctacgatcttattgaaccctttccctcggctacgagccacgaaatcaaccagagcagcttgtaccggtcccaaacttgggctatacgccactgattcaatgtaccatccacggtaccacttcccttcgtcatcctgcagcgccactcccgacggagactcagtgtacggagagaacgaattgtttgccgcggctagagccttgcacttcaaatgggaacaatctgatgagcatatctcttcggtagaacccgaaagggtgaggcagttatcgcgcttctcgagaaggagaggggaaccctttgggaggacgtcgtcaggggtgaatctgtacggaaggaggagcttaaggctcgagaatgatccttctgcttcatgctttgatttgagcaggattttgatgtcaagctcgttgctggtctccataagaaactggcggcagtttccgcacggcgcgccgaattcgatgcagtcactagagatggcgactgctaactgacggagacctttctcggagtttagtgcgaggttggtgacgaggaattgctcggggtggatggagtggtgaagaggaagacctgggaattcgacattgacgcctaaatagacccgacccgatgatgcgcgtccaacggctccgactttgtatttggagattggaccccgagccagagacatcgcctttctgatcagctttggaagtctgatgggttcggtgacaccttccgatgctgcttctttggcagtgaaaacgaacttgtacttatcttgtgccgccattgccctgttttgagattctacacgagattttggaaatgagttaacaagttaggacgttgggccatttaggatcgtgtttcgagtttttttttggttgagagatatgaaatgagatgagaagtggtattgagtctttgcctatttatataggtgtgtcgtgtctgtttgcatattgtgaaaggactttttaaaatcgtgtttaggtcattcgtatactcaaaacaatagttagtgtgtgaacttcaagattaaaaaaaggtgattgtgacgatcaacattcatgaactagcttttaaagcaaagtagtaattagggttaattttctagttagtataaagtaatgtactgtaatgaagagtatttattcgaggaagactaagtagttcttaattaacttttactgagtagtaacatttaatggtttgaatagtactaattaatataggtaaagaattacatggacaggcaagaatataaacgagattatgactgtatctccgtcatcaagactcatgctgactcatgaaccatttctcaaaacaaaattgcttttaaaagtaagtaaggttagtttttttttttttttttaaattctatactaaagaatggttaaaaaaataaaattcaatagtcttgattagtcataaattcatggtatgaaaattgggaatcttattcttaaaaagttataattaaattcattgagtttgtgtgagattgtgacaatataaaaatatcaaataatactctaagtccatgctatatatatattttctctttgtgtttaaaattgaatcttgttcagaaatgagcactttgggtagatcattttgaacttaaatgtatgatatatatttgttcgaaaaatatggattccagttaattttttgagtgaatatggattgaaacgttttaagaaggatgattgtgttactctaatttttgtaacaataaacgttattatatttttacagttactccccataactttgtaaaaagtaaagaaaagccccaaacagagagaaacgaccacgtaagagtggtttggatcactaaactcgaatcgtcatcttcatcgatcgatatgcgacacatcatcttcatcgtcatgttctgtcttgcaaagttcaaacctttttacaaatcagacaaaacccaacaattaatgaaacaatg

SEQ ID NO: 4423 - DNA, 3000 bp, Unknown; identical to SEQ ID NO: 4421
  misc_feature (1)..( 3000): cDNA_ID_1715104_gDNA_ID_1620705_Annot_ID_165237 3000 nt of promoter + ATG

SEQ ID NO: 4424 - DNA, 3000 bp, Unknown; identical to SEQ ID NO: 4422
  misc_feature (1)..( 3000): cDNA_ID_2992562_gDNA_ID_1620705_Annot_ID_165245 3000 nt of promoter + ATG

SEQ ID NO: 4425 - DNA, 3000 bp, Unknown
  misc_feature (1)..( 3000): cDNA_ID_2173018_gDNA_ID_1620705_Annot_ID_165270 3000 nt of promoter + ATG
gtgtctcgccatggcggctaaaccagcggcggttgttatctcggcagacgggacttacgctgacgtggctgccgggacgatgtgggtggatgttctgaaggcggcggtggatagaggcgtctcgccggttacatggacggattatttgtatctcagcgtcggcgggacgttgtcgaacgctggaatcggtggtcagacgtttagacacggccctcagattagtaacgttcatgagcttgacgttattaccggtacgtaaataccaaaacttcactaatctcgttacaattttttaattttttggtaatataaattttgtacggctcaactcttaattaagaatgaaacagtatctatgatcttctagatgctctttttttgtctgcaagctttaattgtagtaacatcagcgatatatatatcacatgcatgtgtattattgatgataatatataatgttttagttacaaatttgattctcaaggtaaaactcacacgccataaccagtataaaactccaaaaatcacgttttggtcagaaatacatatccttcattaacagtagttatgctataatttgtgattataaataactccggagtttgttcacaatactaaatttcaggaaaaggtgaaatgatgacttgctctccaaagttaaaccctgaattgttctatggagttttaggaggtttgggtcaattcggtattataacgagggccaggattgcgttggatcatgcacccacaagggtatgtatcatgcatctatagtgtaatcaatttataattttaatgtagtggtcctaaatccaaaatttgatttgatttggttggaacgtacgtatatataataagtcaaaaggctgattttgaagacgaatttatatacttttgttgaattaaatctgattttgcttacgttttattagattctgcgtaataaatcctaggacttgctcgagtgtaatcttgtcttatgcttgcaaatcttgttgatgtcaatatctaatcttttttattatatttccctacgtaagttttagatatagttattttaaactgctataaattgtgtacgtatagactttagataaaaagttgtggtcgcttgcacctatttgtttatcgctatagtgattcaaaggtctatatatgattcttggtttttctttttgaaaaaaatagaccatacaatccaaggaagatgatcttaaatggactaatttatggatataaattgatatacaaatctgcaggtgaaatggtctcgcatactctacagtgacttctcggcttttaaaagagaccaagagcgtttaatatcaatgaccaatgatctcggagttgactttttggaaggtcaacttatgatgtcaaatggcttcgtagacacctctttcttcccactctccgatcaaacaagagtcgcatctcttgtgaatgaccaccggatcatctatgttctcgaagtagccaagtattatgacagaaccacccttcccattattgaccaggtactaaaatccattattcatgatgattatcttcacacaatcagtatcatcaccaattaccatcatcacttgtcatatatgatccaaagtaaatatatcacatgatataaataaatcgttcaaatctttttttttaaagaataaaagaatcattttcaagcattactcatacacatctacgaatcaccgtgaccatatataaccatacgcttattaaataatcatttttgtttgtaggtgattgacacgttaagtagaactctaggtttcgctccagggtttatgttcgtacaagatgttccgtatttcgatttcttgaaccgtgtccgaaacgaagaagataaactcagatctttaggactatgggaagttcctcatccatggcttaacatctttgtcccggggtctcgaatccaagattttcatgatggtgttattaatggccttcttctaaaccaaacctcaacttctggtgttactctcttctatcccacaaaccgaaacaagtaaatatttactttttgattttgttttatttgaaagtatatcccaataatgtatgttaaattgttaacaagaatttattttattaatagatggaacaaccgcatgtcaacgatgacaccggacgaagatgttttttatgtgatcggattactgcaatcagctggtggatctcaaaattggcaagaacttgaaaatctcaacgacaaggttattcagttttgtgaaaactcgggaattaagattaaggaatatttgatgcactatacaagaaaagaagattgggttaaacattttggaccaaaatgggatgattttttaagaaagaaaattatgtttgatcccaaaagactattgtctccaggacaagacatatttaattaacttatcacatgtcttaattaatttgttatgtaactttagaacgtatttttataacatatacagacaagtacgttcatcgtctaactaacaaatattatagtttagtgatttggttaggctacttacgttaatctttttcgttcttgtatgaaatatattgtataagtcaaaagacaaagaaaaatatattattatagcggtataggtctctcagaaattaagaaccaattatttcttttattaagaacttttatgtggttaaaaattactaagaagtatacaaaattttctaaatttgaaagtaaattaagaacctgttttattaagaaaaatttcgataatatctgtcaaaaaaaacaattcccataactttttaactattttcctttttacaaaatcttctcaaaaaaactgtgacagactaatttatgaaacgacatacatgttgaaatgctaaattgaaaacggtgtgttatttggaaattcaaaacgttttcgtttagaattagtacaaagttctcttcattggccaaaaattcaaaacgctgtcgcttttaaattagtacaaagttctcgtccttagccaaatgcatct

SEQ ID NO: 4426 - DNA, 3000 bp, Unknown
  misc_feature (1)..( 3000): cDNA_ID_1824167_gDNA_ID_1620705_Annot_ID_165269 3000 nt of promoter + ATG
tgctctcgtagcccagacgcacattactttaacaaaccgaatcatatctcctaaaacttgccaccctttgaaaggtaaatgctccacgcttaaatgaaaatcatacaaatctaactttcttgtatcttaactaaatcgataatcagtcattttgtcatattcagtgaaactattagagtactgattccatttccatagactatcaccttatcattgataaattttgagtctttatatcatgatagtatatagagctcacacatttccaaaaggttactagatgagtcccatgactttcttactttttacccagaaactttagtaataagaaaggcacatatttcaacagattaatctagcaaagagatcatgaaagtgatgaacatgtagcttcaggagctttagaagacctatctctagagaatagcaattgagaaagcattgtgaccaaaccatatatataagcagtaacaatgttggtcaagcttcatacacagtgaacaaacaagaggagagcctcacacgattcatagttcagaacctagtcatgactatcacacactaatcaagctttatgaaaatcaagataaatcataggtagatcgaatctatcaggaactgtttcactaatctgacatcaagtaatataaattgagaacaagaaggggcaatttcgaagatctagagatcagatcaattattagcttacatgaagaagatagcggtaatgacgagaccaatcgcaagagtgaacaccgataaagtcggatacagcgccaccggaatcggactcgcaatcggtttcgccgccttctcaccgggaacgagcacaaacacaccaaacaaaatcagaaatcgtaaaagcaacaaatagagagatcaaattagctgtgactgaaagcacttggacggatctagatttaccattgttgctaagctcttcttcttcttcttcgatctgaggaacaatgaaaaagctatttgactgatctcgctcgcttgatcgcttcactaaacaaacacgagtcgcttccggtttgtacttaaccggcttgttataacacaaccacggttattttatgggccagtttttctgtttaaaggttcgatttaataggcccaaatatacttattaaggcctttgatataaaatgtgttcatatctttatcttcttttaacgttgtataactttattcaaagtgcaatgtgatcctttaccattttcgaaaattgaaatccacttcaatgtagacatctccaactccttgtcaatcaatttccggattgaagattgggtactctctctagatttagttcccacctgaaaatatgggaccggatgtaatagtaacagatttttgtattggtcaacaatgacttatagatttcgtttttttcatggaaaggacttagaaattggttagggtttaatttgttgaccaatacgaaaatatggtcccaaagaagtgttgccatactaaatgacgaaaaccggctgccgaatatttctataggtaggacatagaacttacatcaatttgcgaccacatatattggaggtagcattttaatcgtctctagacttaaagggctatagcagatagaggagacggtttactcactcgtttgctatttgcagatatttacgaattttggcacatggatccaagaaaacaattctgcctgttgtgtgtggatagattttatgcagaaaaaaagtactagtccatcacatttactttaaaaattaaatcaacggcctagtatttttgttcgattataacaaaactattataaaaaaaaaaatgtacttatatttaacactattgattaattaataaatgaatcttccgactgttttctttgtagggcgtgatgtaatcacgggacggtgagtcggtgatatcattcgtgtgcttcactctctaaacatatagcgaagtaaattgacaaaaaaaaaaaaaacaaatagttaaccgtcgacaattcaataatggatagagtttgtgattaaatcatctataacatatatatatatatatatatatattaattaaatgtttgtctcactttgcatgtgatacgaaatgaagaaactacaaaaaagtgaagttcgaggtggaataagccttttgctttctcacgccacactaaaacttgcgtatgtgtttcgattctgcgccggtcctgttgattatagaacatgtaatttaataggagaaagtaactgttagtatagtattaaaaacgaatgtatataattttactattataggtatgatcgacttttgtactataaatttcaataacattccttcaatgaaaaaaaaaagaaagagttatattgtaatagactatagttttgtgagagagtttcaagtaacgtttgcaattggacgaacttttaaagaatattaactgcaaaaacactacttgggtgtagaaaagtgttatttatgaaccggcccacagagtcggagtttggtcggttccacaaatttcaaatttacgttgtgatctacatacaataaattatcacatcttataaagtcaaatgaaactacctcaactatactagaaaatattgaatactaaattataaaatacagaattagaaacttatcaggggtgttaaaatcaatttacccagtagactttttattattgttgaactacgtttaaacaacatatagatatttcgaagtcaatgcagtcaaatatttcatacaaaacactttcgacgaacacaacttgtatctttttttctctttggtgtcaacaagacttgtatatatatcaacatcaatgaaaatacgcaaagatatatatgttcacgtgacaatttattacattaaattgtatatagtctctctatggttctatataatctcatactttctacctcatctctatagtaatcccataatcaacaagacactctaatagtaatatctcaacctccgtctcgttttcccattaacctacccgtttgttagatt

SEQ ID NO: 4427 - DNA, 3000 bp, Unknown
  misc_feature (1)..( 3000): cDNA_ID_1033727_gDNA_ID_1620705_Annot_ID_165241 3000 nt of promoter + ATG
ccatgtcttgtttcttggcattggtagatgaagagcctaagagcagcctatcgtaagatattcatgtctactgaaacagtctccttaagttttgaagagcgtctcacggagctggtacgtgtaatcaatgaaaactcacttcactgtcttcttccctgtggatctagtgcataaacatctaaacatattatatctgatgtaattcaggaacaggaccaagagctgtacagtgttcctgcagtatcggcaatgttgcagtcaatccgagattctttcactgaaagtcgccgtgggatatgcaagttcagacaatggctcgattccacaacttagagacttagcttaggcattcagtaatcagcaatggcttattatacctaattgctcaataccatttccttcactggaactgtaatagtttgatatatagctttaactaagtgttgtcaacattctgtgggcacataacatccttaaaaatcacttgtcagagaaaggaaaattcattttggtattatttctaatactgtaatgaagctataacttttggatgctagactcatagatggagatggacttgaaaagcctgaggcagcagagtacctgcaaattccgatatgctcaatatacaaggtatagagagacagagaaccaataaactcatggtcgaaatagaggaactaataaatcgcatctcttcgtgagaccccactttgtttacaaactcgtgaagccatgaagccaaaggaaaatctcaaggctgggaatgcaatcttctacatcagtttcagggactgtggtctgaccaagatcaccgagctgtggtaagaagaaccacagatgggcatccggaacacatgtttcttgaagttaagtgtacggttgcggacttttcgagctgctctcttaactaaactattctgctctattggctacaattggtctgaacacatttcttctaagatgttgcagattatcctctgcttttatttggtgttccaatgtaatctaccaagctgattgttttgtattaaaccgctgcagccttataattccttgaagaatgaatctatatatcattcatttccctttctagccaagcattggatctttcccgtctttagattcagtttttttggagtgttaccaaaagatcatgtcttgtttcttggcattggtagatgaagagcctaagagcatcctaccataagattttcatgtctactgaaacagtccctttaagtcttgaagagctacttaacgaagatggtgcttgttattactcaattctcttcactgtcttttaccctgtgcatctatcgcagaaacatttgtacattttgcattttgcaggaactgaaccaagagatgtacagtgttcctgcagaatccgccatgttgcagtcaatcctagattctttcacagaaaaaggcttatacaagtgttgtgaacattgtgggcacaaaatatccttaaaacagtgagaagaaagttcactttggttggtcactttataataatatacatattgaagatgtgtctacttacattagccgtgagagtaaaggcaaaattaggttttcctgtaaaaatagccagttgcttttagtggcttagtgtagatctcattctcatgtctattcgtgattttagttcaattcattcttctggtctttccataatatcgtttctcttagttctttcttctttgttgtcattaacagtcaacaaaacagctacaaaaacttttaaaccaataaaactgtttggttgaacaagatacctaggtctagttttaaactacaaaagacaatattttgttttcttatcatagaagagaagagaatccactgtttcctttatacagccatagatgttagtctttcaccatggacatgctgaaattgtgaagagaacgcgtttccttttacataactatatacataatatacttgataacaaatgcatggtacatggcattacccgtgatacacgccagcgtgcatatactgcttcgtgcacctcctcaaccttgatgccagaattaggagttgttgccatgatttgagagaatgtaccaactggtatgatctctaaaatatgagcaagaactttcacatttgctcgagttacgggtaacagttcctgtttcaaacaaggaaacatgtttcgactacaatcaatagagagttatctcagttttatacatgtgcattctatagtctttggcatctacttactttaggtttcatgattgacgacatttttgcttgtttctcctgcggattaagaaaagttagttagaaaaccaagaatcttgttttttctatgcatagctatcgatccttttaccagatacaccaaaaaaaagaaacaagatcaacactacataagccaagtattagcatccatttaaacaaatccaggctcaattctactagacccgatgaataacccaaagatctctgctcagaacagagcataccaaagaaaaaaagaaagaaagagaggagatgcaatgatttcattacgctagctagacctaactgttacatacgttcgctatagtttctggctttctgtacacggaatgcaaagaaagggggaaaacaaaaatttgagaaaagataaaagacgttactgttgaccggtgaccaagtagacaatagccggcgacgaaataagcgggaatatcgttatccaatttgacgattggtccaaaaccaaatgagcctagcagagcggaatgaaaatacatcggtctaaacgacggcgtttatctgaatatttattgcctttctacttgtctccgttgccatccgccaaatcgacgaagacgacgattaccaggttcatgaaatctgcttctcacttttattttagccatcgtagatctattttcttatggtcaattcgcttcagtgttttgaaattttgaagccacagctttctggatttgtaatttcgaatatgaaaatcgactgaaattgttttaggat

SEQ ID NO: 4428 - DNA, 1577 bp, Unknown; identical to SEQ ID NO: 4420
  misc_feature (1)..( 1577): cDNA_ID_1571642_gDNA_ID_1620705_Annot_ID_165236 3000 nt of promoter + ATG

SEQ ID NO: 4429 - DNA, 3000 bp, Unknown
  misc_feature (1)..( 3000): cDNA_ID_1824171_gDNA_ID_1620705_Annot_ID_48876 3000 nt of promoter + ATG
cacatacgcaagttttagtgtggcgtgagaaagcaaaaggcttattccacctcgaacttcacttttttgtagtttcttcatttcgtatcacatgcaaagtgagacaaacatttaattaatatatatatatatatatatatatgttatagatgatttaatcacaaactctatccattattgaattgtcgacggttaactatttgttttttttttttttgtcaatttacttcgctatatgtttagagagtgaagcacacgaatgatatcaccgactcaccgtcccgtgattacatcacgccctacaaagaaaacagtcggaagattcatttattaattaatcaatagtgttaaatataagtacatttttttttttataatagttttgttataatcgaacaaaaatactaggccgttgatttaatttttaaagtaaatgtgatggactagtactttttttctgcataaaatctatccacacacaacaggcagaattgttttcttggatccatgtgccaaaattcgtaaatatctgcaaatagcaaacgagtgagtaaaccgtctcctctatctgctatagccctttaagtctagagacgattaaaatgctacctccaatatatgtggtcgcaaattgatgtaagttctatgtcctacctatagaaatattcggcagccggttttcgtcatttagtatggcaacacttctttgggaccatattttcgtattggtcaacaaattaaaccctaaccaatttctaagtcctttccatgaaaaaaacgaaatctataagtcattgttgaccaatacaaaaatctgttactattacatccggtcccatattttcaggtgggaactaaatctagagagagtacccaatcttcaatccggaaattgattgacaaggagttggagatgtctacattgaagtggatttcaattttcgaaaatggtaaaggatcacattgcactttgaataaagttatacaacgttaaaagaagataaagatatgaacacattttatatcaaaggccttaataagtatatttgggcctattaaatcgaacctttaaacagaaaaactggcccataaaataaccgtggttgtgttataacaagccggttaagtacaaaccggaagcgactcgtgtttgtttagtgaagcgatcaagcgagcgagatcagtcaaatagctttttcattgttcctcagatcgaagaagaagaagaagagcttagcaacaatggtaaatctagatccgtccaagtgctttcagtcacagctaatttgatctctctatttgttgcttttacgatttctgattttgtttggtgtgtttgtgctcgttcccggtgagaaggcggcgaaaccgattgcgagtccgattccggtggcgctgtatccgactttatcggtgttcactcttgcgattggtctcgtcattaccgctatcttcttcatgtaagctaataattgatctgatctctagatcttcgaaattgccccttcttgttctcaatttatattacttgatgtcagattagtgaaacagttcctgatagattcgatctacctatgatttatcttgattttcataaagcttgattagtgtgtgatagtcatgactaggttctgaactatgaatcgtgtgaggctctcctcttgtttgttcactgtgtatgaagcttgaccaacattgttactgcttatatatatggtttggtcacaatgctttctcaattgctattctctagagataggtcttctaaagctcctgaagctacatgttcatcactttcatgatctctttgctagattaatctgttgaaatatgtgcctttcttattactaaagtttctgggtaaaaagtaagaaagtcatgggactcatctagtaaccttttggaaatgtgtgagctctatatactatcatgatataaagactcaaaatttatcaatgataaggtgatagtctatggaaatggaatcagtactctaatagtttcactgaatatgacaaaatgactgattatcgatttagttaagatacaagaaagttagatttgtatgattttcatttaagcgtggagcatttacctttcaaagggtggcaagttttaggagatatgattcggtttgttaaagtaatgtgcgtctgggctacgagagcatgtgggttagcctcgagtcaaaactttaagatagacttgaaccattcattttagcttctttgtaataaggtcatattggactcttttggtattcattgtgctggtttagattcattcagcccaacaaggagtgatcaaaacttaccctgtcataacatttgtgttgcagctatgaagctacatcatccaggaaaaaccgaagcgtcggaaaggagctcgctacttcagcagttgcatctgtcttcttggtatggattttcttcttcaccctcttgacttaagtttaagagttttctttaaatctaatgtttggttaaaatctgtttctgtgttatttgcagggttttggatcgttgtttttgctacttgctagtggtgtttatgtctgatccttcttcctcaatactattcccaactagttcaaagacaaaaaaaacagatttatctttgttcaagtaaaatcagagttatgaatgttaagacttgagaagtagcctttaaacaccaagttacaattaaattatcttcttcttttgaacgctaaaccgagttttggtttcaattttcaccgcctttagaacagcgtttgcgttgttaagttgatcagttagtaactttctaccaagatttagaagaaagctttactcaaattttgtaatgggaagatactgattatactctttagtgtgaagaaatcattttaattcgctaatttaagtatttgcctattgggtatttgccgggacgaagtttactccacgtggcataaataataatattataaaaaaaacaaaggagagtagagagaaaacgagagaaaagaaggaaatg

SEQ ID NO: 4430 - DNA, 3000 bp, Unknown; identical to SEQ ID NO: 4426
  misc_feature (1)..( 3000): cDNA_ID_1824167_gDNA_ID_1620705_Annot_ID_48877 3000 nt of promoter + ATG

SEQ ID NO: 4431 - DNA, 3000 bp, Unknown; identical to SEQ ID NO: 4425
  misc_feature (1)..( 3000): cDNA_ID_1824163_gDNA_ID_1620705_Annot_ID_48878 3000 nt of promoter + ATG

SEQ ID NO: 4432 - DNA, 3000 bp, Unknown
  misc_feature (1)..( 3000): cDNA_ID_1824281_gDNA_ID_1620706_Annot_ID_48880 3000 nt of promoter + ATG
gctctcagagatggctattcagagcaggtagtggattgttcaagtgtgtctgtgtatggttatgagcataagttgctcttgtgtcagcttctttgcttcatagatttaagctactagcctactgtggtatatatttattacatgtgctccattattatatgacaattgtgttcctgggatgcagatagcagaagctttgctggaaattacacttcctagattttctggagacgtcatcccaaaaacagatgcaggaatggttttggcaataggtgataggtaaattgaaagcctaaagttttgttgtctctcccatttctttctacgccaaacggttcgtcctgtgaacacaaaaccttgtatctggattgcgcggagctaaattgtatatgcttctgatatgataatttttgttcgaatttgtgatcctatatactaacacctatgcttgtccctatgactgtagattggatagccttgttggtttatttgctgctggttgccagccaagttcaacaaatgacccttttggccttagaagaatatcatatggcttagtaagtttatagatattctgatctgaaaatgagctattatgatatgtcattttatggttgcatgaggttatggatgccaagtaatactttgtatgccacaggttcagattttggtcgagaaggataaaaatgtcaacttcaaacgtgttctagaacttgcagccagtgtacaaccgacgaaggttgaggcaaacactgtagaagatgtgagaatcaattgagtggcatcaaatcttgttatcaccatctgaaattgttcgtgacataattaactcttttatttgtttctaggtgtatcaatttgttactcgaagactggaacagctattggttcgtgcaacttttgtgatgtttatctttttcgatttcccagctcttaaaatatcttacgggtccagttcttgaaacaacgttttatccttttttacaggttgacaacggagtaagccctgaagtagttaggtctgtcctagcagagcgtggaaacaatccttgtctggcagcacggactgcatacaaggttagtgacttgtgatatgatccaatagcagttagctagggaattaggtaatagttgagaagcctttgggcatcattctcctagtgaatgttgctgtgtcatagtgatattgctccaaagaagctaacatcgctggtgcttgccttgcagacggaaaagctaagcaaaggtgagatgtttccgaagatagtggaagcatattctcgtcccacacgcattgtccgtgggaaagatgttggtgttggagttgaggtacttgaggtttctgtctgatcaaagagcatttgtgaaaacttgcagcttctaacattgaatgatgcaatcaggtggatgagaatgcatttgagactccccaagagagaacgttgtggagtacttacacctctatcaaagatcgaattcacactggtaactcactttcttccctgctgtattctctcaaacaagctcgcttccaaattcgtctcactaaccttccaaatttcaggcattgaaatcgaggacttcaccgagatatccatgcaattggtggagccactcgaggatttcttcaacaatgtatttgtaatggtggtaagttaaaactttgtccatacactgtactcgagtatcgcagacgagtgaagtttgaatataacggtttttgcaggaggaagaaagagtgaggaagaacagactcgctctgcttaataacattgccaatcttcccaaaggagtcattgacctctcatttttgcccggattttgatctttacttgtttcataatcccactccggaatcatcaattcattgacctctcattttttctttgtttcataacctcatatagttgtgttcactgagcaaaaattcaaactaaaacttgtgcaatggaatactttaaaaacagtttcataacctcaataaaaagatttcaaagatttttagatacttctgattgagatgtgttctatttcaaaattctttttttttttctcacaagtgatagaatttattaagctttcacaatatcatacataggctttaacaaaagcccaaacagcaggtttacagaaatagccaacaaagaccaaatagataaccgacttctgtagaagaatttcaatctaaactccatccatggaaacgtgtcgacaaccggttaaaccacgtcccacgcctgatgagtaatcacaagtttttccggcaacaacctccaccgttgagcgccgattccggtaagaaatcctcgccgataaggaatcgaacgaagactcttatgttttgcaccgaattgaaagcatcgaagctccaattaaagtaacagcttaagggaccatgataagcgacacaagaaaatcttctttccttcaacaaaagagtgaaatctctttgaaatcattctgtaaatccagagtacaaaagaaaaggatccgaaatttatcttgaagagataagaaactaattcggatcggagtaaaactcaaaggacagagacaaagaagaaccaccgtggatatggcagatcaacatccctaatcgtagatccgatgagattattagcaaattaaaaacataattgaaaaattaaagcaaaaacagaatccggccatggccgctaggttagccggtcgatgccgggcaaaagctagccaccgctacttaggaagccagtcggtgctagacgaaagccggccatcaccgttgagaaaaacggaagacgccggacatgtagccggataaccaccggacggcgagaagaagagcgtattctctctctaaaatattcagagagcgagaagagagagaaacactgacgaaaatatagattttatgggctaacaaaattcaaatgaaaacattggattataagatggttaacaaaaatggttgagaaaaaaccatcgagagaaccaaagggagagaaacggagctaagttatg

SEQ ID NO: 4433 - DNA, 3000 bp, Unknown
  misc_feature (1)..( 3000): cDNA_ID_3073293_gDNA_ID_1620706_Annot_ID_165315 3000 nt of promoter + ATG
tgacaaaaaccctcgatatgaagcatctgacaccagaacatgttttttcaacgcagacgtgtaccaaggaggtagaaatatggcgtcatgtttgaggacaccgctggaagtaaacaatgatgggggtttatctgatgacacaatggagtctaggagctcaacaggagttaccatatttggcacaggtcttcagaatgaagttggcgaatacaattgctttttaaatgttatcatacaggtaacccttcacttttcataaacggtttgagttcttgggaatatagtatctataattccagcttaaagacttatttttgctgaaagctattttgttttgttttgatcttagtctctatggaatttggagctgtttcgagctgagttcttacggagttcaacacgagagcaccatcacgtgggagatccttgtgttgtctgctctttgtatgaaatctttaccgctttgagcgctgcttcaagtgaaaaacaaaatgaacctgtggcaccttcatctctcaggattgctttaagtaatttgtatccagatagtagtttcttccaagaggtaaaagaatttgattactggttttaaatgtttatcctaatacaatgtaaaccttcatttcattaattagcctaatcctgggcgtcatatggtggacaggctcagatgaacgatgcttcagaagtactggctgtgatctttgactgccttcatcgctcatttgctcaaagttcaagcgtgtctgatgtggattcctcagacagcaactgtactggttcatgggactgtgccaaccgcacatgtattgcccattctttgtttggaatggatatttttgagcaactgaattgctacagctgtgggctggagtccaggcatttgaagtacacttcctttttccataacatcaacgctagtgccctacgcaccatgaaggtatcgtatgagtgttcatttgattgcgttttcacatatataatttgattattcactgtggttttgtcccactttacgcctaataggttacatgcgctgaaaattcatttgatgaacttcttaaccttgtcgagatgaaccatcaactagcctgtgatcccgaaaccggtgggtgtgggaaactcaaccatatccaccatattctcactactccaccacatgtatttactacaggtaaaacttatttttaggattttgatgaatggaaattttttcagactgctgatatttgtgtcttgtcactaattattttggggctggcagttttagggtggcaaaacacatgtgagactgtagaagacatagcagctactcttgcagccttgaataccgagatagacatcaacatcatgtaccgtggtctggaccctaagagcacatatagcttagtttctgtggtacgcatttcttcctcttcttccctatgatattatcagaagagtcgttaaaacaccagctatgtgctgtgttttccttgtgtgctttcaccctaaaaacctcaaggtaacaaattgttcttttgctatttctgcaactccaggtttgttattatggacagcattatcattgttttgcacatagtcgtgagcacgatcagtggatcatgtacgatgacaaaaccgtcaaggtaagattatcaatgcaatgggttttgcgggcagcagatacactcgtggacattatcacccagtttttgtaatatctttcaggtgatcggtagctggatcgatgttctttcaatgtgtgaaagaggacacttgcagccacaggttcttctctacgagagacgttaaaataaaaaagaagcaaaacaaatgcagaccaagtagagttctgttgctacaatttaggagatctcgtaagtacatactacaaaggaagtaagtacgtttttttgacaagcagaagtaaactcgagaggaaagaatgtgattttacactcatctcagtggttctaacttctaagaggatggggaagacgattttgtctttaaaatttaagcaaaagtgttttcagtggaagaggtcatagaagaagatatcatgtagttttcttggttacatccttgtcacattaaggattatatgttcatataaatctatttcatcggtcatctctatagatcatatcatcattatacatatatcatatcttgtcaactaatgaaaatgaagtcagaagttaggagagaaattgcagaaactctaatccaatgaaatctctacatatcattcttttaacatttactatgtgactatgtagtagtatatgtttcttattttcttttcaatccgactgtgtttaacacttaggacttaaccgtaataaaacgacatttgaaattaggatttgtgatcgggtaagtgattcgaacattagaaagcaaactaacctatgaggctatgactttagttggtcgagagtcggctttcatatgcggcatttgcggggtcaatcccgcaaagaggcagcctgaaggcactcactagggatagctcttacaatgagcaagttgacaacctcatgctccttgccgatcctgatgaatatctgtcacagtgggcaagttgtgccagcatgtagcggttccaaaaaacacagcggttcaattcgcaaaccgagtagttcgcttcgtctggtaaagtaaaccataaaataccgatggttcaactagaaataattactaatcgaagtaaaccggtttgtaatcgctaatgtaaatctcttttttggtttagtgacattcttctgctccgtagcgagagagagagagagagcacaacaacgactcctgtgttactctctctacctctatcccctcaccaacaatctccgccgtaatacgtggccgggatctctcaggcgacgccgtctgttgactgtaatttaatatccgattttgaccatctttgcccatttggtggcgcgtatatatatatacgtacgcgtagagtattcttcatgccgataaaattaaggtatttaagctgaatcgtgg

SEQ ID NO: 4434 - DNA, 3000 bp, Unknown
  misc_feature (1)..( 3000): cDNA_ID_1824227_gDNA_ID_1620706_Annot_ID_165308 3000 nt of promoter + ATG
atccttattactatgatacgagatatactgcatctaatgtaattgatacaaaaacgatatataaaaatactcggaaatttttcctgtaactctcctttgatccactatattgtattgttttaactacttaattttttttttggtaaggtgttttaactacttaattgttttctctatttgttaaaaattgtattacatatcaaatcttatatctctgatttcctttttttatttggccgcatcttttatccaaaatgatccaaaagactccaaagacaagatccaaaagctttttagcgttttaaggcgaagttgtaaagagatattgatagtttattactatatatgatgagaaattgagaatcataattatcctctatcggtacttagcattcagtcaacaatatttgaccaaagatcaatgaagtaaaaagaagatatatatgtacacagtttcttaaaatatatatatatatatattttaatttctctgactaattaactaatctttgtgaatgggtcaagagataaagaagcgtgcaagaaaagataattagagcataatcaaaccaattaactaaggtttcttattcgtcatactcatcatacgctcatccatactaagggactaattatgggaggagccactctttgagggattacctagaagctataataggttacgtgcacgtaaatgacattttggaatggattgatagataagttacaccatgttatttgtatcatcactttaattttgtagagtccgtaaaattttaaattttgttaatgtttttagtaatgttaagcacacttgtacaaattaatattttccgaaaattttatacggtttgctttttaagaagtgacatacctttagttagatttataattggtcaagtatggtttgtcacccctctttagcttcagttcgactatcagaagattttatgtttatgctaaattcttttctttttttaaatatgagtttattatttttagctcaaccatacataagtaaaccttaccaataaaccagtatcttaatctcaaaaaacaaattgtcaaacatataaactcccattggtcactttatattactgcaatacgagatttaccgtttaactaccaatttcaaaaacgttataattttttttctttcatttttcgtattgttactttttactgtttttaattattttgatattgattacaacttatctatctttcaaaaacgttgtatcgttttctattattaaagaaataggatccgaattgagattaaaattaaaagagtcgttgagggactaattaaacatgttaataaagataagatgtggatcccggttccggggacgggagagggaaggtcatgtgccattagggtaggaaccaccgagaggatgtgtcacgtgtcacgtgtgttggacttaggtgtcagaatggttttgaatggaaaaacaaaacaacgattctcagtagtcaataccccacacgatatcgtcatctttgttgtcttcattctttaaaataaataaattgaaaaggtactagtagttgtctagttccgtacggtacccgtccgtactctctagagcaataaatctttccatgaattttctttttctatctttctttcttttattcttaaaaatctatacttttgagtcttgacattgtatctatcttgtaaccttcaaattgtgagattagtagaaaaattgatggaattagtagaatcgcgagatctaatcaatttatatgaagagatataagtgaaacatatatatctgaaaagatttttttttttatacgagtacatcatcgaccatgtaatgtttgttctacggaaaaatgccaataaggtaaagaagttattgtgtaattgattttacgtcattttaatgaatataaataattatatgcaatctcacttcctctaaaaatcccacattcgttcttcgcaatatattatcataacttatctcgttttgttgcatttttcttccaaatgcatccatatagtatgaaagataaaacatatatataggattctataactctttttttctttatattttcacaaagatatgacaacatgaaactgtcttcatctacttcttctaatcagtccaataatcaacatttcaaactgattaggaccaccgtctgatccatttcaacaaaatccttctcttcatcgttccggttctcacgactagtcctgtggttcctatgtctctttttgactaatcaagctttttattgatgtatcacaatttttttttctttacttctgaggcacctatgacctatctaatgttatctcttaagaaaattttaatgagagatacatttgcttcatggacttcgatgattatgggcctattatatcattttaggcccatttgaaaattgaagttttgtgggtctcaaattaagtcaatacagtcagatgttgtgtgtccgagagcaagttaataatcatggacatgttaaagaatggaatcctctttttcttgtttattcgcatgtctgtttcttacagcattggtttgtctaaagactaaaattaacacgttatatgtttacaaaataaaaaaaaaggtaacatgctatgtagttttgtaattataattatgattatgatattgtaaaacaaatttggaaaatataaataagatggaaagagagaaaactaaaatagaataagactgaagaatacaaaaatgtaaaaaaaaaatcagaaacttttccatatatataaaattaagaatgtgaaaataagccaaaaacagataaaaagagagaattgggtaacaaaataataataattactcttttgtttaacgtaacggtggaaacagccttccctcttccctagtctcccacgcttctgtttcgcattttcccccattttctccggcgacggccaatcatcatcaaccgccggcgaaaacctcagattcgtgaatctgattcattcattccgtgattaag

SEQ ID NO: 4435 - DNA, 3000 bp, Unknown
  misc_feature (1)..( 3000): cDNA_ID_1824231_gDNA_ID_1620706_Annot_ID_165307 3000 nt of promoter + ATG
gcccataatcatcgaagtccatgaagcaaatgtatctctcattaaaattttcttaagagataacattagataggtcataggtgcctcagaagtaaagaaaaaaaaattgtgatacatcaataaaaagcttgattagtcaaaaagagacataggaaccacaggactagtcgtgagaaccggaacgatgaagagaaggattttgttgaaatggatcagacggtggtcctaatcagtttgaaatgttgattattggactgattagaagaagtagatgaagacagtttcatgttgtcatatctttgtgaaaatataaagaaaaaaagagttatagaatcctatatatatgttttatctttcatactatatggatgcatttggaagaaaaatgcaacaaaacgagataagttatgataatatattgcgaagaacgaatgtgggatttttagaggaagtgagattgcatataattatttatattcattaaaatgacgtaaaatcaattacacaataacttctttaccttattggcatttttccgtagaacaaacattacatggtcgatgatgtactcgtataaaaaaaaaaatcttttcagatatatatgtttcacttatatctcttcatataaattgattagatctcgcgattctactaattccatcaatttttctactaatctcacaatttgaaggttacaagatagatacaatgtcaagactcaaaagtatagatttttaagaataaaagaaagaaagatagaaaaagaaaattcatggaaagatttattgctctagagagtacggacgggtaccgtacggaactagacaactactagtaccttttcaatttatttattttaaagaatgaagacaacaaagatgacgatatcgtgtggggtattgactactgagaatcgttgttttgtttttccattcaaaaccattctgacacctaagtccaacacacgtgacacgtgacacatcctctcggtggttcctaccctaatggcacatgaccttccctctcccgtccccggaaccgggatccacatcttatctttattaacatgtttaattagtccctcaacgactcttttaattttaatctcaattcggatcctatttctttaataatagaaaacgatacaacgtttttgaaagatagataagttgtaatcaatatcaaaataattaaaaacagtaaaaagtaacaatacgaaaaatgaaagaaaaaaaattataacgtttttgaaattggtagttaaacggtaaatctcgtattgcagtaatataaagtgaccaatgggagtttatatgtttgacaatttgttttttgagattaagatactggtttattggtaaggtttacttatgtatggttgagctaaaaataataaactcatatttaaaaaaagaaaagaatttagcataaacataaaatcttctgatagtcgaactgaagctaaagaggggtgacaaaccatacttgaccaattataaatctaactaaaggtatgtcacttcttaaaaagcaaaccgtataaaattttcggaaaatattaatttgtacaagtgtgcttaacattactaaaaacattaacaaaatttaaaattttacggactctacaaaattaaagtgatgatacaaataacatggtgtaacttatctatcaatccattccaaaatgtcatttacgtgcacgtaacctattatagcttctaggtaatccctcaaagagtggctcctcccataattagtcccttagtatggatgagcgtatgatgagtatgacgaataagaaaccttagttaattggtttgattatgctctaattatcttttcttgcacgcttctttatctcttgacccattcacaaagattagttaattagtcagagaaattaaaatatatatatatatatattttaagaaactgtgtacatatatatcttctttttacttcattgatctttggtcaaatattgttgactgaatgctaagtaccgatagaggataattatgattctcaatttctcatcatatatagtaataaactatcaatatctctttacaacttcgccttaaaacgctaaaaagcttttggatcttgtctttggagtcttttggatcattttggataaaagatgcggccaaataaaaaaaggaaatcagagatataagatttgatatgtaatacaatttttaacaaatagagaaaacaattaagtagttaaaacaccttaccaaaaaaaaaattaagtagttaaaacaatacaatatagtggatcaaaggagagttacaggaaaaatttccgagtatttttatatatcgtttttgtatcaattacattagatgcagtatatctcgtatcatagtaataaggattaccaatccaaagtgtaggatgaaaaaattgtaatcagtgttgtccctaatagtactatccgtacgtatccatgtgctttcttggtaggtaatatattaaataacattcgatatctttaccggcatttttattaagctgcctggttagtagtaagtacgccattaatagtaatctctttaattggtctctaaatacacttttatactatttccctattaaaataaggcttttatgtttgttcgcctgacgcttgaaaaaatccgtcaaaagaaagaaaattgagtcttatttgttgactgtgtctcataataaggtagtgccactactactatagcggttttatcatcttctacgcttcgatttcgtcgtcctcctcccaacaaagtttgttaggaaacgaatactcgaacagccatttcttctctatttctcggtacggagtttcatccgttaagctttccgattgttccgtttctggtcaactattttggtgtaattttggattttcctttgttgtttcgcttctttttattgttgcttgagttctatcactatgctttcatggagaattcttggataatcatgctggtgttttatttcggtgcagtgcgatg

SEQ ID NO: 4436 - DNA, 3000 bp, Unknown
  misc_feature (1)..( 3000): cDNA_ID_1824235_gDNA_ID_1620706_Annot_ID_165306 3000 nt of promoter + ATG
tagaatccctaatccagaactatctttgtataatttttaagaacatcagtttcttggtctgaagtccatattaattttcttacatgcatgtgcagccaggttctttttggtctgcaatgccatgaagtcttccttgaattgttattttttttttagtttaaagtaatgtatatttgtgtgcattaaaaaaagaagaagcaaatgtttagtgtgaacactgtactacaaaataatttggagttgggatctttcaagtcaaaacctaattgaaaaggaagaaaacactggttatatctatgactttattttgggtcggcttaataacggagtttaggactttataatgtatacgattcatcttgcacaacaatctacacgtatgaaaactataattttaaatactaagtattcatctagatattctgcttatcaggaagatttgtttatcttttttttttttgtttatcttgaactcaaataaagacttaagaggatatgagaatcaatttagtgaaacaaatgttgtgtagataagatcctgggtccacagctttgtcaacaacaatgacttgtcatcgtctatgcctagcaagtattataatagattatagacaattatgagcgaataaaaatcactcagtgaaacatactattgaataatttagaggaatctttcgagaattcgaaagaggacacaacatgtttagctggacgatcttctaaggtttcacctatcggatcatatattacgaaaaagtgagagtaattattaattatgagctccaacaaacaagagcaactcaaatcaaaacttctggactagacgcagtaattaattagaaagaaaaagacacgacaattaaagagaaagttattctagaaattattggaacaggaaagcttcctctatatatttgcgatggaaacagaaaaaaacaatgaaacaaaaacatagccaaatgtttttaccacatgattttaccaaagcttattagatcttggttcttagactggcgagaaactgagagagatcggtggaggaaaaagggatgaaatatatagaagttggattttgcttcaattagggttttgatttgatgatttttttttactgaaacagaaactgaacggtgtttctaactgtgaattaggatggtgttaagatggcaaatattatatgtaaaaactctagcgtaaatatccaatgagatagctagttagatattgttttggcaaatgctaggtgtttttttggtatcatttcccctaagcatgtgtgtgtttaggtttttgattaaaactagcaaattctgtggactgcaatactcatcatatatgccaaacttcgaaatcacatcaataataacctcaataaatgtgaagtaactaaagtggaccctttgcctcttgtctttacatatgtaatcatccatttatgaacggaatcttatgaaatttatgaaccgataagtaattaattatttattttaatttatagtcttttttctaccccattggtaattttggaaaccaaatatccaaagcaacctctatcgctttacccccacccccatgcaggtatacgtacaaatgtgcaatttggtcggtcaactgggtcttagtcagtagccaaatgtctccaacattaaattgtaagagaagatggcaatatgcattcatattgtaacaaacgtatatgtcctctagacgggcgtgatctacctttaagattagttcaaaagcataaagtcgactgatagcacaaaatgatgtcttgccaaatgtgtatttcgggtagttcgatgtttttgggatcggcaaaagttatttgagaagacattcatatatatatatatttttgatttacgggagtagggtaaacatagaacaatacactttatagatatttatatatacaagagaaatgtgtttttaattaggattagctgggaaaaagagaggctggctctagatcttttatacagacacctaccgacttataattattatcactgcacatgcatgtggatcatatatattaaaagtaaattacatgcataacttacattaaaactaattattcattattcttgtttagtttttgatacttataaaattttaaattctttatccataaaactagaatttttttagaaatataccatttttactatgtgtatatatatatatatatatatatatattttaaaattgaccatatgtgttgtccattttcaattatacatatttcaaaaataatatatttaatgtctgtgacggcttatagtggttgaataatcattcatatttataaaatcttataattcatttagaaaatcttgtatttaaattttttttttataaaaaatcttatatatcgttatacataattgaaaatatacaatatatgcggttatttaaaaaacatattacttggatatttttgaaattcccccataaaagaagggattttttttgaaatagctacaaagaacataaattagaaagtatgttgactttattcgtaaattataaatgctagtagattttagagagaaaaaaaaaacgaaacctagtttttcttttacgcaaccgaaacctaaaattattaaattgataggtttgacatatataatataataattcgatcgaaaaatttgactacagaaatctgaaatcataaacttggtgtaatgtaaacatacatatctcattaaacaaaaaactaatatataaaataattgacttttgaaacaatatattgacttactagtgtaaaaatgggcctacctaaatccagctaactcagcccacacattaaaaagaaacgttaaagggaaagtaataaatgaaaatgagtcactcagagacagatgtctctatctttcacagccaaattcacaccattctttattttcatttttccccctttgcccagattccgacaaaatccactcgtttgattccaccactatatataattgagcggagaagcttgac

SEQ ID NO: 4437 - DNA, 3000 bp, Unknown; identical to SEQ ID NO: 4432
  misc_feature (1)..( 3000): cDNA_ID_2175536_gDNA_ID_1620706_Annot_ID_165283 3000 nt of promoter + ATG

SEQ ID NO: 4438 - DNA, 3000 bp, Unknown
  misc_feature (1)..( 3000): cDNA_ID_1824277_gDNA_ID_1620706_Annot_ID_48881 3000 nt of promoter + ATG
aaaagttcaaaatccataaacaagattagatcaaaacttcatttttttttaaattttttttcgtcaaatcagaacttcattttaattttgtgaaaacaattgaatcatcaacaaaacttactttgatcttcttcagtagttcatatccagtcatcccaggcatagagtaatccgtcattatcaaattaatcttcagatcctaaaatataatttcaaaccaaaaatcttttaacaccaaatttgaatggattctcactctcaaaaatattaaacacaatgatcagatttattacctcaaatccaaccgaactattattctctccatctaatccaagatattgtaaagctcttgtcgcactatcgacaacagtaactgagacagaacaaaactaatgtcagattcttgtacttaaacagattacacaagataaacaaacacaacacttttttttgataaacacaaacacaacagttacctttacaagatgagactctgagtaaccgctcgatgaacttccgatcaaccatactatcatcaacagcaagaacatgaagaagtttcggtgatgctaatgaagaagtgtcgttagagatatctaacatctcgggacgcaaaacctcagccatatcaagaagagtaggatcgtgactcgtgagagagatagagagaatcaactatgaggatttgattttgctgagagatgagaggagaataaatggatttataaaggaagaaagaaggagagggaaaagagaaaaatatgatatggggagaggattctgagagatctttgcatatctgtgggattttgtctgtctgatagcgcgtggctaattatttgtttattctgttttcttctcaaaagtcatattttcaaattttggctaaacttcaaataaaaataaaatcaaagtcataaagttttttaatattttttttgttgagaatagtcaagtaatggtgagtggtgaaatcatatgatatgtttgatttgggaagggaaataaaatcaattttggatgagggaaatcgtatcatgacgatctctctcgattattgttgtcaagatcatggctactttgattcatttctttttatttttgtacattttcgatactttcttgattttcccatttttcaagaaatgtaccacagagagaagatttgtatttcaatctacaaaatctttgagattgttaattaattaatgaacattgttggaaaagttagctgacatgtgaccgccagattgactatttgggcgaatgaatttcaatgttgatatctctagttgcgcaatcagataaattcaagatccgtatgtgtatatttctagaaacaaaacaaaaaatcattatttttcaagttattgttgtttgtccatctcgtaactgtaccataatagttgcctctactatcgatcgtggtcgaatggcataagattgatgagttaatagtaagttttcatgagtgttcaaaaaaaaaaaaaaaaatagtaagttttcatgaaaataaaatttcaattcacttttcttgaaaaatattcatatgtttacttgaattttaattcgctttttctataaatttggcgttcttttattcacatatttagcaacacgcatcgagtatttccacacgtgagagatcttttgacaattgatggaaggctttgtcacgacaggatcgaagatctatggactaaactcgaccaatatatttcaagaatggtaatgactaaatcatcattgaaagctgaaaatatgactatgatcgatgtatctctagaggagatatcaaatgaatgtgaggtactaggtgtatagagcacatgaccttactatatatgtcaaatttggtttggcttgcagagaaacggctcggatttctccatgatggttgtttatcagtatgtatatgcgtgtcccttcagagtaagtctacacgttttctctacttgtatatttggaaacaacatgagtttaccgatgaaattattgttttaatatatatgagtgttttggctatgtacatgagtccgagcttagtgtctatcatagtcaaagatcacaagatacatttatagaacttactattgtttgatcaaagaaattaagttaacaattcataaataaacctcttaacagtttatggcaaaaaaaagaaatgccagtaaaatttgttaggcaccaaaacattctataaagaataatcctaatggtctcggtttttacctctcaaatagtatgagaggctgaagacaaatatgctttattggtttccttacaaaaaccaacgaactttcgtgttaactgtctatgtgatatgaattggtacatgcatgttgttgtattaggttcttttgggacatctgataaaattgggaagatgttagcatggtctaaataaaaatgttcttgtattatacttaaaaaaaaaaatcttttctttgtgtgtgtctcaatttcactatatgacaaaggaaaatgttataaaatgagaatcaataagctaatatatgattattcaaaattatattcggggtccaaattttgatttctctacgtacgtaatcttttgatatagaaattttaagttatggattacaaatactcgatttattttatgaattctcctattctataaataatcgtgagtaactgaattacttatattcaattgttattcatcattcattgattatatatctgaaattatttaataattatctataaatgtacaagattattacagcttacaattttgtttttgttgcttagtgaatttacattttagacttttttttttgtcaaatacattttagactaaatggtgttttcttttgaaaaaatcatatagtttaggtcgaaccgcgaactcgagagagagaaaagaaaaaaggaagaaaggataacacaaaacctctctctatctctctcgtcttccaaaaatcgagcactacacattgactctcttctacaaagagtctggtcacactcatg

SEQ ID NO: 4439 - DNA, 3000 bp, Unknown
  misc_feature (1)..( 3000): cDNA_ID_2992453_gDNA_ID_1620706_Annot_ID_48883 3000 nt of promoter + ATG
tcttcattagcatcaccgaaacttcttcatgttcttgctgttgatgatagtatggttgatcggaagttcatcgagcggttactcagagtctcatcttgtaaaggtaactgttgtgtttgtgtttatcaaaaaaaagtgttgtgtttgtttatcttgtgtaatctgtttaagtacaagaatctgacattagttttgttctgtctcagttactgttgtcgatagtgcgacaagagctttacaatatcttggattagatggagagaataatagttcggttggatttgaggtaataaatctgatcattgtgtttaatatttttgagagtgagaatccattcaaatttggtgttaaaagatttttggtttgaaattatattttaggatctgaagattaatttgataatgacggattactctatgcctgggatgactggatatgaactactgaagaagatcaaagtaagttttgttgatgattcaattgttttcacaaaattaaaatgaagttctgatttgacgaaaaaaaatttaaaaaaaaatgaagttttgatctaatcttgtttatggattttgaactttttaacaggaatcatcagctttcagagaaataccagttgtgattatgtcttcagagaacatcttgcctcgtatcgataggtatattctactataataatcttaactatgatccttaattcttgtttaggtcaagattatgtaggaccaaaatttaccaaatatagtagattttgtgcatttattacttcaggagatggggatgattagatttagagggtattgtttgtttaggaaactttttaaagtaatcacactaatttaggatttgtgataaagttaccgttaaaggatatgtattgactaaattaaattgttgtataatcacaagattttgttatgatagaaaaggttattatatgattactttttaactatcatggggttaactttggtggtggttgtatatttgatcaagctgagatttggtgtttattttagtgggtcctaaaatgatttttaaaatggatcttaggaataataaaatttatcttgtggccataaatttagaaaagaataatccatcataagttaagcaagatcttctcttgagatttgattctatataagccggtgacatgttaggccctccaaaactttataatatatgttttaattgtttgggttgcataatcttaggtagggtcatttataaaatcccaatcctcgtgatagacacctcacatgcctttgcttattactaaggaaccaaaccctctttaccagattaagtttaatgattatcatatatgagctggccattttctgtatccaaagttataaactttatggaattagatcactaacatttggttccttatatttattcagatgtcttgaagaaggagctgaagatttcttattgaagcctgtgaaattagctgatgtgaagagattaagagattctttaatgaaagctgaggaaagagcttttaagaatattatgcacaagagagagcttgaagctaatgatatctactcgcagctaaaacgcgcaaagatctgagtttatcagattccacgtacgatatgttctttaaaagctcaaagattcacacacatgcatgtcctgattctttcggcttacaatttttgagacattacggcttcttttgctgatagaaccaagactgatcaagagtgacaaagatgggtttttataagatagaaatgtaaattgtagacttggattcattagagaggagaagagatacattttttttttctttacatgagagatatgtaaaatggtggtgtgttattttggaagttaacatatgaatttcttttgttaagattacttaaataatgatttaggaatggattagtagtttagtaccgttcattacacgaagacaagctaatcttttgtctaattaaaataaagctgtctacatgaatcgaatccagcgagataagttagttattttaagcgttggttggaacactttacatggcttttcgtagaaatttccccaagttgggttttattaagaccaagaaaattctagtctcctagacttttttttgtttcttttgttaatttagtctcctaggctttttcattctatctgaaagcaaaatatggttatgcaatttggtttagccaaaaaaacaaactaaatttttctagtccggttcatgtaacttcataatcaaacaagtaaaagtcgaatgtgacgcgtcttgccgaacgcaaaaacggaccaggcaagaaggtgtagttagttaattcggttaatattcagctgagagaaatcgaaccggttccatatcttgtagattatccggtttactttccggataagatttataagcaaaacagagttaaagtagtagatttcttctatacgagaccaaatctgaaaacccaagtcaagctacaaaaacttaactccaagcgaacaaatctcctcattcattaaacaacaaaattgttttccgacaaaaaagtgaatatcattgagttactgcgaaatcccaaccgagagtgacatctcaaaccaaaagatggagtctatattaaagagacgaagactccaaagtcaagctacaaaatttccaagcaaagattacacagagaaaactttccgaccaaatgtgaatgtttatgaaagtttctgcgaaactccagtcatgtcggatgtacaaagccatacaccaatgtaaaaccgacacgtggaaagctaagattcctagcttttctttcttcatgagtctccaatagccaaagagtcaactccaaaaaaaaaaacccatttttgcattgaaatggtctcatgatggggtattttgggtaactaattagtcctgtctacatcttcccataaattaacagagtaggagcggattaaagaagcaagacgattcaaaagaaaaaagagagaagaaagtccactaaagaaaagagaatagatatagatca

SEQ ID NO: 4440 - DNA, 3000 bp, Unknown
  misc_feature (1)..( 3000): cDNA_ID_1824269_gDNA_ID_1620706_Annot_ID_48886 3000 nt of promoter + ATG
gctgctaaaattaggaattgaattcatgccactaagaatactgttagggctattagaaagtgactcaataaagctctcatgacgatgtgttccattgttatcctcatctaaattctccaccggacgcggaagatctctctgatcaggcttttcactcccaattcttcgattggattccatttcctccttatcccctttgttaatcatcgcaactaataacaacaaaaacccaaatcaatataaacaaaatccacatgtaaagatagatcatttaattttaccttgagaaagccattgttcacgacgaagacctagcttgctctgtttcaatttggccgacctgttcgtctgcaaacccaaagagtgaaatcaaatctttgaagagagaaatgagatttgaggaaggattgaaaacaatacccttttcttttttccgaaatccctggcggttggagctgaagtagcagaagcgttggtgatcgaatcagaaatcatggtggttgcagatgattccaaagcaacaacaaaatcaaatacaaataaatttcaaaatcacgaaatgaagatttctcaaaaaccctaatacagatttgttgcgagagagaagaagaagaagaaacgtgcgattttttatttttttttgctttgtttgttgtgtctgtgagagaaaacgagagagagagagataaaataaggggataacggaaactcctcgtctccgcacagaactttccttctgactaaagtaccctttcttttgacttttgcacacgctcgaatgtaggggtggttttgtaattgtgatggatctacacgtgtgagaaacttctgttcatttaaaaacggtggcgtacggtggactacacgtgaggatagttcatatgattcacaaatatcagcgagcttctagatcaatcagctgggtttcttctggttacagaaaaaattaaatgatttagaaaaacatcaaaaccacaaagtcaaagttgtgtctctttctttcaatttgatgaatcgatcaaacacatttttatcttatattttgatgtaacaacaaaacatgaaattaaacaggttaaaatagcttatgaaaattggtattagggagctaggaaactgcagatgagagttgaacaacatttaggtaagtttttaactaagtcatgattagtttattgtattttgaacattaacctgcaaaattaattactactataataagaaatcttaggtagcaacatgaaaaaagtaagaatgctaattaacaaattacattaaattttagaaagaaaaaaaataacatgttaaacaatattttttattgcatcaacatagttctaagttatgaaatgacataggatgataaaaatcgattttagtgaaatgacatgtaacttgtaatggtgaatcagttacatggtttaccatactttagagtgtatataacttcaatcgatcagtgaaccatttaagattacgtaaagatacatcaagtgcattaagagagaccaattgatctactcgacacaaacagagagtataagctagtgtctaagattgaccgataaataataataatacaaggatttggatttaatccttcaagccactctaacaattccaaaggcatgaagacagattatcaacatgaaaagctgaaacatgtggaatgttttttaattccacaattgtccaaaaaaaacaagcttttatgactttattacaagctaacacactgttcaatatgaaatcaagaaaagaatgaaaaaaaactgaaattaaagaataaatcctactcgaaatagacaaaccaacacgatggttcaaaagaaaaggtgaagttgagcagaatctgacttaacacaacaaacaaacaaaaacccacagaataatattcgggaatctacctgaaaaagagagcaagacacgcatcaatggaaaaagacttttatggatcagagatacaaacagagttttgatatgttatctcacatcaattgcagttcttgtgtacaaaaggtaacgccacacacactctcgatgaaagaaagagatttctgagtaaatggaatattaaaaaaagtatgtttgtttgctgcaatgcaaaagtcgaggttaaattcaaaaagcaaacatatacatacacatatgtgtgttacctttttcctagacaacaactgatcaaataaattactttattattagtatgaagtctgaactaagcattttccaaacagtttacattggctaatcgatcgaagtaaacgaacaatgtccagtgagcttaattatgcactagtgactagtgttataaacttcaaagggagtccaaatttcagcttataaaacctcgtaccgaattatgattatattagcgaaactggttttgggttaaaaacataacacatgtttatatagatagatattacatgctaacaactcatgatgagtagtaatgtgcaatgttagaaagtatggttcgttttcagaatccacctaacggttggaataactcgaaatgtacccatgagtttcctatctatatttagaacgacatgcataatcttgattgtgacactcagtaatatttctctctaacccgacccgacccgcccgaactctcccaagttacctttccccttttcgaccgtttctctctctctctctattctcttcttcgatttattggtgttttgttcgcttacgcgatttctcgaagaaaaattctcgtattcctggatcgaaacaaggctgattcggttactcgctgttgctgttgttgattttggatctgtgttttgttatctgcggatcgggaaattggaaaaaaacctagatatttgagccatttcgtcgcgaaattaggtttttttttttcaccggtgggtttttggatctaaaggtatcgaatattgtctggggaaaaaaggaattttgaggatttgtttgattttcgctgaggaaattgatgttgttcgaaggagaagatgatagaaggct

SEQ ID NO: 4441 - DNA, 3000 bp, Unknown
  misc_feature (1)..( 3000): cDNA_ID_1824265_gDNA_ID_1620706_Annot_ID_48887 3000 nt of promoter + ATG
cgaagccattctaactcaacaaaagcaaataactttcaacgaagaaacgcacaaaaaccagagagattgtgaaatagagagataaaatgaagtgattaacatgaggaagtgtggagaatgtacttcatgttatttttgaaaatctcaaatctgtagtcttttagatcgagcttcacaggaacatgatgatggcttgtccacctgctgtatagctttagtaatagatggatgagccaccatttggttccaatgaagctcgacctaaaagaaaatagatatgaagttttcagaaataacgcgaagttgttgggcattcgctgctaggcacctattgaggggattaactacgaaagtacgacccagttggtgatgttttctgcacaagaactaatttctgcagacaaagtcaccaccaagtttggcactcaaattcatcaagaaaaatgcaacccttttaaaggcacaaaatgtgaggtaaccatctatcaattcagatatgtagatgtagatctttcaacgaggcagccttatcaacgctattgcaatccggctttttttatcaaccacacattaattaaaagatgattccatgattggttacccaatctggaagaaaagagtttagatacgtaacttcagaaaataataatttagaaaaacgcggtagacaatccgccctaatattactcaaacgagaaatagaagatatcgaaaaagaggaaaaatattacggagcgatccaaactcatctagaagattggagaaagcgtgtcattcttcaagagactgcaccatcgagactagctctgtgcaatctgattcaaatgtctggcagtcgatccttcgtgaaaggatattcttcataacccaaattaaagcttccagctccgagtgaaggggagaagggctcctccagaggcactttgcacataagagtactgtttgatcaattccttgaaaacaccaccatcctaatcccatggttagatccgaagatttccatgatccatcaaccctacatctaatagaatgagtcagttgatccatagacaccctggtaacattcgattcaatcggttccagttgggccgcatcccacaataattgttcactcaaagcgacatttagaatatctaaaggttctgattgtaaacctttgaaaacctttttattcctatctttccaaataaactataaaatccatgcataaaagttatttccctctctctcatctattggagatggtaatccacaaaaaaagtaatgaagatttgaaaattccgaggttaaaggaaagcttcctgctattacaggaatcgaagacatttcccagacttgtcgagagtgaggacactcaaaatctattttttgtagtcaatttttaaaaaatatagtcagcctagtataactattcatgcttatggatatatttcgcaaggagtgatgacgaaaaactctggaacggatttgaactacgcaatgcctttggtcaagtacgggatgaggcagaacgggatataaatattggatagctaagaattcgtatagtccccaatgtggagaaggcgaatatattaggatcgagagagggattgctgattcaaacttggttacagaagagagacagagatgttgttaggattaaaacaaaattggttacacaatatagtgcgaccaaaaaagaaaaacatgcaattttacaaaatatggttgaaacaaaaggcccatgtcttttggtcctcaaaaactatttttgtgaattcagttgatgatacaaaaatagaaattcggtaaaataaacaatgatgcggttagatgtggtaagagataccgattaaatataacgacatgataagaaaaaataaaaatggactaaaaatactattaattttaaaaagaaaacaaattttgacagcaacattaaacataacaattttgctgtggattcaatggatgcttggtttcgttttgacggtaaaagaacaacttcgttttttctaaaggggcataaggttttgtgaaagaattataaaaaaaaactgttttgccaccatttttgttaatcgacttatcatatagcacttgtttttactagtgatatgcaatattacaactttttgtggaagaatatacaaacacacaaatcaaaaatccaagtagttattcatctaacttatttgtagttgatgaatggttatgtgtggttgagacaataaatataaccaagttgtaccgaatgaattggccatcactctattttaaacacaaaacagtgactatacacaatttcttaaacccgattgaaaaataatataaattggacaattaaaaaaaaacttctgacaagttttttggtttatttcggttcttcaaaccggcttgcatagaatcaaattttaattgtaaaacaaaaacaaaaaaagtaaagtcaaaaggagtaaggaaacgtggtcaaaaccgtccgtcactcacccacctcttaatctctccagtccctatgtcacctgaaaaagattggagatgacgtcacgcccatattgttttttcatttaagtcaccgcactgtcacgttatctttgccccttccatccacaactcctctctctaacccgacccgatccgcccgaactcgtccaagtcacctttcccctttttcgccccgtctctctctctctctctcttcttcgatttattggtgtttggttcgcttacgcgatttctcgaagaaaaaatctcgtattcctggatcgaaacaaggctgattcgattactcgctgtcgctgttgttgattttggatctgtgttttgttatcttcggatcgggaatcgaagccctagagatttgatccatttcgtcgcgaaattaggttttttttttcaccgataagtttttggatctaaagttatcgaatattgtcagggggaaaaaggaattttgaggatttgttggattttgctgaggatattgatgttgttcgaaggagaagatgatagaaggct

SEQ ID NO: 4442 - DNA, 3000 bp, Unknown
  misc_feature (1)..( 3000): cDNA_ID_1824255_gDNA_ID_1620706_Annot_ID_48891 3000 nt of promoter + ATG
tcgctttaatggttggaaccggttattactacggtgataatccgtggaagaagtgagctccaactacttgttcgttttcacataattgagatgacactcgggaaatctgcgggcaaaggtgtgtgtgctctcgctctgagtgtagaaatatgcggtcttgctaggatttagtaagggtacattacatgatttgaataatttgaagaacgaacaagtatcgttgtatcttgatcaattgattagattgatttaaggaaattctccgaaaaccatctttactctatctgtcaaaatctcattatctttctgccgacaatctctgtgttgtttatttacttacacttatgtttgagttttgacttcttgaaagatcctttgagaaacatgggacaatgcattatcacatagactctattatcaaaatatataatggcaaataagtgggagtgaagagactatgtattagaaggcaagctatgtttaatgatttcagaacatcttagtggaagacaatggtgggcctaatagtttcctaatcatattcttgtgtttttttccagcttattgtggttcttgaccttctacatgtgaaatcctaattacatttttggtctttttagtcaataatggttatggtttagctaataatcatgccaccaagacataaagatgggaccaatgagaagcttttggaatgatacacttttaaagcgtgtcttgatgtttgaaatctcatgactatattttacagtgactgatcactgagctatactcaaaactgctttttctcttcaaacaccaaaatgtgtaggttacttttgtctgaaatccatgaaactgaagctctttcacctaaatcttcatctgcagcaacactaactcttatgaaccagaaagatccatcttcaagctctatagtgtctgttttatgtttagttatctctggtcttgctcttatcatcgtcttcctcggtgtcctctacttgatcttcaaatttctccgcaagtcctcgactttatttcccattccccatttcaactacaacccagatctcttttctttctcctcgcctcagctccagcacctgttcttcctccatgactctggtctagaccagactgccatcgatgcacttccagtgttcctctatggtaatgtaaccattagtcttgaacagccattcgattgcgccgtatgtctcaatgagttctctgacacagacaagctcagactactccctgtttgtagccatgctttccatctacactgtatcgacacatggcttctttcgaactctacttgccctctctgcagaagatcactctcaacctcaaacgtctgctacaaccactcggagactcttgtcgcccccttgtctgggcatcagcaggtggatgacggcaaagcctcccttgctaaaagagttttctctgttcgtctcgggagattcaaaagcacgaacgaaagtcaaagtcaacgacatgatgtcaaagatgaaatcggggtaagaatgccaagaagatgttactcgatgggcacgcaacagtatctcgtatgcgatcaagattttgtggtggctctgtcttcgtctcctcgtgagggaaatatcggtcggtaataaatgctccattcacgagggtgattcggtataacaagactctggtagttggggtaggctctaatgttttgtagtgaaaagagagtatgtctatgtcaaagatctggttttggtcggagaagaagagagttctgtttattaaacaaaaataggtggttttttggttgcatcttagtcttccttgttacttactacagacatgaaatcgttagaacacaggaaaattatagaatcaaaatattagaccgtcgtgatacatttacaagacacgttgaaagaggagtaactttcaacgataaataataaatcaaaccaaacttaacttttaaacaaataataaacaaggaggaaacgcaactcatacgagagacttttcaaacgcctatcgtcgaactcgtccgaagagatatcatttcacggcgtcaacgctgataacagcgggagatttacctgaagcaacggggacagaagcgtagcgcatcgagaagcttctgactccaccgactccagcttcgtcgtcgtcgtctttgtcttcatcttcgaaactcaaagtgtaactcacaggatcgtatcggaatttgtcactatcgtcccagtcttgacctcggcgtggatcgcggttgaatctgcggatgaaagtcttccaccgtggcccagccacgatctccgaccattctcggatctttagaaacgctcgcacccaccaccgtggctcctggtggttgtttctgtgaattcgctgccaccaggaggatttaacggtggtggaacagcaagacgattcaccaagaagcggattcgcttgtccaacttccattacaaaagggtcgaaactgagtttgaagggttttggtgtaatagaagccaacacgaaactgtttttttagctgtaatcaaaccattggctgcaattttatattttaaacaatcatagaccaagtcacatataagtcataaaaattgtattgtcccctacacataatattcaaattacttttaaacatctcgatcatgaattttattacgaataacctaattaaaaaaaaaattgtatacctagatcacatctttttcattaagtttttgaccatcgagcaacataaatagtcaataaattgatttacgatcatcatcttttgttttcgtataatactctctgttgtttctttgtatgtgtctttaataaaattaattttagacgacaaaaacaaaatcagctaaactaatgtttaatatttgtcagtaattaacttttctatcaacgaaataatttttcatagacacaggctctctcctctccttaattgtctccaatatggtctcattcttctactcccacaaatctctcccttccataacttgaaacacacgcaacccccaa

SEQ ID NO: 4443 - DNA, 3000 bp, Unknown
  misc_feature (1)..( 3000): cDNA_ID_1824251_gDNA_ID_1620706_Annot_ID_48892 3000 nt of promoter + ATG
tcacttcctctcctttctttgataaatacttctactgcctttggtggggtctccgtaacctcaggttggttgatattcatctgtcttaaaacaaataaaaccgctgcttttggcgacttgttaactgatctttttttcttgatttggttttgtgtagttcctatggacagagtcttgcagcgagtacactgagcagtgagactatattcagttgtttcatttgtgtcgcgggtcttgttttcttctctcatctcattggaaatgttcaggtaaaattcaaatgaaaattagctctctccatagtttttaatggagtctaagtgatttctctgctttttgaagaactatctgcaatcgacgactgctaggttagacgaatggagagttcgaagaagagacacagaggaatggatgcgacataggcaattgccagatgagttacaagagcgtgtaaggcgattcgtccaatataaatggctaacgactcgtggagtcgacgaagaagccattctacgggctctaccattggatcttcgtcgccagatccaacgacatctctgtcttgccctcgttcgccgtgtaagccacaccagaataacaccacatttccattacgttccactcaagtaagaaaccctaattttacgttcttttaatttttcaggtgccgttctttgcgcagatggatgaccagctcttggatgcgatatgtgagcgtctagttccgtccttgaacacaaaagacacctatgttatacgcgaaggcgatcctgtaaacgagatgcttttcattattagaggtcagatggagagttcaactacagatggtggacggtcaggattctttaactctatcacacttagaccaggagatttctgcggtgaagagcttttaacctgggctttagtgccaaacattaatcataatctaccattgtccacgagaaccgtaaggactctctccgaagtagaagctttcgctctccgagcagaggacttgaaattcgtagctaaccaattcagacgtcttcacagcaagaaactccaacatgctttcaggtaatcctcgtatggtctcataagcaatataggtttcttgcttcacacgctataaggtttcttgatctttatgttttgactgtaaccagatactattcgcatcaatggagagcatggggaacttgttttatacaagctgcttggaggcgatacatgaagaggaaattagcaatggagttagctaggcaagaggaagaagacgattacttctatgacgatgatggagactatcaattcgaagaggacatgcctgaaagtaataataacaacggagacgaaaacagcagcaataatcaaaatttgagtgcaacaatattagcgtctaagttcgcagctaatactaagagaggtgttttagggaaccaaagaggatctacaagaattgatcctgatcatccaactttgaagatgcctaaaatgtttaaaccagaggatccaggattcttctgatagttgttgtgacaaatgcatttaggatttctgacactaacttgatttgctgtaaccaatagtcaggtatacaaagaaacattattacagattgaagtaattgtgacttgacgtcggtcgatattatgtcgatttctatccaacgcactcttggctcctacagcatttattggtacacaaagtgggctttgaaactcataaaacaccttgtgtttaagtctaattatgttttcacataatttaggtgaattaaaaaattaattaattataaattgaatttgggcaatgaccatattttggtcaaaaataatgagaatgacacttataaaagaaaaataaaggatatagtcatagactcattccactatttgattggacgaaaatgatttttgattacacacttcaacttgtatttttcttcgtctacatgattttgtgcaaaccaaaaaaaatatgtaatccctttcagtttattgcttgatatttttaatatataaactgattaaatctcgcaatcgtgtcaaaaaccatatatttgtcatttatgccataatttaattttaaagatgaatatgtgaatatagaatgaaatctgaaaataatattgtaaaaagcacatagaaaaaaaccacctttttctcaactttaatcattttcttgattagtaaccttttggagcagtagaattttctcattgtattcaaatggtacgaattaaatcttcttattaatagcagatgattttttttctttatttgtcgaaagatttcaagggacaaacatcacaatccgcaaagtaacctatatttacaagaaaagatgaaaaacataccaaatagatgacacaactaccgcttagaaaacgacttcacaccataactagcaacttttgcatttatatagatatttcctttattttcattataatttttccacattgccacaaaaaatgatatccacaattaattaattttaatttgtagttggatctaaatctaatatgaaagaaaaaagaaaaaacatattgagtctgaatcatatggatacacataccaaaaaatcagagatcacggcaagacaactttttgtcttatcttttagttttttatttgtcaacgttgtttgttgtcttactaatttattttaattattttttcccgaatctcatttttctaagagggaaaaagaaaaacatttcttttttctcttatgcaataaaaatcgcttcttttgtctttgatattaggaaacggacaaatcagtctagtcaaatagagccattcaaagtacggcaacacaaaccaagagagtgtaagttaagcgacatgtgttagagatatccggagatctcaaccgttggattctttctccttcaaatcaaattataaatcccatcaaacagagagagagagagaagaggaggagaattcgaagaataaaagataagaactttgacgttttgaagcttaaagcttgaaacttgtttcatcc

SEQ ID NO: 4444 - DNA, 3000 bp, Unknown
  misc_feature (1)..( 3000): cDNA_ID_1824247_gDNA_ID_1620706_Annot_ID_48893 3000 nt of promoter + ATG
cacattccttccttccattaagaagagtttagcttttctactttgttgattggttttgtgatttccgttttcacaaaaactttgtatagatcgatttgaagcaatttgagaaagtgatgaagtacataaagtcaggtatcgaaagcaatgctactcttgaatgtggtggtgatcagattggagacaaaggttacttcatccaacctactgtcttctctaatgttaaggtaaaaagaaaactcttctaagacatctttaatgttcttctattaccgattctccatggcattaatctcgaacgcttggttcaactacaggatgacatgcttatcgctcaagacgagattttcggtccagtccaatcgatcttgaagttcaggtatatagagctaccaataaaactgatccagtagacaaataagtcacaatttggtaaaaatggctgagttgttagagatttggtaaactgaaactaatttcgaaccaaccaaacctaaactttttttaaagataaatgtattcaattaaaaaacagaaaccatgatagatttggtttaacactggttatgatgttgggttcagtgatgtggatgaggtgataaagagggcgaacgagacgaagtacgggctagcggcaggggttttcacgaagaatctggacacggcaaacagggtttcaagggctttgaaagctggtaccgtatgggttaactgcttcgacgtatttgatgcagccataccatttggtggttacaagatgagtgggaatgggagagagaaaggcatatacagtctcaataattacttgcagatcaaggcagtcgtcactgctctaaataagcctgcctggatctgatctctggagtgtggtttcagcatcataaatgctcaaacaaaagaaatagactctataaagttacaatagtaataattaaggtcatggtttgtaatttgagtaacggattgtgatacttctaataaatttttcattgttgtttattcatcacatagctgttgttacactgagacttgtgtgttcattttggttttgcaagatttctattgaaactgaaaacaaacatgaaactgaaaaatgcaacgaaaattagaaaatatatatcttaaagtaattaagagttaaaactcaataattaattaaaaacttttcagttgtttaaatatatactctgtttctatataaatgtagtttaagagtttttatttttttcaaaataagtgttgttttcaactttctatacaaataataaatatttaatattttaatcaattatatttaattaataatatttttatataaaagaggtagattaaatgagactttcatgatttttttaatatgtgtataaaaaccttaaactaatatgaaacaaaggaagtagttgttaattattaaattcatatacagtatattcttagaataaaatatcaacataaaattgatcacaagtatgaaaaaaatactttttattaaaaggtttatcagataaatatatttttccttttgtaacagacaaaaaattatactaattttgaatatttattatatttcttaataaatttcgatacaagttttctatttaaataatatttttaacatgactgaaaaatgttgaacgcatcagaagtgaccaaatcgtgaattttaacttgttcgtcagccagaagtttccgtttctctttagtttcttcatcgcgatttttgctacttggctccaaaatccctcctttttcttctttctcacttgcatcattagctcacgatttcgagtatcgattcaaccattttgatcttcaatctatcttagggtttctccttaattcttctctcggattttagctcttctcgactattactcacctctctcatggcgatgagaggtgtcgatttcaagtggtgagctctctctctctctctcttcaatcttcattcacttgggtcgatctaaaggggacggattgcgaatttgattatcgattcccattttttttgagttttggggttttctgatttttgtaaattgtgcaggtacgatgggttcttcttgtcgatgcttgcgactagtgtgtatccttatgctacttggattctgtcaaatttgttttttttctttttcggttttgttcttgtttggatcgagctgagaattctcattcttaaagctaattctccaccattcgatataagatttgatgatcgagatacagttggttaatcagaagaaaaaagtttatttctttgaagatccgattgattagttttggttcttgtgggataggtgaactggattttgttttattagggtttaaggtgatctagataacctctccatttcgtttccttaatggttattttgcgtcgtagaatcattgtagctgtcaactggaacagatatcgagcttgtgaatacccgttgcatatatggattgtggtagctgcctcagttctattctttttgttgctctttcttattatcagtttcagtttcatttgtgtttgtctcctatgacttcaggtcgattacaccaccgtctttatcttccgtgtcttcatgtttgttgacaatggtcttgcttctggacttggcttgtaagttccatctaaatctccctagttctagagttacaatgagttttaaaggtttttactttttggaatcttccccggtttcccagagttatctgaacaagttttttttttgcgtaaaattgtctttgctatccttattccttagataggcgtttaattcattgagaagtattagattatgataaatataagctatttgggaagcatagaatttctttgtagctccagtcgaataggctcttctagttgcaagctttatcttagaagtagctagttgcaacgtttctctatctctctaggtagcaaattttatgaatatatggtttcttatgtcacattgatttctggtatgaacatctgttagggattttggaagtcaacagcggaacgcc

SEQ ID NO: 4445 - DNA, 3000 bp, Unknown
  misc_feature (1)..( 3000): cDNA_ID_2051288_gDNA_ID_1620706_Annot_ID_165300 3000 nt of promoter + ATG
atttggttgagaaacacagcgaagagctcgcgtctctagagacatgggacaatggcaagccttaccaacaatccttgaccgcagagattcccatgtttgcaagattgttccgttactatgctggtatcataaaacgaacttaaatcttgagaattctggtgcttttggtgttactttctgtgaatgaacattcttggttttgctttgatgtgtaggatgggcggataagattcatggactaacaattccagctgatggaaactatcaagttcacacattacatgaaccgataggtgtagctggacagatcataccgtggaattttccacttttgatgtttgcttggaaagttggtcctgctcttgcttgtggtaacaccattgtcctcaaaaccgctgagcaaacacctctcacggctttctatgctggaaagcttttccttgaagtaagatacatccgatagattctcctattgtcttctctaggaaaagaaaaactttgatgagtaacaatgtttcttgtgaaatttatgataggcgggtcttcctcctggtgttctgaatattgtttcgggattcggtgcaacagcaggtgctgccctcgcgagtcatatggatgtagacaaggtagatatatttatttacttgctgctaacttctttaagaaactaaattatcttacattcttctttttgcttcagcttgcttttacaggatcgactgatacggggaaagttatacttggattggctgctaacagcaatcttaagcccgtaactctggaacttggagggaaatcaccgttcatcgtattcgaagatgctgatattgataaagctgtagagcttgcacactttgccctcttcttcaaccaggttttgtcaatagtagaatatattcaccttgagctaagctgactcattttcctagctagttcttgagataatgttgagtaatgtttttgtaggggcaatgttgctgcgcggggtctcggacatttgttcatgagaaagtgtatgatgagtttgttgagaaatcaaaggcacgcgcattgaaacgtgttgttggtgatcctttcaggaaaggcattgaacagggtcctcaggtaacacatacacattccttccttccattaagaagagtttagcttttctactttgttgattggttttgtgatttccgttttcacaaaaactttgtatagatcgatttgaagcaatttgagaaagtgatgaagtacataaagtcaggtatcgaaagcaatgctactcttgaatgtggtggtgatcagattggagacaaaggttacttcatccaacctactgtcttctctaatgttaaggtaaaaagaaaactcttctaagacatctttaatgttcttctattaccgattctccatggcattaatctcgaacgcttggttcaactacaggatgacatgcttatcgctcaagacgagattttcggtccagtccaatcgatcttgaagttcaggtatatagagctaccaataaaactgatccagtagacaaataagtcacaatttggtaaaaatggctgagttgttagagatttggtaaactgaaactaatttcgaaccaaccaaacctaaactttttttaaagataaatgtattcaattaaaaaacagaaaccatgatagatttggtttaacactggttatgatgttgggttcagtgatgtggatgaggtgataaagagggcgaacgagacgaagtacgggctagcggcaggggttttcacgaagaatctggacacggcaaacagggtttcaagggctttgaaagctggtaccgtatgggttaactgcttcgacgtatttgatgcagccataccatttggtggttacaagatgagtgggaatgggagagagaaaggcatatacagtctcaataattacttgcagatcaaggcagtcgtcactgctctaaataagcctgcctggatctgatctctggagtgtggtttcagcatcataaatgctcaaacaaaagaaatagactctataaagttacaatagtaataattaaggtcatggtttgtaatttgagtaacggattgtgatacttctaataaatttttcattgttgtttattcatcacatagctgttgttacactgagacttgtgtgttcattttggttttgcaagatttctattgaaactgaaaacaaacatgaaactgaaaaatgcaacgaaaattagaaaatatatatcttaaagtaattaagagttaaaactcaataattaattaaaaacttttcagttgtttaaatatatactctgtttctatataaatgtagtttaagagtttttatttttttcaaaataagtgttgttttcaactttctatacaaataataaatatttaatattttaatcaattatatttaattaataatatttttatataaaagaggtagattaaatgagactttcatgatttttttaatatgtgtataaaaaccttaaactaatatgaaacaaaggaagtagttgttaattattaaattcatatacagtatattcttagaataaaatatcaacataaaattgatcacaagtatgaaaaaaatactttttattaaaaggtttatcagataaatatatttttccttttgtaacagacaaaaaattatactaattttgaatatttattatatttcttaataaatttcgatacaagttttctatttaaataatatttttaacatgactgaaaaatgttgaacgcatcagaagtgaccaaatcgtgaattttaacttgttcgtcagccagaagtttccgtttctctttagtttcttcatcgcgatttttgctacttggctccaaaatccctcctttttcttctttctcacttgcatcattagctcacgatttcgagtatcgattcaaccattttgatcttcaatctatcttagggtttctccttaattcttctctcggattttagctcttctcgactattactcacctctctc

SEQ ID NO: 4446 - DNA, 3000 bp, Unknown; identical to SEQ ID NO: 4443
  misc_feature (1)..( 3000): cDNA_ID_1824251_gDNA_ID_1620706_Annot_ID_165299 3000 nt of promoter + ATG

SEQ ID NO: 4447 - DNA, 3000 bp, Unknown; identical to SEQ ID NO: 4442
  misc_feature (1)..( 3000): cDNA_ID_1824255_gDNA_ID_1620706_Annot_ID_165298 3000 nt of promoter + ATG

SEQ ID NO: 4448 - DNA, 3000 bp, Unknown
  misc_feature (1)..( 3000): cDNA_ID_1824265_gDNA_ID_1620706_Annot_ID_165293 3000 nt of promoter + ATG
gcacaaaaaccagagagattgtgaaatagagagataaaatgaagtgattaacatgaggaagtgtggagaatgtacttcatgttatttttgaaaatctcaaatctgtagtcttttagatcgagcttcacaggaacatgatgatggcttgtccacctgctgtatagctttagtaatagatggatgagccaccatttggttccaatgaagctcgacctaaaagaaaatagatatgaagttttcagaaataacgcgaagttgttgggcattcgctgctaggcacctattgaggggattaactacgaaagtacgacccagttggtgatgttttctgcacaagaactaatttctgcagacaaagtcaccaccaagtttggcactcaaattcatcaagaaaaatgcaacccttttaaaggcacaaaatgtgaggtaaccatctatcaattcagatatgtagatgtagatctttcaacgaggcagccttatcaacgctattgcaatccggctttttttatcaaccacacattaattaaaagatgattccatgattggttacccaatctggaagaaaagagtttagatacgtaacttcagaaaataataatttagaaaaacgcggtagacaatccgccctaatattactcaaacgagaaatagaagatatcgaaaaagaggaaaaatattacggagcgatccaaactcatctagaagattggagaaagcgtgtcattcttcaagagactgcaccatcgagactagctctgtgcaatctgattcaaatgtctggcagtcgatccttcgtgaaaggatattcttcataacccaaattaaagcttccagctccgagtgaaggggagaagggctcctccagaggcactttgcacataagagtactgtttgatcaattccttgaaaacaccaccatcctaatcccatggttagatccgaagatttccatgatccatcaaccctacatctaatagaatgagtcagttgatccatagacaccctggtaacattcgattcaatcggttccagttgggccgcatcccacaataattgttcactcaaagcgacatttagaatatctaaaggttctgattgtaaacctttgaaaacctttttattcctatctttccaaataaactataaaatccatgcataaaagttatttccctctctctcatctattggagatggtaatccacaaaaaaagtaatgaagatttgaaaattccgaggttaaaggaaagcttcctgctattacaggaatcgaagacatttcccagacttgtcgagagtgaggacactcaaaatctattttttgtagtcaatttttaaaaaatatagtcagcctagtataactattcatgcttatggatatatttcgcaaggagtgatgacgaaaaactctggaacggatttgaactacgcaatgcctttggtcaagtacgggatgaggcagaacgggatataaatattggatagctaagaattcgtatagtccccaatgtggagaaggcgaatatattaggatcgagagagggattgctgattcaaacttggttacagaagagagacagagatgttgttaggattaaaacaaaattggttacacaatatagtgcgaccaaaaaagaaaaacatgcaattttacaaaatatggttgaaacaaaaggcccatgtcttttggtcctcaaaaactatttttgtgaattcagttgatgatacaaaaatagaaattcggtaaaataaacaatgatgcggttagatgtggtaagagataccgattaaatataacgacatgataagaaaaaataaaaatggactaaaaatactattaattttaaaaagaaaacaaattttgacagcaacattaaacataacaattttgctgtggattcaatggatgcttggtttcgttttgacggtaaaagaacaacttcgttttttctaaaggggcataaggttttgtgaaagaattataaaaaaaaactgttttgccaccatttttgttaatcgacttatcatatagcacttgtttttactagtgatatgcaatattacaactttttgtggaagaatatacaaacacacaaatcaaaaatccaagtagttattcatctaacttatttgtagttgatgaatggttatgtgtggttgagacaataaatataaccaagttgtaccgaatgaattggccatcactctattttaaacacaaaacagtgactatacacaatttcttaaacccgattgaaaaataatataaattggacaattaaaaaaaaacttctgacaagttttttggtttatttcggttcttcaaaccggcttgcatagaatcaaattttaattgtaaaacaaaaacaaaaaaagtaaagtcaaaaggagtaaggaaacgtggtcaaaaccgtccgtcactcacccacctcttaatctctccagtccctatgtcacctgaaaaagattggagatgacgtcacgcccatattgttttttcatttaagtcaccgcactgtcacgttatctttgccccttccatccacaactcctctctctaacccgacccgatccgcccgaactcgtccaagtcacctttcccctttttcgccccgtctctctctctctctctcttcttcgatttattggtgtttggttcgcttacgcgatttctcgaagaaaaaatctcgtattcctggatcgaaacaaggctgattcgattactcgctgtcgctgttgttgattttggatctgtgttttgttatcttcggatcgggaatcgaagccctagagatttgatccatttcgtcgcgaaattaggttttttttttcaccgataagtttttggatctaaagttatcgaatattgtcagggggaaaaaggaattttgaggatttgttggattttgctgaggatattgatgttgttcgaaggagaagatgatagaaggctatgcatgggagggtttgtgagcggagacacaaaagtcgtcgtcggcac

SEQ ID NO: 4449 - DNA, 3000 bp, Unknown; identical to SEQ ID NO: 4440
  misc_feature (1)..( 3000): cDNA_ID_1824269_gDNA_ID_1620706_Annot_ID_165291 3000 nt of promoter + ATG

SEQ ID NO: 4450 - DNA, 3000 bp, Unknown; identical to SEQ ID NO: 4439
  misc_feature (1)..( 3000): cDNA_ID_3073315_gDNA_ID_1620706_Annot_ID_165288 3000 nt of promoter + ATG

SEQ ID NO: 4451 - DNA, 3000 bp, Unknown; identical to SEQ ID NO: 4438
  misc_feature (1)..( 3000): cDNA_ID_1824277_gDNA_ID_1620706_Annot_ID_165285 3000 nt of promoter + ATG

SEQ ID NO: 4452 - DNA, 2667 bp, Unknown
  misc_feature (1)..( 2667): cDNA_ID_2990652_gDNA_ID_1620706_Annot_ID_165284 3000 nt of promoter + ATG
aagcttacgtacataccctaaaatggagctctaagaatctcgattggtttgagagcaaaagaaatgaagagagctcacaaatttttaccttttcacttagaagacttatcgcgccactgttgctttctccttcatcgtcctttacattagttatctctgtaacatcatcgccggtgttctcggtaggagtttggcctgtgggtactccaaacatggcctcatcgtgggcggctttcaactgctcttccctttttgccttacaagtttttattaaaccatataaactgtctgaagctctgatataataaaaactgtgacttgattagaggttgacaatgtaagctaatgactcagtaaacctcgatggcggaaaacctataactttgtcccatgcgcttgaccaaggcagcatcatcatcagcacctgcaatcatatgaagtttttagcatcaagagtacagagtaactgagaatgatttccggctttagctctgtccgttcatcgaaatcatggagtaaaggtagagattcacgggaaactgaccttcttctagttcctcatcatcaactggggcctctttgtcgaattcaaatctttcccatcctgcacccttactggtatctttctcagctgcaaaccaagcagatcattaatttcaagagaagaactaaacatgagattgatatcaatgttttcacaaggtatacaacccaagggatctcatttttaaggacagagttgatctttcttgtttttttattctttctcagacaccaggacttttttcttcatctaccataaacacatttacagatttgatatctccatgaaagggtttgtctcaatcctccttatatacagagctgctatgaaaatctatgaggtcaatagattttgctttgctgataaggaaaagttaggaaaagtcttctcccaacagtaacgtgcattgtatcctgaatgccacgagataaagagccaaaacacagccctccacagaactacaccataaagactttgattgatgggagaattctcagctacctgctgacccaatgcccaaccaaaaacctaacattctccgtacctccattttaacattagcacctcaactaactggcttaaggctacgaatcactacaaaactactaaactaataagaaagccttatcagcatcatcaattcaaggccaagacattaagtgccaaaacacagccccaccgttctaacattccaaagatggatcccactcaaaagaagttgtcgaaagaatgagatcttagctgctctgaagcgtggacaacagaatcaatgtaatctctcaaatgggaccgactaacatacccgtttcatcaagctgaagcttcatcttggctttcactttttcagcagctgactgttcaagaaagcaacacaaaaaccaaccttataataccacggaaatgacaatcacacacagacacacacaaaacaccagcaacaaaattacagaatctatgactatcatccataaacaaagaaggagctccacaagaatggtaaaccaaattagagatcaagggtttataatctcaaaacatctattgaatgtgggcacatgaaggcaattcctatgttgcaatatgtaaaggtaattgctaagttcttattacactcctaagtcctaactctagagggattataacattacgatgctgattctggtaaacaaaagttcctcgaagtatgataaccatacaggctgaagaatgatgagagaaatgagtattaccatctcatcgtagcctttgattaaccgcgagtaatcaggcttcttctccttaacatcttctctgctcctccgctctctcctcggcgacaaacttctgcttcggttactcctcctccggctctctctatccccgtacctattacgcctctctgcactcctgctcctgcttctccgtctctctctatccacataactactacgtctctctgaactcctgcttctccttctatggcttttatctctctcatccctctctctactccgataacgacgccgttcactcgactctctatagctcctctccggcaccctaggatcttcaggtttcttcttcaatttatctctgatggaccggatctcggaatccttgttatcagtggatttagtatggttagaagccttgacgaattggttgagaaacgaagacgacgatgcgatcgccgatcctctctccggaacagcgttggctccggtggagaagccgagaccttgcttgaagcgagcagctccttctcctttacgcgtgagctcgtcgtagtaagctgccgctttttcttcctccataacttagctccgtttctctccctttggttctctcgatggttttttctcaaccatttttgttaaccatcttataatccaatgttttcatttgaattttgttagcccataaaatctatattttcgtcagtgtttctctctcttctcgctctctgaatattttagagagagaatacgctcttcttctcgccgtccggtggttatccggctacatgtccggcgtcttccgtttttctcaacggtgatggccggctttcgtctagcaccgactggcttcctaagtagcggtggctagcttttgcccggcatcgaccggctaacctagcggccatg

SEQ ID NO: 4453 - DNA, 3000 bp, Unknown; identical to SEQ ID NO: 4436
  misc_feature (1)..( 3000): cDNA_ID_1824235_gDNA_ID_1620706_Annot_ID_48896 3000 nt of promoter + ATG

SEQ ID NO: 4454 - DNA, 3000 bp, Unknown; identical to SEQ ID NO: 4435
  misc_feature (1)..( 3000): cDNA_ID_1824231_gDNA_ID_1620706_Annot_ID_48897 3000 nt of promoter + ATG

SEQ ID NO: 4455 - DNA, 3000 bp, Unknown; identical to SEQ ID NO: 4434
  misc_feature (1)..( 3000): cDNA_ID_1824227_gDNA_ID_1620706_Annot_ID_48898 3000 nt of promoter + ATG

SEQ ID NO: 4456 - DNA, 3000 bp, Unknown
  misc_feature (1)..( 3000): cDNA_ID_1824211_gDNA_ID_1620706_Annot_ID_48902 3000 nt of promoter + ATG
caagttctggagatattgctaatggaaatgatgtgtcttctggtgcggatggatttctttcatggatcttcacaggaccctctagcgaggaacaagttgtgtcatggatgcgcacaaaggaagataaaactaatcaaggactggagatcatgcagcatcttgagaaggagttctatcacttgcagaacctctgcgagagaaaatgcgagcacttaagctatgagggagcactgcagactgtcgaggatctttgtcttgaagaaggccggaagagggagacttcagcagaatttacccatgaaagctatgaaactgtgctgaggaaacgaagagaagagctaaatgagagtgaccatgagttgttgtttatcagtagcaggtttgagttagatgctataacaaatgttttgaaagatgccgaaactcttaaccacaatcaatttggatatgaagaatcatatggctgcactagttctcagcttcgtgatctggaatctggtgaagctgatgaatgggggataaaggattccttacatgaggctgacagtttcatagagattgcgattcagaaacaaaaagagcagttgtctgcagaggtaagcttttctatctttacgcaacaccactgcaataatcaattaatgcctttctgattttaaaataatctgtacatgtgctatcacagcttagcagaatcgatgcacaaatgatgcgaaatgtcactgggatgcagcaattagagctaaagcttggaccagtttcctccaacgattatcagatagtattgttacctttggtgaagtcctacatgcgggtaagtatctaactcttttgaccttgttactttttcttccattgtgttgctgtgttctttcaggttctaattggcatttccatcttaatctccccatttccctctctcgctctctctctctctctctctctctctctctctctctctctctccaggcacatttggaggcgttagcagagaaagatgccactgagaagtctgatgctgcaagagaagccttacttgttgagctagctcttgattctaagaaggaggctcgaggaagaaatgataattcaaaaaacacgctggaaaagtccaaggacaagaaaaagattaaagacactaggaaagtgaaggatatgaaggttcgaactaatctgttgtctactttttaggtacttcttgtctatatttgtaactaactttttaatttttttgttataggcaactattggaagcgaccatcgctccaatgctgattcagttgaacacaggtgaagatctgccttgttcataatttttacttaagcgggtgtaacctggaaaatctttgtttctgaaaatgttggtggtttataatatgtcgttgatttacctgctaatttcttgttccagcccccttccggttgcacctgtcggcgatcattcagaggctgacattgtttctgaagctgttgaagctttaaaagaagaggaagaggaatataaacgccaaatagagctagaggaggaggagagaaaacttgaaaaaaccctagagtatcagagaagaattgaggatgaagctaaggagaagcacatggcagaacaacaaaagaaatacagctcttcagttcccatgaatgttgcaaagacagtgtataatgggtgcacagataatgaagttgattatttagttttacaaggacaagaaaaatccataaatcaggtaacaatagagtgacaaggtggtggagttatgttttttcaatcatcgcttgaaattaatttctggggttctttgctttaccaggagaaaaggaatggacgacttgatgacctggaaggagccagtgtgaatacaaatggagttttcccgtcaacaaatcattctgcgatatctgatactgcaaaggtgcagaatgtaaaatcccaaaaaggttagcattggtttcgaatatgaaaatatgtgtctactgacctttctgaggcacttatattgttttttcttttttttttgttgtagtagtgcctaacggcacagctatgcaagctggtattttccaatctgatcaacgaactgggaggagaactagacgccaaaaagcttcaaacaagttagctgatggaaaatatccggtcacacctcctgagaccgaaaatagtaaatctcagttgtcaggcaccaacggcgagagacattctgaaactctacgtaacaatggtggtaagtgacattttttttttttttttttttttttttttgtcctagaatcattttctttttctcatgttttcaaagcactgatagttgtgatctatagatgatctgatttttcttcttgagcttattgtttttttctgaacataattattaatttattagatgtgaccagtaaaggcacaaatgaagccgttagatttcttaaaactgatacttctgtaaccggtgtatcttgtttatgcttttatgtcaacgaggaattacattatctacattgattaccagcaattgttttctaacatcattcatcttgcattctagatgtgggaacaaagacattaagacaattacaagctgaagacgatgacgaagaaaggtttcaagctgacatgcaaagggcagtgcttcaaagccttggtagtttttcaacatccttgtttatatatctgatatcatgtctgacagttaacattttgcgatattttgctaagtgcccattttgtcactattgtctgactgactgtcatttgtatgaagaatggtgtattgtgtataccacttttcttcatcccagtgcactttttctttttatctgattactttaggtgtctgaaactattttttctccagcttacttatgccaacagctgctacgttttattttagaatttttagcatatttgttctgtaatcattttggggtgacaaaaaccctcgatatgaagcatctgacaccagaacatgttttttcaacgcagacgtgtaccaaggaggtagaaat

SEQ ID NO: 4457 - DNA, 3000 bp, Unknown; identical to SEQ ID NO: 4433
  misc_feature (1)..( 3000): cDNA_ID_1824207_gDNA_ID_1620706_Annot_ID_48903 3000 nt of promoter + ATG

SEQ ID NO: 4458 - DNA, 3000 bp, Unknown
  misc_feature (1)..( 3000): cDNA_ID_1824332_gDNA_ID_1620707_Annot_ID_48905 3000 nt of promoter + ATG
catcagctatgtaatgctacccaccacgaggatcttaagcatctgagacgcatttcgagatagttactttgatggaatttgtgaatgtgactgaaatattcagcacaaatcagaacatggttcctgtcttgtttggagaagcactatgaaccaaacctgaagcccttgtgatttagagttacagagatacattaaaagggttcgggatttcacagtagcattcatagacagttcaggttagttaaacgtgcttcacaaaaagaaaaaaaacagaagtgtagttgaggtcacaccacaggtttatgctttgctcttaatcaaatatttatctttctcttttttgttatttgtcctttttaattccatttgctttattccttacttgtggggattaaatgtttgcagagaaagataattcgactgaataaatacacttttacctgtatacttgttatatatttgtgtcaccccaaagtgaaagctgcagactttgaaacacagaaattcttcccattgtagtgtttttttctcagaaacacaagaagagcttatggatattgctaagaagttcatatctgaaattgatgacaagctcgagtctaaatcagaatttgataaagagctcgagaaaatcaagtcttccttcaatgaagaatatgagaaatggtcgtctggaaaacagaggggatcttcctctaagcatggaaaccagtccacacatggtgattcatcaccaactcgtaacagcagcggcagcagtaaaaaagggcggcctaaggcgaaccgtgtggagacaagctctgagcttccggatcacctcattcgtggtttcattaacgagaaactgttcttgaagaacttcttgctgaagcaaaaggaatccgaagagttcaagactctagcaattgtggggaaatacggagttgggaaaacgacattgtgtcaggctgtgttcaacgacgaagatgttaagcaagtttatttcccgaggatatgggtttctatgtacagcaaagaaacaaaagaagacgaagatcccaagatagatgttgtgaagaggatcttgagatcccttggagttgaagatgagatgtttaaacacatcaaaacagaagcagaagaagagaagagtatcaaagatgaagctggggaaagagaggaagagacggtcaaagaaaaggagcttgctcgattattgtatgctcttcacttgaatctgattgggaagaagtatctgatagtgttggatgatgtttgggaagacaacgagtgggatcaaaggctcgatgatgagaagaagcaacaggaaaaatcacatctttcttgtgggtttcctaaagggtttggtgggaaagtgattatgactagcagagacgagagattggcgaaggcgatagtcggagaagaagagaatctgcagcgtttgtttccaagatccgatgcagagagcttgtgggagatttacattgatgcagtacccaccaaggtggacgatgcagcagccacgaatttgggcgatgcagtagccacaaatgcgggcgatgcagtagccccgaaagtgaatccgaggtatccgggaagatacaaacaagagcttatggataagtcttgtggtattcctttggctgctcgaatgctggcgaagattgagcctgtgaaagtggatgaaattggaaacatagataggaagcagagcttctaacttctaacgcaatatctatgtatttactatttactctctgatataaggaagctattcaagattactatataaagttattttattgttctagaaactgttaagagttgtcacttgtgtgagtgtaaacctatggcagttaataaagattaaaaagagattttaatacatatttttatcatcttagagtttcacgattttcttgagattgatcctcgtagcttgttgatgatgatttgtggattaaaaaccacgacatagcgtattgcggaagtgctgcttgaactaccgatttgacagaggacctcttggataattttcatttctaagcttttagacactttacttatacatatctaaaactactagttattttggaaatttggaaaaatgataatggtatttttttactatcacgtgtgaaaattcctcttaaagaatactgatctttcaaagtacttcaattttgaaagaagtaatgaaacagtattagaatattaatttcctttcagcttaagagaagtggcagattctccctagaaatatgttaagttaaacatctgtaccctcacttttgtaaaacctgtatcacatatcaccaaacataagtagaacaaaggatcatcaaaagacaaaaaaactagagcaatacatgtgattagcatgtaactttttcctttgtatgtaataaggaaagaaaagtttttgcttgtgtagtaaacaattccaaaagtcatatattcgaaaaatataggggcataattgttactctgaattctgaaataataagggtgaataattattggaagaatctaatatttatacttggcgtttttgtttcgacagagtgtaatctaaaacttgaattttgttattgttgttttacaaaatcaggataggcttgacatggaagttatcggagctggacttgtataaataagtgaatcaatcaacgaaggataacaaaacaaaacataaacaaaaactagaaagaaaaaactatcagtggagaaaactaatctgattaagtcactctaaacaattaaggttcttctcatacctctctctttgtttcgaattttaaattttagttttgtattgttagttgatatttgtcatatattgcatggatatataggggtagtgtggtatactctctgaatacatctcttaagttcataaaaataaagttactatcctagtagcaatctcaataattttgtttaacaatgatctcttcaagaaaactcaaatcaaaggtttaaatatttcctctctcattttttattttcctagagatg

SEQ ID NO: 4459 - DNA, 3000 bp, Unknown
  misc_feature (1)..( 3000): cDNA_ID_1824328_gDNA_ID_1620707_Annot_ID_48909 3000 nt of promoter + ATG
aaacattaacatgagactgaaatgagtgttggagtgcaagctagttatatgtaagataaaggcaaggtaaatgctcagactagcttctatttgaaatactaagactaacgtaccttatcattgacaaagaaaacggatagagaagaactttgcacagtgatatagcaaaatgttaagactaattgaatttgtacctttgcgcacatggagaagatgacttccaaatttgccacaatcatgtgaaatgaacaaaggaaaactttttaggtcaatggcattatttaaatgaggcttcttgttaaaaccagagcatatctcactgacttgtctctgcaaccccgcgatttgaggcatcaaatcactccaaccattggttgagaggtttttaccaaagaaattaaaagcaccctttctagttgcttccacagctgaaaataaaatcagcagacaaaagattactacatgacctgtgcattcaagttgccaaagacccgaatcaagaaagttcaaaactaagagtttacttggtatggagaatacatatttatgaaaaaatgtgtgagagaaagagagagagtctgaggtacatactgttataaggagctgcaagaagaaaatttgtgggaagaccaatgccgagaccagcaagtgttataccaacactaaaaccaacaccgcagccagcaccgacataaccaatgacctcagggccaaaaccaggtccccatccgacgccacaaccaatcccaatccccattccccaaaatgctccataagtaggatgcacaggattccatttttcatatctccgaaatatacctttaatgatcatcaagacctgcaaaattggtaaagatttgaaaacggaataagtttacattgacccaactaaattatctttcagtacccactgaaactaaatcaaatccaatgcacattgaattgagaagctgaatcaatggatattcaacagtgtcaccaacaaaacataaagctcatatttttcccacagattctctcgaaacccccataaaattcgaaccttttcaggatcgcgaacaatccaataagtactaatcaataaaccaattccagctgaaacctggggtatgtataaacttggataaacctacgaaatagaacaatatctacaaagaacaaaatttgtaaaatttaccatcaagagatttgctatttcgattcttctctcttctttgttctcaccttaattcgatcctcaagtgcacacactcttcgttcgatttcttttgttttctcagacgaattcactaagagaaccagtggatcaaaaccactcatcgttttacgcttggattaaaaaataagaatcggaccgaacagacataaccggtacaatctgatccggtttactaataaaaccaaactacggcagcaacatatataatcgatttcagtatccttcttctccggcgttcgatgcctggttctcggagtccggcgtttcgaaaccctaaagtttgttcagattcgtcactcaaatctggaaggctggaacaaagctcgcgaaatctcaagaaagtggtaatgcacgattctctcaggtgaaagtgacgacgatatcagtggtggctctgattgagatttttgctcacaggatgaacacgatcaggttaagcccaaaaacaactcaggattaatctgatcttagaagctaaattctctgttttgaaattagagttagaaaagttagcaaagctacttctggattctctggtttgaatatggagcaggagcacgaaatactcaggcagtaaggcaatttaggttacatatagcaaattagggttttaaagaattgagacgagttgtggattatgattagtcaacaataaccaaagatgttgaagacaaaagacgagagatacaatgtgttacacaaggcaagaggtgcttgttttggtaagaatcagtgtggctctagaatcttccttggtggtcctgaattgctctccgagtccgaaatgagccatcaatagccaaacaaagttgatcagttcaccacctttgttgagttgagctgcatgttgtttagaatcacagtgagttgctgcgtagcaaagcatctccacccacactttgctcactactttccacattgcatcattgcctctttcatttgttatatgcagaagctccttcgctagcatgctcgcttggaacaacatggacttgctttgataccgtctggcgttcccattccctagctcaaattccgtaaaggaatccacaattgctgcacaggccttctttgcatctcttgaaccctcaacatgcatcttctgaaacagctttttagcctctttagagtttttggcttctgctatagcgtctttgaattttatcttatcaattcctgcaactgttgacataagagaggattgtgcgactaagaggtacatcatgtagtctgaaatggttttgctgtactctttgcttctgacatttcttgctgcattgtctacttctgtttggtgtaagagctcagttgcaacgtgccacaccagaatgccctgatcatactccacttcagtgacatatggcaggagtttctcataataatcctcgatttgcatatcgcgcagaatccagtcgcctctagccgaatatatatggctggcactttccgatccaacaactaagagcgatctatgcttgacctcttcaaatatgaattcccagagctctttggtgaggcgtgtgcgggatgtgaacactatctcatttacctgatctgagatgctgaagaattctaggagatagttgatcaacggaattcctaagcagaatctaataaaaagcctgaaagggtaaagagtccgacgagtccacggaaagttgatgaacagatgaatcatcttagagtctatattcttgcggatgccattcgaggctttggaaactaacttcgttcctctgatgatgatatcaacaacaaaatcaatgtgcaaggttcgaatg

SEQ ID NO: 4460 - DNA, 3000 bp, Unknown
  misc_feature (1)..( 3000): cDNA_ID_1824316_gDNA_ID_1620707_Annot_ID_48913 3000 nt of promoter + ATG
aagctgatgttggtgctgcagcaggagatgacatgggtgcgattcactttgcttctcaaaaggggcatttggaagttgtgagaactttattatctgccggtggttctgtgaagtctatcactcgcaagggactcactcctcttcactacgctgctcaaggttctcactttgaaatcgtcaagtacttggttaagaaaggagcaagcgtcagagctacgactaaggctgggaagagtccagctgatgttgcgggtaatgcagaaacgcaaaatttccttgaagaatgtgaagagcaagcaaggaaagctaaggtgaacaatgagaaaaagacggaaatagtgaaaccagagagttgtagcaatgaaggagatgtcaaggatctgaaaagaaaggactctgaggatggaaacgagggtgaggaagaagaagcttcttcgaaaccgaaaaagccaaaagttgctctttctcatcttcaggacattgacgacacagaagctgatcaagaagaagagtaactcttctattccatcagaagtttcttaacaagagttgtaagatcctccatcatatgagataggtcgtagttcaccaaaacttttgttcgtttccgagatccgtaaaagcctgtagaagaatccatcactttgcattttagaattggttggtaaaacagattgtttttagctgtcaaatcaatcctcaaactttaaagctgtttctctgtattgctttctttttctgtaaatgatttaagattacatcacacaactgtctacgaatcattacatactcactgactctcaagtaatgttttttcctaagcatttggaaaaagaatttttaagtattgtgtagccatccatccgagaaccgagaagtaaacaagaagcaaacatgcacgtttcacttgtaccaatatattcaccttagaaaactgtctcttaactgaacaacaagcttgagggaaccaagattttgcatgtcttaagatccttatgatgaagactgtgattatggaagttgcgaagccagagacaatgccagcgatcacatcatatttccagtactttggtgttgattctccattaagccatgactgtaaaagtttagagattctgaaaaaaaaccaatgaaagaggatcaattctgtaaaaaaacaatgccaggacaaggcaagactgagaaactaaacagatgatagaacattcgtatatcacttcgacctcaatcattgtgctattacagtttgtatgtgtttagttataatgaaaaatgtataataatgagagaaaacagaagaacttacacaatagagtattgcttagcaatgtcagtgaaagaaagatcatctgcttggcaaccgaaaaagctatcccgataaagctttatctttggaatccctaatgtgtaccagcaatcgtaagtctcattaacctggacaaacaaaaacatattgcgattcagaacagtaaacaaactgatatcaagtccgagagtcaatatagtcaaaaaacttaccttgaagttatctttggtaagtaatgcagcaccaaagttaggtctgcactcaggaggaagagcttcatttggtgcttctgaaaacgctaaccgtgtttgacccattaagttatctttatactctacctgtgaatacgatatacaatggagttagtaaattgctctagtttgaaaaacaaaagacagaaaattgctgtaaaatagctcacaaccttgaagacagaagcccagtagtaatcataacgacatctgaatttatctctctcaaaagggtaaaacacatgttgtgctttgacgttcaatagtccaatgccacacactttagaagacctaagatcaacagctacatcacaattcggtaaaaaaccaacatcagtttctttatcaaaacccccaaaatcattgtgaagactttccatttcaatcattagaagtgagatcatttaacacaagaaacctatcaatttctgcaatcaattgatgataaagtaaatagaatcaaagctttaaacttacagctggaaacaattttgcagcgagaatgaagagaagcagaagcagatgaagaagaataaacccacaattcaccgatgaaaatcactaagattcctaatagaaacgacaagacgacgaagctaatgatcgagaaaactatcactgtacggaatcgcaaagctaacgaagagaaaaccctcttttgcttctttgtagtcgttaccgacgacgtcgtttcttcggaatccatttacactttcttctccggtgacggtgagtgagttttactcagaacaacaattcgaagaatccatttctcacggtgatcaaaacgacggacgccgggacatcaaatcttaccgattatcaatttttttctttcaattgcgccttttttttttttcccttccgcgttgagtctttgactatgatgcgagtgtgttaaatgcaattacaacaaaaaataataataaaataattttttcggacagggttgatcaatgtgaatgtgatggagagagattgctgactcagcagtacacttgccacgtcttccacgtaatatgttcgtttacttgccattttgggccttcaaatgggcctatatatgtgctttgagccttaccagtctacatcttaacgaagcttgtaagggaattttgtgaaggggtagatccgtaataacaccaaatcgtggctcgattgtgatttccaaattcttgaaaccctccttctttagtttccctctcaaagggagcgtaaagtttccacctttcactctaggggctaatctcaaatccttcatcttcttcaacctctggtctctgtcaattcaaacaaatcgtttttcgtctcctcaattttgaattcatttataaagatttcacccttttcctcctcgaatctcgaattgcttctactgattatccaaattttcttgaggtttgtaacgcttttgaatttgggttttagtgtcaatctgtaatg

SEQ ID NO: 4461 - DNA, 3000 bp, Unknown
  misc_feature (1)..( 3000): cDNA_ID_1824291_gDNA_ID_1620707_Annot_ID_165344 3000 nt of promoter + ATG
gttcttctgttccaattccaattccttctgaaatattcatcgcaattcgtatcggtaatttttccttttgatcgcattttttttttatctttgatcttccgtattaaacgtgctcgatctatatactcaatgatcttatatgtgtatgatcatgtaatttggaagttgaaatgtaaatcatctattccttggtaaattattcttcgattttttttctgatataggttaatggtaattcctgtgatttttactgatgtaatctggtgttgattgttgtgaattcttgatctatgagattatgtcttagatttgccaaatgttaagtttgtttgatctttgacaaaatattgtaggtttaaagtaaaaaagcaatgggaggtggtaaagacaagcatcatgatgagcaagagaaaggatttcatggttttccaggaggtggacattacccacctgctcaaggaggttaccctcctcaaggttacccaccacaacaagggtatcctccagctggaggctacccacctgccggatatcctcctggtgcttaccctgctgcgcccggtggttatcctcctgcacctggaggttaccctcctgctggctatcctgcacctggagctcaccattcaggtatgcattgtctcgttaaagagctcttctttgtagttttggtaaatgttgatgttttctatgcaaaagctatggagtgtccttgtagcttgcttggattatcaacctgctaaatattgttaatcattgaatgttaataggaaaagactttataaatgtttcggttttctatgaaaaaagctaaagattgtgcgtgaagtttgctggatcattaaccttcgaactttgaatgataatagaacaatagtttgtaaatcttactgttttctttgtaaataaagcttagaactggccttgttgtttgctggattatcagcctgctaagtattgtcaagtttgaatgatagtatgacaattgtttctgaaatgttgtttttttttctgtgataaaaagatgaggacatataaacttactgtcttctgttttggtgtatacattgatgttttaattttaaatctactaggagtacatgtttaatcgtgtgtgcttatcaatatgcaactttgtggtctcttatatgcattctgctactttgtggttctccatgtaatactattttcttttttccatcaggacattctggtggtggactcggaggcatgatagcaggtgcagctggtgcagccgcagcagcttatggagctcaccatgttggtcacgcctctcacaacccttacgggcatgctgtaggacatggagggtatggccatgcccctgctcatggctttggccatggtggtcatggtaaattcaagcacggaaagcatggaggcaaattcaagcacggaaagcatggaaagcacgggaaacatggcatgtttggaggaggaggcaaattcaagaagtggaagtaatctcaaaaaccccacctttgatcctctcctccagtatagtctcattacctgaccgatgtttctaataatcccccttcaaacatatttcattttaactatgtcggtttagagattactggttgaggaaataattggagagtgctagtataaaccttatggtatctgcagcagaggtttctttaatctctcaatagtagatgctttgaaacttatctataatttggtattgtaatgacagtttgtgtttggttttttcttcagtatcttctttgtttgatcatttgatgttggtggagttctccaaaatatttatgctattgtagatcctaacctttctatcttgttattcttcgttttttggccattattttcgtttcgctcccgatccaaattccaaagtacttcaacaatatcttatgcaataacgagacaaacacttaaggtcgtgcaagaatagtgtctgtttttcactgattcacttttacagagaacaaactgaattaattttgattattgaatagttgacatgcaataatatttgttaatccaaatgaatagataaaaaaaaaaattccttgagagtaaagaaactaaattttggaagacaatttttaactagttttctctaaaactaggaaagtcagaaaatgagaaaacaaatttgattttattacggaagtgaagggctttccgacaaattgctttgctcagaccaaactgtaaccgacccaagcccaataaaaaagcgaatcgggtcaaacgaaaacagataattcagaaaaccctaaattcgtttctctttttttttcttcattctgagcaaagcagtaactctcaggtgcgtgtgctctccgctggttccttagaacaatcggcacacgctttttcatttcaatcttcttcttctactcttaagtatctcaggtactaatctcgatttctctatttctcgtccatggagatttagatttcaagtcagatgcttttcgatttgttacagatgtataatttttgtaatcgattgattcgcagcttggattgtattgagccatcgacataccttcaaaattcttataattgtattgaaagtgtttgaatttaatgtttttttttttctttctctcgattgttttgatttctgggcaagtgtcaacttttgtaacagattagtgacctttctctttatagatatgtggaagaatttggaatttacaaattcggttcaccatttttatctgaagcactgaatttgcgtttttcaagcttgagtgaatattatttcttggctcttaagattttgcatgtcaactattatttcatcattgttagcatcttgtggtgttcaagttattattttaaatattgtttgtgctactctatagttattccctatgttgttatttcgttcctttgccttagcgtgacatctttatttggtatatttgtatctgtgtgatttagtttcttcaggctgttaaactatagatttcatgtattttgtaggtctgttgagag

SEQ ID NO: 4462 - DNA, 3000 bp, Unknown
  misc_feature (1)..( 3000): cDNA_ID_3073341_gDNA_ID_1620707_Annot_ID_165342 3000 nt of promoter + ATG
ttctcaacaaattcactctttctgtactgcataccaagtaggagacatcaaaaaaccaaaactgaaggcatatctaagaagagaacccttataaagaatcatactcaccccatcatgacagccaagagaaaggtgaagaccgggatggatggttgaatggcagcagcataagtgggatttgtgtatgtaagaccgataagaaataacaactggttcccaaataccctatcaaaattgagaacaaagcagaggtggctttactgagatatttaacctctataaacatgaacacaagatattgagactggatagagatgatttcttaccctgctaagcccagaaagaagaatgacaagagaaggcttttattcattggagttctgatctttctacatacatgaaagacgaacactgttcactgattagattttgaaaacttgaacattcaaagtttgagagtggtctcgcttaaacttgacgcattacaacctcctaaaccattctttcatttactgatagaactagacaaccctagctcgagaaaccagatcctatttatcccaaaacccgaagaagagacatggaactcagagaacattatcaaagacattgtatctaaatctactaacagtggaagtaaacggaacacagatctcaacttaagtctaggcacattgctccaactctgaaatctagttcttctataatgcagatcacattgactttaaatcctcaggagaacttctacagattcatcagagaaaaacccaaaagcaaaatacgaaaatccatactaatggatcaggcaattacaaggggactgtgtatagttctcacttcatatataaacccacaaattgatcataaaaccaggaaaccattgaaacccatctcgagaattcagaactaaaaacagaggaaacaaaaacaagttgaaaaagaagagacctttcgcggaagtaagcaagaggagcgagaatagagagagcaagaagatcacggcatacacagaagacaagctggttgactccaacattaagagctactttagtaatcacatggtatccaccattaaagagctgaacaaacgccatagcagtgtgcgccatccgagcgtctctctccgccgccgatccacttccggtcaggatcatcggcgccgtcatctttccgatttactcggcccctctctgacttgtagttataagttatttctaaagcaaagactaaaaaagtaagatcctttacttcgttagcaacgaatctgcttcttctatttgtcgagtcctataggttctgtgcaaattttcatatacaatatctaggagatttaattctcaaatcgatctacttttatttgagtctgtatcattttatcaaaatatattcgtgtattattaaatctggttaggacatcaggctcatactcataggctgcctaatttaggcattaaaaattgaattttcataagtattttgaataaaccatttgactcaaattttaattgaaatacgttaaaatttgtaaataaagtaatcaaactagggccagaataaaatccgaaaaccgaaaaccgcatccgacgacttcaaatcttcaaaactgctcctctcttctctctttaaaatctttcagagaggtaatgttaatcatcggttaggaatctcttccgggttttcccggatctgtaaatatctctctttgtaagatttaaataatttctgactctttgtcggattctgaataccggctaagttcggttttttgtttctcgcttctgcgagatagatctcttcctttacgcggattgaagactctgttttactttaaatctctgccaatctcaccaacatttcgtggagtaatatcttcatcaattccttatgcccatagagtatggagcaaagaaccaactacatcaaatttggtgttgtcaatgatggagctttcctggagtttggatatgctcgaagatttttgaagccaatcctcattcgacccagagattctcgatgtcttagccttgggtttgagatcaccagaaggccggaggttttttatcgctatttggccgattgacggtggatcatcggactttcagcggcggtcggtaatttcagcggtggagctcaatgcctagacacgtggcgtaggatcgtgatacatcgttgatacatgatgtggatcgcgacacgtcatctgcaagtgtcattaaatcaatttgcgttaatgtttatcttttcttagattgattttgggtctgggcctaacttgctgtattcctctatggacttgtgtaacttgcccatttgggatttaatgaaataagccgacaaaaaaaaaaaaaaaaactggaaactgtaaaacgatatgaataatctggctccgaaaccgaacatataaagaattctcctatccaaattaccggaaccaaattcgactcgaatcaaaaaccgaacgaatatctgctaattcgaaataaaattatatatctaaaaatattagttatatttagttatactttatacccaaaaaatactaaataactaaaatatctgagataatttttatatccgaaatttttaagttatatttgttataattatacaatattttgcaaaattaaactaaattttagtaaaattaaacaatttttttgttttttctctctcaaaaactgatccaaaaacgaatcgaatccaacaccatccaaactgaaaccaaaccgaataatcatataattcaaacggataataaactccctcatcctgattattcgaatccgaaagtattcgagctaaatccgatccaaaatccgagtacacaagcttaaatcaaacaatagaaataaataactaatcacagttgcaaattagatattttttgaatataaagtttacaaattgaaattataaagaaacggagggagtaattaaaattaaattgaggtatttcaataaccaaaaagcccatcattgggtaaatcttcacatcgggac

SEQ ID NO: 4463 - DNA, 3000 bp, Unknown
  misc_feature (1)..( 3000): cDNA_ID_3090982_gDNA_ID_1620707_Annot_ID_165341 3000 nt of promoter + ATG
ttcacaatgacactggagcacttaacaattagcatatttgaaagagtaaaaaagaatatggcataccttggtgcatttttaagaacctcaaattcttcttcagtaggaagagcacgaccaaacacatctttgggtcgtggtttcttcctttcctgtgtgcgttctcccccaccttgtgattcttctggtctacattgcgtcaaagagagaatattgtcaaatttcaaccacaaggatttaacttaatatcgtcctagcaataatttgtcaaaccaaatatctgtttctgtcaacatacctagaaccaacattgtcgtccgccactggatcctgagttgaagaaccctgacccttgtgtttctcatccttgtattctgctgctttggcactttcaggatcatagccaggtggacgaacatacataaagctcacagctttcatcgtttcgatctgcgcattaatctcaggaatcaacatcatgtaacacaaaactaagtaaaatcactagtttcaccaaatttcaataattgtataggttttgacatctaactaaggatcaaaagagttaagacatagctcaaatggattctgattggtaagagtcagcaacaagtggatattacaattcagcctaagaattcaaaactatcatcaccagactacagaaacctaatctgatgcattagggcacttgtgaacaaagttatcctcgaaactgaactcctaacaagatctgaataacataaaccctaatcttactcagaaaaactaaccttctctctttctttcttcgagataagagctgcttgcttgaaaaattcctgctcttgcgcaaactgcaaatccacgaaaaaaggagtaaggaaaacacgaattgaatcaataacacaatcacgagaaattggagacgatgtgcgatgaattacctcgcgagccacctcttccgctcttcgatcgtgttgggcatgagtctgctcggcgatccatttgcggcgctgattgggataagaaagaggatgccatggcttctgattcaggaaagagtggctccaagcggtaccggatttggtcttgtaatcgacttctaagctaccgccggtgaccttcccgccagcgaatctcttgctcagccgtattccgctcccttccccttcgccgtccatgtcccgatgtgaagatttacccaatgatgggctttttggttattgaaatacctcaatttaattttaattactccctccgtttctttataatttcaatttgtaaactttatattcaaaaaatatctaatttgcaactgtgattagttatttatttctattgtttgatttaagcttgtgtactcggattttggatcggatttagctcgaatactttcggattcgaataatcaggatgagggagtttattatccgtttgaattatatgattattcggtttggtttcagtttggatggtgttggattcgattcgtttttggatcagtttttgagagagaaaaaacaaaaaaattgtttaattttactaaaatttagtttaattttgcaaaatattgtataattataacaaatataacttaaaaatttcggatataaaaattatctcagatattttagttatttagtattttttgggtataaagtataactaaatataactaatatttttagatatataattttatttcgaattagcagatattcgttcggtttttgattcgagtcgaatttggttccggtaatttggataggagaattctttatatgttcggtttcggagccagattattcatatcgttttacagtttccagtttttttttttttttttgtcggcttatttcattaaatcccaaatgggcaagttacacaagtccatagaggaatacagcaagttaggcccagacccaaaatcaatctaagaaaagataaacattaacgcaaattgatttaatgacacttgcagatgacgtgtcgcgatccacatcatgtatcaacgatgtatcacgatcctacgccacgtgtctaggcattgagctccaccgctgaaattaccgaccgccgctgaaagtccgatgatccaccgtcaatcggccaaatagcgataaaaaacctccggccttctggtgatctcaaacccaaggctaagacatcgagaatctctgggtcgaatgaggattggcttcaaaaatcttcgagcatatccaaactccaggaaagctccatcattgacaacaccaaatttgatgtagttggttctttgctccatactctatgggcataaggaattgatgaagatattactccacgaaatgttggtgagattggcagagatttaaagtaaaacagagtcttcaatccgcgtaaaggaagagatctatctcgcagaagcgagaaacaaaaaaccgaacttagccggtattcagaatccgacaaagagtcagaaattatttaaatcttacaaagagagatatttacagatccgggaaaacccggaagagattcctaaccgatgattaacattacctctctgaaagattttaaagagagaagagaggagcagttttgaagatttgaagtcgtcggatgcggttttcggttttcggattttattctggccctagtttgattactttatttacaaattttaacgtatttcaattaaaatttgagtcaaatggtttattcaaaatacttatgaaaattcaatttttaatgcctaaattaggcagcctatgagtatgagcctgatgtcctaaccagatttaataatacacgaatatattttgataaaatgatacagactcaaataaaagtagatcgatttgagaattaaatctcctagatattgtatatgaaaatttgcacagaacctataggactcgacaaatagaagaagcagattcgttgctaacgaagtaaaggatcttacttttttagtctttgctttagaaataacttataactacaagtcagagaggggccgagtaaatcggaaagatg

SEQ ID NO: 4464 - DNA, 3000 bp, Unknown
  misc_feature (1)..( 3000): cDNA_ID_3073345_gDNA_ID_1620707_Annot_ID_165340 3000 nt of promoter + ATG
ttctcgagctagggttgtctagttctatcagtaaatgaaagaatggtttaggaggttgtaatgcgtcaagtttaagcgagaccactctcaaactttgaatgttcaagttttcaaaatctaatcagtgaacagtgttcgtctttcatgtatgtagaaagatcagaactccaatgaataaaagccttctcttgtcattcttctttctgggcttagcagggtaagaaatcatctctatccagtctcaatatcttgtgttcatgtttatagaggttaaatatctcagtaaagccacctctgctttgttctcaattttgatagggtatttgggaaccagttgttatttcttatcggtcttacatacacaaatcccacttatgctgctgccattcaaccatccatcccggtcttcacctttctcttggctgtcatgatggggtgagtatgattctttataagggttctcttcttagatatgccttcagttttggttttttgatgtctcctacttggtatgcagtacagaaagagtgaatttgttgagaatcgaaggtcaaactaaggttggaggcacacttgtgtgtgttatgggtgctgtcttcatggttgtatttcgaggtccggccttgttaggagataaagatgcagactttgcgatgaacaatgaaatcagtgctaaaggtcaacctgagcctactggttggttagtctctggttttctcgatcttggatttgagcaatggcacattggagttttatgcttgattggaaactgcatgtgtatggctacttttcttgccattcaggtaaatctcttcattgtttttgtttcttatggttaggtttagaccaacgcataaactgcagcctactaacctctgtgcatgtgtcttttaatgtggatataatggaaactctccaggcgccacttttgaagaagtatccggcaaatctttctgttgctgcattatcatacttctttggcacagtactaatgtgcacaacagctttctttatggtaaaggagccattggattggaagctaacacaatctgaggttcttgcagttatatatgcagtaagttacatcaagatttttttttcatctactcacatgtttctcgtggaatcatttgacacaatttcatctggtttttcttctctctagggagttatcgcatcagcactaaactatggactcttgacttggtccaataagattattggtcctgccttggttgctctctacaatcctcttcaacccgctgcatcagctttcctatcgagaatctttctcggtagccccatttatctcggaaggttagatacattttctggaatctttttcaaccatccacaatcttcacttgcaaaattaaacactttcacttttcaacatcttgttccatttcacagttttcacttgcaaaattttctaactcggtttcttttcctctacgcagcgttgtgggtggattcttcatcattctaggactctatatggtcacttgggcatcgtttagagagcgaaaaacagcggtttccgggattgggattgcgccccatggtctaaaaacctcagagcctctgatatttaatgggacagttaacagactaggacagttgttttctggattacccagttcctctgtgaaatctgcagactaaaaagataccaaaaagttaagattcagacgagatcccattttacaacagctataactttttgttaactttcatctcttattaatatcttcttcgattactactaatcacagattcacaagtacttgctcccttgttaattactctttaatcttgaagctcatctaattcgcattggttatatatctaaaccatatattagctatgaagatgacattttatctttacctttgaattttttaacaatagataacattcagtgcaagatatacaatatagtcttaggttaaaagggggatatcataaagttggaaaaagcaatccaagaaaaagctgtgtcttatttggtaagaacacataacagtagtggcaaatgtacgaattccaaaaaagaagttggttttatcccaatctagtttaactttttcgcaaaaaaatcacacgagttatcaaaaaaacgtggaactttattctttctttttggcaactaaaattgtttttagccttaggtaatctcttaaaggtatacaaattggatgagtgacacacaccattagcattttaatatcggcgccattagcattttttaaccaacaaatagacgatttgttaaataaattactaagaaagaaataaacttatttcatttacatttccaccccaaatgttttcaaacattctaaatttcccctggaaattgaaaattgagcaagacgttttctgttgaagagagaaaataaaaatcagagaacaaaaagggaaagagtcttttctgcacaaaacggatctctctccaacgtcttcgtcttcctctggtctgagtcgtgtggttttagccccgatactcatcagatctgcttaagattctcgatttttcttatacgaagacgacgattggttgattaactcatatatgtatatgtgcttttatactccttagacgcagagcgagatacgagatctaagagctgaggaagctttgacggtggctgaagtttcgtcttcgttctatgccaatgcgtgtttctggtattgtaccctagctatccaattttatgattgagtcgttgtgttgttatcgcaatgttgatttaactgcagatcgctcctttcattgtgtttgttgatttgtgaatcactcaagctcttttccgagatttttgattgaagacataaattgtcgatattcattgttgaatgcatttgatttgatttgtgtagttaacattttctgcagaagaatgaagaatctgaagagttcgttgtgcttctgcatttgagtaaagacaacggagaaggttgtgttgagtttgttagtatatgtaggcaagagaaatg

SEQ ID NO: 4465 - DNA, 3000 bp, Unknown
  misc_feature (1)..( 3000): cDNA_ID_3073357_gDNA_ID_1620707_Annot_ID_165331 3000 nt of promoter + ATG
tttcgcttttagtatatgcttggtgagaattatatatttcttttatttttaaattgtaactttaaattttactttaaacggtgatgttcgagatttctcgaatgttaggtataatgatttgagatcttcttgtatttttttacacgttaacatgtttggtggtccatttagattaagcgattataaaattttctcttcgtttccctaatgctaataaaatatgagtgttttttcaacaatcatttatacggatgaagagcaaactcaccgtatgtaaagtatttgcagtttgcttgtaaaaaaaatcgtgtttcaaaaatattttaggacaaaaaaattagatatacaattgtaaagtaaatctagctagtcgtgttcgttaggtggacgatccgaaatcgaataagataaactaattttaaatatgattgcaggaacaaattaaaaattatgcttaaacatatttttctataaaacaaatataaacaatctccttaatattcaaaaatcgcatattccctaatccctaccattatgcaacaagttaaaagttctacagagggaaacaatttgaatttattttcgcctttttttttccaaacaacttgaatttgtttccctctaattatatccaacaaaaattggaacttgtgatccggaccggaactagatttcagcatcttgcaatctttttaaaacatgaaagaccgatttttttttttgataattaaagacgataattccaaacgtgttgtatcatcgtatttaactcttcaacagataatatcaacatttattattttataaacatgtaaacttataacaataatggcggtaattttattttatgtttggtaaatccccatgaatcatgaataatatatagctctcatagaaaagtcaagaaaaaaaaataccagtgttacatcgtggaaggcaagaataaagaggcggccacgtaaagataccgatgaatccttagcgggccataataaagaaaagacacaaccacgtgataatcccacggttatatatgaaaagaacaccgtaagttcgtagagtgagacacagacgattatagcagtttcgaacgcgacacgaccacaatatcatcaatgacgatcgaaccaaagtagaaaatattctttttctagctcgggaatataaaatcgtagggtttttttttggtcatcacgagagaaccgcacattgaaaagggaaggaagagagatatttggcagagagagaaaacgttggaggaaggattgatatttgttggactttggatcgaaaaattgaaaggtaaaagaggtagagaagctctggattccgtctcttcccgtcgtcggcgacggtggttttgcccgttggctctgaggtatttctttcgcagatctccatctctccatttcatttctctctttatggtctcgaatttgatcagagtggatctaatttttcgttttgattaatataaattcatttggtatgcttggattcgtctgtttgggatctgtttgagtcggatttgatgtgttcggattatttgattgaaatttagggtttcttaggtagaattattgatttagtattgattgatatatcctcgaattggatatgtttgttttccagctttttccagcttttttcagatctgtgaggtataaagtgggccaatagttaggtgatgatggcaccacggttcagatattgtgctttgttatcttatctgcattttaattattgctgctaggtttttatggtttcgtgaacgatgattacttttgctaatgttgtttatgagactgtaatgtaagttgagtccatttttagagcttgcctggcttttggatggttttcttctagctattgttgtgtccatctttggatttcttataattttttaattgctttttcattgctatcaggttatatcaggctttaatttaagtggattgtcatcttctgagatatggaacaagtttttgtctggccaagctgctaccactatcggcttttctcattccaagaagcgctcgattggcggtttcttgtacgttctgatttccttgtgggctctttcgttaactgcacttagtggtcaaaccctcttctatgatctttaggggaaggtgtgaggcaaatttctgagacaggtatggctttcgattaaacctgttttattctacacgagtcttccctccttagatagtttgccattggaactttagtgcgtgttatgcatttggtacaagttgaatttcttgtaattatcccaattgtagtttttaataggtttcattaagatggtttagactttcttatgagtggcaaaataagaaaatttgagaaatggtaaaactgctaattttttttggacaatttgaaaaggaaaaatataaacaaacaatgaacacggaagtgttgtatgccatcacgtcaaccccacacttaatgatatcttttgtgcacatattcatatctatcagaggatatttacatatccgacattttcgttttttttgcagggctgaagtctgcaaattcttccttcgcatagtcctagagaaacctctttgttcctctctttcatatcttgttcttatgggtgctggttgaagaaagatacatcaatttcttttctttttcagtttacaaatgtcgtttccttgagtctgaacccctgagtgagatgttgtgagcatagggtccttcctattagccaaaacagtctttcttgttggttccttcgcgtctttgagttctcagtatgtgttttcctcttctcttgctctctttcttttgcctaaatggtcaacccgtttatgttcgaagtaaataacggtcagtctacccagctggagaatcattgattttactgccttggtgtcaagtacttcctacgaacgactggaagattaatgctatataaatctttcagaagttctttacttacataatataaagaggctactttgcttaaccagaaaaaaaaagatg

SEQ ID NO: 4466 - DNA, 3000 bp, Unknown
  misc_feature (1)..( 3000): cDNA_ID_2176945_gDNA_ID_1620707_Annot_ID_165322 3000 nt of promoter + ATG
gcaggaatactattgggcctgaaacccaaactcctacccagcccacaaaagctacagacacagtttaatctctctgttcttcttcacacgacgaggatgaagaaacaaaatttccgctgatcttatattatctcaccgttaataattatccaagtcttgaactttgacagagcttgtaattcgaaacttttcaaaatggttactttgtgttgtgttgtgtgaactcttaaaataaagaataaatgaatgttattttatttttagtcgtcttcaagttttggtctgcgatcgtgaaatttacgcagagagagatcagaatcgaagaaaacattgcaatataaaagagtcaccttcgagttcgtgtctcactccgataaagcaatgagtctattcgggcttggaaggtgaattactgattcctctccgtaatttgtccgaaaaaagagagtattttttctagagatttcgagattgtttgttatctcagatctttcgaatagttattcctgattgggtattaatatttcaatatgttgatttttgtggatttgctgagtaatggttgtgaatgaagatttgattgttcaatttttctattattcagaacttgatggaaccaatgttaacttactaccattgtcaatgtgtcctgaatgattcttgtcaaaatcttgttcaagttaatgtagaatttgcttatctgattctatgaatttgcattgtttatgttcatctgattagaaatcaaaagactttccgtcctaagaagagcgcaccatcaggaaccaaggtttgtagattcgattatttgacttgtttcttttacaaatgtgattcatgtttttgtagccttataaagcgtgttgttttgatctttttagggagcagagcttcgaaagcatatagatgcaactttaggtagtggtaatcttagagaagccgtcaaacttcctccgggagaggatttaaacgaatggcttgcagttaacagtgagcttataactacaccatcactttttcctcatggtttcactctgttgattaagttgttgtttttcttcagctgtggatttcttcaatcaggtgaatctgttatttggtacacttaccgagttttgcaccccggagaactgttctacaatgactgctggtcccaagtacagatttctcttcttcattatataagtaattttggtgctcatgattgatatagtaatttgatcactgttttctcttaagatcttgaatacaaaaaactttgaaactgctggagcaatatgggcatttgtaaagtggaaaagagtctttgtttttgagtgacaattatctcgatgatcaactactgactcatatgtaactattccattggtgaaatgcgtcggttgcaacgtttcaggtacgaatacagatgggccgatggtgtacaaatcaagaagcctattgaggtttcagctccaaagtatgttgaatacttgatggattggatcgagacacaactcgatgatgagaccatatttcctcaaaaacttggtaaaataaccttactctggcatatctttgatgattatggataaaaagacattggtctcaatccatggtaaattctgacaggtgcagcttttcctccaaacttcaaggaagtggtgaagacaatctttaaacgactattccgagtttacgcacacatataccactctcatttccagaaaatagttagtctcaaagaggaagctcatctcaacacttgcttcaaacacttcatcctcttcactcatgtatctataaaccctcttttactcatcattaatcttccattctagtcttttatcagtcactgagtttgttgatttttgatttttattggtctggttttgttttgcaggagtttgttctcattgacaagaaagaactcgctcctcttcaagaactcatagaatctatcattgcaccttactaaaccaaacaaaacccaaatcctctgtccaattacaagacttttttttttcaatcacattcatggtaataagtttaaccccaactgtaaaaaattgctgtttctgtttgtaaaaaaagaatatgcaatacactgctgaaccttggattttatttaaatggttacattcgaaatttcactggattacatatatgactcgtttacataattgctatgaagtttgttgatcaataactttgaagttttggctttcgttgaaaaggaaaagactaactttttgtatgtttgcataaatgttgtggtgttgtactgttgtcttacttaaaaactaagaataaagacgtcagccaattattgtggttcacgtgtatgtggttaacacgtcagctattttgttgatacggcgtcgttttcttctctgcctaacggaataagatggccgtcagcgaccttctcaatggattgcttcgtcacctaacgacaaaataccaaaatgcggttttgaactgatttggcatgactttaattaattaatgactcctccattaaattaaattaaaacattattcatcatttatgtttgtttaactgactaaacttacgtctttggcgtgattagttattttaatttatttatttattttgagtatacacagatatttctctctctgctgttttatttttttatagaaaatattaatttagctttggatttttttctttttttttctctgtcaaagttgaattgctttttctcttgtttttcgtcgaagtggaaaatttgattttattttttccggaattttgaaaatctgtgagctcataaatcttcgctaatcgcagagacgaatctgcgaaaattccaacaccagattccggcgccggagcgccgatgaacaatcaggtcgtttagtaaaattcgatgaatctcccgcggaaataattagattcgatttcgatttccgtggggaagttttgtgccatttgatttgttttcgttcgtccccgttggagattttttgtaatttctggggacagaaacaatg

SEQ ID NO: 4467 - DNA, 3000 bp, Unknown
  misc_feature (1)..( 3000): cDNA_ID_1824305_gDNA_ID_1620707_Annot_ID_48916 3000 nt of promoter + ATG
caaaacaaatcgatacatggataatggggttattggatatattgtagccaattctatacggatagggagccctacgtttccacaaatatattgggatggatattaaagcattttaaaaacttactgaaaataaacattgaatattatatagtcaatcagccatcgtcatggggttagaataaaacaagcactcctttcaagttgatgctttgttttaatcaaacgtcatgatcccaatactaatattcccattttaacgtcacttaataacgtaattaagtcaagataatttacgattgatttttttagcataagtttaacctaatcttcaaattatgttgataatccccgcttaagttcttctttattttaatcaagtctactaaaactaataatgtattatgactcgattgccttgataaaaaggtaaaactgaaaagcacaagattttctcttctcccacctaacttttggatttctctattgtttttccacaaggaagacctaaatttcttagtttaatggatgattaattgttttgccaaaaaaaataatatcacaatggccaaccatgataaaaatgactgaaaagaaaaaaaatcattctatgataattagctaaaagccatttgagcaccaaaatataatctacagcatgtatttgtaaataattagtacgattatatggatttgattaagtaagagaaaacatttattcaaaacgtaacataattatttattaatggatcatatgtgtgttattcacgtggttgtatagtaacgttattgcgtgaaattcattttatatgcatacttgttggaattcaatacgtactgcataagtgcatagatatgccaatattcaagtgccaatgatgattgtgccgtgttcctaccaatcgttgtggatgagcatatataccatccacttacgagtaaattaaaaagaggcaaaaaaactattattggtttatcttaaatcgtttcatgtaattttcataagattcgtctatcagaatcgaatcttattaaaggaaaccacttaagaaatattaaaattgagtagacaaactaaaatatatagcactcgtaaaatataattaagacaaggagcaacattatccagttttctttatacatgggatctgcgggaatatatgcttatgttctggaaaaataatggagtaattgagttttataaaattgcgtgaacctccaaaatcaatgtatcaaattcagatccacataaaagttatcaacataatcaaaattatctttcaattatattagtgcttccaaattcctagtagtctaaatatcttgttctttgacaaaaaaaaaatatatcttgtaggttcggctttgaggaatctaagaaaattaccggacccaacttaagatatattagtatttagtgacgtgtaaaactaataccataaaaataaaatcaattatggtgatttagtagaatataaataaaataatgttaagtagaatttaatgatgatttatgatatggccaaatgaattaacttataaaatagttaaaaagttgttttgtttaataattgaagaaaaattaagaaattatttaatagattggtaaactaatttatctaaatataattttcaaaaataatataaatgatataaaactttggctaccaaaattgaactagtcctctttgggttggtttgactgtttgagaaaattgcttcttacagtttagctttgttgtctatgcttggccttggctgatcgacaaagtgattcgcataatcgcatcttttggatgcaaagacaaataaagatatactccaaaagatgcgactataacattcttttcaatattaacgctactttatcatcaacataaattacttaatcaacaaaacatgaaaataaggaacaaagctcgaaacgcaacatgcactacggaaaaagaggaattaaaatgaacatgtctacaatttgtcagtgaagttttggatgtttctactatgatatggcttgtttcatgcctaccatatgataagtgttctcgtgattctcgctttatttttgcatttttttcatttgtttgtaaatcacttattattgttgtttttcattttttttttctgcgtttggcgttttactggaactttaagttacagaaaacatgaatagggaaatttgttaatatgtaactaaggttagatattttgtaagtgacgtaataagtaaacagattattccatatcatttgtattataaaaatatgaaaattgtggtataacaagtaattttttaaagtttttttttcagttgttttatgttgctttccaaaaatatattaacacaaaaaggaggcaaaaataatctttaaggaaaaaaaaaactttttttaggaaatttttgaagaattaataaaaataaaagaccatttttcatattttcacttaattaaattggcttaactctgcaacaagtgtcgtcatcagtccttttaaaacaccttgtatcttccttttaccaaatccgccattgaagaataagagagagagaagagaactactcagatataaaaaccctagatttcttctcttaaaacccacatcgaatctcaactcagaaccaacaatgctccaacctttctcttcctcctctgttttctcgagaatcctctggactttcttggtttaagaagattcgttgttgaatcagagagaaagaaagcatccatttttctatcattgcttgcttgctatggaattgggtaaatctcgattctacttatgttgcaattgcttttctcctgttagattttccgattattctttagctggaagtgattatccagacgccatctccatcactttcaattgtattcctataccttcttctgaagattcttcgtatttctcgattcgatgtttataaacttcaaattctcttccaaatcttgaaacgaatttctcccaaaaatctctgtttcttcacaaaaaaacaaaaaaaca

SEQ ID NO: 4468 - DNA, 3000 bp, Unknown; identical to SEQ ID NO: 4463
  misc_feature (1)..( 3000): cDNA_ID_1838565_gDNA_ID_1620707_Annot_ID_48918 3000 nt of

SEQ ID NO: 4469 - DNA, 3000 bp, Unknown; identical to SEQ ID NO: 4462
  misc_feature (1)..( 3000): cDNA_ID_1824297_gDNA_ID_1620707_Annot_ID_48919 3000 nt of promoter + ATG

SEQ ID NO: 4470 - DNA, 3000 bp, Unknown; identical to SEQ ID NO: 4461
  misc_feature (1)..( 3000): cDNA_ID_1824291_gDNA_ID_1620707_Annot_ID_48921 3000 nt of promoter + ATG

SEQ ID NO: 4471 - DNA, 3000 bp, Unknown
  misc_feature (1)..( 3000): cDNA_ID_1824283_gDNA_ID_1620707_Annot_ID_48923 3000 nt of promoter + ATG
cttttaatgtcggggaaaatggttttgacaagctcaaattcaaccattgttttgtcaatatattgccggtttggtctgaactctgaactctgaagaataaataaacaagatatgatttcgggcaataattattaatgctaattgttttaagctaaaggggaggggggagaggaagaaattttggttctttattatatcaacaaaaaacataacgaaaacatgaatctaggtatatcattttaatctgcatatccgaaaatgttccctatactaactaatacacgaatttattataagggaaacaaatagacaggtgatattttaaattagagctctacacatctctttttttgcttggtggctcaacaaaaacttcatcttcttttggtttcaaactctacaaaatcgtggatgcacttacagttatatataattagatatattactgataatatagattatatgatatggatctctctctctatatatacattgtatttaatccattattccatttactcaactcagacaaactatgattaatagataatatatatatatatatatatatatatatatatatatacacactgatacatttatatatcgcatatatatgtttgtaatcttgtatatatatctaacgtatggatgcatgaattttacaaaatgagagaaccatttattggtaagacttttctttgatatcatgaaggaagcagccaaagtaatatatattttatgttctgattattatatttttctccgctccgccaagtcaattgataaatttcgtgcaactaagaaaaatatctgcatcttaagctaagtcatatcattagaaatataaatatagaagtcatattcttatgttccttttctctaatcagattacatttaaaacccaaaagtttgaagatatatactagagttatttggctttgttacgttaacgtgggaggaaaatagcgagtgtttctgattaaagtcaagagcaaatgagcaatacatatttgtctgtatatgtatccatgagttactagtcgaaaaaaaaatgttcattacttttatgttatgtttatttttgtcaacaggtcgttgcagatttgcagcttatcttaaccctaatattttacacatatgtcatgtatgtatttctcagaatcaagttaagaggttaaacaaaaaaggaggttaaccagggtttgtagcttataatatattttatatttattatatgtagtttatattaatttttgtatatataagtgaaaaagctatgtaacaatattgtaaaaaacaacatatcatttaaattatagctccataatatatatagggaatagaaacaactcaaatgtaaataatatagtggtaagactcctaaattatataatccttaggcctcaaaaaagaatgcgttagaatgtaaattaacggtttaaaattttctgagaaaaaagatgatgaggattcggtccacaattctccgattaaccatataaaactctaaactttcatataactcttatcatgaaaccgtaaaagatcgtccataattattgatccagattttttcattaaataatagaaggattcaatatgattttagctagatagatttgggagtttaattagctggtttagctaattcaccagaaaatgttttatctaactagtactaattagcatattgtattttacatgttatcccaaatgaattatttttaattttcacacacacacacatgtatacacttttcatctagaatgccacacatcttcattttacttttagtcattgttagttgtatttttttgttaatgaatgattgaaaactgaaattgcaatataagaatattttgataaaaaaatatatatgacacaaatgcaaataataatagagaattctcaatatagaattgtttaaagaaatctatcatattaatctaaaaaattattatcaagatataaattaaaaaaaaatatcttatctaattctatatgtgcatgtggtatgtgtaataagctactacagacacgtaaacagatattactactttgaatagcaattacatttataactttacaaagaaagactacatatgtagtaaataaatctcaatattcaatctcgtttagccatttgtcatgatatttgtatgtagatatgctatataatatcacaaatatcatattcaagtagtaaaaaatctaaagaaaaaatagttgccaaaacaaaagagataagtaaaactagtcttcgtagttatctctctgaattatgcatggatatcattcccactcttttattcactctactattaagaaaaaaaaacgtgctgtatatgaaacaaaaaaaaaacccaaagaaattgttgatgtcaattgatataacacatatctgaaattaaatatttgatgtagcacaagaaacttaaatttaaaaaccaaataaacttataaagggtagactttaccccacatttgtctctctctacttaagccaaattgctctattcttttgttttctctttataattaggctttataaaccaacttttattaagaacaacaaaaataaaattgttatttatttggcaacagaacgaattattaaccaaattaatccatttgaatggccctcctctctctctgtctttaattagttggtttggtcaaaatctcacacgctctttatgcatgctctttgacacgtgctatcttcgtctctctcaaatgagctgtctctctaataagagtttcttctgtataggaaaggaaaggtctctctctctctatttacttatgagaatagcctataaaaccccttcacatctcccacttgttttgcatcacaaacatttcttccattacattaaaactccaaaaaattcatttttgttttcttttagagttcacaagttcttcgttgttcagctactcccactgtcataacacgaagtgggtttttttctgatcaaagaacaaaaacaaaa

SEQ ID NO: 4472 - DNA, 287 bp, Unknown
  misc_feature (1)..( 287): cDNA_ID_1822388_gDNA_ID_1620708_Annot_ID_48925 3000 nt of promoter + ATG
aagcttcgaatacttcaacgctctcgtcctccgtgattggctaatccgtggccgtcgtctctccgagtcggaatcggaatcggagtcgtcgcttactttctccgacggcaattccacttctcgtatcagctctctcggattgttagtttccttttgctcacaatttttgataaaacttctctgttttaggataagtctgattttattttattttctgtttcaatttttctgatatcagtttgcattacacgacggtgaaattgggtactccgggaatgagattcatg

SEQ ID NO: 4473 - DNA, 3000 bp, Unknown; identical to SEQ ID NO: 3920
  misc_feature (1)..( 3000): cDNA_ID_1824402_gDNA_ID_1620708_Annot_ID_48926 3000 nt of promoter + ATG

SEQ ID NO: 4474 - DNA, 3000 bp, Unknown; identical to SEQ ID NO: 3925
  misc_feature (1)..( 3000): cDNA_ID_1824395_gDNA_ID_1620708_Annot_ID_48928 3000 nt of promoter + ATG

SEQ ID NO: 4475 - DNA, 3000 bp, Unknown; identical to SEQ ID NO: 3926
  misc_feature (1)..( 3000): cDNA_ID_1824387_gDNA_ID_1620708_Annot_ID_48930 3000 nt of promoter + ATG

SEQ ID NO: 4476 - DNA, 3000 bp, Unknown; identical to SEQ ID NO: 3927
  misc_feature (1)..( 3000): cDNA_ID_1824383_gDNA_ID_1620708_Annot_ID_48931 3000 nt of promoter + ATG

SEQ ID NO: 4477 - DNA, 3000 bp, Unknown
  misc_feature (1)..( 3000): cDNA_ID_1824374_gDNA_ID_1620708_Annot_ID_48935 3000 nt of promoter + ATG
attccccatccatagccgcaaatatgagagtcttgactaaatctgattagtaatttgaataagtaaagggtagcaatgattcttgtcatagttaggccaagcttcgtctcctttcacaagcgtctcatggcgcttccaaacttgtgcatcgtagttttcagttaaaatgtagtgtaaaccaatgtccttaatctccttcatgaacttttccaaggagtcacctctcttaggactgaaaaataatgcttcggaggcttttttggctttaagcagcatcttgatggttctcgcaaggtccttatgaaattccttgaaaaatgtactgttgaatcataaaaatatgtgtcatgataagggatgagaaaaaaacatatcgaaaaagcggaagactaaaatggagagcaaggtaccaatcgcttgcaactatgatgtcgaaagtgttggttaactctgaaagttgatgctgattccagtgcaactccatggcttttacgcttgtgccaccaaatgccatggagttggtttctatgttacgtttaatatctggatgttaagtacatcaatgaatccaaaacgttttgagtaccgagattccatatctcaagggtttcagccatagaagaagacaattctaatgaaacagtatatgcacaacacaaaaacaaaacatgaaggatacaattgactacttgggggtttccatcggagattaccacttctgatgcctcggttgcagctgcaataactaaaccggctaatccataccctgatccaagctcaattactcttttacctctgcaacatcccaatgagccgagtaaaattaagtagacgaagttataaaagaacaaagaacacagatgcaaatcagtcttaaacctgaaacgttctggctgagacttgcaaaagtaggctagtacttcttcagagggccactgacctggaaaacaacgacagtatgaattcagagaatcacaatttagatagcattagagttccctaagcaactaaatcttttttattcttaacttgtttgaatcatggttaatgccacgttgtatattgacagactaaaagtttaagcagatatagtttggttagcgattgtatcagccgcaaacaagccaaatacacagagcagagcagcaacattgtactactaagtttcaaaaccaacaaagacactaatttatgtgacaagtagagagatacagtgagattgagaacttacagacaagtccagtattatcaatgttgtatcgattagatatctcgaagtcattgagatcactacaattatccactctttgtctgcatatattttaaagaagctcttaggagtggcaaatctatcgaacaaaacataacattgtttcatttgatgaaaacttcagatcaaaatcctaacgttagatagagtttgggagagccagtgatgggaagtgtgtagcaaacggatgcttcacgagacttatccgattgaggagaagagtccaccacttgacaaggaatcaagttgaatccttgagttgctttccttgaaatccgtttggtctcagtttgagattgagaatctgaggaaaattgaaagatgatccattagctatgcgaatgtgtgaaatcgaaaagtggatgcaggaaggagaaggagtaggggagtatcaaccagatctacggagaagcgcttggcgaagaattttccatctaagagcagaggaagaagaagaagtgggatccattgaagaatcgttatagctttctccgccggaatctgaaatttctcttgcagactaaacagcaaaacagggaagatgacgatttcgcttcccggcgaactttagtttggtttttttgcctttttaacacagtactttttgggggtcaaacaaagtacagtgaaaattaaattgtcaactgtaaagtacagtaacatttagattctgatctcactgatgttaattattttaaaattgaggacttgttttgtaatttaatattaaaagtgacacaagatgacaacacaactgctataactcaaaagtcaaatgacaattgtcaagggataaaagctgtatgttagaaataaatcttattcactctttagatttggtgcacaattttttttaaaatctatagattttcttaatcttacttatttatacagttttaattactctaaaaactctattgattttttttttgacatctaaaactctattatttaattttcaaataattgtacttcatagagtgatatgagattatgcaattgatttcttcttaaacaaaatagaaaataacatgtgacagaatattatgtttttagtagacatatatttttatacaaaaaatagtataagtgttatatccctttaaatcttattcttatttttatacaagaaaaaattttcatcatcataattgattataccttttaatcattttttttgccttttatgttttctaatagaaaaaaaaaccaaagttttcctccatggtttaggtaagatcctactgttaaatagaatttcatttggcaaaacaaagtcaatacagattaccattatcatagtcaattacacatcttaattacttgaataattcttgtttagtgtgacactaaaaaaggtggcaaaacaataaacaaatgtacaatatacactcaacaaaaagaaattttggatataaacaaatttaatatttggataaagcgcgggaaaatctcctaaaatagttaaaaaaaaggttaaaccggcccggttcatagtcaaaaagtatgctcctcttgaaacacgcaacgcccacgtcttcctatctccgagactccgacagcaaggttacttaacagttaatcaaactagattcgctttcttccatcactaatcttctgactttttctatttctgccccaaatctttttcaaattcatataaataaccaaacacttgttcttcttcattcccccttcgtcttcctcctcctaaatcaccggcgataatg

SEQ ID NO: 4478 - DNA, 3000 bp, Unknown
  misc_feature (1)..( 3000): cDNA_ID_1450444_gDNA_ID_1620708_Annot_ID_48936 3000 nt of promoter + ATG
cttgacctttcgaagccattgttaatccgtagttcaacatctcgttctctgtttcgttgactgaatgatccgatgactcggattctttaacgggtcggagcgagaagaagtaatgagactcatcgactttaacggcgggttcgtctttagtcaacggccattggatctcgtcaccgacgcgagcgaaaaccgcgacggtgatatctccttgaacaagacggagaatctcgagatcgccgcaagcgagctctacgctgtaggatttgtcaatgaggtggaccatcgcgccgtggattgtgagaatcacttcctccgtcgcgagaggaggcgctgaagctgagtcagaggcggtgggatcggggaagatattgttgacaagatcattgacattgattgaaggatagagattattattattagtagaagaggaggaggaagaggacttagggagaggagcaacggtggttgaagtgtcgacggttggataaagcttgggaggagttgcagagcattccattatcgccggtgatttaggaggaggaagacgaagggggaatgaagaagaacaagtgtttggttatttatatgaatttgaaaaagatttggggcagaaatagaaaaagtcagaagattagtgatggaagaaagcgaatctagtttgattaactgttaagtaaccttgctgtcggagtctcggagataggaagacgtgggcgttgcgtgtttcaagaggagcatactttttgactatgaaccgggccggtttaaccttttttttaactattttaggagattttcccgcgctttatccaaatattaaatttgtttatatccaaaatttctttttgttgagtgtatattgtacatttgtttattgttttgccaccttttttagtgtcacactaaacaagaattattcaagtaattaagatgtgtaattgactatgataatggtaatctgtattgactttgttttgccaaatgaaattctatttaacagtaggatcttacctaaaccatggaggaaaactttggtttttttttctattagaaaacataaaaggcaaaaaaaatgattaaaaggtataatcaattatgatgatgaaaattttttcttgtataaaaataagaataagatttaaagggatataacacttatactattttttgtataaaaatatatgtctactaaaaacataatattctgtcacatgttattttctattttgtttaagaagaaatcaattgcataatctcatatcactctatgaagtacaattatttgaaaattaaataatagagttttagatgtcaaaaaaaaaatcaatagagtttttagagtaattaaaactgtataaataagtaagattaagaaaatctatagattttaaaaaaaattgtgcaccaaatctaaagagtgaataagatttatttctaacatacagcttttatcccttgacaattgtcatttgacttttgagttatagcagttgtgttgtcatcttgtgtcacttttaatattaaattacaaaacaagtcctcaattttaaaataattaacatcagtgagatcagaatctaaatgttactgtactttacagttgacaatttaattttcactgtactttgtttgacccccaaaaagtactgtgttaaaaaggcaaaaaaaccaaactaaagttcgccgggaagcgaaatcgtcatcttccctgttttgctgtttagtctgcaagagaaatttcagattccggcggagaaagctataacgattcttcaatggatcccacttcttcttcttcctctgctcttagatggaaaattcttcgccaagcgcttctccgtagatctggttgatactcccctactccttctccttcctgcatccacttttcgatttcacacattcgcatagctaatggatcatctttcaattttcctcagattctcaatctcaaactgagaccaaacggatttcaaggaaagcaactcaaggattcaacttgattccttgtcaagtggtggactcttctcctcaatcggataagtctcgtgaagcatccgtttgctacacacttcccatcactggctctcccaaactctatctaacgttaggattttgatctgaagttttcatcaaatgaaacaatgttatgttttgttcgatagatttgccactcctaagagcttctttaaaatatatgcagacaaagagtggataattgtagtgatctcaatgacttcgagatatctaatcgatacaacattgataatactggacttgtctgtaagttctcaatctcactgtatctctctacttgtcacataaattagtgtctttgttggttttgaaacttagtagtacaatgttgctgctctgctctgtgtatttggcttgtttgcggctgatacaatcgctaaccaaactatatctgcttaaacttttagtctgtcaatatacaacgtggcattaaccatgattcaaacaagttaagaataaaaaagatttagttgcttagggaactctaatgctatctaaattgtgattctctgaattcatactgtcgttgttttccaggtcagtggccctctgaagaagtactagcctacttttgcaagtctcagccagaacgtttcaggtttaagactgatttgcatctgtgttctttgttcttttataacttcgtctacttaattttactcggctcattgggatgttgcagaggtaaaagagtaattgagcttggatcagggtatggattagccggtttagttattgcagctgcaaccgaggcatcagaagtggtaatctccgatggaaacccccaagtagtcaattgtatccttcatgttttgtttttgtgttgtgcatatactgtttcattagaattgtcttcttctatggctgaaacccttgagatatggaatctcggtactcaaaacgttttggattcattgatgtacttaacatccagatattaaacgtaacatagaaaccaactcc

SEQ ID NO: 4479 - DNA, 3000 bp, Unknown
  misc_feature (1)..( 3000): cDNA_ID_1824368_gDNA_ID_1620708_Annot_ID_48938 3000 nt of promoter + ATG
ggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatccctttttgttataactattacaagtttttagctttatttgatatggatgctctctccttttcttctatctgtttctggaaattttgacctcatcatattacttatgtcatccaaagtttgagttttgtcctttttattaaagtgctgctagtttcagttcattgcttttgtacttggatgttttgactattagcagcacaggtatgacgtctcaagttcaatagtactttttaaccctttgacacaagatgaatccaatccactggttcttttgttgttggtaattgttatagactttttagctttatctgatatgagtgacatcccaattatcaattgtgacttaattagtaacctgtgaattgatggatatgattttgcagtttcatccttctttaccaataaaggactggatacaaatcttgtggacaaagttcaagtgatgacctcagtcttacctgattaatccctgctttgtacagtcatttagggaatgtcacagtcgttttaaagggttaaaagtttgaacctaattcactattaactaaatccaagactgatgacgaatcttcctgatagaagaaactggaaaccaaagtttggtgttcaccttttcatgtccaaacaaagccacaaaatcatatgatcattggttagaagattatagtaataaaccacatataaaaacctgattaggttaaacatcatccacatctccttgtttatatcatcacttggatccaatcaacgaaaaccttgctaatcacctcagatcgcattaatcactaatatttttcatggtattaagttccattgtcatatagatgtctcttgaaatggtagcttaatgagcaattttaaggttatggatcaatttcttttgatatttggtcagtttttttttattccaagtgcaatcgaacctgcaacttctactagttttacatccaaaaactcggatcttcaaccacacatggatttaaaggttatacttcattttatagaaatatgcactaaacataaacgcaactatatagccaaatctctaatcagtcataccaattttgcttggatgtttggaaagaagatcaaattcaataaatttgcatagtagaaacatacatgagacctaccccacttgtagtatttgtttttcctatttgaacataagaaccggtcacatgtcttagtcaaaacataaataacttgtaacaatggaagaagcatgaaccaacaaagttaatatctctacatcacacaactaaaccttggaatgtcgttgacccaacaccctttctttataaaacaatctttacggaaattctcatccaacgttagccactgtatctctttccaataataactcaaaaaaaaaaaaaaaaaaaaattgtattcctctcctgaacttctgtattgtatgttcctgcttgaattctaaatagagagagatagatgtttgagagtctcacgaaatatcaaacatcatcatatttagttttgtcatcttgtacttattgtaataattaattaacagtgacacaacacaacttgggtggatagtagctatagatactttgtaagaccgtgtcccttggaagaaagaagagggcagaatctaaggatggcatcacacaatacgttttctttgtcagccttttttgttgttcaccttatttccttcaatacatttccattttatggtgattagtctgcgttagtgatcgataaaccactaaccaattttttctcgctctgctcttttacttaaagaaaaagaaaactacaaacgaagtaatggatcgtctaatatattatttaagccaaaggaggagacaagttctattttagatcaccgacatcaagactgatcaatatccatatgcaacccatattgtcatattgcacgaatcatacaaaataaacaattaagaacatgatataataatatttctatgattcaaaagaaatgtttctacatataaatgctcattaaaaataataataacgtgaacatgaacgacacattggccgactaacttagacaaaggcggcatgggctcacgtgaagccgacctttctaaaaaatctccaagccctttaaaagattcaaccatcccctaaacctctctctctcactccaatttctttcattaccatataaatacaacgccttcacatttgcactctttatacatttctctcgagagcagaaacagagtcaccggtaaactcatctccggcgacataaaaacacaaaagttcatatatttagattctggtgactctctgctctaatg

SEQ ID NO: 4480 - DNA, 3000 bp, Unknown
  misc_feature (1)..( 3000): cDNA_ID_1824360_gDNA_ID_1620708_Annot_ID_48942 3000 nt of promoter + ATG
aacctgatttcagagaagtcccatggccaaccattagcaacggtgccaaagatttcgtgaagaagttgttagttaaggagcctcgggcacggttaacagcagctcaagcgctatgtatgttatgcacaagcaaatgccatatatttccattatttttggttaacttataagttactcaacttatggatttggtttgtagcacattcatgggtgaaagaaggaggtgaggcctcagaggttccaatagacatatctgttcttaacaatatgcgtcagtttgtgaaattcagccgtctgaagcagattgcacttagggtaatagagaaagagatagtttgtatttcatacgattaagtttttcagtatttttcttaacctgagttgttgtgtttttggaggctctggcgaaaacaattaatgaggatgagctggatgatctcagagaccagtttgatgcgattgacattgacaagaacggttctataagccttgaggaaatgaggcaggtaagaagaagacagcacaagtaagcgatttcaacacatgactgcaacagagtttgttgactttctaatcttaacaggctcttgcgaaagatgttccttggaaactcaaagatgcaagagttgcagagattctccaagcggtaggtaaacttagagtattaggactaattaaagccccttcgacaggttagtttatcatccaaaatgtttatgtgtctctgcagaatgatagcaacactgatggtttggtggatttcactgagtttgtggtggctgctttgcacgtgaaccaattggaggagcatgactctgagaagtggcaacagaggtcaagagcagcatttgacaagtttgacatagacggagatgggtttataactcccgaagaacttagattggtcagtctcatgcttttcacactcccctctttgtctaccttgtctcactagaatcaatgtttgcagcaaacgggtttaaaaggctccatcgaaccacttcttgaagaggccgacgtagatgaagatgggagaatcagcatcaatgagtttcgcagacttttgagaagtgcaagcctcaagtcaaaaaatgttaaaagccctcctggttaccagctttcacaaaagatgtaaattactttttaacttctcaaatcaccaagtccacaaactctaatctcccatgtacaggaacagaacacatcatttgtcacaatctgttagatgggatttgtatagaggataccgaggaacgcacatctgccgttaggtttgaatatgtttctcaagtcttataacatcggtcatagacaatagttcagttgcaaagagatataagcaaatgcttttgtgttttatttgcttgtgataagaatacatcgttaatcatgtggataatctacaacaagtttaatcatggtaccttctcaatcacggtattaaacacaagttcaggggaatatgtttattggtttatggcttcaacatgtcatttacggtaccgggggaactatcttgaacagcttgagataatgagtaactattcgatgagcttgcagtggttgtcaagcttactttcttctcttttccagaaacatcctgcatggaagtaaactctggtcagtccatgaaagagcttgttggcaaaactattgaagagatcactcacctgttgagctaaagaagaggcatggattttaagctcgagctttaaacgaacatcatctttttgatcatttccttgacctgaatggttactgttcatcatcagatccaaatctaacggcttgattttggaatcttgtttcattgaagcatcggcagaagaagaagaatgctgctgaaccgatgcttgttgttcggttagaggattgacagaggctgaataaggtataaaactggactgaccctgagttatggctacgaaggggatatgataactgtaatgaggtacccatggaaccatggttttgattctatgctgatattgagcattaagaatctcgatatcagactttaaagtcgctttctcctctctcagctcactcttctcttgaattagctgatcaaacgaactggaagatgagcacttgagcagagcatattcaactataaatccaataagagaatggacaaagttaatcaaatcacctcacgagactcttgagatagtgtttcatactcagcttttagtctatcaacttggttcattacatccttgagcatttgtattgtatcagtgagaactgaggctttgtcactcttaggcctattcggatctgtagaaagaaaccattactctaaactcaattcaaagaaaattttgaaaatctgtattcatcttgtgaaaagatatataccaagtgcatttccaagctcaagaaactgttccttaagcttatctctacgaagcttctctcgctctgctttctgggaacaaactgcttccttcttcacttccaccaccatctcagctcctctgtaattagacgaaactatgaataaacatgacacagccatgtaaagttaacatctttaagcactaaaacctgagattttgtcccgaagaagaagaagaagaagcagaggaatcatcagcaaaatcagattcagagcaagtttttggtttcattggttgatccatttgcaacgttaaaatctctaactaaactccaagaaagataaagagagagccactgagaagaagtagaagttggttttcgtcttctcattcttcttctacgtgaatatataaaaatccggcgataatggtggtggacgccgacgaggcaaatcaataacttgtgctccccacgcgccaccattgaaaagatatcatatgctacggttagttacaaacttacgtattcacgtgtcaaccgtcgattctactgactttagtcttctaagatctcaaccgtccaatcttagagatacccaatttcccctaaaggaatgatctttgtcgaacgaactacagtgggaagaaggagaagatg

SEQ ID NO: 4481 - DNA, 3000 bp, Unknown
  misc_feature (1)..( 3000): cDNA_ID_2993638_gDNA_ID_1620708_Annot_ID_48945 3000 nt of promoter + ATG
tcatccgaacttaagattgcttctgaatttcttacgaattggttgcctttcttatctagagatctctgcaacgactgtgctcatgttctctccgatcgaatccgttctctagacccaggtttgaattcttcttctctgttgaaaattctgattcttttttcataattcgattaaagaaacggaggagaattttcgttactactaatgttgtgtgttctgtttcgaaattttcttcagctattgaattcaatttaatgattggagttacaataatttctaaactaattcatagatttgtgatgattagagatatcgaatattctatgtaatcaagctatcttcgtgagatttctgtatttgttctcttaccttatgtgtaattgtgtttccttattacagagcattgtagtaatggagaagttaaagcgggttctggttcaatggtggataacatggaatctgaagaagttgataacatggaatctgaagaagttgataacaagatggacaatatttatgacgggaagttgtgtgtttctcactcattagatagtttgaaagctggggcttttgtatttggatctttgtcagacagtgtaagtcatgcaatgccatcatctcagtcaactgtttctgaggcggcaagtgcacaaatgtcttgggctgatatgggagaagaagatgggctcgaggaggaagaccagaaagagaatgaattaggttcacatggagttgatgtgagtccttccgttggagactcgatgaagactcctgagaagcgtaaattgtctagggaagaaagagagcgttatcggtttatgaatgtgaagaaaatgaaagtgttttcttgttatgagaaagttagagggaggtctgttaatattctcgaaggacttgaattgcataccggtgtttttagcgcggtggagcagaaaaagattgttgattttgtctatgaactacaagagaaaggccgtagaggagaattgcgaggtttgcttctggttttctttcattgctttttgcataatgtgaatttgaaaactctaaacggtacttatctaatcttgaatttttggttctttttcgatatctagagcgtacttttaccgctccgcataagtggatgagaggcaaaggacgagttactattcaattcggatgttgttataactatgcaccggtaagtgactctttcctcatctttaaaaatgaaaacattttatcaactatagtgaatatggaaagagttttttgttttttggataggacaaagcgggaaacccacccggaatccttcaacgtggagatgttgatccaatgccatctattttcaaagtaataatcaaaaggttggttgggtggcatgtacttcctccaacttgtgtaccggatagttgtatcgtcaatatctatgaggaagacgattgcatacctcctcacatcgataaccatgacttcctccgccctttctgcacagtatcattcctcagtgaatgcaatatactctttggttcaaatctcaaagtcttaggacctggtgaattctccggttcttactctataccgcttcctgtcgggtaaatcactaaagtttgcgtaccctctctgagtttattctactgaagcttctgttgcttaactttttgacgagtttttcactttttttgcttcagatcagttctagtgctcaagggtaatggagctgatgtcgctaagcattgtgtacctgccgttcccacaaagaggtaatttgttagcaccttgattgtttgtcaacgtttatttatatgtttggtaatgaaaccattactctctctttttacaaaaggatttggtgttttgcaatttatcggtgttatctcgttttgttttgttcatactgtttttgctatcgtcggttctgctttcaggatatcgatcacgtttaggaaaatggacgagtcgaaaagaccagtcggattcaccccggaacctgatttggaggagattaagccgttgccatacgaacacaccacgccgagtactcctgctgatgcagtcattagctcttcaagatccagcattgatcaaaatggtagtaatcacaacaatcgaactgcacatggaggaggaagcaagtatcgtaggtcgagagattatcattctgagagtcgagagcggtcatcatcgggccaacgaagagaaacttcacgacatactcctaataggtcctatagacccaaggttactagctccgacaacgtctgagaatttgtaacacgaacataatatttgattttaccacagaacaaattatagaaattgcttctaataattcttttcgttttgaccgaattttttacgataatttcaactatatggttgaatagacgaaaatatcatccaattggtttcttctgaaagaaaaaaaaaatggcgtgaaagatttctctctttttttctgtaaactttcattctccgtgtaaaacttgttcgatgattataaaaaacgaacacaactatattatcagtgttaattacatttccttaaccataagattttgttttcttcgcatttctgaaatttgagggaacaatggggactttttatataaaaaaagttgggacctttatatataactcggctgctgaatttcgtttcgttgcactgctacgctcgagttctcaaaggttctcctcgctttctcttttcaggggagtctcgcagagagacccacaccaaaaaaaaaaatcgagagggaaaattcatcatcttccatcgttaacctcgaggctattggtgttataccagataaccgactcttattaaattagcttaatttgataaacccttgttagtgtctgacctagtggagcaccttgggcttagcgttagggatcgtcgcggtttgggttttagaaaggaggaggaggaagcaacgtttactattcctactatgtgacggaaccctaagacagcgttttcgcttgtctgggtcagctttttttatagccatg

SEQ ID NO: 4482 - DNA, 3000 bp, Unknown
  misc_feature (1)..( 3000): cDNA_ID_2687174_gDNA_ID_1620708_Annot_ID_165394 3000 nt of promoter + ATG
ttcaaaaagatgacttgacattcgtttggttgatgatccttgcatctcttggatcgaaaatcttgcggcttcaacgattttgtcaatgctaatgccctcttgagattcaaatatcctgttgattcttgagcggagaaccattagcagctgatcaagtgttgttgtatcctcatctggctcactggacttactagaggactgtttttccacagatcttctactgcaaacactgttggaagattttgaagctgagttagctccatctggatcactacctactaacttttcaatctccaagaagtcatccatcaactccagtctactagaactcctaggctttgaggaaccattaacacttacttttctcactttatgagaatctagtgaggttgctgggccacactcagaagaacttccttcttcatcaaatccatcttcggacaccgaggtgacactaggcggatagtgatgatcatgaccactggatagactttcagagagatttctgctatttgattttggagcattcttgtcattgttaaacatatgcatctgcccttcaagaatcttaagcttcccaagagtcttagcgcatacatttctcgaaacctgcagttcattgttacgagcagagagatgttctttaagcgtctgaatctcctcctccatttccaatgtacgtcttgtgagatatacattctctcttttgcactcttccaacttatgatcagtagaaatctctgcctttgcgatgtgtgcattgtgattttgagacatgtttctctgtgctcgagggtctgtgaattcatgccctaagccttcaacttctagcttcatttgagccatagcagcaggaccaggaagctttttccgcagaagtcctctaagcctatgacactctgcttcaagttttgcaatctttttcacaccttccagatgctgcttatttgcgatatccgccgacttcaaactcatgtttttctcttcattgcggatctcaacttctttggaagcaacgtgaagatcgtacttcagataactaatctccttctcagccaactgaagattagtcttcaacttttccacatcagcttcagctttagacctctcctcactaatccttactatcatctcagatcgttcttgcaacgatctagtgagtgctgcattgtcagaagctgcccggtgtagtccttcactcaattcatcgatctttccttcaagctcggctttgatcttatcccattgactggtcttagcaagaatcacatcctgcagcttcttatcactctcttctttcacaatccttatctgccttgtacactctttcaacgcatcatccaaatgcgatgctcgatcctctgcagtgagctttaagagtgtaacagattcgagttgacgtttaagtgccaaagtttctgcatcagccttctcccatcctaaaaaaagaacaaaagactataatcagcaacaaaaaaaacatctcaaaacaaacaaaaatgctgaaataacattttacctgaaacagcttcttcagcgactttggcatgttgaagaatcaaagattctttagtgttgatctcagagtgagcaagagtgagtttttctttaagatctttaacttgaacttcaaacaatttgacctgatcctccattctactcatatgtgtgtatgaatccatagttatctgaacatagtttgtgtttttacacttctcctgacacacaaatcaaacacacaaaaaaagacttcaaatgaaaatttctatctcacagaaactgacagattatcacaaaactatataaaacagaggtttggtgtaaaattaaagcacctgattctcaagagaagccaagtaggacaaagaacaaacaggagttgactcgattccaacaactggtttctcagtcgtggctttgtccgaagactttctcttccatggccaacctctaccctccattttttttgctccaaaataatagtactctgcagaatccgtagaagaaggaagaaaataagctttaataaaaaaacagacaaagaactgatagaagttttgaaatttgaactaacgtacaaaaaaaggaaacaaaatcttccgtaaatgttactttcaatttcatccgacaaaatcccgctatatatttattatactgtatcacctcaacaatgaccgttttgttgtttctttctttttttccgcagtgattcacatttaatgatttctttccaaaactatgtaaccaaatttattgaaaagtctactaaaaaaataattcaaatcccatcgcaatgggcgcgagcgagtccttcacattaaacctgatcataatcatcatcagctaccacagtatcgcacttagaacacacacaatcaaattcaaacaaactttcgcttgacaatttcaatcgaaaccatatcttttcaagtttagctaactatcggaaagaaattacataccgagactaatgattccacagacttgagagagcgcaaagatcgaagaacattcgtcgagagaaagaagaagaaagtgggaggagcgtgtatgtgccagagaagaaggagcagtggatgatttatgcgcttgggctgtcgctttttttcaactttgacgctccacaaagacacaacaacgacatctctctatttcaaaaaagttttatttttttattcattttaaatacattttaaaaaaattaacaaataaatcgccatttgttgttcttttttcaaaaacggaatacgagggtgcagttatcctctacgagcaggtgcatgtaataccatctgatggatttgacttatcgtttatccacaaaagattcaaaatcttcccggtttttaagtttgggcttcataaggcccaattagtggcaaatccatcacagtccactagggtttttgagagactggatataaaatttgattttgttcattgttgtcattcgccgtaatctgaagaagacgaagcaaatcctcccacaaagaatcatcc

SEQ ID NO: 4483 - DNA, 3000 bp, Unknown
  misc_feature (1)..( 3000): cDNA_ID_1824344_gDNA_ID_1620708_Annot_ID_165387 3000 nt of promoter + ATG
aacattaccaaaataaataattaaagttttggatggtcaagaattcaccgaaccacctagtcccaccttgtgtcccaacacagctagcttccattaaggatttctgtggctccatagataatgttctcaactgtctcttgacgctgtgtgagctcctgccaacttttattttctacgtagtttcctccaccgaccatgaaaactatcgcttctctaaacggtcccttcacatggctactactactagagcctgactttgaagctctcgggtccagtattaggtatgactctgtttccaggttcggttttccttcagttaaggcttcaacactcaacagcccttgccaccgctagtttctcatcactggataagagattcttgactcccgcgcggtcaccacgtttatagactggccatagagcaatatgacttttgctggctgagtttgctgctaaagaaacgttcagcgatttgatctttttcacatactgaaacgtgcttgtatctatcttagcttcacgcaatgctgcttccacagcttcaacttcggtttggttaacgctttctaaggaaattaagtacatgattgcaaaccgtaacttgtctatattagtacctttcgccttcaaaacagatagaagctcggttctgttgatgctgcctatcatcatcatcatctccttctctttctcatcgtatgcatccaaagattgctccttgatatgtgattatcatccaataattaagtgttgccaatacacagaacaaaccattagcgaccttttcaccatgacctcataagtcttcaacaaactctgctgctcttgaatctctgcagctaaacgagagtcttgtggagagacacatacaggcttggggttattctctctgtaaaaatgcttcatttcggaaagattcttgagttcagaaatgacaactttgtccgctgcctgaatcttctcgggatcgtaaggagtatgagcactttgaagctcgatataagcagatttcaaggacgagatgtttccaaagagattggagataagtgcttccatagcttcaggattttgattgatagactcttccattggttgaggatggattatgtatgtgtttcatgtttggatcataaaaatataagagacagtgaaatcagcactatgcatgtcaccaacagaaagtaaataagagtatcaaatactataacaagtacctacaaatttgcaaaagaacgatccaacttgcaaaaaaggttcttaaattcgaaaaactattgtcgcttgggggaaaacaatgataaccaagaactcacagtccctaaagtcagcaaagctttatttatataagacctttccttgcgccttaaaccactggtttcagcctttgagctctcagaacctgtcaggtcaatgaggttctgcagatatatgtgaaagtgaaattatggtcagttgttcatctttaagtgttcagacagtgcaataataaacagtttgtcagagttaatgaaacagtaagctattaccgaacataaaatcacttgataaaaagaaaagatgttatagcagctccactttcattattgtcaaccaatgtattgaccacgggtgtcataagagaaaagttctactaggttgcaaagtgtgtaaagcagagaactaagctaaagaatgcaactataaactaactacagtaaaagtaaaggctttatatggtcaacagaacgacagtagctacatgcataatgtgagtttgatttcctgtctgggacctcactcaagtataaaccaatgttaacaatccacagaacaaacatatcaaacaaagtgattgtgacaatttctttggaatgcaaagccttaggcggtacctttcctgtataatgtaactgtggcttgttatggctatccacagatgtctttggataaagttttgaagacgacgttgttgaagatacaggggaatcacaaaggctttaacttgcttaatccagcatttgtagactttgatacttgtttagatcctatcacaaacgaaattccaacttccggtgactgaaaaaaaagatgcaagtacaaaactttatcaaataataagagctagcaacaagtatactattgcactttttttgagtttttaagccaatcagaaggctctatttcgtaccctttccaattcatgactttttttatcgacgcacatctctccaaattctccatcgcgtgactcttttagtttttttcaacaaaaccaatgaaaccgaaccgaaatcagttttaatttcaaaaccaatgcataccaaaccgaatcagcaaatagtgtgaatcaacaattctggacagaaattttctcaacatctcaacaacgggaaaaagagaaaacaccacaactcaaaatcacaaatcatagaaaaatatccaaaaaaatcacagtagcctttgattaaactttcaaattgcaaaaatctcagaatcaaagccaagaagaatcctgaagatttctacttccatggcatccaatagtggaagaagaacaatctactgcttcaattaaacatgaaaaacgactcaaagagcttagctttactagttttagtaaaatttctcggcaacaaagtcaaaacagacatgaacgcataaaaaagatactaaaacacattggaggagctcttcctcaccacgagcttgtagagtggaagctgttgtatcacaaaactacccttttgtaaatattttcgtttccgggttaacgtaaacttaagtgggccttttgattcatgggcttcacggaccagaacttttgtcggcgttttgtagtggtaaattccaaaactacccttttgtaaatatttataagcaaatccgacctaaatttgttatcaatgaaagacgactcaaaagagcaaagtaaacgaactcgagaaaagtttgttcgatccgtacaaactgaaactaaagtacggaaacagcgagatttggtttgtgcgatagaagataatg

SEQ ID NO: 4484 - DNA, 3000 bp, Unknown; identical to SEQ ID NO: 4481
  misc_feature (1)..( 3000): cDNA_ID_3073372_gDNA_ID_1620708_Annot_ID_165386 3000 nt of promoter + ATG

SEQ ID NO: 4485 - DNA, 3000 bp, Unknown; identical to SEQ ID NO: 4479
  misc_feature (1)..( 3000): cDNA_ID_1824368_gDNA_ID_1620708_Annot_ID_165376 3000 nt of promoter + ATG

SEQ ID NO: 4486 - DNA, 3000 bp, Unknown; identical to SEQ ID NO: 4477
  misc_feature (1)..( 3000): cDNA_ID_3072158_gDNA_ID_1620708_Annot_ID_165372 3000 nt of promoter + ATG

SEQ ID NO: 4487 - DNA, 3000 bp, Unknown; identical to SEQ ID NO: 3919
  misc_feature (1)..( 3000): cDNA_ID_1824395_gDNA_ID_1620708_Annot_ID_165362 3000 nt of promoter + ATG

SEQ ID NO: 4488 - DNA, 3000 bp, Unknown; identical to SEQ ID NO: 3920
  misc_feature (1)..( 3000): cDNA_ID_2134143_gDNA_ID_1620708_Annot_ID_165360 3000 nt of promoter + ATG

SEQ ID NO: 4489 - DNA, 3000 bp, Unknown; identical to SEQ ID NO: 4483
  misc_feature (1)..( 3000): cDNA_ID_1824344_gDNA_ID_1620708_Annot_ID_48946 3000 nt of promoter + ATG

SEQ ID NO: 4490 - DNA, 3000 bp, Unknown; identical to SEQ ID NO: 4482
  misc_feature (1)..( 3000): cDNA_ID_2687174_gDNA_ID_1620708_Annot_ID_48950 3000 nt of promoter + ATG

SEQ ID NO: 4491 - DNA, 3000 bp, Unknown
  misc_feature (1)..( 3000): cDNA_ID_3073448_gDNA_ID_1620711_Annot_ID_48990 3000 nt of promoter + ATG
acttcttccctcaccgaaatcagaatcgcgggcttctgttcttccatcattagttaagacgtcgtgttcatgagtagttgcaactgttttgttttgctggttcttctcactgtatctcctcttctcttttgttttgataccaacagcaaaactgtgcggttgtgctttttcatggtttatatcatcgcatcttctctgtcgctttctttccccaccaacatcaatactgtgcgcttctggtgcttgatgatttttctcattacctcttcttacccttccctttcttccctcacctgcattagaaatgcacgcatatgaaatttcataattcttctcattaaatcttcctcgctgctttcttcccttatccgaatcaatatcatcagccttagaattttcccgagaatgagtttcagcagcaactttttgcattttctgactcttctcgatcactatccatttattgtttaatccatcaccttcccttctcttcccactaaccataccacttgctccagaaacattaacctccactacattctcaacacctccagcttctttctccatcattaaacccacatctactcctcctaaactctctctacatcccttcctagacttgtcagtcagcataagcttcttccctaactccaaacacttgacaactacacgcttataccaacaataaggacaatagaaatttccaaattcatcgaaatcaggttcatcagatgcacaactctgatgaatagctatagtacattcctctccgtaacataccaaaacccaattgtctttcccatcacacacgaaacaagtattagtctttacaacattatcactatcacctcccttgctttgccctaaattttgagtctttcctccaattggaccattctcgtgagttttcgggttttcttcatcaacgtcgtcctgcgttatcacatcaaaacaatcaccaaactttcgaaagaaagtaacaaaattgacttaaaagatgagaattttcgattttttttatctccagtaagtacagagaaacgtaagaagattaccgaatcggaggataaaattcgagaactcatatcttcttcttctttttgcaatttcttctgttcatcgtttcagaggttaattcctgcgatttggttcactttacttctttcttattgggctgtttatggcttcttttattttcattaggttgggctgtgcccactaaactttactttaaagtaaaacagataaaattttaatcaaattcaagagaatataccaaattcaagagaaattttaaccctaaaatcatgcatataggaacaaattctaatcaagttcatgaataaaataaagatccaatagagtattaatcgaaacaatcatcaagactgatgaaaaaaactatctctgccaataatcggctttactcatgcttagcttcttttaccattatgtatatcaatcatgtcttacaatacatacatatactcgttaatgattcaaattaccctaattttactgacaacgaacaactttattttttccaattcgatgaatcataattctaagaactcacatcacatcaattcatataatcagagagagatttttacgttgacaaaccgattggtgaatgattacctccaatttttaaatcaaaattcagatatcgatttcgaaagttcacttcgttgattagatgaaacaaaaacgctgtggagataatagcgtaaggacgaccggaggtcataaacctaattaaacccaatttaccatttaattttgttaacattcttatctatgaatcctgctaataatcatgtggcctatttcaccatgaactaaattgctttatcgtttccattcaccgaacttttttatgtgcttataactacatgaacttaaatttaatttgaatttacaatacaaactatgaaaattcggtagaaaacctcaaattgctagactgtagaatatcatgttacatttcagcttctcaaaacattattttgtgaatattttactctattataatgctagttaacatatatattaatgtatttaatgtttgagaaaatacgcatgtcaaaatgccggatgccagcttctcaaaatatgtattttgtgtaaattttactttcttacataagagttcaaaataattcaaaattgtagtaaatattgaattctttagcaaaaaaaaaaatgttcaaattatatgtgataaaattattttttgtttccaaaaaattggtcatttggctttgttttatttttttaaaaattaactacattatactctctctattttacaaaaatctcatttaaaaaccgtcgtttacttaaaaatataattaattataaccagttcaaccaatagaaattcaaggccttagatgaagttttttttttttttttttttggcctcagatgaagttaggcacggtgattaccgcaccgacatattgtataagcgcgtcacagagaataactacccaacacacccacgattttcttgattttcgttattcgctctctttgcgaacgcattaagcaaccaaagcaaagcagtgagagagattatcagcgtgaccttcgaaacaacccaaagtccctcgaccacctcttctagatctgactccctcgtagatctccatacctggatctctctctctcaggtttgctctcgaatactctgagatctgttggattcgcatctgcttcttctttcgcgttttctgattttgtattcatcgttttcgtattccattatatcaattagcttctgagttttgcgtttatgatccatttgagatctgatctattgatccaccgatctgattcattaatcccgaatctggttactacgaatctgatctacatgcataaaccatttcgatttcaatgtattcgtgagaatgtgcttgaatctgttacaatagtagtgatttttactaatcgtgagagagtttttgtattttgatacaggaagggacaatg

SEQ ID NO: 4492 - DNA, 3000 bp, Unknown
  misc_feature (1)..( 3000): cDNA_ID_1824561_gDNA_ID_1620711_Annot_ID_48991 3000 nt of promoter + ATG
aacctcaaatccaacaatctcataccccaatgccttcttcttatcagcttcagagatcacacccataccttcttcaccagtaccaatcacctccatgacattgccttcatactcatgaaccaaaaccttaaacttgaggtgattaatgatgtaatcatcattactgttaggtggcgaatacccaacaggatatccagtccactggatagtaaccccattctgcttagcgaatctcaaagcaggcaagttatcaagaatcatattcacttgatacaactcacgagttctctgtttcaagagcttgacctcatgctcattcaaaggactcgtagtgcataagtaaagagactcattggttctcatccgaaacctataagcagagttatcaatctgatcacccatgagaagctcaccaagattctcagcacttttcttgataccttcaagtggttggcagtaaggaagactatagtaactgaaaggaagctcagtttcaatagaagtcaaggaattgactttggcgaagatagagtctccatctgaatatgtgtgcatataactccctggtaagtaaaacccattgcaaagctgactaacaaacaccagtaacacgaatactcgatacacaccaaacattgtcccttcctgtatcaaaatacaaaaactctctcacgattagtaaaaatcactactattgtaacagattcaagcacattctcacgaatacattgaaatcgaaatggtttatgcatgtagatcagattcgtagtaaccagattcgggattaatgaatcagatcggtggatcaatagatcagatctcaaatggatcataaacgcaaaactcagaagctaattgatataatggaatacgaaaacgatgaatacaaaatcagaaaacgcgaaagaagaagcagatgcgaatccaacagatctcagagtattcgagagcaaacctgagagagagagatccaggtatggagatctacgagggagtcagatctagaagaggtggtcgagggactttgggttgtttcgaaggtcacgctgataatctctctcactgctttgctttggttgcttaatgcgttcgcaaagagagcgaataacgaaaatcaagaaaatcgtgggtgtgttgggtagttattctctgtgacgcgcttatacaatatgtcggtgcggtaatcaccgtgcctaacttcatctgaggccaaaaaaaaaaaaaaaaaaaacttcatctaaggccttgaatttctattggttgaactggttataattaattatatttttaagtaaacgacggtttttaaatgagatttttgtaaaatagagagagtataatgtagttaatttttaaaaaaataaaacaaagccaaatgaccaattttttggaaacaaaaaataattttatcacatataatttgaacatttttttttttgctaaagaattcaatatttactacaattttgaattattttgaactcttatgtaagaaagtaaaatttacacaaaatacatattttgagaagctggcatccggcattttgacatgcgtattttctcaaacattaaatacattaatatatatgttaactagcattataatagagtaaaatattcacaaaataatgttttgagaagctgaaatgtaacatgatattctacagtctagcaatttgaggttttctaccgaattttcatagtttgtattgtaaattcaaattaaatttaagttcatgtagttataagcacataaaaaagttcggtgaatggaaacgataaagcaatttagttcatggtgaaataggccacatgattattagcaggattcatagataagaatgttaacaaaattaaatggtaaattgggtttaattaggtttatgacctccggtcgtccttacgctattatctccacagcgtttttgtttcatctaatcaacgaagtgaactttcgaaatcgatatctgaattttgatttaaaaattggaggtaatcattcaccaatcggtttgtcaacgtaaaaatctctctctgattatatgaattgatgtgatgtgagttcttagaattatgattcatcgaattggaaaaaataaagttgttcgttgtcagtaaaattagggtaatttgaatcattaacgagtatatgtatgtattgtaagacatgattgatatacataatggtaaaagaagctaagcatgagtaaagccgattattggcagagatagtttttttcatcagtcttgatgattgtttcgattaatactctattggatctttattttattcatgaacttgattagaatttgttcctatatgcatgattttagggttaaaatttctcttgaatttggtatattctcttgaatttgattaaaattttatctgttttactttaaagtaaagtttagtgggcacagcccaacctaatgaaaataaaagaagccataaacagcccaataagaaagaagtaaagtgaaccaaatcgcaggaattaacctctgaaacgatgaacagaagaaattgcaaaaagaagaagaagatatgagttctcgaattttatcctccgattcggtaatcttcttacgtttctctgtacttactggagataaaaaaaatcgaaaattctcatcttttaagtcaattttgttactttctttcgaaagtttggtgattgttttgatgtgataacgcaggacgacgttgatgaagaaaacccgaaaactcacgagaatggtccaattggaggaaagactcaaaatttagggcaaagcaagggaggtgatagtgataatgttgtaaagactaatacttgtttcgtgtgtgatgggaaagacaattgggttttggtatgttacggagaggaatgtactatagctattcatcagagttgtgcatctgatgaacctgatttcgatgaatttggaaatttctattgtccttattgttggtataagcgtgtagttgtcaagtgtttggagttagggaagaagctt

SEQ ID NO: 4493 - DNA, 3000 bp, Unknown
  misc_feature (1)..( 3000): cDNA_ID_3000049_gDNA_ID_1620711_Annot_ID_48992 3000 nt of promoter + ATG
ttcggtaatcttcttacgtttctctgtacttactggagataaaaaaaatcgaaaattctcatcttttaagtcaattttgttactttctttcgaaagtttggtgattgttttgatgtgataacgcaggacgacgttgatgaagaaaacccgaaaactcacgagaatggtccaattggaggaaagactcaaaatttagggcaaagcaagggaggtgatagtgataatgttgtaaagactaatacttgtttcgtgtgtgatgggaaagacaattgggttttggtatgttacggagaggaatgtactatagctattcatcagagttgtgcatctgatgaacctgatttcgatgaatttggaaatttctattgtccttattgttggtataagcgtgtagttgtcaagtgtttggagttagggaagaagcttatgctgactgacaagtctaggaagggatgtagagagagtttaggaggagtagatgtgggtttaatgatggagaaagaagctggaggtgttgagaatgtagtggaggttaatgtttctggagcaagtggtatggttagtgggaagagaagggaaggtgatggattaaacaataaatggatagtgatcgagaagagtcagaaaatgcaaaaagttgctgctgaaactcattctcgggaaaattctaaggctgatgatattgattcggataagggaagaaagcagcgaggaagatttaatgagaagaattatgaaatttcatatgcgtgcatttctaatgcaggtgagggaagaaagggaagggtaagaagaggtaatgagaaaaatcatcaagcaccagaagcgcacagtattgatgttggtggggaaagaaagcgacagagaagatgcgatgatataaaccatgaaaaagcacaaccgcacagttttgctgttggtatcaaaacaaaagagaagaggagatacagtgagaagaaccagcaaaacaaaacagttgcaactactcatgaacacgacgtcttaactaatgatggaagaacagaagcccgcgattctgatttcggtgagggaagaagtgggcaaggatgtttccatgagaataaccagcaaacgaaagtgtcgtctactgaaagatgcgagcaggaaatccctaggaccaataaaagagtgtcactcggttctggattaggggaggggcgatatcgggagggaagacatattgaaaagaatcagcataccgaaactgttaaaactgaaactcatgggaaggaagtttctaaggataggaagagaaagcgggaaagaggagtggaaagagatggggatgagttctatttggcggagaatcaagacagacaatgccaagctgatatgagaaatgatgatgtggccttcaataagcaagcgactggtttcagcacagttgaacaagtagagcgaaagtctgtatcatctatttcatctccggagtctacaaacaatgttaacgaccctaatgttgcttttcaagagttagctttgatcatccaccctaaggctggtgtacaagaacaacctatcgaagcacgacctttacgctctgtctcttcgaagaaaccatcttttcaacctgaaaaatacggacacaaaagttacctggagaagaatggacctgcgtctaatgatcccgcacaaaggtttctattcatttggaacttcgtgacatttaaattgcctttagcataatggatgtttttgaggaagattcctaagcagcttgtcacgggctttaagctaacaatttttcttccatgtagtgctacaaaaaggaaaagacgattttggacgctggcagaagtagagatgcttagggtatgtaacttgcacatttctctctatcctacgtatatttcatgctgcagttatcttggtttttcgtaatttggagcttacacattcaacggctctttttaaaggtttatgcctgttttagtttatcagctttataaaaacagccagggtagctggtcttatcatctcctaagaggcggtatttcattttcagtcgtaatgcaattgttttgtagactagacttcataaataagagcttatcctccaaatcattgtgaaattatatctgagatatataacattgtttgtggctgtccaaattaaatattttgctatgtagtgcacaatggtgataaatgtggatttgtctaacttcgtcctgtcctttaggttggtgtgcagaaattccctggcgagaggaatattccatggcgcaaaatcttgcaatttggtcgggatgtgtttcatgatgaacgggctccaagcgacctcaaggacaagtggaagacgttaaacaaaattccttctgacacggggaaatgggtaagcctttcaactgaaagacaaccgaattactatgtgtctgaagttagttctgaatgacctatcggacttagcaagcattagagcttagaagagtagtagatagggctttgcagattttgtacaaccttgcttgctcctagtttgctaaatgtatatggagcaaaactgatcttaccttttaacactaaattcaaaaaaaaaaaaaaaaaattgatcttacctttctaatttgtatgtcctcggcaatgtagagaattcacaagagtgagatgatatttcatgacacttgaacacaagtttatactaaaaatcatgaaccaatgttgtacttcaatatctattaaacttttacatgtcttttgatatggatttctctgcaattgtaagacaaagaagaaaacagtaaggtcaattttacacttcgtgtaaacaaacttttttctaagtttttaatgaattaaaaaatagatgttttagacagaaaatgatgagggtagaattcccgccagtgcgtgggttcaactataaatcctttaaccgccacgtgtcctagaagagtgccacgtacagccactatcctccactttcggcttatttctgtcggtttattctctgctcactgagtggcaagaaaaaaagaa

SEQ ID NO: 4494 - DNA, 3000 bp, Unknown
  misc_feature (1)..( 3000): cDNA_ID_3000053_gDNA_ID_1620711_Annot_ID_48996 3000 nt of promoter + ATG
atttaaactgtttaacagacaaagaccaagaataccaaacttcaaaacgaaaatgccgaatcaatgtgacgagacagcgtaaaaagcatgaggaagggttctgatatacacatgacccataaccaaaagtatgtacaaaagggaaagaaaaattcagccttcaaaacttagcaaatggtttttcttccaactccggagaggtaagactagacctaaacccggctctaattcttgaatttttccagatcagaacctgaaacactacaaatctcgtaatgcaaccttcttgcttctacgatatcaataatattaccactacgatcgttagctattcgatttggaagagatatcaggaatagatgcacaagacgcagccttgtgctggatgcttttcatgctcagctccatgcttctatgaaccatgtcctgcagcagtttcttagccgtttcagcagctttttctgccccgtcgacttgtactgcaatgccatagacaattttctctagtgttaatggagtcatttctttctcacgaggggtttctctcagtaggtccaagagaactctggctctatctcgggactttgatgttccatctactgttgaacttaggagacccgggattgcaccttctttcagtatgagttttcggtacttatctcggtcgctgcggcatagagaaagcagagctccaactgcgtgttctatgctgagtggagaaccatcctctacagtctctactaaagtcagaataccatcttcacagctggtgatggcatttcgcccgtcctcagagtgagacaggatcatctcaaccaaggctgtggctttttcagcaaacttggaatgttttttgcattctttaaggaggtggatgagcgggtagacagctttagcatcaagaattggagcagagtactctttgcaagctgataaattatgaagggctgtgacagcatctactttcccttgtacagttccggagctaagcatctgaatcagaagcggtggaactccagaacttataatcatcgccttgttggctggtgcagctgaaagtgttagaattgctgcagtggccaattcacgcaaactagcattgtggagcttcagaatctgtatgagaggtggaacggcaccggctttcacaatctcaatcttattcctggtcagaaatcacaacccaaaataagtaatgaccaccacaagaactgaaaatgcaaatctatttccacacagattacaaaggatctgtagaaaatactgctggagcaagtaggtaaattacatcctacatttgctatctttatccaaatagcagtaaactacaggtaaagctagacctagagcaatcagatcagtgtccaaaaagcagtatcctcttggtttcaacagatctaaagtccaaaatgtagctactctcagtacattctgatgcctgattgatagagttaaacaattgccttaacactaaaactacaaatccagaacaatgtcataaatcaagctctgagcagagattagtgaagtcactaatcctaaacactgcctaaagcctcagatcgagttaaattagacctagaagacaagacgagagaatcagtttctggtacatggcaataaaacctagaacaatccaagagagattaccgttcatttctaacggcgaggttaaggagagcgaggagagaggcgtgacgagcatcaacgttagaggagaagagcatgggaacaagcggcgggataacgccggcgtcggcgagttttgacctagcggaagacttaaccggagactttctaagcagctttcggatttccttagcggcttcaattcggaaatcgagatctccatggagaagcttcttggagagatgtagaatcagtaattcctttgtggttttccatgtgttggtggtggtttcctcctctgcttcgtcttcttccgatatatttgccgtcaccgttgagtcgccggcgatggaagccatcatctgattctggttctcttccaccaccattatctctgtctctctcgctcgcttgctcgctcttgtgtttgtttctctctagtcaaagacgaaacgacgacttatcgaatcatctacttaattaaaacgaaagttatggtattagttgaaagagcccatatttctcgaggttagttagttcacaatttaccaaccgggacatttcaatattttaactttttcaattttatgcaaggaaagaatataagaaagaattagctagaaaaattattttcaaaattaacaacaaatcccgaatatttatataactatttaaaagtataattaggttgttcgtttgatcgccgcatctatttgcgacagcagcaaccatgatgatattcgtttggtggacgcaagacgatgtggtcaaacgttaaggcaaacgcaagtagctgcggttaaaaattgttgacatcattttacttcaacaatatgcggtagagtttgctgctgccgttaggcgtaatgaaacaaatagactaacacaaagaataaacgactacaatttataatttttcatttataaaataaaataaaaattggaatatattgtgcggaattcctatatatcagaactcattgatctgctgcttcttctgaaagttcttaagtggttccacgatgtttccattttgttctgacttccgaggccaacgagatgagtccaataaacaaagggcacggaaacattctttttaaattaggtttgtttttttatttttggtttttggtttttcccggaaattgtatgaagtcttcgttacagtttctctctctcaccttctctgtataaagtcttcttgagatcgaaggataacttcaattcaattctctccaaggtacacacaggtacagttttctccttcattctctcttgtttgagatttctgaagatgggtttgttaaaaaagtgtacttttttttgttctctctcgtgtagctgatttttgtgataagaagattgattgag

SEQ ID NO: 4495 - DNA, 3000 bp, Unknown
  misc_feature (1)..( 3000): cDNA_ID_1824549_gDNA_ID_1620711_Annot_ID_48998 3000 nt of promoter + ATG
gagaattcaatatgttcaactctagcaagtgatattacattattcgaaaagatatcagaatcaacgtatcgtgtacgtgttaattgtttctctgaggaccctgacaagagccagtctgattcggacgactccgggagtgttgatgatgaatctgatgattgctcaattagttctggtgatgaaattgaacatgtttcagaaaatcctgcacttcgaaaagttaagtgtaggaaaaggcggaagcataaaagtaaaatgcgggaagtatgtagtgagattgatgaaagccatcccggagaaccatggctgttggggctaatggaaggcgaatattcagacctaagcgttgaagagaagttagatgtttttgtggctttgattgatcttcttagttctggttccactatcagaatggaggtaatctacatactatttagaccaaatatttcaacatttcaactgagtcgaggtctgaataacttttaaaacctgagtgttagatcgctccaacattgcatgtctaataaaatcttgggcagatggacttttgatccatgttattttggcggcaccttgactaaagatatgagctaaaacttgacacccttctttgaaacttaagaaaatgacatttttttttgaaagttactggaaaaagcttttttgttacatctatatatctccgttgcgtagtgctaacttttatttttcaccacaggatctaccgagagctgtggctgactgtgcccctagtatctatagtcatggttctggtggaaaaattaagcgatcctcctctaatcagtacagctatccacgtggatcatgggtccatggaggagagctttatggaataaaagcactatctaaatcgtctgattctcatccagttgattcttcatcaattgtgggggcatttgcaaagctggctggaaatagagcgaataatgttcaccctatgcaatctgtgtaccttggttctgatcgaaggttcaacaggtactggcttttcttaggcacatgcaatgcaaatgaccctggtcataggtgtgtgttctttgaatcttctgaagatggtcattgggaagttatcaacaacaaggaggtaatgtcattgtactcttcctgaaatcttaatcactctgctggttaaatggaaacttgtattgaaagttatatgatcatgtgcctgattatttcctctttcgcttggtgtaggctttgcgggcgctgttgtcagttttggacgataggggcagacgggaagctcgtcttattgagtcgttggagaaacgagaaagttttctttgtcaagccatgctgagtagacaggtgacccagtcggagacagcccatttcacagatatagttagagaggacagttcttcacctgtttctgatatagacaacaacctatgtctgaatgaaattgccaatgatcaattctcctcgcaacatgcggctatagtatttgagattggaagtaagcgggagaaaagcttattgtggagccttattcaggaatttgatgattggatatgggcaaattttaattttaatctcaattctgttaaacaccgccgaagatcctaccttgattcacttactaggtgtaagagttgccatgatttgtattggagagatgagaagcactgtaagatttgccatgccacgtttgaggttgatatagatcttgaagaaagatatgcgattcatgcggccacatgtatgaggaaagaagagtgtgatacatttccggatcataaagttctatcttcccagttgcaatcactaaaagctgcagtatatgccattgaggtatgtcaatagtcttttgctttactttttttctgagtgctcaaagtcttactttcttggtttgtattaagagatgcctctgttgttttacgtgtgctgaaacatgttgcagtctgctatgcctgaagatgccttgattggtgcatggagaaagtcagctcataggttatgggcgaaaagacttcggcgaagctcatctgtgtctgaaattacgcaggtttcattctattatataagctccttttcctagttcaaattgactgtcctccaactgaatcttaaattgataaaacattatgtgtaatttatgaaggtgattggcgactttgttggggcaatcaatgaagaatggctatggcactgtagtgatcaagggcagactttaatgggagaaatcataaattgcttcccttcgatgcctcaaacaacttctgcgattgctctctggttggtaaaattggataccttgattgctccctatgtcgaaaaagctccacctgaaagggatcaaccgttgtgcaggaccagaaatacaagtatgatcctacttttctaaactcatctatcagaactcagccttcttgcttttgcttgttctcgcttacgacttttcaagactgatcgtttttgaagtttcagatttcacgtcatttgccaattgtcttgatgatttcacgtcacttgaacttgataatgtttttgggtggttttagtttctcacttgtgtgtattactccattgcaggtagacgagcgtctaagcggtagttgtagctattatctggacatcaaggacggcgatagaataggggaagaagattgtatagaggaagaatgtttagttcctgcattcagtttgagataatttgagattggaaaattctacaatccaagtgactttgagataatatgtacagacaatttagatagtagcatggatcacattcagttttgggtttgattaccaaaatcttttttttgttgttgttgtttttgtgtatgggcatagaaagactgtttaacgttgtgtcaattagacaattagtcctttaatatataaattacattttaccccagaagttatgttcttttgcatagtcatcccccaaaagtatcataatttttaatatctctaattctatatggaagtttcaatttagtccacattcctcctaattgaatg

SEQ ID NO: 4496 - DNA, 3000 bp, Unknown
  misc_feature (1)..( 3000): cDNA_ID_2031854_gDNA_ID_1620711_Annot_ID_165439 3000 nt of promoter + ATG
tcagtcactaagttaataataaaactactaagatgaataattaaataaagaccttatctctaaattttatgtttatgagttgatgaaccttctaaattttattttatcactatattaacaccatttcgacaagtaagaaatatgataaacactctacactaataatcatcatcaagtcatcataccataatcagtcataaaaaccaaaacaaaggaacaaaattatgtatgaatgttgtatatttacatgctatgcttttgttttcccctgtttttcttgtatggttctaccaaacttgttgatcacaaaggaccaggcttagtatctaccagtttatctgtagtttcagaggaaagggacaaaaatgaattatatattttgtttttattttgaattattctgccaattaaaaccagcttttaaagagataccaccaaaacaatcttgaattgacaatagacgcatcatgagaaaatttgtaaaatagagttatttgtgaatctattagacttgtgatatagacccttgttaattacttgactcatcaaacaagagtttttgaacttttgagttatcagcaaagtcgattagcgacacgggaatgggttaattatacttaaatggtccattagaatgagttcttatcattgtcattgtattgttgtttgatcattagtttccgttgatcgtctagcttttaccttgatataatagatttatttattttcttgtcttacttctctatgcttagtttattgctttaactcacctagatatataaaagtgattatgattgtataggttcatgaagaactaatccgttacaaagtatgaaagtagtcataaaaagttttctaataaaaacatctgagtacaatattcattactatccgcaatgctatactatagattgtgaatgtatttgtaggaactattattaatgaacactaactttgagtgtaatcaactctttattaagccacaaacaaaacctttatttattataaatctgattataacgtatacataaaaacatattatgaaatataacaacataatcacttctcttagtacgaaaacaacatttgccttatcaagttggtgaactcgccggaaaaaaatccaaaacaacttatagaaatacacataaaattgatttcttattgtgctggaggaggaggagtaaaaggaggaggaggaggaggagtctcaactaaaacatctagcttcatgccttgaacgcaaccacctcttccatcaagtagataataacgtctagtctcatagagaggaacaatatctctcccagctccacgtgtataattacgtattgggcggttggagatacatttttcataatcagccttgtttacctcaagaatgttgtgttggtctctatagaacacaaaatctgacaagaaagtgataaataaaacataagtctaaagacagaaccaagacttaacttaaccaaaaaaaaaagacagaacaaagaaagagttatgttctaactagatctggacttaaagaaaagttaaaaaaactattacaagatttaaagctaaaccaatttcaaatcagatctaaatatgacagatctgagagtgtagattgagaaagaagagatagagagaacgtacaaagccagtctccgacgtagaaatgtttgccttgagcccatagggtatagttaatgttggggttccagaactttttgtcgccgactaaatatttcttggctgttacttctggtatcggcgccgccactagaaaagccagtacaaccgccgagattagcaccatagatctccccatttctctctagcaaaactctctctctttctcccttgtagaattaattagctatcataaatatagtagttcatcagttccacttccactaaattattgtttttggcaaaacagtaacttaagttatataaaaaaaaaaatcattagtcaatcaatcacagtcctttatgataaaacgaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaatgaatttaatatattctaagtaacttgcttaaattttttttcaaactctaaagacataactaacataaagtaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcactcaacacaaactctttacgaatacttttaagt

SEQ ID NO: 4497 - DNA, 3000 bp, Unknown
  misc_feature (1)..( 3000): cDNA_ID_1012082_gDNA_ID_1620711_Annot_ID_165438 3000 nt of promoter + ATG
aaagaaaactggaagtaaagtaaaataaaaacactattaagagtcgagtccatgcttcgtggagacataatggacattttacactcactgactcatacacaataagctctttggttacgtgaaacaattatatttaatttattgcatgtattcttcattcttcatcattaatagatgatcatagagtcctcttctaatagcagaatgcatgccttcttctaaattaaaaattttaacacactatggctgagattttggcacttgcattgattatttggactacgtgtaaccgcaagcttaattaggatgtcactacctcatttatgaagttgaaactgttgttgcatcatcaagtttctcaattcttgcttgatttttttttttatataacttggcagaatttggtattaataaacattttcaacaaactttggagacaaatgctattaactttattatctagctaagggtattgacaaatttcattcatctcattattctaaaatttatcagccgtgatattgcctgaaatttttatgaggccgtccttcaactaagtacttgtagaaatagtctaaatatagttcaatataggccttcttcatttaaaaggaaaaatggataatcagaaggttcatgaacgcgtaaatataaaagttcagataaaacgtctttatttatcattccacttatagcataaagattagatccatcttagtttcaataagaagtttgttaattaacttattaattgatagcttcatctacataggagacttgaaactttgacactttcctctcatacaagaccgaggaactgcatagttttgggagatcctttcctttgtacgctttgcagacttgtgcgaccaaattatggtaattctgcatccccaaaataaagatattaatttaaaattcgttaaaatgaaaatgaaaggaagagttatatatacgtcatagagtggtttgccgttgagtgtgacccatggtacgtattcatgttttggcttcaaactcgaggtcagttttgcatacccaagtatcagctgcaattacaaaaaaaaaaattggttataaggttatataattataatttatatatatatatgtatatatatataaatgtgtgtatatttttatatttttgtatatagacctaccttttgagagagatcaccattgtaacaatcattgatggctttctcacgtccagattttttaacacatgattcccattcattcgtatctttttcaacgcagcgtatgaacttgtactgcaatttctgtgttccaaaaccatcccatttttcatattaagcttctaacaaacccacacatacaaaatagtataaatatagtaggtaattgtattttttctataccggatcgggcaaagttcttataccgcaagcttcgagagcgttaagtttgcattcctcttcaccatgcttcacaaaattcccaaatttggttaactagagctagagtcaaagtaatttatcaacaaaaagtgagaaaatttgaaactaacctggcaagtaatagtcagattattggagatatgagcgttaccgaatggaacgagcttgagatcggtgattttgaggagatcggagtcaaagattttacctagatcatcaacaatgaaattttgacaatagggacaaagtgattcatagtaaagattgatcttcactttgttggaattttcagccacgacgaggttgtttgagtatgtgaacacgaagaggcaagctaagaaaagacatgggaacagatcaacaaacttggttgcagaagaagaagccatacttaaaagtattcgtaaagagtttgtgttgagtgcttatgactactgttgtgtaaacatttatagatactttttgaccgctgtaaatgcttctttgttattaagttggtagcattttcactcggggtctctttttggacttttgagtccatggtaactcaagatgcaaatatctactcagttccaaagtgactattagtgactagctaggctggtagtggtaacagactaaatgtttttatcttccatttgagtatatatcttgaatatttagtttaataagattgttttatatattttaaaatataatcacactaactgtagttttctacttttacctatctgagtaggtcttgatgcatctttcaaactactaaactttaatagttttgggaataattttaacgtcaataagctaaagaggatgtctagggcctaatccaattagaggtatagttttccaagataaatattgccatttagtaattgaataaacacaacttttcatttcacaagaataatagctaaacaaaatagaaacaatagtacaatgttttaatagcaatataatttttaaaaaaaaacttgatacgagattaaacacgttagagagctaatcattagtttaatttttttcttcccatgtattaactttttttttttactttatgttagttatgtctttagagtttgaaaaaaaatttaagcaagttacttagaatatattaaattcatttcaaaatcttctagcccaaatcaaggatttctcggtctcgtcggttgtggggttctattgagcttgacatcgcgtatcacccgggagatttgagcaggtccctctagtcgctaagaacggaatcatagactatcttcatacccattttttctattaaaaattgtccgatttcgccatccgaattattttagctaggttgatatcaatataatataatataatttaagaaaaaataatttaaaacgcatgttgtcggtggaataattatgagttcgttttatcataaaggactgtgattgattgactaatgatttttttttttatataacttaagttactgttttgccaaaaacaataatttagtggaagtggaactgatgaactactatatttatgatagctaattaattctacaagggagaaagagagagagttttgctagagagaaatg

SEQ ID NO: 4498 - DNA, 3000 bp, Unknown
  misc_feature (1)..( 3000): cDNA_ID_3073414_gDNA_ID_1620711_Annot_ID_165437 3000 nt of promoter + ATG
gtaggttgataaacaaaagaattaaactatgaaatttgttgcaatcaaccttccacgtaaaatcgtaaaaaagagaccttgtaagtatctagcttccttaacccattcataaaccttgagtactttttacataagtagccaattgataggttggatgtaattcttcacaaatatactcaagaaaataacacacaatagataagctaaaccaaccctagttctaactattaagtttatgatgattcttacaacaccttgagtaaagaacactcttcagatcaagctgaatatcaacttcattttttgatgcatgcattgtttaccaaggttaataagcaacaattttaacaaaaaaaaggttaataagcaacaacaaaagcgtttaatgcaccagaaatgttgagaagcatgtcttatgggtctctctgtccctgattctagactcattctaagtgtttgtacactctctgtccctgattctaaggttgcaaaagaacaagaattagcaacatctcgatcacttgaattttcctcaagcgtggtcttcacatgaatttttgctcacatcttcaaggtcacaagggtttatgtttgacctttcttcttgcatagtgattatctttgagttaatatcaaattcatgttcctgttcaaaatgggccactcgtatatatatatatatataatatgtatttaaattgtggatatgttcgaatatctgttcgggttcggattgggttcgggttttaggatttagaagtttagaactcgttcgggtattcataaattttgggttggttttgaatatggttttttggatcgggttcggatcgggtaatcgggttctgtattatacccacccctacttctcactgtcagatctgaaaacatgaatattcatatcaaacgtgttacaaattacattatatcttatgacattttaattcaataataaatggcaataagtgaattgattcacaaatctcatcacattttcgttgtgggattttttaacgtctcttttaaattattagatttttttgggatgaaatatgtctgaacaatattcaggttggattaatgtatttttgtggtttatttttttgtcgagcctcattggccattagtaagtggtgatggcggcaacatattttaacggactagaacacatcccatgttttggttctgctaccgtattgaatgttcattcatagactcatagtccatctaaacatatacaatgagaaatatttaattggttctgataacatatacacaaacttacaaaaactaatttaatgctacttacatatcttacatattttcaacggctagctgaaatctccaacggtattcttttcatttatttatatataaattagtcaatatatatagcttgtcagctaaatccaaaggttgatatatgctcgtgagagctaataatcattcttcaattatcgatctcatttttaagaattattttgctacctaaattaagtagatgcactaaaattagtaaagcaaactcataattgtatagagattgcacataaattaaaattaaaaaataaatcacctaaaaaggcgtatagacttataaatttcatagagataactcacaaaaatattttcctaaagaaagatagaaatatttgaaactaattgatgctttgctctatttacaggttttattttgaatcaaaacgttgtactttagtaaaaactaattattatgattaaggaagattcttgatgaaatggaaagttgagtttattcaatcttagtttaatgaaatttttcacacacaaaaataaaataaaaattgatgacattagataaaaggtaaaaaatagactctattaaggttcaagctagacacccacttgcatattgtcattaattgttttccaaaactattaaagtataacaaaatattgcaatttgaaaaatgcattaagacctacttagataggtaggtagaagttggactaatttctatttactgttactaagattactttattttatctcttttatatttgatttgttacaatgctagaccattttttaataataattattatgattcactgtcagattttataactttttttttaccatcgtaacatgtgtgtcgccaaatagtttatgtgagtcactagataaaacggtaaaagtattcattatgacttcagttaacaatagtcaactctttatactttatactgtagtgttttcttatctccatttttctttttgtgtacatcttgtagaaaatcttcccactataacttcttcttattatttttaaaaaatactaatctactattatgttgttggacacaaaaaaaactaaactaatctactatgttgtatggataatctttttttgttgatagtctcattataaattaaaacgaatacttcacagttcactagatgattaaatatttgactcaatttgccaaatatgattatagaagaacttttctatataacataccttcaagtggatgaaaatgtgtgagattttttcttcataaatgttttttttcagtgacactatatttttctttattaacctgctatttcttctatatgactcaaaattgatttatttatctatcctatttttaaaaataatcagcaaaacatcctctctcaattacgattttaccaatattttgtttgtcgtttttgaacaaaaatttggctatctacgtaataaaccttaacaagagttatcaattttgatctaaatgatgaataaattatgaacctcaaaatctggacttggatccgccacttactagagtcacacaaacgtcaaaagaaggacccacgtgaaaaaccaaaaccaaaactaaaaccaaagtaaaaaagcacgtaacggtaaaacacatgaataacttggctataaataaatagcaaggctttagtcatgaatgagcactcaattcgatcactaactctcactcttagtacaaatattttcaaga

SEQ ID NO: 4499 - DNA, 3000 bp, Unknown
  misc_feature (1)..( 3000): cDNA_ID_3089775_gDNA_ID_1620711_Annot_ID_165428 3000 nt of promoter + ATG
aaggatactccatgcaatacataagggcaccattaggaccaagctttagatcctccatcacatcttccaaagaaataagttctctgatatctgcattcaacgatgtcaaaaaagtgagaagcactcaaaactccccccaaaggtaattgaacaagaagaaacttcttcactcacccatagccacaggatagttgaagatctccgcagcaggatcaaggttaacaacatgcattgttcgaccgatagtttcacaatgttcatacaaagacgagcaataagttgactgatagatccaaaacacacaaaaaaacacagttagtcaaatctcactgatgaaactagttaacagaaattaacttaacatagactatagcataacctttccactgcctgctggaccaataactagctgggcgtaacccattgtagcaagcaagcagaacctctccacaaaagctcttgaaattaacaaatacagtgaaagattctaaaagacgcaaagattgcaacagttatataagcaatacaccagacacctaaaccaaacaacactctcaaaatgtcgcagggacccataaaccagaagcaagaagcaatagacacatttcagtacctgaaaggcaaaaaagatcaaaactttaacactcacatacatgatttagctagggttttaaagacccacataaacccatgaaatagataacctaaaaaagacgaaatttgggagagaaattgaagaaattagaagcagccgacaaaaatttcacaaggttgaaacgaaacccagaaggaataaataatcagaagcatcaatggagaagaaaatcggaatcagagaaatgattattgactttcacctttgacgcgtcttcgtttttctttgctctcaaaacctaaagctcaagcaaaagaagaagagaggaaatttcaagagcttcagttttttggtttgttgcgttttattaaagaccttttttagggttctttatggtttttcattcattacttttttaatagtggtcgtaatatataaatcaaaaagacttttttacttaattattttttaattctttgaaacagctaaacgatttgaccatgcaaaagaactagtctccaccaacgtgtctcacgtggatcaaaaacaatgggttttatgcaaaaaaaaaaaaaaaaaaaaacacattcaaaatcgatatttttacaattttagtttttagatttaaaaaatagaaaataatttgattgaatctaaaataatatgtaatatatctaattttagtttgcaactttacagtaaacgttttcacgatcacatatatttgtgtttaaatattttaaagatatagttgaattcatcatctcgagagattccatttgatatattatttatcaaaattttaacatttgacgataatgaaaaaaattgaattgcgtattattttatattttataggtttattttgcatttctgacataaataaaattgtaaaaatagacgacttcgaagtttgagcttgagatcactaaaagaagttaatgaggtatgttgtttgaaataaatttggggacttgtctcccacaaaaactccttatggattaaatagatcaaggcacacctactcaaaagagtcactatttggtaaataaaagaaaatactactttgggctcttagatgtggaagaaattactcaaatacaaaggagtggccaaacaattttgcaaagttgaggtaaacaactggaaaaaagtttcattctggtatgataactggtttacaatgggctgtttgatggatatcataggagagaggggacgaattgagtttgacatcttaaagcaaatgtcgatggcggaagcatggacataactgcaaccctaaaacaaattgaaacagatctcaccatgaagagacaaaatcaaaccgatgaagaggatgtggtattatggaaaggaaaaacgatgtgtatcaatcaatctttagaaccaaagacacttggaatcacactcgtaccgatacaaataaggtagtttggcataaagaggtatggtttactcacacaacaccaaagtattctttttgcacatggttggcgatccagaacagactctcaatgacaaacttctttctctacagcaactgcattgaatcagaggatcatttattcttctattgtagctatgcagctgaagtatgggaggctctaactataaatatctacaaagcaaactactcgacgaactggacatctctaatcacaagcatatatagcccatggcaggagcgtatggaaggttttattgcgcgatatatattccaagccacagtgtcacacaatttggtgcaagagaaacatacgtagagataaagaaacaccaaaccctctggctcggctcatcaagtggatagacaagcatagcaaaatgttccaattttaagtaagaaaaacaaaattctactgacaatttcaaaaacaagataagtaaaagtttaaatttaaaaaaaatgaactaaaaagctttgtcctattgatcacctaatgagcctttaaatttctaaccgtcttaaatcctattactagttaaaatctttaaattattttaaattaaagatataggttacattatttaaaatatagatataatcaattaaaagtttaaaactcatgttaaaagcatcttaaagggaaatgaaatattaatacaagaaacaaatatatatatgtaaagacatattttcaccagcggtccaaaaaaaaggatatattcacatattaaaagaaaatattggggcaaagtggataagataacatccaatgagaataagacatatcaaaattcatatccctgagagccacaacaatcttaagaaacagatcctctgtcttgccacatcagcaaacgcaatctcaagtttcgtagattgcttatttcttcatcacacacttcaaactcgattttattttaattttcataagagaacaaccaagacaaaaagaaca

SEQ ID NO: 4500 - DNA, 3000 bp, Unknown
  misc_feature (1)..( 3000): cDNA_ID_1824534_gDNA_ID_1620711_Annot_ID_165425 3000 nt of promoter + ATG
tggagtactcgtattctgcggctctacaacatcatcaaatgaaacattcttagaatggtaaagcccagaactttctactggtgactgggagccactgatgtttcctggtggccttaaatgactcttgcctctactattcatatctggccctgattttccaagactatcgagaggatcagtatcaacaaatactcctccgtggacagatgaatgatcagtttttctgctgttgaatttaccaatttcctccaatggatcagtgaaccctcctgtggaaggttctctaagggttgatgtagactcctccaagactacaaatgggtcttctttcacattagaagatgtctcggcagtccgatacggaggtttctgggattgactagttgtctctgaagttgtcctgcgcagaaagagtagatcatcaatcaattggtaaacaagttatgcctataccagcaaagatcaaaatgaaattttgcatataaacgagttatgctttcaaagactttctgggagttatcttctaggtttaagagagtacacataagagacccttgtattgtgtgcaagcaaacatacccttgagcagctctcaagacaggtctaggagaaacaattttgaagagcaattaatggatataaagacattgagtatagttcatgctacaaagctagatataaaggcactactattatgaaagcatgaagtctctagtctaagctctatacccttgagtcatttcacgcaagcaaggtcgcaaatttgaagagcgggtgacaggagcaaccctaactagtaaccacagatctaagagcaatgaccggatataaagacattgaatatagttcacgctacaaagccagaagtaaaggctctcaagtcagctctagctcctccataaccactgatatagttcatgctacatcacatttcattacgtgatggctctaaattctacacccttaacttctttcacgcaagcaagccctcagatttgaaaaccaatgacaagatataaagaacaatgacccatttgtagtcatatgaaatgaaattttgcatatgaatgaccctaacagcagattaaaggttgaagatttctcttgtaagttctacaaagtacacataagagaaccttgtatgctagcaaaaagctcttcagtaagacctaatatagttcatgctacatgtcatcatgtaattgttatggctctaagttctagacccttgagtaaactctcaagtcagttttaaggagaaacaaatttgaagagcaatgtcattcaaaattggatatgaatgacaagcaaaaggttgaagcttttgagagcaatataaaaaaaacttgtagacttgtagtatccaagtaaacagctatccataagcattatacagttcaagcaaaccaaaatctaagcttcatacccttaactaaaatcacgctagcaagctttcaaatttgaagagaacagcttccataagcaccaaatgctactacatttcatgctctaagctctataccgtttattcatttcatgcaagaaagctccctagctagtaaccataaacagaagaagagtgaatgaattcttaccgtttagctggaggagagctagtgcgaccaaacccgggaattaaatcatcaaaaatggaactacccttctcctctcggtcactctctttcttccccaaattgtttcccatgagatcatcgaaaggagaactgttctgtttcctgtgcttcgtaggagaagatgagatagaagagaaaacattctcaaacctagctgactgagaagaagtggaagggattttgagctcaggaatagactcaaacacatcctcatcatcatacacaggcttatcataaaccggcatagacgacgctgatttggatttgggttccttgaacataacatcatagtcaaaagcaggagcagatggagaacgagaatcaccagaagatccatactttggtggtggtccgctaaacacatctctgaagagaagatcatcaccatctcgaccaagatcgtcaaacaccggcaaagaatccgactttttaccagcggcagaggcgaagctataagaagaagcgaaagtgttgaaatcagcggcagaagagtttgattgagaagccatgggcgcagatttgccttgaggtttcaatccgaagtctctcgctaacaatcctgtgaaatcatccattggattcctttaaattctctagctccgaattcgaaaagctttagattttgcccactagaaatgaagaagaggttatcttcagatctgagtcgccattaacgaatcggatcaaagcatttgattttttaaaaagctcttttttcttcgttttccgacttgtttatggtttcttctccgactcgtacatgtttcccagtcttcataatttcttcattattgctaaatgggtcctaaagtttcagaaataacaaatttggtctccaaaatcttaaaaaaataaaaaaagtaattccttagagttgatcctcaatatatataaacttataattatattaattaccaaaatacaattatatgtttaacattttctatagcaatgaaactcttagaattatcaaaatatgtagaaaatatttgtcaatgtacaattttgttttttttgtgaataaattttggtattttacattggttcaaaaccaaaatgaataaatccaaaactctagccaaagtatcaccgaatttataagacttgggggacccaaattgaaaactctgaaactttaggacccatttagcaaaaacgaagaaattatgaagacacccagtcggagaagaaaccagagacaagttgggaaaacgaagaaagaaaaaaagagagcttttttaaaaatcaaatgctttgatccgattcgttaatggcgactcagatctgaagataatctcttcttcatttctggtgggcaaaatctaaagcttttcgaattcggagctagagaatttaaaggaatcca

SEQ ID NO: 4501 - DNA, 3000 bp, Unknown; identical to SEQ ID NO: 4495
  misc_feature (1)..( 3000): cDNA_ID_2051413_gDNA_ID_1620711_Annot_ID_165420 3000 nt of promoter + ATG

SEQ ID NO: 4502 - DNA, 3000 bp, Unknown; identical to SEQ ID NO: 4494
  misc_feature (1)..( 3000): cDNA_ID_3000053_gDNA_ID_1620711_Annot_ID_165415 3000 nt of promoter + ATG

SEQ ID NO: 4503 - DNA, 2231 bp, Unknown
  misc_feature (1)..( 2231): cDNA_ID_2051442_gDNA_ID_1620711_Annot_ID_165409 3000 nt of promoter + ATG
aagcttcgtcattttttcagcatcatacttaacactgcagggaacaacctcaaatccaacaatctcataccccaatgccttcttcttatcagcttcagagatcacacccataccttcttcaccagtaccaatcacctccatgacattgccttcatactcatgaaccaaaaccttaaacttgaggtgattaatgatgtaatcatcattactgttaggtggcgaatacccaacaggatatccagtccactggatagtaaccccattctgcttagcgaatctcaaagcaggcaagttatcaagaatcatattcacttgatacaactcacgagttctctgtttcaagagcttgacctcatgctcattcaaaggactcgtagtgcataagtaaagagactcattggttctcatccgaaacctataagcagagttatcaatctgatcacccatgagaagctcaccaagattctcagcacttttcttgataccttcaagtggttggcagtaaggaagactatagtaactgaaaggaagctcagtttcaatagaagtcaaggaattgactttggcgaagatagagtctccatctgaatatgtgtgcatataactccctggtaagtaaaacccattgcaaagctgactaacaaacaccagtaacacgaatactcgatacacaccaaacattgtcccttcctgtatcaaaatacaaaaactctctcacgattagtaaaaatcactactattgtaacagattcaagcacattctcacgaatacattgaaatcgaaatggtttatgcatgtagatcagattcgtagtaaccagattcgggattaatgaatcagatcggtggatcaatagatcagatctcaaatggatcataaacgcaaaactcagaagctaattgatataatggaatacgaaaacgatgaatacaaaatcagaaaacgcgaaagaagaagcagatgcgaatccaacagatctcagagtattcgagagcaaacctgagagagagagatccaggtatggagatctacgagggagtcagatctagaagaggtggtcgagggactttgggttgtttcgaaggtcacgctgataatctctctcactgctttgctttggttgcttaatgcgttcgcaaagagagcgaataacgaaaatcaagaaaatcgtgggtgtgttgggtagttattctctgtgacgcgcttatacaatatgtcggtgcggtaatcaccgtgcctaacttcatctgaggccaaaaaaaaaaaaaaaaaaaacttcatctaaggccttgaatttctattggttgaactggttataattaattatatttttaagtaaacgacggtttttaaatgagatttttgtaaaatagagagagtataatgtagttaatttttaaaaaaataaaacaaagccaaatgaccaattttttggaaacaaaaaataattttatcacatataatttgaacatttttttttttgctaaagaattcaatatttactacaattttgaattattttgaactcttatgtaagaaagtaaaatttacacaaaatacatattttgagaagctggcatccggcattttgacatgcgtattttctcaaacattaaatacattaatatatatgttaactagcattataatagagtaaaatattcacaaaataatgttttgagaagctgaaatgtaacatgatattctacagtctagcaatttgaggttttctaccgaattttcatagtttgtattgtaaattcaaattaaatttaagttcatgtagttataagcacataaaaaagttcggtgaatggaaacgataaagcaatttagttcatggtgaaataggccacatgattattagcaggattcatagataagaatgttaacaaaattaaatggtaaattgggtttaattaggtttatgacctccggtcgtccttacgctattatctccacagcgtttttgtttcatctaatcaacgaagtgaactttcgaaatcgatatctgaattttgatttaaaaattggaggtaatcattcaccaatcggtttgtcaacgtaaaaatctctctctgattatatgaattgatgtgatgtgagttcttagaattatgattcatcgaattggaaaaaataaagttgttcgttgtcagtaaaattagggtaatttgaatcattaacgagtatatgtatgtattgtaagacatgattgatatacataatg

SEQ ID NO: 4504 - DNA, 3000 bp, Unknown
  misc_feature (1)..( 3000): cDNA_ID_3073448_gDNA_ID_1620711_Annot_ID_165408 3000 nt of promoter + ATG
cttctccaggtaacttttgtgtccgtatttttcaggttgaaaagatggtttcttcgaagagacagagcgtaaaggtcgtgcttcgataggttgttcttgtacaccagccttagggtggatgatcaaagctaactcttgaaaagcaacattagggtcgttaacattgtttgtagactccggagatgaaatagatgatacagactttcgctctacttgttcaactgtgctgaaaccagtcgcttgcttattgaaggccacatcatcatttctcatatcagcttggcattgtctgtcttgattctccgccaaatagaactcatccccatctctttccactcctctttcccgctttctcttcctatccttagaaacttccttcccatgagtttcagttttaacagtttcggtatgctgattcttttcaatatgtcttccctcccgatatcgcccctcccctaatccagaaccgagtgacactcttttattggtcctagggatttcctgctcgcatctttcagtagacgacactttcgtttgctggttattctcatggaaacatccttgcccacttcttccctcaccgaaatcagaatcgcgggcttctgttcttccatcattagttaagacgtcgtgttcatgagtagttgcaactgttttgttttgctggttcttctcactgtatctcctcttctcttttgttttgataccaacagcaaaactgtgcggttgtgctttttcatggtttatatcatcgcatcttctctgtcgctttctttccccaccaacatcaatactgtgcgcttctggtgcttgatgatttttctcattacctcttcttacccttccctttcttccctcacctgcattagaaatgcacgcatatgaaatttcataattcttctcattaaatcttcctcgctgctttcttcccttatccgaatcaatatcatcagccttagaattttcccgagaatgagtttcagcagcaactttttgcattttctgactcttctcgatcactatccatttattgtttaatccatcaccttcccttctcttcccactaaccataccacttgctccagaaacattaacctccactacattctcaacacctccagcttctttctccatcattaaacccacatctactcctcctaaactctctctacatcccttcctagacttgtcagtcagcataagcttcttccctaactccaaacacttgacaactacacgcttataccaacaataaggacaatagaaatttccaaattcatcgaaatcaggttcatcagatgcacaactctgatgaatagctatagtacattcctctccgtaacataccaaaacccaattgtctttcccatcacacacgaaacaagtattagtctttacaacattatcactatcacctcccttgctttgccctaaattttgagtctttcctccaattggaccattctcgtgagttttcgggttttcttcatcaacgtcgtcctgcgttatcacatcaaaacaatcaccaaactttcgaaagaaagtaacaaaattgacttaaaagatgagaattttcgattttttttatctccagtaagtacagagaaacgtaagaagattaccgaatcggaggataaaattcgagaactcatatcttcttcttctttttgcaatttcttctgttcatcgtttcagaggttaattcctgcgatttggttcactttacttctttcttattgggctgtttatggcttcttttattttcattaggttgggctgtgcccactaaactttactttaaagtaaaacagataaaattttaatcaaattcaagagaatataccaaattcaagagaaattttaaccctaaaatcatgcatataggaacaaattctaatcaagttcatgaataaaataaagatccaatagagtattaatcgaaacaatcatcaagactgatgaaaaaaactatctctgccaataatcggctttactcatgcttagcttcttttaccattatgtatatcaatcatgtcttacaatacatacatatactcgttaatgattcaaattaccctaattttactgacaacgaacaactttattttttccaattcgatgaatcataattctaagaactcacatcacatcaattcatataatcagagagagatttttacgttgacaaaccgattggtgaatgattacctccaatttttaaatcaaaattcagatatcgatttcgaaagttcacttcgttgattagatgaaacaaaaacgctgtggagataatagcgtaaggacgaccggaggtcataaacctaattaaacccaatttaccatttaattttgttaacattcttatctatgaatcctgctaataatcatgtggcctatttcaccatgaactaaattgctttatcgtttccattcaccgaacttttttatgtgcttataactacatgaacttaaatttaatttgaatttacaatacaaactatgaaaattcggtagaaaacctcaaattgctagactgtagaatatcatgttacatttcagcttctcaaaacattattttgtgaatattttactctattataatgctagttaacatatatattaatgtatttaatgtttgagaaaatacgcatgtcaaaatgccggatgccagcttctcaaaatatgtattttgtgtaaattttactttcttacataagagttcaaaataattcaaaattgtagtaaatattgaattctttagcaaaaaaaaaaatgttcaaattatatgtgataaaattattttttgtttccaaaaaattggtcatttggctttgttttatttttttaaaaattaactacattatactctctctattttacaaaaatctcatttaaaaaccgtcgtttacttaaaaatataattaattataaccagttcaaccaatagaaattcaaggccttagatgaagttttttttttttttttttttggcctcagatg

SEQ ID NO: 4505 - DNA, 3000 bp, Unknown
  misc_feature (1)..( 3000): cDNA_ID_1824538_gDNA_ID_1620711_Annot_ID_49001 3000 nt of promoter + ATG
cgtcgagttcatccatttgagatgctgtcgggctatttacagaagctcttcctgagctaggaacgtgtgagtggtaagcagacgtcggtatagaaggctcattaaccttctttttaataggacgtgtaggtcttggtggtggaggtctcgtaggtggcggagcactcgtaggttgcgtaaagagggggatctcggatacagtaagccacacatcatcagacgactcgaaacttccatttgaattggtaggtggtggagtactcatattatgtggctctaaaaaatcttcaaatgaaactttcttagaatggtaactcccagggctttctactggtggtgactgggagccactgatgtttcctggtggtcttaaatgactcttccctttactattcatatccggccctggttttcctagattatcaagagggtcaatatcaacaaatactcctccgtggacagatgaatgatcagtttttctgctgttgaatttaccaatatcgtccaatggatcagtacgggagggttctctaggggttgattcagactcctccaagactacaaacgggtcttcttccacattggaagatgtctcggcagttcgatatggagctttctcggattgatttgttgtctctgaagttgtcctgcacaaaaagagtagagtatcaatcaattggtaaacaagttatgcctataccaacaaaaatcaaaatgaaattaagttagaaaactacgcataagagaaatctgtatagtatgcaagcaaattgaagcactaataaatatagttcatgctacattgcattatgattatgtaaggcgtgatggctctaagctttatacccttgagcaagctcttaagacaggtctggggaaacaaatttgaagagcaatgtcaggatataaagacactgaatagagtgcatgctacaaagccagagataaaggcactacaattatgaaagcatgatgtctctaagctctataccctttgagtcatttcacacaagcaagctctcaaatttaaagagagaaggtgacaggagcaaccctaactagtaaccacaggtctaggagaaactaattattaaggcaatgaccgtagccacagatcaaaaatgagattgtgcatatgaatgacatgaatcttgaagtttctaaagtttttttttccagatttctcactcaagttttagagagtattcataaaagaaccaatatccaagctctgtgaccaaccaagctccataatcactaatatcaacttcatcattatgtacgtttgaagagccatgactcatgccacgcaagcaagctctaaaatttgaagagcaatgaccctaaccagtaaccacagatgaaggtacatagtaaataacatatcgaaaccagggaatcaaacagctctacatacaaggaaacagttctccataagtactaaatgctacatttcatactctaagctctacaattcaaagagtcatttcacgcaagcaagctctcaaatttaaatggcagtgagtgaccctaactagtaaccacagataaagaaaaagcaactagtgaatgaatattaccgcttagatggaggagagctagtgcgaccaaacccaggaatcaaatcatcaaaaatggaactacccttctcctctcggtcactatctgcccctttcttccccaaattgtttcccatgagatcatcgaaaggagaactgttctgtttcctgtgcttcgtaggagaagatgagatagaagagaaaacattctcaaacctagctgactgagaagaagtggaagggattttgagctcaggaatagactcaaacacatcctcatcatcatacacaggcttgtcataaaccggcatagacgacgctgatttggatttgggttccttgaacatagcatcatagtcaaaagcaggagcagatggagaacgtgaatcaccagaagaagatccgtactttggtggtggtggtccactaaacacatctttgaagagaagatcatcaccatctcgaccaggatcgtcaaacaccggcaaagaatcggactttttaccggcggcggtggcgaagctataagaagaagcgaaagtgttgaaatcagcggcagaagagttcgattgagacgccatgggagctgattttccctgaggtttcaatccgaagtctctcgctaacaatcctgtgaaatcatccattggattcctttaaattctctagctccgaattcgaaaagctttagattttgcccaccagaaatgaagaagagattatcttcagatctgagtcgccattaacgaatcggatcaaagcatttgatttttaaaaaagctctctttttttctttcttcgttttcccaacttgtctctggtttcttctccgactgggtgtcttcataatttcttcgtttttgctaaatgggtcctaaagtttcagagttttcaatttgggtcccccaagtcttataaattcggtgatactttggctagagttttggatttattcattttggttttgaaccaatgtaaaataccaaaatttattcacaaaaaaaacaaaattgtacattgacaaatattttctacatattttgataattctaagagtttcattgctatagaaaatgttaaacatataattgtattttggtaattaatataattataagtttatatatattgaggatcaactctaaggaattactttttttatttttttaagattttggagaccaaatttgttatttctgaaactttaggacccatttagcaataatgaagaaattatgaagactgggaaacatgtacgagtcggagaagaaaccataaacaagtcggaaaacgaagaaaaaagagctttttaaaaaatcaaatgctttgatccgattcgttaatggcgactcagatctgaagataacctcttcttcatttctagtgggcaaaatctaaagcttttcgaattcggagctagagaatttaaaggaatccaatg

SEQ ID NO: 4506 - DNA, 3000 bp, Unknown; identical to SEQ ID NO: 4500
  misc_feature (1)..( 3000): cDNA_ID_1824534_gDNA_ID_1620711_Annot_ID_49002 3000 nt of promoter + ATG

SEQ ID NO: 4507 - DNA, 3000 bp, Unknown; identical to SEQ ID NO: 4499
  misc_feature (1)..( 3000): cDNA_ID_3089775_gDNA_ID_1620711_Annot_ID_49004 3000 nt of promoter + ATG

SEQ ID NO: 4508 - DNA, 3000 bp, Unknown; identical to SEQ ID NO: 4498
  misc_feature (1)..( 3000): cDNA_ID_1824505_gDNA_ID_1620711_Annot_ID_49011 3000 nt of promoter + ATG

SEQ ID NO: 4509 - DNA, 3000 bp, Unknown; identical to SEQ ID NO: 4497
  misc_feature (1)..( 3000): cDNA_ID_1012082_gDNA_ID_1620711_Annot_ID_49012 3000 nt of promoter + ATG

SEQ ID NO: 4510 - DNA, 3000 bp, Unknown; identical to SEQ ID NO: 4496
  misc_feature (1)..( 3000): cDNA_ID_1824503_gDNA_ID_1620711_Annot_ID_49013 3000 nt of promoter + ATG

SEQ ID NO: 4511 - DNA, 3000 bp, Unknown
  misc_feature (1)..( 3000): cDNA_ID_1824647_gDNA_ID_1620712_Annot_ID_49014 3000 nt of promoter + ATG
acaggaattggtgaagagatattctgaattcattaacttccctatctccctctgggctagcaaagaggttgaaaccgaggtcccagttgaggaagatgaatcagctgatgaggaaactggtgagtattaatgaaacaccatattataattttctgctgcagtgttatcttttttcccttcagtttaggcagccctgatttttggtaatggtacttgacttcagaaaccacctctaccgaggaagaaaaggaagaagatgctgaggaggaagatggtgagaaaaagcagaaaaccaagaaggtgaaagaaacagtttatgaatgggagcttctgaatgatgttaaggctatatggctgagaagtccaaaggaggtgacagaggaagagtacactaaattctaccactctctctcaaaggtgaaaaccatgcgttaactaaatcatacttgttacatactaggtgtaaaattttcgtgtggatttccctgaccccagttgttatacaggattttaccgacgagaagccaatggcttggagtcactttaatgctgaaggtgatgttgaattcaaggctgtgttgtatgttcctccgaaagctccccatgatctatacgagagctattacaacagcaacaaggcgaacttgaagctatatgtcaggagggtgttcatctcagatgaatttgatgagcttctgcctaagtatttgagtttcttgaaggtaaactacttgaaagacaaactaaggggttctttcaatacaaatttatgggctaaatccctaacgtgagttgcttttgcagggtcttgttgactctgacacattgcctctaaatgtatcaagagaaatgcttcaacaacacagcagcttaaagacaattaagaagaagcttatccgaaaggcgcttgatatgatccgcaagcttgctgaagaagatcctgatgaaatccatgatgatgagaaaaaaggtattccataaaacaagtttcttggtatcaatccactttgaccgttccacttttttttaccatttggtagcttcatctttctgaaacatggtctaagcttattgacttgttggcacgcagatgtggagaagtctggtgagaacgatgagaagaagggtcaatacacaaaattctggaacgagtttggcaagtctgtcaaactaggtatcattgaggatgctgctaacaggaaccgcttggcaaaacttcttcgttttgagacgtaagctctgttactttttttttaatacacgtctgtccattcattagcaccagcaggctaaagatttgtattttgctatttcagaacaaagtccgatggaaaattgacttccctggatcagtacattaagagaatgaaaaagagccaaaaggacatattttacatcacaggaagcagcaaggaacagctagagaaatctccattcctggagaggctcatcaagaagggctatgaggtttgcattgcacacgaataattcttctttaaatgatctccaactcgcataacacgttctcatacttgtgttcccaggtcatcttcttcacagacccagttgatgaatacttgatgcaatacctgatggattacgaagacaaaaagttccagaatgtgtccaaggaaggactgaaggttgggaaagattcaaaagacaaggagctgaaggaagcattcaaggagctaacaaagtggtggaaaggaaatctcgctagcgaaaacgtagacgatgtcaaaatcagcaaccgtttggctgacactccatgtgtagtcgtaacatccaagtttggatggagtgctaatatggagaggatcatgcagtcccaaactctctcggatgctaataagcaagcttacatgcgcggaaagagagtcctcgagatcaacccacgacaccctatcatcaaagaactcaaggatagaattgcaagtgacccagaggtaaaacaaacataagacccatcaattcttttttttacttactgtctattagagaaataaactaacataccaaattctctcaggatgagagtgtgaaggaaacagcacagctcatgtaccagacagctttgatcgagagtggattcatactcaccgacccaaaagactttgctgcccgtatttataactcagtcaagagcggtctgaacatcagccctgatgcagtagccgacgaggaaatcgaggcagcagaggaaccagagaccagtgaggcaactgagacgaaatcagatgacttggctggtggtctaaacattgaagccgaacccgttgagcaacaagaagagaacaccaaggacgaactgtagatttcacttctgatgtttctcctttgtgtttacctctttagtttaaagcagaacatcgttttactcgaatatcaagattagtttaattaagcagtttttgatggattatgtaaacgcactacttgcattctagagatcaaggaacctaaacttcttcttttcaatgtatgagttttttatctttcaagattaatggtcctgctgtccgagtttatctagattgtccgagtttatctagatatggtaccataatatgcactctctttagctaatttggccacctatcatgcatatattactcggtgttattttccacaaaatttattttcgaaaacttatgacttttgcaaaaatttcaaacagataatctgtaaagctatagattttatatggaaaaagactttaatcaatatattcgtgataacatggcttttcaagatgttgttttatcttgtatcactttaaaacataaaagaaattggtcaatacttttgtgagatcatcacatatcttgagcttgacccttgagacaacgtatatatagaggtgctttaaactctactcttggtctttctttttcctcttttctctcttggtctttcgttttgtgaatattccaaacttaatttctccaccaaaagtactttttttttttaatagagagacaaaaataaacagtgatg

SEQ ID NO: 4512 - DNA, 3000 bp, Unknown
  misc_feature (1)..( 3000): cDNA_ID_1824643_gDNA_ID_1620712_Annot_ID_49015 3000 nt of promoter + ATG
attcaaatgaggtgagcaagaatgtgtctgggacgatatgtgggtcgcacgatgtgagcgtagcccataatagcaaacaggtgtcttcattgactcatatgacggacaatcaagattctgacaattcatcaagattatcaggtggccttggtagaagtagaaaatttgagagtgacaatttaactggtcttgctgacaatgaaggaaaagatgatatgggtcattctgacaaaaagaggagagtaaaacggagaaaaaaacgcatctcttctagatcaatgaccatatcccagcgccttggagcaattgacaaaacaactactgatattgatcttggtattttggatgccttggaggtcgctaccaaagtcgcacaggaagtcgcaagagaagtggactctggagaaccttctcatagttcttcagaagaactatccgatgaaagcgggcagtctggttcgcaatactcccgcgatgatgatgtacatacaggttctccatctaagggattatcagtgactgaaaaccattcctttgaggaacctcatgttggagatgatgatctaatggatgagaaagatgacaaacctgaaagtggtgatgttgaagaaagacacctagcaacagctgctaaatctgaagtaggcagagagaaaagcccatgtggctttgatcttaatcaagatatatgtcctgatgaaacagatgtcattatgtcctccacatctacaacccctgctcctatgtctgtttcattttctgtctcatcttctgcaatgcctgcagcagcaccgtggcatttggaaagatctcttagcgggaaaggatcagctgctacgagtgtatttcactcagcattacctcataaagttcctagtggggatttaagagaaaagcaggtgatttctcgtggtatcgatctgaacgtggctgaggtaggagatgatcaagttgaagatcttactccttggaaacagtttcctttctcctcatcaaactctaggggtggagagtcttcacatgaagccagtctgcgaggatcaagcaagttcaacttggatttgaattgtatgaacgaggacgatgagatgcctccaccttctgagtcgaagatggaaacaagattgtttttaagtcacaatggtcagcaaagcgcatcacctgtctcctcatcgtcagttgctcaacaatcaggcaaggaagtaaactttgatttgaatgacaggccacagtttttcattgattcacgtgatcagggtccctactatgggcggcacccatggagtacagcctcctatggggggcacaaattggaagaaccaggtatatctatcttgggtacaaaagtggaagctgacagaaaagactctgtacctcagatggcttcgttcttgtccaatggcaagtccctcgagcctgcaacaggtttacacatgggaagaacgggaaactctttgggtctagcccctggtgtctccttttctccagcccctatgtatggctacaacggattgactggtcctcctggtttgtcaatgtcatcacccatgtatgttcctggaactgctattccatacatggtggattcaagaggtaccccagtgatgatgccgcaaataatcggatcagcgccgtatgtgcagccaccattccctcaacaacacatgttcatgagcttggcgggtggatcgcctagtacgaatggatcaatgcggccaaactttgatcagaactctgggtttggacttgagataggaaacagagagtcgctaaatttgaggcagtttctatcaccttcacaaagcggggctatgggagagcattcaggagcaaatgtagagccctcatcgagttcttctatcagcattggtggaaagcgaaaagagccggagccacgttgggagtttcctccatggaggtgagtgatctacaaagtggtggagatgggttcttgaataggttgatgaattgattgattggtcaaaggatgatgacaagtgttttgaggtaacttataaagtgtcttgctgaacttttccttcttttttttttatttcctcagttttcccatttttcaggttttttattttatttcataacatataggaggattagttcaaacattggtatatgtcaagcttctttttaaccttgttgggtttttctccataaataaatatatagttttaagatacagaaaaggttctagtggtttgattaatctgttgcgtccattttcgttccattcgtcgatatgttatgctctcatttctgaacaactgttcatggaagaaagcagcgaaggaggtctctggtgaggaaggaagtctctcacgtgttgtatctttcaataaataatgggaccaaatagacattaccatttttgaaccgcgcatacatattgctactacggatgagtgatgactatgatcttcccaaattgacaaattgtatcgcctttaggcgagactttagccatcaaccgattaaagccagccaaacgtaataaccttggcaagcataatcatcgttgtacaaagaaaaacatcattttacttttgtatccgacatcaataaaagcatagcatcctaatatccaatagttatttgtcacatgtaaaacaactaaatatagccgtccgatcgtcccaattaggacgtaaacgaatatcaccgttgatttagcatactttgataatttaaaagtcgtccatccacgccacaaccccgaaatccacgtcgctccacgtcaagaacaaaaccttgctccaatacaaaactaccacgtggctatctcacaatacgatccgttagatctgacacgttggcaaatcatgacgaagctaaccaatcaggagaaactaaagtgtacgcaactaaacagttcacacatcactgaatcatttcctattatatacggatctatcgagctgaatcatcatcatcactgagtaacccgaaagcaaagactgagagaaccaaggctccgatctaacaatg

SEQ ID NO: 4513 - DNA, 3000 bp, Unknown; identical to SEQ ID NO: 4512
  misc_feature (1)..( 3000): cDNA_ID_1824643_gDNA_ID_1620712_Annot_ID_165458 3000 nt of promoter + ATG

SEQ ID NO: 4514 - DNA, 3000 bp, Unknown
  misc_feature (1)..( 3000): cDNA_ID_1824639_gDNA_ID_1620712_Annot_ID_49016 3000 nt of promoter + ATG
atcagaaattcatttgtttaatgctctctaacaaacaataagaaattcaatataacttcagatgagaacaaatcatttctatcttcactggatcattcttttctctcgaaaatgttcgatgccacgatctcaaaatgtctgcagcttctatatatgttcttccgtaaactaaattccatcaagttaccatcggataacgcgagtacccctctagctcctagctctactcaattttctatataaaaaaaaaaacttgacgaaaccatggattaatatatatatgcgagtaacttgtattttgcaggatgagttcgttcgatggtacttggggctatccttctcagctagagtggtgatttatattacagttttgggtactatatttctcccatatttatataattaacatatggagtactatttatcttcaatgtagagctaatttgtttgtttttttgtttttgttattgtttctcaggaacaataatgacgattacttatttggtattgaaattcctgagcgaatgtgacatggaggatgacacacagaggctaccattggtggcagaagaagaagtcaccaccgattggacgccgccgttgatcaatgagtcgttggaggtaacggggaagggagatgtagaaacggcgtcgtttagctcgtcggatgatgtggactactcgacactgtgtgttatatgcttcgaggaacgtagaaactgtttctttgtaccgtgtggtcactctgccacttgtcgcggctgtgctcaaaggatcttgtcggaagaaagtaaggtgtgtccgatttgccgaagggtgatacgcaaatcaaagagattagtgttgaaaaagctttgagcgccgttgctttgcctaatcaccattttgcgaactcatgcttccaagaaacgccctttgctttgcgttttattattatttgttcttttcagttttcagcgacacaagtgaaagaaagatccgagtatctttggtgtcaccacaagactataattccatacaatctgtaatttaacaatgcaattctttaacaaccaaaaacaaagacaattccatgccaatgtacacactagcatttggatttgtttctttttcggtaaaccgatttgtatttatcatgccaactgtttgcgtttttgggggtgtatcatgaaattaaaatcaattctgtaaagtttagatttgaaatttgaaattatttttaaaaatctattttgagccatttgaaatgaaattttttcggagtttcataacattggatgttaatgaaagtatttaaaatcttagttgaataacaccaaattatagattctagtaagcatgatttacaaatgtaaagatttcataacaacagattttaaagtatagtttagaatcattaattgaataacattggattagtgttaaatttcagttctattaaatccatgattgaataacaccaccttatagtttatgccggattataattggaagaaagaaaatattgggttttgagctatagtgtatatgttcttataaatttagtatttggtattttagaatgtatcaacaatatttaccatgctaaaatcaaataataaatcataaaaataaaaaactactttcataaatttaaaggtctacataagaaaactctacaaagtaacatattgcaaatataacaaaaaattcaaaacatattttaaccatatgaaaaatcttaattattatattatggattaggatattcacggaatttatctgatttttgtttgttccccatagaattccgcaaaaatgggttgtggtggaaccatatgggtgggttcttgttgactcacacaagttggtacataatgagccgggccgtgagtccctaccgattcactcttcacacgcttagcacgtgcagttttcatcaaaaaacgcaaacgaaattgagcaaaaaaataaatattcaccaatcgcttcataagatttttagttattaaatatttattgccaaaaagaataaacgaagaaaaagccttttcttctctctcgttttcgcgacaaccttttcctcgaagaagaagaagaacgaggttttctctcagagctgccaaccatcgttgcccggagatttaaaaaacctgtgataaatcgtaactgagtgagagatatatacacatatatatacacagagggacaaggaaagagattgggatatgcgagtgcgcatcggttctgtcggaacggctaactcgcttgacctagggtttcgtcttccttgtgcttcgtggtgagttctatattcctctctctctttttacaatgatgaatagctctgaaattcgcctagggtttattagtggtattcatttggtcatctgtcttcaattttttaatcactttttgaattgatctttggaatcttattcattgaattggcttaatctcatattatttgtcgtatagttctccacatgtgttgaattttgctagttttttcttcttctcaattttagggttttgatcctggacctgggatttggttggcatgatttttaaatagatgtactctatagtttctgagattgggagattttacaatttttgttgtcctttgtctgtaccatcaatttgaaagtcgctgtattcctgttaatatcagtcacggtcactagaaggtatagtgtagttgtcctgcatattgtagttatttgtttttggtactatgccaaatgtaaattcatatttcttcgacaatggagtgatcttggattccttgcatatgaattgggtctctctaagccatggtgaactcgatttcatattcaaaatattttgaacagtttgattgtgtttttttttgtacttgtcacagtaggttaatgacataaagtttgtcttgttctgtttttgttttgtttctcaggagtttttcgaatgggagaaagaacctttttgctttctaaccgtgttctatatttttggagttgtcataagtaaagcagtatg

SEQ ID NO: 4515 - DNA, 3000 bp, Unknown
  misc_feature (1)..( 3000): cDNA_ID_1824635_gDNA_ID_1620712_Annot_ID_49019 3000 nt of promoter + ATG
gcgtttctctctctatatctttaggtatgtgttgatagtgcatcagtcaaatcgaccaccactcataggcttacacgtgtgatcatttgtcaagcgttttgacactcctcagcgtcaatgattttaaatttggagcaagtggagctcgaattatatatatattcgttattattattcgagaaaaatctaagatattttatatttttgaggctgattagatgctaaaaatataaaaattaaatttttaattaaagaaagatctaaaaggaggaaggtctctctcttctctctatagtatttttcagagaaagatttttccgatgtaagtttagaatcgccgtccgggtttcttccggtttccgttatctggattttttccggctattatctcccgttgatcgggatttagatttctttttgggcaattttgaattcggtttcttcggatttgtttttgttttgtagctttaaaatcttgatgatgaaacattatgacaggcagaatcttcagttccgaagaggtgttctcttcgcatgatttagtttctttctgctttgattggcttcaccgttgggttctgttttttttggctccaacagttttccggcgatgtgtgcgttctcgacaattaggttcgtttggatctactgtgtttaagacagtttcaatttctccacgactaaggttaggtcaaagctcgtttcctatgcaattaagatatgcctttgttgttcttgcaagagatttaattgttagacaagtttgaactactcagttttctctaatttcttttacccatttttgccgaatcctttgtgattcttgcaatcggatgagattaggagattgatgtttgttctgtaacttttaattggtgataaaaaagaagtctcgttgaccggtgattttccaacgacgtttctgattcaccaggcttgagtctcatgtgcagtggaggttaggcctgggcacgaagcgaatatccggaaaatttgggatatttgttattcgattcgttttaatcgaatacttaattttattatttgctttgatccgaaaatttccaaatatccgaaaatacgaatatccggatttttgtatgatatttgtcggatatccgctttgctttgctacatccaaatatttttttatataaattatttaacatagatttcaaatttcttaccttatgacttacgagtgtgagattgagagcaactgaaaattttctggttataaattctgtaaccaaattgagtgataaaaatagtgaaaggtcgaagaaaggaaacagaaatgtcgctcttatatttgatggattggaaagtaaaacgacaattttaggataaaatataaaaaataaaacaattttattttaaaaaattccacttctctaataaaaactgtgtcacaaaaaaaacacaggcccaaaggatacaaatacaagcccaaatcccaacatatacaaatgcacaacctatattgtgatatatatatatatatatatatatagatcgaagcgaatatccgactttagaaaaaatagtatttgttatttgcttcggtttttacgattactacatttttctatttgctttgctccaaaatcttacgaatattcggatttttcgaatcaaatcaaatcgaatattgagttaaagcggatcgaacgaatattttgtccaggactagtgaaggttgtggacgttccacgtgtccctagcttattattattggtctgacacgtctatagcttatctcttcttttgtgtcgtatgagcctttatatgtgggatgtcttgggctttattttggttttctcataaccaagcattgtactggtaatgataaaatgaataaaatattacacttatgagaaaaaaaaaaaaaaaaagatgctaaaaatattacatatttatgcagaatatagaataaatcacacatactgatttaataaatgctctatcaactctgatatataaggagattttgaaaagaaaaaaacaaagaggagacttttgttgtgcgacagtgattttagtaattttggcaaagttaagtttgcctttctttgtttggtaaagtcgttagggaaagaaacaaaaactttttattagtgaaaacctcgttagactgatttttaagtttcttcgtgaagtgtgttgttacccatttatcaagttttttttaaccgtagttgagcaaataaggacgagtgtcatgattgtggttccgtcacaaacttatcgactgggtttggccatgtaggtgaataggtaggaagacatgggccttagtcttatcatattatgcattaacataggcccatgttttgtttgtaaaggcccaaataaactatgaactgtccttgcatattacctcaaaaacctttaatctctcttttggtcttgttttctatttccatttctataccattcaaaactataacttaatttcagcatcattaaagcttggaatgggagtaattttcaatgagctggtttttgttatttcaaaaaaactcactaaacatccaatcaaaattaaggaaattagttttcataaaagtgtgttttttaaaagccagatttttatcatacgaaaatccaaaaaaaaaaaaaaaaaaaaaattaaaaaaactcttccaatcattattttagtttgtaaagagtccaaagacaaagatccagtgagagcaaaaaaaaaagcggcgcgctgcataaggattaaggaaggagccggtgaggtggagaagaggataagaataaaaccgcaagagccaagtcagcagtcatagcggttaggcgttgagaaaatataattgacggacccgcttcccgtttaaagccgaatatgctttcttctttgtctctcatttattcctttttcctttccttcttttctaacctttcgtataattacattctttgcctttctccttcttcttctttagatcctaagtatcttactttcctttttcatcatcttcttcgatcatg

SEQ ID NO: 4516 - DNA, 3000 bp, Unknown
  misc_feature (1)..( 3000): cDNA_ID_1824623_gDNA_ID_1620712_Annot_ID_49023 3000 nt of promoter + ATG
gaagcgccgccgccatttctggtgcccattctgagaaaagcagaagtgggtgtggagaaaggaccggttcttgtaccgaagaaggcacttctcggcataaaggtaccgcctttaccattgagatttctcttggaagaagaagaagaagcgaatccaattccgccgagaacgtggatttgggcggctgaagatgccatttttcgagctaagcaatagagaagtaaaggtaacggagggaagcggagagtgcaaggagggtttgaagctgaaaaaccctaagggaaagtaggaggaagagatatagaaggcagagaagataagaggaaggtgggagaaagagggagagaaattgtggaccccacttgaagtttcgagaagagaagatggatgggcttcaataggccaacaagtgtttgtgagtttgacacccattactagagacttgtggtgagaaacatctacacttttcactaaagcccaccatctcttaaacctctcaaatgccacggatcacttagcttgagattttgaggtacgttttgggtgaaccaaccaagaaagagaaatgatgatggtatttgatgggttgtttgctagaacctttatacgaccgtttttgttcatatagacatagtttacactaccgatccagtttgatgtctgagacaatagcaatagacttttttttaactcttggaatacttgttggtaaatgcggtggcgacatttttgtcataaacttgtcttttgattatgggtattatccctaattactgtatatacctcaaagttcatggaccaaagagttaccaaataaattcgaataaaaataaataaattcgaactccatgtgcaagtgcattgggctggacgactctctctcgagttttacacaaaaggacaatcttggagtcaaggatcctcatcatcttccaaataaagtaatatttagtttattcatcttattgcttgtatgataatttgttaaattctatctttacacagttttctttctttgttatctttcgacggattcagacgcacaaaccacaatgggtctactactactatagttatagaagtaagtgggttgtgactttcagtaaaagatacataaaagaaaatctaaatcgtgtaatatatcacatctcactagtcatcaagaatgcaaaatacgttaaaccactgatccaatacacaaagcgatcgataaaactataaagaaaaatttcttgtattaaacgtttcatgaaaaagatggactctaatcgaaaataacaatgagatctattatatgatagatatggaggtagaggaaacaaaaactggtttcacgagatcccaaaaaaacgcttacaagcctttacgaatgcttttttcttgaagttgttgctcttcttcttcttgtgcaccttctctttatcatcatcatcttcgtcttcatctccttcatggaaaggaagcggccaagtcgtggcagagctctggtcatagattctacagtagcgttcagagacagacgaagatcttctcatagacatctttattggtgaaggaaccgcttgtgctgatgcagacactgacctgttcctgctcagcttcggtttcatttcagcaggttcaagatcgggcttctgaatctgaggatcgaccaccgggtggtccggctcaagtttctggtctgttgaatccatcttggaatagccactcatgatttgttctctctttcttcttcttcttcttctgatatatgttttgatagtgaatggacttctaagctatagtagtatcgcatatatatataaatgtgtcgagaggttcatgaatagagtaatttttatcagaatgagatccgcacaatattacagctggtggagattgtaagcaacgtttttaacacagggcatgtgcacttgtctggcaaatgtttggcattacatatagcattcatacttggtgtctcaaaaatgtgttaaaataaaataattgggagacaaacaggtgaaaagatttacgttatgctagctgctcaatagtcaattactcaataatagtgtagattagagacaacttttacttattcgttactctgtgatttattcactacaactacaagaaaacatgctattaacaatagaaatatctgttgtctctaattacttattcgttactatatgatttatatatatatatatatatatatcactacaagaaaacatgctattaacaacagaaatatccgttgttaaattttgtcgtttataaattatagcaacatatccataaaaaaaaaacactttgtttgagtaataaactaacaacgaatttcaaatgtaatatggcagagaggaataaaagacaaactaattgaagatattggttttcatatcctaagaggctaagacatatttacagtgttcctaattaatccaagtgttagaaaaaaaattttatttaaaaatatagattttttttaaaaagaattattttaagttcctatgcattttattaattaataatgatgaattgtatactccaagacaaataattgaatactattgaaatgatgcatctgtaatcaaattttaatttgtttgcttaatatgtgtgaaaatcttagaaacttggatttataaggaataaaacggattattagttttctcatttattaatagtttcatagtttgtggtatttgaagaaggataacatatattatgtgctctttgaatatagtttttgaatttgtggtattttgaccaaaaaacaatttgtaatatttttacagtaatcttcgttatttttgattttacaaaaacctataaaatactatacgtaaaaagaataaatagtgaaaaatcttccgaaatgaactgaaataaaaaggtctaaatgtgacgcaaggactagtggtgtttgagaggaattgctatttgcaaagttgtatttggagcttaaaaccctaaacccagaaatccccaactcttaaacttgagaagatg

SEQ ID NO: 4517 - DNA, 3000 bp, Unknown
  misc_feature (1)..( 3000): cDNA_ID_1824619_gDNA_ID_1620712_Annot_ID_49024 3000 nt of promoter + ATG
tcgtagttgtaaggattagcggagagctccgactccaaggttacaatctgctgattcgactcggcttcatcttctgagtcggaatcagaatcgccggaatcatccgatgaggggggatcagctcgggcagggttttcggctgaagcgtcttccatcttctggtcagtgttactgacgagttcagtgtcatcagccatcatcttctcaagtttaagagttggggatttctgggtttagggttttaagctccaaatacaactttgcaaatagcaattcctctcaaacaccactagtccttgcgtcacatttagacctttttatttcagttcatttcggaagatttttcactatttattctttttacgtatagtattttataggtttttgtaaaatcaaaaataacgaagattactgtaaaaatattacaaattgttttttggtcaaaataccacaaattcaaaaactatattcaaagagcacataatatatgttatccttcttcaaataccacaaactatgaaactattaataaatgagaaaactaataatccgttttattccttataaatccaagtttctaagattttcacacatattaagcaaacaaattaaaatttgattacagatgcatcatttcaatagtattcaattatttgtcttggagtatacaattcatcattattaattaataaaatgcataggaacttaaaataattctttttaaaaaaaatctatatttttaaataaaattttttttctaacacttggattaattaggaacactgtaaatatgtcttagcctcttaggatatgaaaaccaatatcttcaattagtttgtcttttattcctctctgccatattacatttgaaattcgttgttagtttattactcaaacaaagtgttttttttttatggatatgttgctataatttataaacgacaaaatttaacaacggatatttctgttgttaatagcatgttttcttgtagtgatatatatatatatatatatataaatcatatagtaacgaataagtaattagagacaacagatatttctattgttaatagcatgttttcttgtagttgtagtgaataaatcacagagtaacgaataagtaaaagttgtctctaatctacactattattgagtaattgactattgagcagctagcataacgtaaatcttttcacctgtttgtctcccaattattttattttaacacatttttgagacaccaagtatgaatgctatatgtaatgccaaacatttgccagacaagtgcacatgccctgtgttaaaaacgttgcttacaatctccaccagctgtaatattgtgcggatctcattctgataaaaattactctattcatgaacctctcgacacatttatatatatatgcgatactactatagcttagaagtccattcactatcaaaacatatatcagaagaagaagaagaagaaagagagaacaaatcatgagtggctattccaagatggattcaacagaccagaaacttgagccggaccacccggtggtcgatcctcagattcagaagcccgatcttgaacctgctgaaatgaaaccgaagctgagcaggaacaggtcagtgtctgcatcagcacaagcggttccttcaccaataaagatgtctatgagaagatcttcgtctgtctctgaacgctactgtagaatctatgaccagagctctgccacgacttggccgcttcctttccatgaaggagatgaagacgaagatgatgatgataaagagaaggtgcacaagaagaagaagagcaacaacttcaagaaaaaagcattcgtaaaggcttgtaagcgtttttttgggatctcgtgaaaccagtttttgtttcctctacctccatatctatcatataatagatctcattgttattttcgattagagtccatctttttcatgaaacgtttaatacaagaaatttttctttatagttttatcgatcgctttgtgtattggatcagtggtttaacgtattttgcattcttgatgactagtgagatgtgatatattacacgatttagattttcttttatgtatcttttactgaaagtcacaacccacttacttctataactatagtagtagtagacccattgtggtttgtgcgtctgaatccgtcgaaagataacaaagaaagaaaactgtgtaaagatagaatttaacaaattatcatacaagcaataagatgaataaactaaatattactttatttggaagatgatgaggatccttgactccaagattgtccttttgtgtaaaactcgagagagagtcgtccagcccaatgcacttgcacatggagttcgaatttatttatttttattcgaatttatttggtaactctttggtccatgaactttgaggtatatacagtaattagggataatacccataatcaaaagacaagtttatgacaaaaatgtcgccaccgcatttaccaacaagtattccaagagttaaaaaaaagtctattgctattgtctcagacatcaaactggatcggtagtgtaaactatgtctatatgaacaaaaacggtcgtataaaggttctagcaaacaacccatcaaataccatcatcatttctctttcttggttggttcacccaaaacgtacctcaaaatctcaagctaagtgatccgtggcatttgagaggtttaagagatggtgggctttagtgaaaagtgtagatgtttctcaccacaagtctctagtaatgggtgtcaaactcacaaacacttgttggcctattgaagcccatccatcttctcttctcgaaacttcaagtggggtccacaatttctctccctctttctcccaccttcctcttatcttctctgccttctatatctcttcctcctactttcccttagggtttttcagcttcaaaccctccttgcactctccgcttccctccgttacctttacttctctattgcttagctcgaaaa

SEQ ID NO: 4518 - DNA, 3000 bp, Unknown
  misc_feature (1)..( 3000): cDNA_ID_1824615_gDNA_ID_1620712_Annot_ID_49025 3000 nt of promoter + ATG
caccctcacacgtgccaagttcgaagaattgtgttcagatttacttgacaggtaattttagttacagttcttatggctaatattcatagcccgtcaagtaaacagattgccacatgttcattttgtagcttttgattaataatggaggcttaagattcttaccatgtatctatcttatagggtcaggactcctgtcgagaattccctgcgggatgcaaagctcagcttcaaagatattgatgaagtcatccttgtcggtggatccacacgtattcctgctgttcaggaactcgtgaggaaggtgactgggaaagaacctaatgttacagtaaatcctgacgaggttgtagcgttaggtgctgcagtccaggtgtgttctcctgaacttgtatctttcaccctatttaggtcttgaatttaacaatatgcattagtcattcctttgataaccttttggcaaagaagttgtgttctactaaaatgaattcttatcaagtaccattctcttctggctccaggctggtgttcttgctggagatgtgagtgacattgtgcttcttgatgtgacaccgctttcgattggtttggagaccctaggtggtgttatgactaagattattccaaggaacaccacactgcctacttctaaatcagaagtcttttcaactgctgctgatggacagacaagtgttgagattaatgtgttgcagggtgagagggagtttgttagggataacaagtctcttggtagcttccgtctagatggtatcccccctgcaccacgtggagttccacaaatcgaagtcaaatttgacattgatgccaatggaattctatctgtcagtgctgttgacaagggcacaggaaagaagcaagacatcaccattactggcgcaagtacattgcccaaggatgaggtgcgttcactttaggaattaaaccgcattgcttcattaacaataacttgtttttgtcagtcccatctttgaggtttagtgattttctactgattatgaaagtggtagccataccataccataggttaactggtagcattctcgttgttgctatcacttaatggctgtagcaatctccatcatcataggagtggttatttttcgttagtattcataatcatggtaacaaaagttggtgtggatggatgttgcaggtagaccaaatggtccaggaggcagaaagatttgcaaaagatgacaaagagaagagagacgcaatcgacacgaaaaaccaagcagattcagtggtgtaccagacagagaagcaactgaaagaactaggagagaaaattccaggtgaagtgaaagagaaggtggaggctaagctacaagagctgaaagacaagataggaagtggatcaacccaagaaatcaaagacgccatggctgctcttaaccaagaagtgatgcagattggtcagtctctatacaaccagcctggagctggaggtccaggtgcaggtccttccccgggaggcgaaggtgcttcatcaggagattcatcttcaagtaaaggaggagatggtgatgatgtgatcgatgctgacttcacagacagccaatgagaaaacaaactaggaaggctttggaattcatacatgggatgcgatgggagagacaaatgattttgtaggttggatttgagaacacaaatgaatttaagcaatgcttgtggacaacatttatttgtcgttagaaggaagcagtgtggttacagaggatgatgtttaatacataataatatgcaagccttctcttacacggtacttgcggatacacacaaaatgtacaaagtgggggcttttgaagcaatcctccgcaattatagtgactcaaaccttaaaatgcttttggtcattaactttgtactttttttggtatccaattatagcgactcaatcaatctgagactatccaacgcaattttagtatccaatgcacaacgacgtatgctttatctaccaaatcttatatgattttggaatgtttatcaaaatgcgttgattgcttatttatcttttctaaattctggccaatagttaaaattgtcacatcgtgttagtgaagagatctctctttgaaatgctcgaagttttgtttcgagcaagaaaaatattttttgtcgttgttatgggttctttgttttctactaaaatcccttcagacagaagaaaaaaacataaattaaatcccagcgaagcatatgtaataatgtaacaacaataaaatgtaataaaataaaaaagtaacaacaggctgtcaaaatgataaacaaataacaacggaggaagagtaaagtggggaagaagatcaatgggcccacacacaattcccaattctttgaccaatagttgacttttcttcctcgagtctttttaactcgcttcacctgttaccatctaccttcttacattattattacttactctcttaatcacttttgattaacaaaactaatttaccattgagggttttcttcttccttcttcttcatcctctttgctgctatgattgagctccatggatctgcaatcatagttcttcgatttaggattcgtttagatcgcggtttttgagctcggttggtgaagacatatgcttgaaaacgtactttaagctccaacttcgtctatttacaatattcctttattactttcatattcttctttcaaagtctttaagggttattttgcagtctttctatttgacttttgcgcttttattgaattgattttatatggtgacattttggacttggtcttctgttcaagattcctaggtcatctagcttcagtttttggtctatatttagaaactatgatttcgattgagatcttattggtcagattcacactttgtgtcagcaattctcagaaatatctaaagtggtgacttttgattgtttttgtgtgttgttgattctgggctctaattctctttctttgattttggtctggccaacagagaagtcttgtactgaagc

SEQ ID NO: 4519 - DNA, 3000 bp, Unknown
  misc_feature (1)..( 3000): cDNA_ID_2999587_gDNA_ID_1620712_Annot_ID_49029 3000 nt of promoter + ATG
attttatttttaacgtacgtagaaaaactagggaaaatacagattcaaacatccataatgataggttacacgtaggaattatgacggtgggagctttttaatgaactctaaaacagctttggcagtgttagtggcagccaaagatccaaactttcgaacagtgttatctcctactcctgctaaatctgataatcctcttatcacaattaggggatacccatttgacacgcaagtctggtcgaatccaaaacacatgcaaacaaaattaagtgaaagttcaatgaaaaaaaaaatggagtgaaaggaatgaatcacaatgttagaaacgtgaataattaccatggccacagcagaactctccatgtctgaggaggaaactccaaaagtatcgtataagaaatttctataggctgcattatccacaaatatgtcagcagtggctgcttttaatccaactactactttgggtttatttggaagacacagacttgcattcacacactgcaatagctccatcttctacattcatacaacaaccatcaaccatggaataaagtcttttgttagaaaaaatatattctaatctaatcatatgtcattcttaacaacctcaagatcagctgcaagatgaagccactcttgagttgtattaatccaaaacactttctttggtgaattgatgtgaccactgactgaatataattcctcgtaactgtatccaatagttcctaacttattgtttccttgtggaacattatagttcccgacatctaagtacgctacatcctcatttccttttgctttgcctggattctgtttgacgatcagaactaaaatcatcagacaatatgaaggagaagcaattatttatcaataacaaaacttgtgcatgtaaattttgtatataccagccaatcccacaagccagcattcgtgatttgcttagggatgctcacatctcctatggacatcgagttgtttatatttccagcaatcccaaaatgcacaatccctttcacactgaacacatctatcatttgttgtgttgctgctgctgcgttcaccttcaaataaaattcaagaaaaatttaccatctcctttttatagaaagttttggtttgatacttttaatataaatgttttttagtacatcaatttattttgtgattttaatataaatgttttttaattatcatttcaattttttattaggatccgtgaaataacattacaataaccaaataaactctttttcacgttgtacttttttattttggggtcaacttactcaccattcctatcccacatctgacatacacaaccttctttccatgaatcttccctatacgaaaacgtcttcctgcattcatttactcattaaaatcagaaactacttacattttcatctcaaaggaacaagagtctagagactctctcaaggtagaaaaacttaatagaaaccaattcaagtggtaattttagggatcagtgtagataccagagagatcgaggaaaggatgcgtaggatcgagtctgaaatcaacactgccgagaaaagcatcttcttcggtctcaaagaccgtcacaaggccaatgtaaggtcctctacggttgatttttctaatggtagtggcggattttagtttgtgtgagtgtgaaggtgtggtcgaagcacgcaaaacgtgcaaggaagagatgatgatgatgaagaggagaggaaaaagaaaatgattgtgatccatggaagccatctgatatattggttggttggtttgagataaatgcctagctcatgtctacatatatatagcatccaagtcaaacctctacaaggctcacatgagccgaaactagtatgaactttcttctttacacatgattctcgtttcattaatattttttattcgtgatcaaagatgataacgtattttattcgtcagtgtgagaccatgcataaactttttaaaaattcttaatagcttaatgccttaagaccatcgtgttttaatgcttctacatatattaacatgtcctccttattaatcagtcactcaaaatgattaattagaagggatgttttgctttaattgatacatcctaataaactcagtaaaccttagggtatgattttatggatagaaagaagatattaatttggctattaaattaactttaaacatctatatatacatttttgcagccattttgtgaaataaattctgtagttgagacttatttacaatggttgccactggattttaatatttgtttttaataattagaaaaaaaatcttcgaattaaatatttgacatttaacaatttttctaaaatctctctacattaactacacgattggttactaaaataaaactttcaaaatatttaatatcatttaattactacaaaattatcattattgatattgtttttctgcatgactattacaattcaattataatcatcaaaccgcagagatatttgatagcatttaattactagataattttaaaaataaatgattcataaacatatgataaataagatcaacattaataaaataaatgagtttttttacgggacgggttggcgggacgggtttggcaggacgttacttaataacaattctaaactataaaataaaaatattttatagatagctacatagatagttacaaattgcaaaattttatatatattaattttaaagtataaattgttcccgcgatataccgcggatgaaaatttagttagggtatgatttttggtagaaatcttaatatatcctatccaacgagaaaatattataactcaaccttattcttattttcctttaatatttttaatttgtcagatgaatttttggaacaaaaaaaaaaggatctggtggtggtggccaagcaaggcttaggctatagcacgacgactcaaccagctaattaacaagttttaaactttttctccggagctctgactcttcttctctccggatccaaaaatg

SEQ ID NO: 4520 - DNA, 3000 bp, Unknown
  misc_feature (1)..( 3000): cDNA_ID_1824601_gDNA_ID_1620712_Annot_ID_49030 3000 nt of promoter + ATG
tgtccacatctacagacatagatagcaagagtaggtgacgctaatcatgcaccaattgaaaggcaactgtgtcactattgacaaataaaattgagatatatttttaaaatttacgagaatgaaacagtagacataccgcagcaacggcattttcaaacatcagagaaaaacacagtattcaaatgctcttttgaaacttttaatgtaagcgagaggaacattatacacattacatactagtgcttcacccatatcacattcacaactcaggtagtgatcctttaacaaatccatcgagccaaaatatatcatgacaaggggaacctaagaaatttttcagtacatcataattattcaccctacatttctacacagtttgacaacgaggctaggcagttggattcacaccaaaataagaagatgttatggaacttagcaaaaggaactgcccagctatagttctaagctaagtgatcagtgatcactggagttcttattctgatcaagcgcctccctttggagtaaaaagagctcatttttcttattcaacatgattagagaaaatcaaagtcaccaatgaggccagggcatatagggattggagtcaaaaccagttactctctcaaaacttcctatgaactttcatgttcatccataaatcaaatgtttaggctgaagtccaagaagaaactaaactaaactgctaagattgtcaatcatcaaacaaacaaaaaagcatctgacctgatcaagtacaacatcggtgatcatatctccagctacctccttagactcagagaccacagctaactcctccgttacccacttcctcccgccaggactgggaaccatccctccaaatctctgcagatccctcagctccttgtgcatcgttttagccgccttcttcctcgccatagcaaacacaatgtgatccatggcttcatcattcatatacacctcaaaactaatctcatctttacaaggcacgacagagttgaatagccttgagatcagatcgtgtctactcttaagctccaaagtcgccaaaagcccatggcaatacctacgcccactggcatagaacttaaacacattcgtcgcttctttcagcaacaaaggagagtcttctccttcaccaactccaagcaaactgaagttcttctcaaaaatcgtatctttaagaccaaatttggaagcccaagccaaagcgaggttctcattttcacgtttaccagtgaagtaattgatagcgtaaccaatcaatatagagacgcaaacgatctccacagtgtacgattgcatcttcttcggaatgtcagtatctggagtttctgaagcagactcaagatccggcgtctgtggatcggcaggagaggaggcgtcatcggaaaaaaccggagactccgtagatttctcgtcctccggcaatccttcgaactcatcttcatcccagtaatcgaaggagatggaggacgaaggcttcacggtctgagtgggaggatcagatttagatgcaggagtagaatcagaatcgggagatgggtccagatccagaaccgttgactcagactgagtcagaagaggaggacggagagagtggtgaagctcagtggaatcttctgaaacatcgtcgtcttcagcatcgaaaccttcgaagtcggaagaggaagaagcgagaacatgatggtggaggcagaggaaagcgatcagagctatggagaagagagaaaagagacgattcatttttggatccggagagaagaagagtcagagctccggagaaaaagtttaaaacttgttaattagctggttgagtcgtcgtgctatagcctaagccttgcttggccaccaccaccagatccttttttttttgttccaaaaattcatctgacaaattaaaaatattaaaggaaaataagaataaggttgagttataatattttctcgttggataggatatattaagatttctaccaaaaatcataccctaactaaattttcatccgcggtatatcgcgggaacaatttatactttaaaattaatatatataaaattttgcaatttgtaactatctatgtagctatctataaaatatttttattttatagtttagaattgttattaagtaacgtcctgccaaacccgtcccgccaacccgtcccgtaaaaaaactcatttattttattaatgttgatcttatttatcatatgtttatgaatcatttatttttaaaattatctagtaattaaatgctatcaaatatctctgcggtttgatgattataattgaattgtaatagtcatgcagaaaaacaatatcaataatgataattttgtagtaattaaatgatattaaatattttgaaagttttattttagtaaccaatcgtgtagttaatgtagagagattttagaaaaattgttaaatgtcaaatatttaattcgaagattttttttctaattattaaaaacaaatattaaaatccagtggcaaccattgtaaataagtctcaactacagaatttatttcacaaaatggctgcaaaaatgtatatatagatgtttaaagttaatttaatagccaaattaatatcttctttctatccataaaatcataccctaaggtttactgagtttattaggatgtatcaattaaagcaaaacatcccttctaattaatcattttgagtgactgattaataaggaggacatgttaatatatgtagaagcattaaaacacgatggtcttaaggcattaagctattaagaatttttaaaaagtttatgcatggtctcacactgacgaataaaatacgttatcatctttgatcacgaataaaaaatattaatgaaacgagaatcatgtgtaaagaagaaagttcatactagtttcggctcatgtgagccttgtagaggtttgacttggatgctatatatatgtagacatgagctaggcatttatctcaaaccaaccaaccaatatatcagatggcttcc

SEQ ID NO: 4521 - DNA, 3000 bp, Unknown
  misc_feature (1)..( 3000): cDNA_ID_3073490_gDNA_ID_1620712_Annot_ID_165487 3000 nt of promoter + ATG
ttcttcgcttacattacttatataaaaccctctctcgcatccttcctcagttaatcatcactgctctcttctccatctcgctttcactcgctctctctcttgccctagcttcccttttctcctgaatcggcctcacatcacggctttttccgactgttttccgtcgaatttcaatgggatctcgtgacggcgatccgccattttcgaaattcttgagctgactcgtctccaatagttcatcggttagtctgattccgtgtatatctattcttaacctgcaatttgatttgattgtacacattttttgttgagtcgtttttgtgatatttgtttttatccgtgagattagtttcgtagttatggcgtttatcatcgatagatcagctgcatgagctttaagattatataatttctgagctgcggatctaattttagtaatgtatggaatgattttgagtactaatgtatcataatttggttttgcatgtccagatttgtgagagcttttaaaatctttaagtggacctgtctcatgtattgaggtttgttttctcatctatattatttgtgtttgatgcatttacatatatgtatatatcttatgatctgttttattctacaagtattgtgagtgtcatttgttgattgttacttagttagtctatatattccttttacttagttagttatgagcataagataaaaacaaataatagactcgactcaattgatctgaagaaacacagaaaacaaatctatacccagatatttagttactgtggttattgatatctgcaccttctttagttagctactgtgaataagagactcgactcagttgatctgaagaaacatagtttgttactgtggttttttatatctgcaccttctttagttgtaattcctgagaagattttgaaagcatcattagattcttacttgagcccactttaaggtaaaaaggagctcgtggaaagtctatacccaaattatatgaaattaagcaaaatatgcttgttcgttcttcttcttcggcaaactaacactaattcacccactaaagagttttcgagtttgtctgagtatggtctttttttgtttaacatggtctgttaagtaaaaccctcaatatggaaccttctgagaattcaagcgtgatcatgatatccttgtcactcaactttgattcttggtcaaataagacttttcaaaaaactatatgataggctccttttagagaccatttattggatagcttcatctgtgtttgcagtctctaaatgtacaaaaatgcatttgcacaatgtcttcaaagaagagaaagtgaagaaaacttgctttactatgaggagattaagaaaaattttattgattgaatgcaagacaattttgtctcaaatcattaaaataaaaaatactactttgctgttgcataaactagcaatgcataaatatcaggtttatatctgcatatctttgtaattgtatgctgttcgttgtttttataatatgaattttaaatctgaaaattcatcttcccttgttaatgcagtggaaaactgctacagttgactgagataaggttctgacagtccagctgagatgctgagtatcaccatttgtacttgagttgtctctcatgtctagaccatttgtgagaagggagtttttgtttacaccaataccccccagtctctaaatttgtaagaagtattatgctcaattaaggaacatagctagttcgacataccatactaccctttttaaaactatcctatatgtttgatgctagcatagcgtaattttgtgttctcatggtgcagcagggttagtttattgtgtacctctagatatatattctcttgctgcgtagggttcccaagctgccaaaaacttttaaaaattagtgatctgttccccaaacccccattcaataagaaaggtctacctgtagctcacagtcacagctattagagctgtccttgcttctttgggtttactgttttagttaattagttaccctatgaaagtctgatccttcagaagttaggtatagaagtaagtcgattaagttcattcatgacttttccagatgttgcatacataactttttttatttgtattcgaactagtccaagccgattctcaaaatcatataaaatcatttacaccttggtcatggtagctaagaatattgtatctaaaattggggagtggggagatgtttggttatattcccttctcatcgatggtctagatgtgcgaggtgactctcatggaggtaaagaacaatggtgattttgtgaagaacccaacgtaatggtaattcctaaaaaggttagaagttttttcagcttgttgtattgctaaaatggggttgatgtactcaacgacatccaagtgtacttgagtgagcttttttggggttgagtacctcgacccattattcaaactaatgtaaatggtgaatgcagcagtgactttgttgccttttgcaagaactaaagaagacagaaacaggttgtaaaagagagccaagtgtgtgtttatggtagaaagagcaaagtgaacgaaaggtgtacctttttgacttgttgtcactggttttctcccacttcatccgtttcatgctgcatcagaaaacaacataaggaatgaatgacgtaacgcgaagcattaggagttgcttgtaaattaatacattgccattactaacgtaattcagtagattctaactacaaatgaagtcaatgtatctatttgtctactttagccaatgtatgataagaccaaatagtcttctcttttttcagaaactctctaggattaaaaagtttgtgggtgaaagaaatattatcgtgtggatgataagaataattgatcttgtgttagtaaattaggaatagatatacaagtaggtttctctctaaataaaaaataaaagagtttaaattgcatgcgtataaaagaaaaaagtaagaagaaaatatgttccggtta

SEQ ID NO: 4522 - DNA, 3000 bp, Unknown
  misc_feature (1)..( 3000): cDNA_ID_3073497_gDNA_ID_1620712_Annot_ID_165483 3000 nt of promoter + ATG
cgtccattggctttcctgtcacgtggtcaggcctatggcgacccattatgcaaagtctaaacacagtaagctgcgggcagttctccgacatggctgtcacagctccattggtcatattctggcaaaagtacaggatagattccagtttcctacagccctctgaaattgcttggaggcctactcccgagacaggaccttcactgtcttcacgaggatcaaaagggaaaatccgaagctcacggagctccttgcatgtggcagccactgcctgtagtccttcatcacgtatcgagtcaagagcctgcattataaaagtttcaagatacgcatgtaactcaaagtcctcggttaaaggatattacactatactatacaatgagatcaataaagatacatacccagaagactcggatattgtgacagttgcttatgatgggcttgagcatgtgaggagaaatgttagcataactgaagttaagagaggtgagattagcacaaactgaagagatggctaggaggtattccggtctaaattccctgaatcctgagagacaaactatggatttacaagcacgaaaagcagctgcataatccggttgttgttctccctgaggcacattgtctggactaaatgaccccgtcccaagactcgttaactgcggcgctcgaaccattagtcgatgcagctcttcaagggaaacaaacctgttcgttctaagtttcttcaagaatggtgacctaaccacgagctcctccaatgccttgaaattgataggggattcaacacagtcaaaagacaaagactccagatgagtttcaccctcaggaaaacaagaaatccaatccaactcatcatctgtgacttctgactccatcaaatcaaggacctttagctgcctgaaaacaaagtcccacttgataagcatttctagaagactctgagaacaaacaaacaaacaaacaaagagaagagatctacaaagtacctgcatttgttagcaacaatagcaataccactagtcccaaaaccttcacagcagaccaaagtaagctctttgaacccaggaaacgactcagcaagaagagccaaatcatcatccgtaacaaacatacgcttcaaatgaaccttctcgagccaaggataagccttagctgtagcagcaacccaaggagagaattgagctccccaattaggaggcatgagattaaaatcagcaaacctaggtttccctttaagcacaagagacctaacacgcttgaaccggtgaataagccgagcaggagagagcgagtaacagtttccaataaaaacctctaatcgagtctgagcctcgacgcgataccacgatctgcagaccaatgagactgcgttgcgatcgcatctggaagtgaggaactgaagcacgttctctaaaacgttctcaaggacatgatctggacacggcgggggagaagatttgaaatttcgagacttgttcgtgaatgtagcggcggaggaagaagaggaggaggaggagcaaggtggatttaagttgagatatttctcaacatcctctgacattttagctgagctatcttcttctgtcatacaagtaagtgatgaaaaacaagaaagactctgactttgatcttatccagaatttatgagctcaggtgctctctttctgatacaaaatctgattcagatgaagaagagagataggtgaaaaaggagctggtcttggtgtttggactctctctctctctccattttcacctccattatttaggagactatgtaaaagaaaaaaaaacaaatatttttggttttgcacattatttttgttgatgaagaaataaaaagaatcatcaagtattttgtgaccaaacatgatttttaatcctattaaagatttgtacttctattttaaggtgtgacaggtgacatttagagttttatgtaagtggtaatcatgtaaacttgttgaatcttaaccaaaattaaaaggatttaaaagtgttttgtactgtttctttaaatgaataatactaatatctaaagtcactttcatccttttttaagttaatgcattttacatgaatttaatttttatcatacaatcaacttttcgattgtgttctcttaagaaggcctcaaggctttcgtgtaaaggaaaaatgtttgggcttattatatctcataatatggtggccaaaacaagatcaaaggtgattaatggttggtttactgccaataatgggttttgaagataagtgtactgtatgccttattcgattatcttttcaaaaatgtgtttgcttaattttccacaaggcaaattgttatagatatcttcaaatatgcttcttaaaattttcaaaaggcaattatttagaatatggataaatttcaaataagttccctaaaagaagaaatttcgaagtcaagttttatagaataagtcataacgacgttgtatccatagtcttggtcactaactactaataaatgggtcataagtctatagatatttttcaaaagctaggagtcgtattagtgtgaaattatggtataaatatactgaccttccattacaaagaatgacgtgtaaacaaccaaatattagaatgtggcaagtagtcgccgaacacgtctccttcgtcaaagtctccttttctgacttctctttaacccccaaccccttgttactttaatttggctctacatagatttgtaatcaaacacaaatcacaaatctatatattttcccttaattactttggctttctattgattaaagcttctttaattccaatttgcaatttaaacacctatctctttcccaaatttgagactttcctaattaattaaaagctttgctctgtatatttgtcgttataaatttaattttaaaattcgaaactttttttctgcctttcctctttctctctctctatctatcaaacactagacttgaagaaatgcagtgaaattgaaattgagtagaagcagaagagaat

SEQ ID NO: 4523 - DNA, 3000 bp, Unknown
  misc_feature (1)..( 3000): cDNA_ID_1824593_gDNA_ID_1620712_Annot_ID_165482 3000 nt of promoter + ATG
gctatctgcacggaaactcaaaacttacagtttctggatttggatccaaaattctattaatcaaggactttgcccccagggcaaaatatgaggggcaagagaactcagctttgtcgatctgaaaaatgttggacaataagaagaaaaggaaaccatatcagaaagaaagtacatagatgccttacaagcacataacacggaaggtttagagaaagggagtcttgactacagtgaaaataatttagccataacgatttctattacaggttctgcagatattgcttgttcaatcctagtgtttaattgggataattaaactaggcagcaacaagaaactttacaaaacaaaatatcaagaatcaagaggcaacaacagcagagctcatgccttactatataaagttggtagatccatttcatcaaatggaagatatcctgccataagaacataaaggatgaccccacaggaccaaatatctgcaacggcaccattgtaacccttgtgactgagaacctaaaccaaaacggagaagaacacataagctatgataagaaagacattaaatttcaaaacattatgatatttgatttacctcaggagcaacgtaattgggagttccacatgttgtctttaggatggtaactcccttcagatcaaagtaagataatttagtcaataatgatccaataacaaactaaattctcaaaatttgaaagaaaagatgtcactgagaacccccattacttgttcaggtaatgcactgaggccaaaatcagatatcttgagatttccttgagaatccaacagaagattttccggctgcaattaacacaagacaatcatcagatcaagaacaagtggtagaaatgtattaattcttagcaagtattcacctttagatctctgtggtaaacacctttactatgacagtaatcaactccatcaataagctggtgaaagtatttcctagcttctgactcactaagtcgtccattacgaacctatagtagcaatgaaacaaatgaatcattcaacaatatctgacagagtaaaacgctgtaaaaatcatcaccaagagctactcacaatcttatcaaacagttcaccaccagtaatgtactccaggatgatataaatctttgtacggcttgctagaacctaaaaaggaccaaatatcaaaatcccaaatggaaagcaagaatctttcagtaaattataaagcaaagaagaagaagcaaaacattcacttacctcataaagacgaacaacacaaggatgacgaacaagcttcataatcgagatctctctcttaatctgctaacacatgtcatcaatctaatcatatctcagccaaaatgaaatcgaagagagtaagtagtaagaagatagagacgggacctgatccaccatcttgcgcttgatgattgtgctacgatccacgattttcatggcgacgctctcaccggtctctgtattctgagcgaacttgactttagcgaaagtaccttcgccgattgttctacctaattcatacttgcccaccttccttaccaccatattctcttctgcttctactcaatttcaatttcactgcatttcttcaagtctagtgtttgatagatagagagagagaaagaggaaaggcagaaaaaaagtttcgaattttaaaattaaatttataacgacaaatatacagagcaaagcttttaattaattaggaaagtctcaaatttgggaaagagataggtgtttaaattgcaaattggaattaaagaagctttaatcaatagaaagccaaagtaattaagggaaaatatatagatttgtgatttgtgtttgattacaaatctatgtagagccaaattaaagtaacaaggggttgggggttaaagagaagtcagaaaaggagactttgacgaaggagacgtgttcggcgactacttgccacattctaatatttggttgtttacacgtcattctttgtaatggaaggtcagtatatttataccataatttcacactaatacgactcctagcttttgaaaaatatctatagacttatgacccatttattagtagttagtgaccaagactatggatacaacgtcgttatgacttattctataaaacttgacttcgaaatttcttcttttagggaacttatttgaaatttatccatattctaaataattgccttttgaaaattttaagaagcatatttgaagatatctataacaatttgccttgtggaaaattaagcaaacacatttttgaaaagataatcgaataaggcatacagtacacttatcttcaaaacccattattggcagtaaaccaaccattaatcacctttgatcttgttttggccaccatattatgagatataataagcccaaacatttttcctttacacgaaagccttgaggccttcttaagagaacacaatcgaaaagttgattgtatgataaaaattaaattcatgtaaaatgcattaacttaaaaaaggatgaaagtgactttagatattagtattattcatttaaagaaacagtacaaaacacttttaaatccttttaattttggttaagattcaacaagtttacatgattaccacttacataaaactctaaatgtcacctgtcacaccttaaaatagaagtacaaatctttaataggattaaaaatcatgtttggtcacaaaatacttgatgattctttttatttcttcatcaacaaaaataatgtgcaaaaccaaaaatatttgtttttttttcttttacatagtctcctaaataatggaggtgaaaatggagagagagagagagtccaaacaccaagaccagctcctttttcacctatctctcttcttcatctgaatcagattttgtatcagaaagagagcacctgagctcataaattctggataagatcaaagtcagagtctttcttgtttttcatcacttacttgtatgacagaagaagatagctcagctaaaatg

SEQ ID NO: 4524 - DNA, 3000 bp, Unknown
  misc_feature (1)..( 3000): cDNA_ID_3091764_gDNA_ID_1620712_Annot_ID_165479 3000 nt of promoter + ATG
gccaacccgtcccgtaaaaaaactcatttattttattaatgttgatcttatttatcatatgtttatgaatcatttatttttaaaattatctagtaattaaatgctatcaaatatctctgcggtttgatgattataattgaattgtaatagtcatgcagaaaaacaatatcaataatgataattttgtagtaattaaatgatattaaatattttgaaagttttattttagtaaccaatcgtgtagttaatgtagagagattttagaaaaattgttaaatgtcaaatatttaattcgaagattttttttctaattattaaaaacaaatattaaaatccagtggcaaccattgtaaataagtctcaactacagaatttatttcacaaaatggctgcaaaaatgtatatatagatgtttaaagttaatttaatagccaaattaatatcttctttctatccataaaatcataccctaaggtttactgagtttattaggatgtatcaattaaagcaaaacatcccttctaattaatcattttgagtgactgattaataaggaggacatgttaatatatgtagaagcattaaaacacgatggtcttaaggcattaagctattaagaatttttaaaaagtttatgcatggtctcacactgacgaataaaatacgttatcatctttgatcacgaataaaaaatattaatgaaacgagaatcatgtgtaaagaagaaagttcatactagtttcggctcatgtgagccttgtagaggtttgacttggatgctatatatatgtagacatgagctaggcatttatctcaaaccaaccaaccaatatatcagatggcttccatggatcacaatcattttctttttcctctcctcttcatcatcatcatctcttccttgcacgttttgcgtgcttcgaccacaccttcacactcacacaaactaaaatccgccactaccattagaaaaatcaaccgtagaggaccttacattggccttgtgacggtctttgagaccgaagaagatgcttttctcggcagtgttgatttcagactcgatcctacgcatcctttcctcgatctctctggtatctacactgatccctaaaattaccacttgaattggtttctattaagtttttctaccttgagagagtctctagactcttgttcctttgagatgaaaatgtaagtagtttctgattttaatgagtaaatgaatgcaggaagacgttttcgtatagggaagattcatggaaagaaggttgtgtatgtcagatgtgggataggaatggtgagtaagttgaccccaaaataaaaaagtacaacgtgaaaaagagtttatttggttattgtaatgttatttcacggatcctaataaaaaattgaaatgataattaaaaaacatttatattaaaatcacaaaataaattgatgtactaaaaaacatttatattaaaagtatcaaaccaaaactttctataaaaaggagatggtaaatttttcttgaattttatttgaaggtgaacgcagcagcagcaacacaacaaatgatagatgtgttcagtgtgaaagggattgtgcattttgggattgctggaaatataaacaactcgatgtccataggagatgtgagcatccctaagcaaatcacgaatgctggcttgtgggattggctggtatatacaaaatttacatgcacaagttttgttattgataaataattgcttctccttcatattgtctgatgattttagttctgatcgtcaaacagaatccaggcaaagcaaaaggaaatgaggatgtagcgtacttagatgtcgggaactataatgttccacaaggaaacaataagttaggaactattggatacagttacgaggaattatattcagtcagtggtcacatcaattcaccaaagaaagtgttttggattaatacaactcaagagtggcttcatcttgcagctgatcttgaggttgttaagaatgacatatgattagattagaatatattttttctaacaaaagactttattccatggttgatggttgttgtatgaatgtagaagatggagctattgcagtgtgtgaatgcaagtctgtgtcttccaaataaacccaaagtagtagttggattaaaagcagccactgctgacatatttgtggataatgcagcctatagaaatttcttatacgatacttttggagtttcctcctcagacatggagagttctgctgtggccatggtaattattcacgtttctaacattgtgattcattcctttcactccattttttttttcattgaactttcacttaattttgtttgcatgtgttttggattcgaccagacttgcgtgtcaaatgggtatcccctaattgtgataagaggattatcagatttagcaggagtaggagataacactgttcgaaagtttggatctttggctgccactaacactgccaaagctgttttagagttcattaaaaagctcccaccgtcataattcctacgtgtaacctatcattatggatgtttgaatctgtattttccctagtttttctacgtacgttaaaaataaaattaataaaatctgtttttcttttctttaatcagcttcttgcatggaacactttaatttcagccttcaaaactagaattacaggtctctttgttcatatcaacgatcccgtgacagcaacaattcaaatatgggcaaaaatattttgtgtttataaaatagtatttttttggaaatttgtagagcgtgtattatcgtccacaaaatttattttagtggtattgtaggatatttgtcaaaaaaaaaaaaagtgcgcagccagcagcccctcatgtttaatgcatacacaaaggttatatcagctagtctagagacgagaagcacgtggaaagaagaaactatcaagttggacttggatgatatatatatatatgcagctgtggatttgaatcgtaaaccaaccaaccaatcag

SEQ ID NO: 4525 - DNA, 3000 bp, Unknown; identical to SEQ ID NO: 4519
  misc_feature (1)..( 3000): cDNA_ID_3073501_gDNA_ID_1620712_Annot_ID_165477 3000 nt of promoter + ATG

SEQ ID NO: 4526 - DNA, 3000 bp, Unknown; identical to SEQ ID NO: 4518
  misc_feature (1)..( 3000): cDNA_ID_3073509_gDNA_ID_1620712_Annot_ID_165474 3000 nt of promoter + ATG

SEQ ID NO: 4527 - DNA, 3000 bp, Unknown; identical to SEQ ID NO: 4517
  misc_feature (1)..( 3000): cDNA_ID_1824619_gDNA_ID_1620712_Annot_ID_165473 3000 nt of promoter + ATG

SEQ ID NO: 4528 - DNA, 3000 bp, Unknown; identical to SEQ ID NO: 4515
  misc_feature (1)..( 3000): cDNA_ID_1824635_gDNA_ID_1620712_Annot_ID_165464 3000 nt of promoter + ATG

SEQ ID NO: 4529 - DNA, 3000 bp, Unknown
  misc_feature (1)..( 3000): cDNA_ID_3091760_gDNA_ID_1620712_Annot_ID_165490 3000 nt of promoter + ATG
cccgagatgggccaacagtgtgggaaatagggatacctgaccggtctgcagctgagttctttgttccagacccaaatcccaaatacatcaacaaactatatattggtcatcctgataggtatgtccatgatcaaagatatcacaacattaaggtttcagattgttaaaacagtagagagctaaagtatggttgtacgtaagcaggtttaggcaatacgggctatgggaaagatacacagaactatatcctaaggaagatttggtgttcaccattggcgtcagtgattacaaaaaagattggttctttgcacacgttaccaggtaacaaatatttcacattttctaagaagagtaaaacaaagaagcctcacatttattttaaatgatgataggaaaatgggagatgatacatatcagaaaacaacatggcaaatcaagttcaagctagagaatgtacagaaaagttgcacatacaaaatccggatcgcgctagcaactgcaaatgtagcagaattacaggtgaggatgaatgatgatgacacagaaaagactactcctatattcacaacgggtgtaatcgggcacgataacgcgattgcaagacatgggatacatggaatctataggctttataatgtggatgtaccaagtgagaagcttgtggaaggagacaacactttgttcttgacacaaaccatgaccaccactggagcctttaatggtctcatgtatgactatatccgcctcgaaggacctcctttagattcatactctcactaggacttttagtcacattattgtatacgcaattttgtattgcgggttactttactaataaaaaaaaagacattatatgggccttgtgttgggccttctttctaatctcagatttgactttattacaaacgaaagggtaagaatgtaatttttcgccgactcgatctatcgctgcctatatatacagttacctgcaaaatctagggtataaaagcccctaattttttctccgcccaagagacaaaaatccttcgcaatcgagcaacggaagctcctgcatccaccgtccaaatctcttctaacgtcgccggagatcggtaaaccggttcttcatcccgtattcatctcttattgaggtcttagattcatctagcaccttttttttggcgtcgaaactttcagattccctatttgtaattagttgcgaattttgattcgacgatttgttgctcgaatttgaatcaacagatcgttggggaagtagagaatggcgacgtttgagctgtacaggagatcgacgatcgggatgtgtctgacggagactttggacgagatggttcagagcggtacgctgagccctgagctagctatccaagtccttgttcaatttgacaaggtttcaatttaacttttatttgactgatcttggcgtcttgattcgtttttgtggttttttttttctttcctctttttgatatctgtatgcttgttgtagtccatgactgaagctctggagagccaagtgaagaccaaggtgtccatcaaggtgattttcagttcttttaatctcttagtcagcgtaattgggtagaagaaaatatccagttcgtgaattgggtggaagacgattaagagtttctaaactatcttgctctattcggttatcgttaagagtttctgtgagtaatgggttgaagctggatatcaaataatttagtgttaaaaagttcaacttgatagtaagatgtggattcagttatctgcctgataaggttattagatttgctagcacaggaaatactaacactgtcatggattcaatcaagttcatagtttctttggatgtcatatatgaataataggttgcagattcccattcctagagttaagtgtcaaccttagattaagctgtatggatttcagttatctggctaggagcttatatctgttttacctcaagaaatacttgcaattttatgaatactctcgagtgttgtagactcgtagtttatttgtctggacgttgtatgttcttttggaagctgactgatcaattgtttttggtgttcatcactaatctggatagtcaaaaattgagcttattctttgctccgaagacacttttttttaaaaaaatcatatctggatctcaaaataagagaaaactttggcagatgaaacaatcagattcttactatcgtttcttatttattatttcagggacacctgcacacttacaggttctgtgacaatgtctggaccttcatattacaggacgcaatgttcaagagtgacgatcgtcaagagaatgtgagccgggtgaagatagtggcatgtgattccaagctgctcacacagtgagatgcaaattgtctgcagggaatttactttcctttgtactagattttgagttttttcactttgtaaactcagcacttgctatatatgttgagcacttgctatatgttgagctccatctgcagccatcaatttagcctatatgtaaattctcggcccaaggacataaggatacattctgttgctatgagaaagttcttgagcttcatcttgagttttttttttttttttttttttgtcaagagtgttacttttatatatataagccagtacaaaccgagtcagtacaaaagtggaggaaacaaccatgaacaaaagcatggactaaagcctaacctatcaactattacagatatgattaacaagaacaaacttgacaaacactagagaaggttaaacttgtatcataaacgaaactagtctaaaacagaatccaaaaggtgacctaatctgttcttatgaccttttatctgtaaaattccgaaccacttgatattgatttggacaaaactttgtctcatggaactgattggtctcaaagccattggttaatcttagactctttctttctcttggctcacttcactctcctttttttaggtgagagtgagttattatatgtatgtgtcatttttgccttttcag

SEQ ID NO: 4530 - DNA, 3000 bp, Unknown
  misc_feature (1)..( 3000): cDNA_ID_3073486_gDNA_ID_1620712_Annot_ID_165489 3000 nt of promoter + ATG
gtctttatataaatgtttataaacttggctgaggcaggatcaaaggcacaagttttgaagtagtagtggaaaatgaagagctggtagaaatttccttctcaaggaaatgggattcttctctccaagacagtattgctcctattaatgttgacaagaggtatgtcattttaatacaacatgcatttatgtgtgagtgtgacagagagtttgatttggatattgtatcattcaggttcataatgcgtaaagatgtaactggattctactcatatgcgatatttgagcatctagcggaatggccagcttttaacttgcctcagacaaggattgtctacaagcttcgtaaagacaagtaactaaagttcaatatcaatctttcccttaaaaccaatattagtatatactcatgtggaaagaaaacttgcaggtttaaatatatggcgattgctgataacaggcagaggaaaatgccacttccagaggatagattggggaaaagaggaagacctttggcttatcctgaagctgttcttcttgttcatcctgttgaagacgagtttaaaggagaggttgatgacaagtatgagtattcaagtgagaacaaagatctgaaagtgcatggatggatctcacataacttggatttgggttgctggcaaatcattcctagcaatgagttcagatcaggtggcttgtccaaacagaaccttacttctcatgttggtcccatcagtcttgctgtatgtttcttttctctcttcctccttgaaacatgttctcttatctatgatgatgggttcttacttaatgattgtgtaaacacagatgtttttgagtgctcactacgcgggtgaggatatggtgatgaaggtgaaagcaggggactcatggaagaaagtgtttggtcctgtctttacttacctcaattgcttgcctgacaaaacctctgaccctctttcgctatggcaagacgctaaaaaccaggtttatccattaaccaaccttctaccttttgtgcatattataaaaaacttatctaacattgtaggaagtggtgtttgattagatgttaactgaagtccaaagctggccttacgatttccctgcttcagaagactttccagtgtccgataagcgcggttgcatcagcggtagattactagtatgcgacaagtaagcctcacattccaccatttgctctgcttttcttcgttttactatcattcactcaccgttgttttcttatgtttttttgttaaaattccttcagatttcttagtgatgattttttaccagcaaatggtgctttcgtagggttggctccaccaggagaggttggatcctggcaattagaatctaaggtcagccatgcaaattatactcttagaccatataagaatatacatgtaaacaatgaacttatgcttgcatgaatttaacttatatacatagggatatcaattctggacagaagcagattctgatggttatttcgcgataaatgatatccgagaaggcgagtataatctcaatggttatgtgacaggatggataggagactatcaatacgaacaattgattaacattactgcaggttatattttctttaacttacaatgtaatcaagatttatattaggctgtatcaagaagtgcaagttaacttaacattagctacactctgcacacaaaaaccaggctgcgacattgacgttggcaatatcgtgtatgaaccgccccgagatgggccaacagtgtgggaaatagggatacctgaccggtctgcagctgagttctttgttccagacccaaatcccaaatacatcaacaaactatatattggtcatcctgataggtatgtccatgatcaaagatatcacaacattaaggtttcagattgttaaaacagtagagagctaaagtatggttgtacgtaagcaggtttaggcaatacgggctatgggaaagatacacagaactatatcctaaggaagatttggtgttcaccattggcgtcagtgattacaaaaaagattggttctttgcacacgttaccaggtaacaaatatttcacattttctaagaagagtaaaacaaagaagcctcacatttattttaaatgatgataggaaaatgggagatgatacatatcagaaaacaacatggcaaatcaagttcaagctagagaatgtacagaaaagttgcacatacaaaatccggatcgcgctagcaactgcaaatgtagcagaattacaggtgaggatgaatgatgatgacacagaaaagactactcctatattcacaacgggtgtaatcgggcacgataacgcgattgcaagacatgggatacatggaatctataggctttataatgtggatgtaccaagtgagaagcttgtggaaggagacaacactttgttcttgacacaaaccatgaccaccactggagcctttaatggtctcatgtatgactatatccgcctcgaaggacctcctttagattcatactctcactaggacttttagtcacattattgtatacgcaattttgtattgcgggttactttactaataaaaaaaaagacattatatgggccttgtgttgggccttctttctaatctcagatttgactttattacaaacgaaagggtaagaatgtaatttttcgccgactcgatctatcgctgcctatatatacagttacctgcaaaatctagggtataaaagcccctaattttttctccgcccaagagacaaaaatccttcgcaatcgagcaacggaagctcctgcatccaccgtccaaatctcttctaacgtcgccggagatcggtaaaccggttcttcatcccgtattcatctcttattgaggtcttagattcatctagcaccttttttttggcgtcgaaactttcagattccctatttgtaattagttgcgaattttgattcgacgatttgttgctcgaatttgaatcaacagatcgttggggaagtagaga

SEQ ID NO: 4531 - DNA, 3000 bp, Unknown
  misc_feature (1)..( 3000): cDNA_ID_1824581_gDNA_ID_1620712_Annot_ID_165488 3000 nt of promoter + ATG
tgattgaataattattattattattatagttggtatatcgacgttgaaggattcgacacttcgcttcctgaggatgagatgaaggaggccttgactaatcatttcaagtcatgtggagtaatcgctatggtttctttccggagacaccctgaaaccgatgttgtcaacggccttgctactattaccatgatgggaaatgacgctgatgagaaggtgatgctacttaatggaagtgaattgggaggaaggaaacttgttgtcaaggccaaccctactcccagactgaaacttgaccatcttaaccttccctttggcggctcctctgtcccaggtacatcataagtttggagtctctttggtgttttcagatccagatacaatgcaacctgctttcttttcatcactcgttgggtccttatgaactgtgagacaatgaaaccccctttgggtctttctttctttgccatgtttaaatgtaagctccatatgtatgacgtttgtgtgtggatgattaaagtaagctctattatcattatctagtttgacatttgtgtgtggatcattaagtaaagctctattatcattgtctagtttcacatttgtgtgtggttgatttagtaaagtttttcaattatttatccagctctttgattcggttgtcaaaatctgctcagatttagtatctcgacttggttgtcttatgtgaaccaccagtttactgtgttactcaagacagactgagactttagcttgaggacctcactgcacatatccaaattcttagtctcttccttaggctctcagtgagggagatgcgaacttccgagttgtagctgtgtcctcctcattgtttcctttgcttctgcttcggtctttgtgtagtcttcttcctcgtagacagattttccggaattgttgcaccgtttcctctattttctacacaaggttttaggtgcgcagtctcagggttgtgtcttcttgaaaatgattccatgtactgcgtaactctcttctacttgtgccgctgcaaccgcctacttgttcccttgtttggacattgctaaataaacgcatacatacaattttggttaagagatatctaaaaatgtgttcctatcaacctttgtaataactcttctagattcttttcgaacccatgaatgcccatctcaacctcctcaagtttcttttgaagatcatcacaaaagcagcataatatcgtgaatccaaactctccaacatgttctcctaaggttttaagttcttcttaaaatctgtttcatcagcccgatggtagtcttgcttttgttcacttacctacaaaaatcacgcctaaatgccaaggttttttgcttgacacctttgcatatatctcatctaacaatctcattatcatagctttaaataaagaggtttccgtgaatacatactttaaaaatcctaaaatcatactcttaacatattgataaaggtaccataagtcatcacaagtaataacaaaagatcacaacaaatggcaaaatgtttaaaagatctgaagagatgttttcatgtccatgtccttcaatcctctttatgatctgaaaaaatgtattttgaaatatgaattacaaatctgttgagacaaaaacaaaccaagaaaccatatatacaatgctcaactgggctgagaatttaacttttaaaaccaagaaaccacaaacataccacactacccttttaaaaactatcctatatgttagatgcttattgcatagcctaattttgttttctcatggtgcagcaggttagtttcttgtgtacctctagatatatattctcttgctgcctagggttcccaagctgcccatttttttttttaaactgttccccaaacacccatccaataagaaaggtctactttgtagctcaaagctattagagttgtgctcgcgtcttggttttactgttttagttaccccatcgatggtctagaatatgcgaggtgactctcatggaggtaaagtgaattggtaattttgtgaagcacccaacataatggtaattccttacaaggttaattaaaagttttttcagcttgttgttttgctagatttattctagaccaatggatctgccaatgcaacttaggtgatgcttccaagtatacttgtgtgagcttttttcgtaaactaataatgtaaatggaagtgatttgttgcaaaggtgaataagtgttgttgccttagcaagaactaaagaagacagaaacaggttttgaaagagagccaagtgtgtgtttatggtagaaagagcaaagtagacgaaaggtgtacctttttgacttcttgtcactgattctctctcactcatccatttcatgctgcatcagaaaacaacataaggaatggttgacgtaacgccaagcattaggcgttgcttataaattaatacattcattccattactaacgtaattcagtagattctgactacatatgaagtcaatgtatgtatgtatctatctaatttagccaatgtatactctcttttaagtactttcataaatatggatacaactacttttttttatacatacatggactatatatcaaacaagtgaccataaatgatcctattctttttaacaaagtgtgaccatggttttcaataatatgtgacatgagaaaaatctgattcaaatgaacgatgttaaacatatttatttcaccttttcaattaactttgccggggatagatttatgggtaacaaatgtaacttcttgcgtgagaatccatcaacaaatggaataatatgttggatatacagtacttacccaaaaagtaaataaaagaagctcaaagcttaaagataccacttgtccaatcttgaagaagaatcaaacgatctctacaaattgaagatgaatcaaacttatccacagattgtttctctacaaaagcttcaacctcatatctctgaaaacaacacaattagaaagaaagattgtgagagaaagag

SEQ ID NO: 4532 - DNA, 3000 bp, Unknown
  misc_feature (1)..( 3000): cDNA_ID_1807774_gDNA_ID_1620712_Annot_ID_49032 3000 nt of promoter + ATG
gtgggataggaatggtgagtaagttgaccccaaaataaaaaagtacaacgtgaaaaagagtttatttggttattgtaatgttatttcacggatcctaataaaaaattgaaatgataattaaaaaacatttatattaaaatcacaaaataaattgatgtactaaaaaacatttatattaaaagtatcaaaccaaaactttctataaaaaggagatggtaaatttttcttgaattttatttgaaggtgaacgcagcagcagcaacacaacaaatgatagatgtgttcagtgtgaaagggattgtgcattttgggattgctggaaatataaacaactcgatgtccataggagatgtgagcatccctaagcaaatcacgaatgctggcttgtgggattggctggtatatacaaaatttacatgcacaagttttgttattgataaataattgcttctccttcatattgtctgatgattttagttctgatcgtcaaacagaatccaggcaaagcaaaaggaaatgaggatgtagcgtacttagatgtcgggaactataatgttccacaaggaaacaataagttaggaactattggatacagttacgaggaattatattcagtcagtggtcacatcaattcaccaaagaaagtgttttggattaatacaactcaagagtggcttcatcttgcagctgatcttgaggttgttaagaatgacatatgattagattagaatatattttttctaacaaaagactttattccatggttgatggttgttgtatgaatgtagaagatggagctattgcagtgtgtgaatgcaagtctgtgtcttccaaataaacccaaagtagtagttggattaaaagcagccactgctgacatatttgtggataatgcagcctatagaaatttcttatacgatacttttggagtttcctcctcagacatggagagttctgctgtggccatggtaattattcacgtttctaacattgtgattcattcctttcactccattttttttttcattgaactttcacttaattttgtttgcatgtgttttggattcgaccagacttgcgtgtcaaatgggtatcccctaattgtgataagaggattatcagatttagcaggagtaggagataacactgttcgaaagtttggatctttggctgccactaacactgccaaagctgttttagagttcattaaaaagctcccaccgtcataattcctacgtgtaacctatcattatggatgtttgaatctgtattttccctagtttttctacgtacgttaaaaataaaattaataaaatctgtttttcttttctttaatcagcttcttgcatggaacactttaatttcagccttcaaaactagaattacaggtctctttgttcatatcaacgatcccgtgacagcaacaattcaaatatgggcaaaaatattttgtgtttataaaatagtatttttttggaaatttgtagagcgtgtattatcgtccacaaaatttattttagtggtattgtaggatatttgtcaaaaaaaaaaaaagtgcgcagccagcagcccctcatgtttaatgcatacacaaaggttatatcagctagtctagagacgagaagcacgtggaaagaagaaactatcaagttggacttggatgatatatatatatatgcagctgtggatttgaatcgtaaaccaaccaaccaatcagatggaccacactctttctcttcttccatttctcttcatcataatcatttcttccttccatgttttgcctgtttcacccacaccttcacacaaactaaaatccgccactaccatcagaaaactcaaccgcggaggaccttacatcggtctcgtgacggtcattgcgaccgaagaaaatgcttttctccgcagtgtcgatttcagacctgaccctactcatcccttcttggatctctctggtatccacttgaatcaaataactttttcaagttttctaacgtaaatagagtcttttgttttgcttaaatggaagttagtacttttgagatgaaaatattagtagtttctgatttaataaccttatgtatacagggagacgttttcgaatagggaagattcatggaaagaaggttgtgtatgttagatgtgggagaggaatggtgagtaaccacaacattaaattatccaaaacagaacaaaaaaaactacaacaaaataaagaagtttatatggctcttatttcttatctaaaagtagtatacaaaaagggaatgggcacacaccaaaatatcctgatccgtatacaataattgaaatgatgaattgatgataaaacttatattaagttttaatatagttagtaagtagtatagtatattaaagatgcatattagtaaatgtaatccatatgaaaagtagcaaacgaacacttatattaagacaaaagaattgcaggtgaatggagcagcagcaacacaacagatgatagatgtgttcaatgtgaaagggatagtgcattttgggattgctggaaatatgaacaactcaatgtccataggagatgtgagcatccctaagcaaattacgaatgctggcttgtgggattggctggtaagtataatagttacacaagtttgattgcttcttcttcttcatattgtctgatccatgcttttggttctgagtaaaacagaatccagacaaagtaaagggagttgaggatatagcgtacttagatgtcggaaactataatgttccaaaaggagatggcgacaatgagttagggagtattggatataattacgagcaactatattcagtcactggtcacatcaatgcacctcagaatgtgttttggatcaacacaactcaagagtggcttcatcttgcagctgatctagaggttgttaagagctatacaacatactgattagattatagattataaacaataacggttccattgttaacaacggtttttcgtgtggtatacggtggcagaag

SEQ ID NO: 4533 - DNA, 3000 bp, Unknown; identical to SEQ ID NO: 4523
  misc_feature (1)..( 3000): cDNA_ID_1824593_gDNA_ID_1620712_Annot_ID_49035 3000 nt of promoter + ATG

SEQ ID NO: 4534 - DNA, 3000 bp, Unknown; identical to SEQ ID NO: 4522
  misc_feature (1)..( 3000): cDNA_ID_1824589_gDNA_ID_1620712_Annot_ID_49036 3000 nt of promoter + ATG

SEQ ID NO: 4535 - DNA, 3000 bp, Unknown; identical to SEQ ID NO: 4531
  misc_feature (1)..( 3000): cDNA_ID_1824581_gDNA_ID_1620712_Annot_ID_49039 3000 nt of promoter + ATG

SEQ ID NO: 4536 - DNA, 3000 bp, Unknown; identical to SEQ ID NO: 4530
  misc_feature (1)..( 3000): cDNA_ID_2109345_gDNA_ID_1620712_Annot_ID_49040 3000 nt of promoter + ATG

SEQ ID NO: 4537 - DNA, 3000 bp, Unknown; identical to SEQ ID NO: 4529
  misc_feature (1)..( 3000): cDNA_ID_1839312_gDNA_ID_1620712_Annot_ID_49041 3000 nt of promoter + ATG

SEQ ID NO: 4538 - DNA, 3000 bp, Unknown
  misc_feature (1)..( 3000): cDNA_ID_1824573_gDNA_ID_1620712_Annot_ID_49044 3000 nt of promoter + ATG
taagatactgatatagccaagaagtttgacatttagaattgttcaattcttgtagggtacattgagggatctctcaaagaaaacagaagagaatcagttggctttaatgaaaccggtaagctcttataaatatcaccctgtgtttctggttggtttatccacataaggcggagcttgaatcatcatcgcttatttgtaggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatatcagatgtctttggtttcagagtttgttactatgcttgcaaccatacccattgacatggtgtggttaaaaacgttaaagtcgattctgaggggaaaaaagtttacttattacgttacatcctcaaaagatatgatcagattaaaaagacttatcaatgtctcatacataaatcaaatactaatctactcaaaacttgaaaggtgatttcttcttctttttggttgtattgaccaactaacaacactacgtatcaaaatatccgaaaagattttaaaagtttcattggaatgggacaatgcatcttagatctcaatcctagtttacaagattagtttattagaggatgtatgcatacgcatcatataccaaaaccatgtggattactaaatcgggctcaggaccactaaatagattagattatctacaaatcacattattgtgtacataacaaatagaatacattatataaatcacacaaaaatgtatcgaagaaaagagaaccgtcgaaccagtttgatggtaatcaactaagataatgtttttttttctgatgtcaatagtgtttgtttatgaaggaatttatgatgagattattcgagaaggagtcgctttaagtgacccgatcctcgtgacgactcgttgctctttctttctttattatagattatagttgttcaaacaaatgaaaagtatctgagacgaataaattaatgggtggtctgtttctgtactataaagaggtccatgcatgtaccatatcatcttattatgtactattaaacaaatagattaatgattatataatgttttccgatatattgaaattagtttatgagtcacgagttaaatctgaaggcttcaccaaacctaaagttaaaagtctcaaaacagttaaacactcttgtgatatcatccctgtatataatctttaatgaaaacgtagaaaaaaagattatttgcaaccagaaaacatctgaacaaatatccatttctcgtggttttatgttaaaacatttgtcgtgttgggaaataattgaaacttttattttccaacattgaatttttctttatgttaaaagtgatgtgaactttgtataaaatgaaggaaaatttaaaagcactcccctatatgcgatgcgagaaaagggagagaagatatgtatgcacttgtttcttgtcacgttccgtttccacaaaatcagtagatatgccagtaactgtgttatcttcttcttttcgtgcgtctgtatccaggagacatataaatgatgctgaatttcctaactatttttaatttataaacatgagaagcgttaaatgggtagcagcaatcaaacgtttggtgcttaaaagcgcttatttgaagtataaacaatttgatatttataagataaaacagcattacatatgaaatatcatgattcataactatatatgcaaaatttgaaaacttctaaatcccaaaattacacaaagattaactaaactacattataatttataaataaataaaaagattagtatcaaaactaaaacgttaagaaatatcataagtgatgattagacgacagtcaaaatgttaaatttcatgatgaaaaaacaaaaaaaaaagagtaatttgtccaaatacaatcagctgactatatattttgtcaaatcatatatcatatatactaaaactaagaaaaagataaccatcaaaccaattcaatttatatccacctacatatgactttgatacattttttgtgtagtttgatcagtgataagattttcaatcctctatagtaataaaaattgctaatttcgataatttaagagataattacaaaaccaacaagcacctagacacccctaagatctaggagaatgcatcctccttagtcatcacttccttataaagtaaaactataaaaactgagatcacgagagaaaccgagaaagagagccaagaaatgcatgagttaggatgataatccacgtgtcactatcctattgcatgaagagtatacgtgtaagctcgtcacataaagtttccctcttcttcttcctcagagtttttaattggccattttattacttttccataaataataatataaaaattcaaaatatttaattccccatttgctgttgtctttccttttcttcttcttcttcttccttccttttctcgtgcaatctccaacaccttgactacgcttcttcatcccaccaacaaaaaccctttctctatcaaaaccaaaccaccgttagtttttctttcccggtgatacgtttagatagcttctttttttttccggtggttaacgttgacgattgactacttcaattctaaacggataagtattagatagcttcctcttcttcttctccagtatctggcgacgaattcaactagagattattttctctttttcttgtctcctcttgatcgtttgtttttgtttgtatctggattcaatgacgggatttggttaaacgaagaagattcatttctctgttcgttcgatctgtaaatttttgctttcagagtgagattttaacgaa

SEQ ID NO: 4539 - DNA, 3000 bp, Unknown
  misc_feature (1)..( 3000): cDNA_ID_1817265_gDNA_ID_1620713_Annot_ID_49052 3000 nt of promoter + ATG
gcgtttgttactcacttcaagctccttagctttgttctcatgatgcaacttaatagcctcataagcttcctcagcatgcttaatcctctcctgaagactctcataatctttcaacagagtctcatgattctccttcagaatttcatgctccaaagtcatcgttttctctaaaccaaacatcatcttcttctctgatttgtcctaaacccaaacctgaaacaacatcaaccaatttctacagattattaccaaactcataagcttaatcaaaaattctgcaaaaaccctaaatatccaagctttatgttctctttatgactgaaatgcaacgaagatgagaattaaaccagatttatgagctcagattgtggaaatcgaaatgggtttcggaggattcagagagaaaatggtgagtaacagggaagagagagtgtggttaaaactcagattctttcaagcattcaacaatgtaaacagaatcagatagaaagaaatggaattttctcgagaaaatcttaccaggattgcgaacttgaagaacctaaagagagaagaagacgaagaagcaaagtcctcctaaacgttggttaatgataacgtaatcgaagatgacagataatgtttgtatgtatttaagtaatattattcaaattaattaattgtttattccatgtgaccaaaaaaataattaataaattgttcattcttaagctaatttaacccaaacctttttttaatttaatccaaaccttgtaactgatgcgatgttttttttactagaactttaattttctgtttttaccgttttatatatggcattcagtaggtctgggtacgaaacggatatccggaaaaattgtgatatttgttattcgattcgttttaaacgaatacttgattttgtgatttgctttgctttgcttcgaaaatttccggatatccggaatttcgaatatccagaattttttgtgatatttgcggatatccgctttgatatatttaaatattaaaaaaaatctatatactatataactatatcagatattcaaagtttttatttaacatgctttcaaaataaaaactaaatacttgttggtaccaccagtctacaaaatgttatcaaactaattccgaaaactaaaacccgatagtttttgatgtcgttgatcaaaacataacatgagaaaaatgatcaaacaaacattttaacataaaaacgtaaaatagcaacaatacacaaactattatgatatatatatagatataactatattttctaatatatatataaaaagatacggatcgaagcggatattcggttttttttttttaaaatttgttatttgattcggtttttacgaatactacattttcctatttgctttggtccaaaatcttacggatattcggatttttcgaatcaaaccaaatcatataccgaatcaaagcggatcgaacgaatattttgcccagccctaacattcaggttaacaacagaaattaaaggtattctaacattgtaacattaatgtatgttttcgtataaaaatgaaagtttaaatatcaaattgaagtttaggttaaatcaactgtggtataatacgtgtataaatgcagcatagttcaaactaaagatatgaaaaaaccaattttccgttttttacataacatttgtgcaaattcctatactattaaaagagaaatataaatttgtttcaatttgaattggatcgggttatgttaaaaaattaacataaattgacctgaaatttaagtaattggatttttggcaaaacaaaattcggaatataatatgaaaatcaatgtttttaaacccgatctggacagtgaaccggacaacagttttttttcttctacgcatcgtttgtttgtattatttatatatatatatatatatagtgatatgataacttccctaaaattagctgaataattaaatgaaaaaaatttcagttgatttaacattgaatttttttccttgttttttttaacccatttctccacatttttttgtagtagtttagtttcgtaatttctgcagtcacaacttttagtaatgagttataaacaattacaatcaaggtttttatagtaaacacatcttttactaaaaccacgtagaataattggaaatcaaacataatttttctaaagctcctaaatttttttagtttgtccttagaaatcaaatatatttttgaatcttttttatctaattaaccgcaatatctataatctgaaagtgttaggaccgattggtaacaagtgttatttctaactatatcaattttggttgtagaaaattttggtgtaaggaatttgaccgtagaaaatatagagacttttgcagttaaaattgcagatgtgaaaattttgaaacaattggtaaaaattatgagtttagaaattaaaactttaaataatataaacgattagattagttgtgacatatgcgatacaattttttttcatctctactgaagagatcgtttttattgatattgacacaattgatgacggtttcatatcattaaaaatgataatttagagaatgttttttccgattttaaatgatgctttcaactttcaatataaaagttaaatgtatttaatattttttgaccaataatattctatagtatattttttattggttgacttagatatagttacttatgcaaaaaaaggtaaattaaactaaacttttgtaatatgtgtaaaaaaccttaaacattacttaaaatcagagagagaataattacggttgtttagaatcctcattaatcattctctgtttcatttattaactttctgtatatcattaaccccacaagcattaaattactcactaatctttttggattctattattcattggtttatcgcttaggcaataagtacggaatcaaaaacattccactttctgaccaaaaaaaaaaaatcgtatatctctcagcgcgagggaagaagaagaagatg

SEQ ID NO: 4540 - DNA, 3000 bp, Unknown
  misc_feature (1)..( 3000): cDNA_ID_1817289_gDNA_ID_1620713_Annot_ID_165538 3000 nt of promoter + ATG
ctttttgctatttagtcatttaattagaaagtttttgatgttttacaataacttaagttcaaaattttaataaaaatcataaattttgtcttaaatctatagttttatgtatctatattattaattgggaagcattgtgtgaactataaaattgtaagggtagtttaaaattaactaaatgaatttttgcatgggtaatttagtaaattaacaactagtacaactaaataaatatcttggattttgttcttttaaaaaattaaatttaaaatcaataaatttgtaactacccaatattttcagaaatcatttaaaaacgtttccataacatatcagactattttaattcgaattgtatatatgtaaatttatttattttggtaatatgttattagataattcaaaaatttcaatctaatttaataacaaataatcatttagtttagattttaaacaatttccttaacaaaactatgttaattgtttctcattagtacacttaaaaagaagattttaaattatgatttagcatattcaaaagataatttttggattttagatttgtaaatatctagaagatattatgagtatagattaaaatatttaacattttaattagaatttaaatcatataaacttttcaagtatttttttaaacatgtaattttcattatttttaaacaagtaattttcattatttttaatgctatgcatatattcacattgcctcacaatcaatctagaatatcgattctttaaaacaatagatagagattcataagtaaattacttcatgttctaatgagtttatctcctaatattactatctatttatgcgtattcttatggatttttctttcaggctaaacactagattacaagaaactagattatagttatacaatcttaaacaataaacaaaacaaatataacttaatttaattttttatttttaactaaaatcaacaaatttattagtttataaaaaaccaaaaactattactcaaccatataaaaaccaaatactattatactttaattataagaactacatcttatggaaaggtatacactaaaaatcggttttatatactagaatatcataaatatataaatcacaaattatttttaaatatattaatctaacatgtaccacatgtcaacccctcgatttttttatatattacaataacaatatttaaaaataacaaaatagtttttcattttacggaataaagttatatggtggaactagtttgggttgatattaatacgggacaataatctacaagtgaaatcttagaattaataattataacataattatacaatcttaaacactaaacaaaataaacaatatttacaaaacaactatatcttaaaatttgagtttttagttacaaacaaatcgaccaacggtgtaccgcggagtaaattttacattatatcatctaattgatcaaaaatttcaaacaaaaataatcaatttatatatacatcaaactaacaaaaatacacaaattttccaaatatctctatattattccgcaactcgaaacaaatataacaatctatttactatgctaaatacaaataaaatataaataatataaattaattaaaaaaattagctattttatcataaataacactatacactttctatgcatattataatttgtacactataatatctttcactaaaaatgtattccaatacatttcttaaaatatgaaaccccgcacgtatgtgcgggtcagaatctagtttactataattttgaaaacaatactagattaatatgtttttaaaacattaatataatcctaaaactaatctcgtttaatctccgattttaatctccgattttaatccgatttatcgattaatagctagtcccataccgagcgcccgattaacgcctaacgcgattttttaacaataatgatatatatatatatataaatgtatatatgatttatatattctagtgaattttacttgtaaactaaatctacaatttaaaagttaattaataaagtagtttagaagaagaagaagaaattgggttgtcttccctaaagattttttctacatatgttcgtagagaactattttttctaatgacaaaaaaatatttatatttaatatttttaatataggtttcaaaatgtatcattcataaactgcaatactaaatttaactaaaatgaatgaatttttaatttcatgctcaagtctaccgaaaaagataaacaaaccacaaaaaataaaagaatattatgggggtgattggggaggaggactttgaaaactgtaaattctattaacaatttttacagttttaatttatccgatcacacttttttgcttttaataatttaaaaattctcacaaccttttttctcattttgttctttgatttcatgtttttgtttaaatcgcataaatctggctttaaaatgataataaacaaaagtcaatagtttttccttttcgttcttctccatatttatgaaaactcccatagatgaattattcctttttaatttttttttacgtttatttacaattgaagtctttttcttgttttattaagttccatattttcaataattatttaaaatcataatttatgttgtcacaacctatagtatatagttatagtttttaaaatattaaaaattttatagcaaaaatttatgcagcaaaagtctttacagccaaaagtaactttcgagatgcatgttttaatttgtcttatttacttgatgatatacaaaagtcagcctaggcgacctttaatgagatgcatgttttgttgtctacaagggtctagttgcaatataataataaaaatgaaattaccatgtcatttcctagaaaatctcatattacaactttgacacgcaaaggcattccatagattctataaattgctctcccaaaacactccaaacaagtcaatataacaaatttttatcttcaatcctctcccc

SEQ ID NO: 4541 - DNA, 3000 bp, Unknown
  misc_feature (1)..( 3000): cDNA_ID_2144432_gDNA_ID_1620713_Annot_ID_165537 3000 nt of promoter + ATG
tggtcgggctcagcctggcggaaaaaattgttatgggtctaaggcccataaagtggcccagaaataaactcgtcgtatttacacacgttgtcgtttctcttatcttctagaaaactgtatcccgtttttgttcttgtactctacacaaacagacaacttcaaattactcaacaccacgtcgtgaaaatccgatctacgtctctgtctctctccaatctctctgcgccacagaattgtgcgatttacgaaaatctctgaaacctccgatcgttaacggcgaccgccgattttcccggtaaaaatgaacgacggagatgtatcgaggcagatccagcagatggtgagatttatccgccaagaagcggaagagaaagcaaacgagatctcggtttctgctgaagaagtatgatctttagtgtttctgtttccatttatcagatcttatgatatgaatctctaattcaatcgtaagcggtttatctgattgttatcgatttggtttatttgaataatcgtaggaattcaacattgagaaactccagcttgttgaggcggagaagaagaagatcaggcaagattatgagaagaaggagaagcaagctgatgttcgcaagaagatgtgagttttctgatttcaatttttttgatcttggttaagttttaagttagatcgcttgttctggattacaatatctctgaactttgaaaaaattagaagtttatgatttatagatttgaagttttgacttgattgatttcaaacttgtaattttcttcattgatgaataagaaacatagtctggtttagtctaatcggcaaaactgaagactaatttagcaattagtctgatgtaagattatggtgtagtagtgtactgtgttgatctagctttcaaattctctaatattgttagttctctgtgaaaattatgttgatcttgttcatttactgtgttatcgtgtattactttgccagaaaataactgtcatacatgttttttcagtgattactctatgcagctaaatgcatcaaggatcaaagttcttcaagcgcaagacgatattgtcaatgccatgaaagaccaagcagctaaggatcttctgaacgttagtcgcgatgagtatgcctacaaacagctcctcaaggatctaattgttcaggttggtacttaaaacaaatccctgatgcattcaaataaatatttgatatttggaacttttttttgtatatcctactggagattatgtaatcgtgtcggatggcaatctttttttgtgtgttttgatccgttctgctgatgtcattttgcatttcgaataccttttggtctgttaaagattctctcttgaattgttgcagtgtttgcttcggttgaaagaaccttctgtgttgttgcgttgtcgtgaagaggacttgggtttagtggaagctgtacttgatgacgcaaaggaggaatatgctggtaaagcaaaggttcatgccccagaggttgctgttgacacaaaaatattccttccccctcctcctaaatctaatgatcctcatggtctccactggtaaaatttcatgtttctcatcattactttacatttaaatttttataaaagaacattatcagtgtttagatccggtttgatagtgtattttgaacatgtaatagctctggaggtgttgtgttagcttctcgtgatgggaaaatcgtgtgcgagaacacacttgatgcgcgtcttgatgtggcattccgtatgaaactcccagtggtatgaaaaacaaattctctaccgcatagattacttgttatgatccatcactcactgtctaggtttacttttttactttggttctctgattcactcattgttgttaacagatccgtaagtcgttgttcggccaagttactgcctgatgaaagaaaggaaaagagaaaagagattattcaaaccggtttgcgtttggttatttacctattttgggagagatttctctttgttgtgattctttgtattttgcaaaatcttactttggtgccaaacccatcgaacgcttctttttttcgaattcctttttttcattcctcctcgaatgtgtgttatcatggctatacaaataaataaaatgaaagacttcttttctttttcttcactttttctattcaatgtctatgctttatactagtggtttttcgtcatcatagataaacacttaattcataaaaagacccttgaatttttattataaggttagcaatttatccaacacgatcctgaaaatcgtccatcctagtatttttttcgtctaaacacctttaattgcggagttttgataagtttttaacagaaaaaaactcgaataagatatttttttggtttgggctaaaattgttatagacttggcccttgggttttatcccaaatacattttaggtatcacaaacaagaaaaacatagaagtaaaaaactagaagttttttgcgcttttgatctttgtccttttttctacaagttttttctccagactaatctcctcacgattgtctgaagacaagagtctacaagaccggagattcaccgttcgacaataatttccgtacctttcaaggttagatgttcttgcgcttaatttgacttgtgttctttttgtgaattttggatgcgcgcacaaggtgtttgttcatttgcctagacaaagtaaaattgatttagttattcttctcattcatcttctatagtatttgtacttgagccaatcattattcatctttggtgcaatctgaatctgacccatttgagctgttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatga

SEQ ID NO: 4542 - DNA, 3000 bp, Unknown
  misc_feature (1)..( 3000): cDNA_ID_1817281_gDNA_ID_1620713_Annot_ID_165536 3000 nt of promoter + ATG
acttcattttttttaatcaaaacaactaagaaagtaaaataatattttattaattctagatttagagagatattttttaaaagaaaataaacgctattattcggtgttactacaaacaaatgatacttaatagtgatacacatttatttatttgtctcatttttactggaaagtaatttgctttataagaatgaagtatttgccttataccctaaggcctaagcaatatatggatgtgattagtaacatatatgttatgattgatttaatttgaggtatggatgttatattcatagttagcttaaaaatattgctaagtaagaattcatttaaactttagagttcgcgttttgttgagtattaatggttgagttacaagttttagttatcacttctggaaactttatcttactatatagtattgtgtaagaaagctcatcttctgtatacattggatgatatacttattcatgctaagcaagaactaagaaaataatttacacagcaaaaaataatattacaatttataactatgttgatagcggcaaaagctgaaatctttgtaattcatcaccttcacggggtacacacgactctactaaaataattcatgtaaaatcttgagtcaccgatatccacacgtgtcccttatgtttaaattttaaaatgtggatattgcttttcctaaatttggttagtatctctgactagtgactatataaacttttagttacttatcttagccgattggataaatttggctgacaagtttataataaaaaaaaaaccacttcgttttagtttgttatcttgatgttattacatagacaaattgaggttttggcctaaaatcatgttaaaaaagacatcaaataaaacatcaaaccccatttttgaaaacaagttagctacccaatcatttgagagtccaataaaagtggtagtaatagaaactaggttttcaaagtttcttcgtgagaataaatagcatatgattaaaggtaatgatgagccttcttcatgacacgaaaataaaacaaaataagtaatgatgtgcccttggtccatgtaatattatgattatgacaaaatcatagagaaagtttttttaatagcggtaaattacgataatcgtaataatgtatacttaggttttgaataatgactcaaccgcacattaccgtgcgttttaagtagtaacaacttttttttaatatatatatatatatattttttttattactatttaaaccacaccagattttatctgcagttgaaccgtacattttcatcgaagccttaaaacatattagctcacgttattgggagatgtagctatcgatatggattaatggcttaggaagtaagagtttgattaattttgaaccaagtataagaaaaaaaagagaccgtacggataaatgtcgaagaatataaggacaagagttggacgttagctagtaggaagtgggcctcacttaccgctcgcaccgttagtcccgcaaacggcgccgttctctcgtttcgagccatcatcccacttgtttgttgtttcatgtgacttcttcgtctcgaggcaaacttgactcttcttcactttcgcttaattacccatttgtctgccaacatctcttttggctatatactcatgaaactttaaaaaatcttcttatttgtatgttcgaaactccctgaaagtttcagtcttcttatgtatgacaagaatcgcgagagactatgcaatgaacctaatcaaatataactcttctcaagaaatgatatgaaaaagattcatgaacataagagttggtccttggaaagcgacctcttcaagtcttcattaattagacattgattcaggtgcttaggagttaggacaatgtaaattaataaacaaaggtggtgcttaaggcggtccatgacgttgtagaaagtatttttttttcgtataagccgactatatacatatgtgtttttcatttacttatcgcaaataagaaacacacactaatcaactatttgtaaattcaaattcaccaaaattatttatgttatatgttgaacctacgaaactcatagacacagaataaaacataagtgaaaagactgaattaaacacttacttataagtgaaaagactgaattaaaataacaaagaattatcaatagtatttttaataaaattaaacatttaaaaaataaacttatttgaggacgtaacctaaaaatctctatatagttgtttttgacgaatatgagttttattataagactaatttttccaagagataaatttataaaaaatattaaatacgtaatattttttaactccaataaaatattgtaatttcaaaccaaatatttattaattaaaatgtgtaatgagatacttacatatcatctagacaagttgagattttctttatagggttttgtaaaaatttgatgatttttaacaagaagaaatccataggaactaataataaaaaatacaatgcaatgatatttaaaaaaacaacaactgcattgcagtgaatttcatcaaaatccattaaaacatttccaaactcaaatagaaacaacttcaaaaccttaatccaaaatgttatagatagatatgcaatagctcttaggcctagtacatagctagatcttgtaactcgtgaaggcaaatgattgggacgttggttcggttctagtggtcgggctcagcctggcggaaaaaattgttatgggtctaaggcccataaagtggcccagaaataaactcgtcgtatttacacacgttgtcgtttctcttatcttctagaaaactgtatcccgtttttgttcttgtactctacacaaacagacaacttcaaattactcaacaccacgtcgtgaaaatccgatctacgtctctgtctctctccaatctctctgcgccacagaattgtgcgatttacgaaaatctctgaaacctccgatcgttaacggcgaccgccgattttcccggtaaaa

SEQ ID NO: 4543 - DNA, 3000 bp, Unknown
  misc_feature (1)..( 3000): cDNA_ID_1817277_gDNA_ID_1620713_Annot_ID_165531 3000 nt of promoter + ATG
gttggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaaatggcgtttgctagagcagtgagaagaccaattggagtcttttattatagtgttagtagtagatttagttctggaaatgagtattctactgtggcaagcaaattcgaaactttgtctcagtacaaaagctctgtaccgtctggttacacaagccttgttcgtggttttgggaatttcatacggagttttagttcggaagctcctcctgctgtatctgaccaaatgagtcttattaagcaacttagggaaagaactagtgctcctattaaagatgttaaggcttctttagttgaatgcaattgggatcttggtaagaatttggtttaggttttttgttttggtgaaggttgtgtatgttttgttgtgttttgaagtgggtttttttggatttgacacagaggctgctcagaaggatttgagaaagagagggaaagttttggcttcgaaaaagtcgtcacggactgctgcagaaggaatgcttgccgttgctcaaaatgaagggaaagttgctgttattgaacttaactgtgagactgattttgttgctaggaatgagattttccagtacttggttagtcccatagcaatttcacattggttgttgctgaatgatgggctttttgtttattttactgttccttgtcttctaaaattgacatgtcttgcaggctttagctatggcaaaacatgctttgctggttgagagtagttcgcagcaagtttctggtgtcttcccctttgggccggagctttttgaggtcagttttttatgtactcgcttgtttccttttttgttatttaaatttatggatttatgttgtttcctttgcactgtctgagatattgatatcaacttttcatttctaatcactctaatggatgctatcaggagttcaagcttaacctcgatcatccaaaagttaatggtgaaacaacggtttcaaacgctgttacagaagtagctgcaatcatgggagagaatgtaaaatttaggagaggtttcttgatgtcaaaatcttcagcaggcgtcctttctgcatatcttcacacaagtcctcaaccaggtacaatttgttcaatatacttcccattgtttctaatctctttttttatgatatttctgtgcatttctaactttaaaaaaaaaaatgagaatagggttgggtcgtatagctgggattgtatctctcgaagtagaaggtgaaaatactcaactagaggctattcagcgtgtaggctcagaactggctatgcatgttgtagcagcaaagcctttgtttttaagcaaagaccttgtttcttctgaagcaatggcaaatgaacgcgagattctaaagtctcaggttagtgtcactttatgttatgaaattgaactgtaatttgtaaaaagtacacaacctgcgttagaaaagtttgcttatcaaatgttgtatatgacaggcagaaagtacaggcaagaatcagatggcgatagagaagattgtggaagggcgtctccgtaagtattttgaagaagttgctctaatggagcaaaagtttattgtgaacgatgctataaacattaaggtatgtgggtcttagcttaaaacacctagtttaccgttttattacctctgcatcgcttgttgaattcaactcttgggctcctattccacagacactggtggataatttgtccaaggaggtaggttctccagtgaaggttaccgattttcttagagtcgaggttggggaaggaatcgaaaggtaaactaaccgtcacccgtatgtccagtacggcttatcattgttgtaagattagtcgcttatgaattttgttttttttgaaggcttgaagcatctgatgaaccagttgctcaaactgcttgaagacaaagaatcaacgacatggttttagatttacagaactctttccttctttggttcctttagagttcatggcttcaacgccttcttgagattatagaatctttctcatgattttgtttctcacacaatatggcaataagagtgattgtgcctaggaagctatgaccagaaaaaaaaaacatgtttgtgttctcctactcctactaagatcattatacaaaaaccttcacttatgtgtttgattttaaggtactcaagtatttgaataagcagatagtgagttcttggctcctccggttaccaacggtcgaaattgacggtttaatataattcatagacaaaaccggtcaactttatattatccacaatcaacgatcaagatcaacgagaactaatcttacggttgatatcatacatctgtattgagttacagtacaccacaaaacactcaataaacactaagcactcttcttctaccttttgattttcgaaaaacgcaaactttctgaaaaagcaaaaacttctgattctctcgagaatcatttactcttcacactgtccccgtctctctttctcttgggttaatc

SEQ ID NO: 4544 - DNA, 3000 bp, Unknown; identical to SEQ ID NO: 4539
  misc_feature (1)..( 3000): cDNA_ID_1817265_gDNA_ID_1620713_Annot_ID_165525 3000 nt of promoter + ATG

SEQ ID NO: 4545 - DNA, 67 bp, Unknown
  misc_feature (1)..( 67): cDNA_ID_3071783_gDNA_ID_1620713_Annot_ID_165515 3000 nt of promoter + ATG
cttagcacaagccacttgtgagattatctggttgcaacagctgctcaaagacttgcatgtgactatg

SEQ ID NO: 4546 - DNA, 3000 bp, Unknown
  misc_feature (1)..( 3000): cDNA_ID_1824665_gDNA_ID_1620713_Annot_ID_49054 3000 nt of promoter + ATG
ttaagttgcatcatgagaacaaagctaaggagcttgaagtgagtaacaaacgcttgcttgaggaatgtatgaaagagagaagggagaaggctaaggttaggaagacttttgaggagatgaagaagacaatggagagtgagagaactgctattgttgatgagttgaagtcgaagaatcaggagcttttgttggggaagaagaaagaggaagaagagttagtgaagatggagaataagtatgttgagttagctgagaagtttgatgttgttgaaaaggaatgtgcttacttgaagtcactctatgatgcggaagtagtagcttcggttactcaaagtgctgtaatctcaggggttggagagactgataatcttattggtcaaggagagaacgaggctaatcagaatgtgaacaatgctgtgacaggtatacatagacatctctgtacccaagtgttgtttagtttacaatgacatttcttttgaatctatctttgtgtgcagatgcgataatgataagtgatgatgaaaatgataataatccacctattgagagtaacataagctctcatcggtctggtgatagaaaccaagaagaagaaggcaggaacagaggaaactcagcgactgagaaccgagcttcgggagaaacctttactccggtatctgctaatcatccaccgcctttttctccttcatcgtcatcttcatcatcatcatcttcagacggcgctgagattgtgcttaagctgcctcgtaattggcctgaatgggcaatcccgaaaggtcccgggaaggattccaacaagccttagaacatttcagatgcaacagagagccaaaagaagtaaatttgaagctgcactcttaagttaagctagttatggaaatcttcttacatattgctttctgtttttgtcaggagtttatttaacaatctctggaactacaacaaactattctatctactatcaaatcaattattcattcatgagtataataatagctgaaactttctgtgttacaacaatttcaccataactaaaattgcatttgcatttgaatactgcaaacgcaaattggctttgtatacgcatcttgtttatatatggattagttttttctacataattaatgaaagcttttgtaaactaactcttgagtactaactaataagaaagttccgtggcaaaataatttccgaatcatcggataatcatccatttacgaggttaagttccgggaactgctggtgttaaggttctggaagatctccggaagattggcattagtgagtttgattctcttgctgatctgttgtttgccatgccatgaatatgtgcaacagctcttctctgtgtagtgttcatcacacatgcttcaaactaagcttatgcagctccttctcgactagcttgtcgcttgagttgtctatgccgcggtatagaggtttaaagtcgtcataaacctgaatctgacccttgaaatcagcattagacagtccttaaacttttagagccagcaaatatgaaagacaatcctgaaaaatggataatcataagaccacaaaagtcttttgaaaccatttaagatcaggagccagtacactatccgtctatcagaatctggcaataaatattatcagaagcttattgattatgaagttaatacatcttaaatagaatcagttaagcgttttttgtaaatctaaatcacatgtgaaatttctttatgtcacgttttcatttgtgtaaaacaatatcttttgatttattaagcaaataatttgcagctaaagctctcaagattcaaataaattgaaatgtaagtagtgtaagtagtgatttcttatagaaatagttgaaatctaaaagtattaggacactgatgtaagtattgttaaactaaagagatctatcaggaaatcaaatcactatagttttttttttttttttaaattccttgagtttatcaaacaaaaaaatgtaaatgtccctagcaagtactgtaggttcattttttttgtttcaaaagagtatgttatttcttaaaaatcgccaaagatagataagattcgaaatttgcataaatgtggcaataaatattatcagaatctttttattgaataatgaagttaatacaccttaaatagagaattaagcgttatttagatctaaaaccacatgtgaaatttctttatgtcacgtttttgtttgtgtaaaacgatctctttgagttaatttgcaactgaaagctctcagcattttacattaattgcaatataaatagtgatttctcatagaattagttcaaatcttaaactattaggacagttacgtaaacattgttaaactaaagggaccaatatggaaacacaaatcactgtagttaatttttattattatcttgagtttatcgtctatcgtgttcgaattctctgtcgcttacttaaacacagtcaaattcattttctgccttagaaaagatttttatcgaaaatcgacgtttttgaaaaaactcaaattatcgtcgttttgttctcagatttcttctgctctcttcttcttctccttcttcttcgttccaccgcctctgttgctttatcttcttcttccttccttcgattgttgattacgtcggtggatctttgttctcctctgtgttgttttcattgctagatttcgtcaatgattggcttctcacgattcgatttttccggctcctgttcttaatttcctctgaggtagattagtaaaactctttgtctcgtaaacattgttcgatgatgaaattagaaagttctcactcttgtttgccaaatttgggatatttctggaattgaaaatgaatcgtcatttttttcaatttctgaggattttgttacaattgttttttatttatgttagaattgagattgtgtgatgaatatcagtaaccctagacaattgtgaaatcaaagctatgaaaatcttttgatgctatgtttcctatgatacagagaatg

SEQ ID NO: 4547 - DNA, 3000 bp, Unknown; identical to SEQ ID NO: 4543
  misc_feature (1)..( 3000): cDNA_ID_1817277_gDNA_ID_1620713_Annot_ID_49056 3000 nt of promoter + ATG

SEQ ID NO: 4548 - DNA, 3000 bp, Unknown; identical to SEQ ID NO: 4542
  misc_feature (1)..( 3000): cDNA_ID_1817281_gDNA_ID_1620713_Annot_ID_49058 3000 nt of promoter + ATG

SEQ ID NO: 4549 - DNA, 3000 bp, Unknown
  misc_feature (1)..( 3000): cDNA_ID_1817285_gDNA_ID_1620713_Annot_ID_49059 3000 nt of promoter + ATG
acttgttatgatccatcactcactgtctaggtttacttttttactttggttctctgattcactcattgttgttaacagatccgtaagtcgttgttcggccaagttactgcctgatgaaagaaaggaaaagagaaaagagattattcaaaccggtttgcgtttggttatttacctattttgggagagatttctctttgttgtgattctttgtattttgcaaaatcttactttggtgccaaacccatcgaacgcttctttttttcgaattcctttttttcattcctcctcgaatgtgtgttatcatggctatacaaataaataaaatgaaagacttcttttctttttcttcactttttctattcaatgtctatgctttatactagtggtttttcgtcatcatagataaacacttaattcataaaaagacccttgaatttttattataaggttagcaatttatccaacacgatcctgaaaatcgtccatcctagtatttttttcgtctaaacacctttaattgcggagttttgataagtttttaacagaaaaaaactcgaataagatatttttttggtttgggctaaaattgttatagacttggcccttgggttttatcccaaatacattttaggtatcacaaacaagaaaaacatagaagtaaaaaactagaagttttttgcgcttttgatctttgtccttttttctacaagttttttctccagactaatctcctcacgattgtctgaagacaagagtctacaagaccggagattcaccgttcgacaataatttccgtacctttcaaggttagatgttcttgcgcttaatttgacttgtgttctttttgtgaattttggatgcgcgcacaaggtgtttgttcatttgcctagacaaagtaaaattgatttagttattcttctcattcatcttctatagtatttgtacttgagccaatcattattcatctttggtgcaatctgaatctgacccatttgagctgttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatgaatgacgtcgaggcacttaggcaagaaggtgctctttttatactctttaccttttttttttagtgaatttcgtcgagtgtttctgaagaatttcagcgaaaagtttgtagctttagcttccatttcgttactattttctggtatttttcccaagatatgcatagctttaatgcaaattcttggtgtatttatgtttgctggtttgattagaagttatggatgatggatgattattaaatgttgtattcttagttctcatgctgtttatttattggggtttaggcctttagcttggatttaaaagtctatctgacattttatagtgaagcaaatttgcatatgtatgaatgtgactagacatacgagtatgcgtttatcattgtctaagctattggtattttaaattcttgatgtgaaatattactatttcggctgtctttcgaattgttgattctaaaaatcgttagacgctactctgccggtgaagtagcgcttagcgcctagacggtcgaaacggggattaatcggggcctaggcgttaaagtaaactataatgaatttatattgttttataagaaattttatgaaatttattatattataagtgaagttgtgatgtgaagttatgttggtcctgtggctttctgctcaaattttattgctacagcccttggttcgatacttttcacgctaaaaaaatcgaatttcccccacttaaatgataggggcaaaattgtaatttaaaaatgttggggtcatcttcttcctcaaaaccctattcgcttgtttgatcgttttttcgcttatactcaatttttttcgtttttatccgcttgtttgatcgttttctcacgtaatcaaaccaaaataacacagatctaccactaaaatacatattcatgatcaaaaagaagataattaagtagattctcatgaacgccgatttgttcaccgattgagccaaaatcgcggcggtccacgcagaaatagcgcttttttcgacgcctagtcgaccgattagtccgatgtttagaagcgtttgttttagagaataattatgccttcatttttgtcaagtttgtttggtttggtgagtagtagttacacaatgttcttattgctttgcatatgtttatggatgtctcaagaaactttatgaaatttgcagggcattcaagcctcttttagaataggtttggttcttcctcgagtagtagcatctacagagagacagatttcctctacggttttaaaaagagcttctgaaagtgtctctttttcattcgctccgtacataaatggtaagtgtcactcacaggcgattacaatttttcttagattgttagaaaatgaattagaataacgagtaatctcacccttttgttcatgtttagggtttggttttagttcgttatcaaattggtctcgtagttatgaatctttccctactgaaacatccataaggtaaaccattcgcctagacttttctgtcatttctctcttaaatttcatcctcagagcactcactatgtgaatgtttgctggcttgggttgtgtttcttcttgaacaggtattttcatgcgagtcgagaaacattggcgaaaagaaaagaggatgctgatcgactgctgagtcatcgtgaacgcaagaaacagactgtgaaaacgaaaggaaagttctcaaaacgggagaaaaaaacagataagccacctgttgaagctccttatgtgcctcctaggctgaaaagattggcaaagggattgcctgggaagactgtcgacatatttgaaggg

SEQ ID NO: 4550 - DNA, 3000 bp, Unknown
  misc_feature (1)..( 3000): cDNA_ID_1824733_gDNA_ID_1620714_Annot_ID_49066 3000 nt of promoter + ATG
tcttttccaagaaattcttccatgaatacagtcttcgaacaggtaatgcttgtttcatcagtagctgagttctctcatattgtcgatgcctaacgtctctttcgcatcttttatgtatcttacagaaagaaaatgtttcaacagagtctgcagcaccatcatatctatctcctgcacagttgtctctttcactagcttcacaaccatcatctttccctacgtcaccactttcgtcccaaagctacttgcaccctgcaagttcatctacacttaaactgacacagcaccctcgtctatcaaagcaagtctcagatggtcaaatctatggtcagaactcactaagtagaagctcagcaactgaagagaggcagggaactcctacgagatatgattcgtctcagtctggaccatctgaaggttggtctctacaagccttttctgaaatgatgtcatcttctcgcagcaacaaggctctgtcttatgacaattatgacaatgattgttttgggcttcaacgtgacaagattgaccatcatggcaaccggatgtccaagcatcagcagcatacctgcggtgcttgctctagacccttgtcggagaaatccttgtggagcagccaaaagatctttatgaccaacgagctctctgtatctgcaattctagcttgtgggcatgtctatcatggggagtgtttagagcagatgacgccggaaattgataaattcgacccttcatgcccaatatgtacaatgggtgagaagaaaacagcgaagctgtcagagaaagcgttgaaagtagagatggatttgaaagcgagacacaacaaaagactcagaaaccgagttttggacagtgactttgattgcgatgattttgtaatgtttgaccacagccacaggacagcagcagcagcaagcaagagccctagactcgtctcaagttcgagtgctaaaagctattcagcaaagcctttcttggctcgacacttctctttcgggtccagaagtaactataaatcccctaaagaaaatcttcctgtgaaaaagaaaggcttcttctggaccaaatccagcaaaatatgaacttgtaagcctttctctctctgtctctttttcttgctatatatatagttgaaacttgaaaatcaaatcagtgagtcgcaagtaagactttgtggttgttgtatcagatttcgccgtgctctgtactttgactgctgtctgaagcatagaagtcgacacacaccggggcacgataccattcagttaaaagcagtctatttgctgttacacacttgctcaacaaagtcttctcattgtttttttttttaatgaatactaaattttcacacatgtaaagttacaaatttagattacaaggttggggacaaaaaaaaaaaaaacattggatcattaatctattgatttgttctggctatgcatagatcagaactgggctctgaaggcagccgattgggtatagtttgttatgtattatatctaccagcttgacctctcaatcaaacttcttttatgtaaattttgatttgtttctccctctattcctggtgattgtaataaatagacagatcgataagcttttaaaatattatacgtgaattattacaccatcatttctctactaccaatattaagcaaatattgaaacacgggttatatagaaatcagagaaatcgatttcaagcaatcattatcgactacggtcgttcgttaaagatcatgcatgtgcttagtggcaataccctacgcatcttgattcgttactgcggcacgtgtcatgaccatgcacatgaatgatgattaatgtttagtacatataatgttcacgcaaacgcatagtgttaggaaaagagaatggcggatctgaaagacgaacgaggaaatccgatatatctcacggacgcacacggggagccagctcagctcatggacgagtttggtaacgccatgcatttgacaggtgtggcaaccaccgttcctcacctgaaggagagcagctacacaggtccacacccaatcactgccccagtcaccaccaccaatactcctcaccacgcacaacctatttccgtgtcccacgaccctcttcaagaccatgatctccgctggttcggcaccagttcggtacgattaaatatctattacatagttgtattgagattcaatatctgtatcactcgtaagtaagttctaaaagcatgtgaacgcaattgtctaatagtttgcgagtagaaattctacatccatttcatttttatttatgtatgcgtgtatattattttaaaaattattatcaagattcactgtccatggtacgtataaaaatgtagacggaggagaatggcgaaggagtagggaggaaaactaatataacggatgaaacaaaatcgaagctaggcgtcgacaagccatcagctgcgaccgtaacaggatcaggatcaggatcggttcacgagaagaagggtttctttaagaagattaaggagaaactttctggccaccataatgatctttgaaagcttccatacggatggtcatgattacttgtgtaatcacaatcatgttctaatttcttgggaacaaaaaaaaaaaaaaaaaaagaaattgtgtaaaatgttgttggtaattcaaagttgattacattatacggtccaatatcaaaccgaaccgaaccgaaccaagtttgagagatgtaaagttgatccaacggatgagattgcataatcgtgatctctctattcaaaccttttccgtcgttgatgactggctgttccgtgaacttcccactcatagcaaaatgttagctcagtcgcacttcttctctaagtccttcgatctgattccgccacagtctccggcgttgcggtctgcaaatccttctcttcgtatctcttcttcttatagtaacagccgcttatcctttctttcttcttctgcaattgctgttcccgtctcccgccgtcggttttgcctgactatg

SEQ ID NO: 4551 - DNA, 3000 bp, Unknown
  misc_feature (1)..( 3000): cDNA_ID_1020484_gDNA_ID_1620714_Annot_ID_49067 3000 nt of promoter + ATG
attttattcttcgggtattgatttgattttaggggttttgtatctattttgggtcatctcaacatgttttgcagattctccggccttaatctcggatctgtttgatgctaattgttacttcaattactacttctttgatttcctgatttttttttcttaattacggattctcttagtgaagagagtcatggcagttccagtgagcagcagtatatagatcgatatgattccttttctatatttccttatttgatccatgattagtagtaacatgggggctctactaatttttgcttgcaagtgttgcaacctgagtctttgattggggatctcctgactctatgatgatttgattgtcttattgaatttctggtttctcagctattgatgatgctgattgaattcctgtatcttcatttcttaaattgattttgtgttttttttttgcttgttaattttgtagctagaaagggattgttgtgcctgtgttctactgaagtgtctctcgtcaaataatttataagcactgtctttgcatagtgcttagtaggtgctagttatggggaatgcgtgttgtgttgctgctcgagacaaaatggtggtgcctaattcatcagctggtgagaatttgcagaggagcaatatcaggcattctccgtcttggagtttccggtgggataatagagggcgtgtagctggtgaagaaacttctctcagttggttatctgatggtattagtcggaacgatggctctgagatcaaatttgaatctgctttcgtatcatctgaagggtcccctttggacagttttcggacacagacattgcaaaaatctcctgcctcaggtatattatttcagcttgttaggaaatagttaacattaaaaatcgttttcttcactggctcagcttttttagtggaacttgtaaacttgagggaagcacatgctacttggtgttactcacttgggactttagatttttttttttcacagaacctgttaatgcccctctagagtcatgattagcaaaaagacgtggttatgtttaatgataagagttgtcttctgattcttggcttgcttcttcacctgtcttgatcaaattctattgtggcagatctatcttttccaagaaattcttccatgaatacagtcttcgaacaggtaatgcttgtttcatcagtagctgagttctctcatattgtcgatgcctaacgtctctttcgcatcttttatgtatcttacagaaagaaaatgtttcaacagagtctgcagcaccatcatatctatctcctgcacagttgtctctttcactagcttcacaaccatcatctttccctacgtcaccactttcgtcccaaagctacttgcaccctgcaagttcatctacacttaaactgacacagcaccctcgtctatcaaagcaagtctcagatggtcaaatctatggtcagaactcactaagtagaagctcagcaactgaagagaggcagggaactcctacgagatatgattcgtctcagtctggaccatctgaaggttggtctctacaagccttttctgaaatgatgtcatcttctcgcagcaacaaggctctgtcttatgacaattatgacaatgattgttttgggcttcaacgtgacaagattgaccatcatggcaaccggatgtccaagcatcagcagcatacctgcggtgcttgctctagacccttgtcggagaaatccttgtggagcagccaaaagatctttatgaccaacgagctctctgtatctgcaattctagcttgtgggcatgtctatcatggggagtgtttagagcagatgacgccggaaattgataaattcgacccttcatgcccaatatgtacaatgggtgagaagaaaacagcgaagctgtcagagaaagcgttgaaagtagagatggatttgaaagcgagacacaacaaaagactcagaaaccgagttttggacagtgactttgattgcgatgattttgtaatgtttgaccacagccacaggacagcagcagcagcaagcaagagccctagactcgtctcaagttcgagtgctaaaagctattcagcaaagcctttcttggctcgacacttctctttcgggtccagaagtaactataaatcccctaaagaaaatcttcctgtgaaaaagaaaggcttcttctggaccaaatccagcaaaatatgaacttgtaagcctttctctctctgtctctttttcttgctatatatatagttgaaacttgaaaatcaaatcagtgagtcgcaagtaagactttgtggttgttgtatcagatttcgccgtgctctgtactttgactgctgtctgaagcatagaagtcgacacacaccggggcacgataccattcagttaaaagcagtctatttgctgttacacacttgctcaacaaagtcttctcattgtttttttttttaatgaatactaaattttcacacatgtaaagttacaaatttagattacaaggttggggacaaaaaaaaaaaaaacattggatcattaatctattgatttgttctggctatgcatagatcagaactgggctctgaaggcagccgattgggtatagtttgttatgtattatatctaccagcttgacctctcaatcaaacttcttttatgtaaattttgatttgtttctccctctattcctggtgattgtaataaatagacagatcgataagcttttaaaatattatacgtgaattattacaccatcatttctctactaccaatattaagcaaatattgaaacacgggttatatagaaatcagagaaatcgatttcaagcaatcattatcgactacggtcgttcgttaaagatcatgcatgtgcttagtggcaataccctacgcatcttgattcgttactgcggcacgtgtcatgaccatgcacatgaatgatgattaatgtttagtacatataatgttcacgcaaacgcatagtgttaggaaaagagaatg

SEQ ID NO: 4552 - DNA, 3000 bp, Unknown
  misc_feature (1)..( 3000): cDNA_ID_2998676_gDNA_ID_1620714_Annot_ID_49068 3000 nt of promoter + ATG
acaatgtttaagttgaatttggggtctgcttttgatttccaacaacggaggatcaaacggaaatctttttttttcttttcgcgtaggtgcggtcaacttacttctgttgcaggatgaagtgagcaagctgaatcagggagagaacaaagaagagaatattcagaaagccattgaagctaaaaaggatgcaatgcttcaatccctttggcaaataaatgttgttgacatcgaatcaaccttatctcgtgtctgccaagcggtaagatacaccatgatttgtgtcagacattaatgatcctatattattagtttattacatccactataatctcactgtaatagtaacgatcttgtcatctcttttgtttgttctcaggtgcttaaagatccaagtgtttcaaaggatgttcttcgagctagagctagaggattgaggaagctgggtaacgttttccaggtgagtcatattacaaaaataaagtcttggctctctaacataacatactgaaactcagctaaacattttacagggttctaagaaagcgtattctagagaaaacagcttgcgtcatgaagaagaaacaggagtgaaagtccacaccggagattcctcgaagccggcaacttaaaccaaggttcgaatctatcggttcgaaacagaacaatcaggttttgtgagaattcttgaatgtattgtaacgattaatattgttttattcgtatttatattcaacactaaataaatattgttatgggaagtgatggtttcgtctttatattcccttcttcgttttcgttggatctttttcttccgtgttggcttcacaaagctccaggttgcgtatccggtaagatatagtaatagacagggacgggggattttataaattggtccctctattattgttaatttataaaactggaatctaattttttaatttctaaacggccccatctaacgacgtcactgcggaaagttgccggttaattattcgttctccctctctttttgtcctttaacgtgacgtggcactactcaccgtaaagtcactataactccgctaactctaacggcgtcacatctaaaccggcttatcttgggttattttacacaaaccggcttatcttggttcgatcatggcaaaactgttctttgattttcttttaaatctttcatataggctaattctttcccttgacacattagcacatgaaagcttgtcacctaaacttcataagataagaatacataattagtaattaattcaacataacaactaaaacaggaggatataattaatcagaacttgaaccatcactcattctacatttttttaattcaatgtatcctctttaattttgagatccacttaagtagctaaagtgatcataaaatccaaacatgttacacatattttttgcctaaaaattagacgattattatgaaagaaactaaatgaatatgcagattaaatatatctaagcttttcgagatttatgttaagaaaacaagtaatttgaaagatgtttgaggagctatccttataactaatacttaagatataagattatgataagaacttaactaaactttctaagaacatcaagttgaatatgattagattgaatatgcagaaacatggttaataaagacatgttatatttttagtgtaagaaataaattttctaaaattttaccgtctcacaatttaaaataaaacaaaaagataagaatatataaattaaaaaaaaaaactgagaatctagaacaacaataaaaaataactcaaacacattcatttttcagatgaactaatatagttggacttttcaaaaacaattacaaatcatatttatgtttcaaaaccgatgaattcaactttattttatatgaacagacattatataaaacaatttgtaaatagtaatacataaacccggacgtagtgggtttactttgcatgattgatgaatttgagaagttattatctatgtatatgactatttcactttgcatgattgatgaaaatctatataaaaaaatcgaaataaccagtatctgttcaattcggtttgatttgattttgttatttggtacggttttagagctctgatcacaacagacagtcacagtacacacacctaccggaacctgacggcgtgaagtaaaccgtcagaaaagacttgtattcgtctctttccctctcttcgctctctctctctctctctaaaggaggaaggaacaaagcagtgctctcgtttcatttttctccctttctcactctaacagacccatccatcgctctctctctgtgaaactatcatcttcctcttctccggcgacgttttggaagttctgggagcaggttcgatgttcgtgactctcttagcatctagtattttgctttttgttttgttatccttttgtctctttcggaattttattcttcgggtattgatttgattttaggggttttgtatctattttgggtcatctcaacatgttttgcagattctccggccttaatctcggatctgtttgatgctaattgttacttcaattactacttctttgatttcctgatttttttttcttaattacggattctcttagtgaagagagtcatggcagttccagtgagcagcagtatatagatcgatatgattccttttctatatttccttatttgatccatgattagtagtaacatgggggctctactaatttttgcttgcaagtgttgcaacctgagtctttgattggggatctcctgactctatgatgatttgattgtcttattgaatttctggtttctcagctattgatgatgctgattgaattcctgtatcttcatttcttaaattgattttgtgttttttttttgcttgttaattttgtagctagaaagggattgttgtgcctgtgttctactgaagtgtctctcgtcaaataatttataagcactgtctttgcatagtgcttagtaggtgctagttatg

SEQ ID NO: 4553 - DNA, 3000 bp, Unknown
  misc_feature (1)..( 3000): cDNA_ID_2998684_gDNA_ID_1620714_Annot_ID_165582 3000 nt of promoter + ATG
gtttaggatcaggttgtttcccaattttatgttatcgtttagactttagatcttttttgagcatggaagggagtttagcatcattttttaagtattctagcgaattacataagaattagtcattctaacgaacttaaaacccgaccaactaataattgtgaatccaaattttcttgcagtgtactcataaactcattcttggtcaccaactatgtatataagtaagtaactatataatattgatatttttgaaacaatatactaccaaacatattcgagagccccacattcaccagacaattcgtccaacgccaatctcgccagcctttagcttaaattaccaaagggacaaaaaaaagttaaagatgaagaaaaaatataatacaatttccgttaaatttacttataaacactaaattgctagtcaaaatttcattacctatgaataatatttagaaaaaaaatactgtataagttggatttcttatacaaagatacatgactcagccttccgttacaaatagtcggaaccaaactaagaatttgctccataatctcttacttgtggcattaattagtcatttgaacgtcatttctattaagtggagagtaaaagtctgatgctaaaaaaataatcgatttactttcgcctttgtgtctctttgtatccccaccacctccttatctagttaaccgcgtaacgagatggacgggcacaactatatacatacaagacgtgtgtgtgtgtgttcatgcctatataatagctaatgttcttgtaagttataactcgaacaagaaacagtaagagaacttataaatagagaaggctatatggggaattgtgcactaaagccaaaagttctgtcagaaaccggagctccggcgccggaggagctcaaggattcacttcttgaataccataagatggacgctgcaaaatctcttagcaacttgttccttcaagtaagtcactataaaattaaaaacaagcacaagaaattatgatgttatattaagttatgttattctttgtgtctcatttgtgttttcttttggttaataggacaaggcagataagataacgaaagaagacgagaagatcacaccggaaaagataccggttactgatgatctgaaaacagctttggaggaggaaaatactccgaccaaagaggcaaaatctccggcaacagagacaaagtattcggtaacagagaaaagagctccggctgacaagaagataacaccggaaatgatgccggttactgaagatctgaaaacagttttggaggaggaggcaaaacctcctgcaacagagacaaaagctatggttgatgatcagaaggtgaagaacgaagtggccgttcgtgaagagaaaatcattgacctcgtgactgtgaaagagaacgaaacagaggcgaaaacagagtaggtgggaaaagaataaacacagtgaaacagccttgaaacgctagtttctgcgttcttgatagcaaaatgcttgtttttgtttagattatatttttcctcgatagataaacgcaaacgctgtattctttatatgaattgaaaacttcaaatttcctattgaccgatccgtcaacccaaaagaatgtcaatgtaagaggctacgaagaacgtgtttttccgttttcgttttctgcgattgcgtttcaaagagaatgcatgcgtaaatcggtgcccgttacaacactttcgaaagttttggtttggactttaacgggccgatacgggccgtattataaaaaatttgtaaaataagcaacagtttaatggaccgaacttcgtcgatcgagatctaacgggcgagtaagaaccgggtcggaaatacggatccggattctgagcattaaattgtgaaacaactaactcgacaaaccttttaattgcagcaatttaagaggccaccgaactctcgcgcctcgacatctcaattatacatgtagtgaacagccaataatatttagccacgtgttcatagtttgttggtagttataaacttagactaataaactcgaccacttctaaccaccaccggttcatggacgaccgacctgacctacgaaagttaaagtgagttctttaataaatgtgagaccaaacgaagaatttttgttagcatcaaattaagtccaaaacatgacttttattgatttcatatgattcaattataaagcagatcagataagtgatgtgtaacgaggatgaagacattaattgttatggcgagttcggtataataattcgaattttatcaacaacgtccaaccagatttatccataatggctttaacttcaagtttgaaccatgatgatgtgaattataagaagaagaaaaaatcacaacctcgcatagtcatatattccaaaaatagagaaagtgaaaaggacatcttaattatacatcatgtattttttctttttatccatagctaattgacgtgctttaaaaccgtgagagtgttatatgccagtcataaattcccagcaaataaatcggccatgcaagaaaatttgaaatcaagaatcaagggcagtgaattcagtaacgtgtcaattctgacagtaattttttctctctttttttcaaaaaaaaaaaagaaaataatcgcatacaaaacaaattatatggctattttctgttaaattttataaatgatagtaattttagtcaaccataatttaaaatgtgattttgttttaagaatttttccctaagatggcatttcagtcaacattcatatatggtattatatataatgaaaataaataactttcttaatttcacgaaatggaaaagtttagtatagaaacaaatctttagtctcttaatttactggtggcagcaataaaagggatattaatatctctatctacttctctcaactgtaactgcccatatatgtaccactccctcgagagtatcacacaacataaacccaatctctcactcagactaagacagagtcagaaaca

SEQ ID NO: 4554 - DNA, 3000 bp, Unknown
  misc_feature (1)..( 3000): cDNA_ID_3073609_gDNA_ID_1620714_Annot_ID_165578 3000 nt of promoter + ATG
cggggtcacaaaggcgttgcaagtcctatcgcattaagtagaagaaccacaagtcagagaaagaagcaaagttttagaaaaatcagaaggagcaactaaataatctaagaccaactagacatatatctcaacaagacatgattgtataagagaagtaacagttcctttcttcaaagttttgatctttatcaggctttgtcccagtcgaaactatatctagtgaagccacaatcttttgtacacttaaaaaacatatctttcacagatatcatccagtttcacatctaatcagtattgtttgagctaaaaaaaaaaactttgaatccaacgagtgtagactaatgaaaaatctcttgccacaattatgctgctattcaagaatatcatctaatacttgctatctttttaagagttgtgatcccatttcataagagagattcaagcttactaagaaattgatctcctgtttcaatcttattctcaaaaactttccaaatgcacaacagataaagcagaaaacagaatcaacccaccaaaaagacaacaaatttaaggataatttgcaagaaaacagcaaaaaaatagaggaaaaaagataccctgagaaagcaagctccaacaagaggaatcagcagcgatgcttgaccggagacgagctgaagcaacggcactgtgaagtggaatcatcgtttcaacacttcccaaagcagagagaacccttcacataaaatgtttctgattaaaacgagctgaatattttctctaaatttcctttttccaaagttgagcataagagaaaatgagttaaacttcttgaatcagctgaaaggtgaagtagttacctcgaagcgcgagggatggattgagacattgaagcgaaaggagatgaagtagttgtgggtttaagattgagggacttttgagttacggttctggatcttgatactaagtttctggaacctgccattaacgctgatctgcaaaacgatgccatctttgatcttaagatttcgcacaaccgaaagtttcgtttttcttttcttacacagcgaaatggaacaagtgaacagagcacggatgcactaaaccctacaacccaaacggcatcgtttaagttttgcagaagtagcacaaatttgccctctaacttttaatttatgcattatacaccctccctagtttttatttttgtgcgttaaaaataaacataagaaaatattatcatgtcatcctttttttatttttgtcaactataaaatattaccatccctgtaaatcagttttagataaaatctatatattcgtaacagtacaatttgttaactaaatcttttttttttcgtcatatatcgtttgtaaattaaatctttttaatacaaattagttttttccactttccaagggatacgagttttaatttttgtgcatatatactgtatttgtggcagtggatttaggattattattagagatcgagaggaagcgaaaacgtacgtacgaagctttcgttcacgtatcccacaattatgttaatgtcgaaggaagatgagtcacagatgacgttttcgatgcttcctgatgatttggtattaaactgtttagcccgtgtttccaaagtgtattaccctagcctttccttcgtttccaagaaattccggtctctcattgcctcaacggagcttcaagagcttagatcattcttaggttgtactagcagtggtctttacgtgtgtttacggttccgtacgaatactgattacagacaaatttgtttcaccctccgccaaaaaataagtagcagcgccaaaattttggtcccaatatcatctcttgattctccttttgactacagatcaggtgttgtagcggttggttctgatatctatgctattggtggacgaaacttaaataatagtgcatcgtctaaggtcatggtcatggactgccgttctcatacatggcgtgaggctccaagcatgcgcgtggcacgtgatgactttccatctacttgcgtccttaatgggaaaatatatgtaataggaggctgcaagaatctcgattcaacaaattggattgaagttttcgatacgaagacccaaacatgggagtttttgcagattcctaacgaagaggtatgcagaggttttaattacaaaatcgtagggtataaagaagctatccacgtaagttcattagaaaataatcgtgcaactttcatgacttacgagatacacaaaggtagatggagagagccacacttatcgttaagtcatggatttcatttctctaattgtgtgatagagaacgtgttctaccgttatagttacgagatgctccaatggtatgactcatgtagaaaaatatggaaaaatttgaaaggattcgtgcgcaggtcgattatgaatcctcgtggtgaaggtgttaaaatggtgaattatggaggaaacatagttcttttgtgggaggagtgcgtgactattaagaagaaactaatctggtgtgaagaagttgttattgaaaaaaaacatcaaggagagatttgggggttgcttaagtggtctgacgttgtctttataaccgatgagaaaaatcaattagtgcgtgctcttgctcctgatgtttgatgcaatggcttatcagacatgtgtttaattagttgatcattcactgatatgtgcaagaaggactattatttggttttatttgttcattaactcgtttggagtttgctttcctcccataacttacatattttactatagtgaaaaaatttttagctttcatttttcttttaaaagtatttgggtctatgttgcaatttcaaaagtaattggagactattaaaaacgcactctaaagtcaaacccttaaaaaccaatttaatgcaaatactattctgcggcgttactcactctctgtttttgaccggaggagatagaagagtagggcaaagctctttcgattaaaaaaaaaaaaaaacacttcaagagattacttatg

SEQ ID NO: 4555 - DNA, 3000 bp, Unknown
  misc_feature (1)..( 3000): cDNA_ID_1824700_gDNA_ID_1620714_Annot_ID_165577 3000 nt of promoter + ATG
gtaattattgataagaaaatcatttgaatcctttagctgctgttcgattaaatacatgtgtctaacaagataaattatttgagggaaaatctcgaatctggttaaaaggaaacgttataaatttagtaaacaacacgcgaattaacatttcgttccagacaaagaagacttaaacgaaactgtttcatcaaaaaagtaaaccaaacgaacgataaccaaaccagaagtggtgacacaaaaccaaatctaaaccaaaaacagagcagcagcacgcaaacaactctatctttgattaccagccgccaccaccgcctccgtaacttccaccatcaccgcctccgtagccacctccctcacggcgtccaccaccaccgtatcctcggccaccaccgcctccaccagatccgtaacctccgctacgtctctcgtaaccaccaccgcctcctcctgagtatccgccgccaccgcctcctgagtatccaccaccgcctccgctgcggtaaccaccaccgcttccaccacggcctcctccgccaccgccgctacctctcgactgagcctcgttcacggtgatgacacgtccatcgagctctttaccgttcatctcttcaatcgcatccctcatggctttctcgtccttgaaggtgacgaatccgaatccccttgatcttccactctcgcggtcgttaatgatctgtaaacaaacaaaatcatacacatcagcaaaaacaatcgtggaaggaatataaaacaaagcgatgaatataaagcaaaaatcgatcgatctccgagctcatagaagcaggaagatgaacgtaccgatgggacaaattaagtaacagtaacaaagaacgagagagaacatagtaacagtaatcgaatcaagtaacagagaaacagatcggaatcagatccgtcgaggatcagaatcatcggaatcggctcgatccgggagaccgatctctcgtgtaacagaccttagaatcgataacgtcgccgaactgtgagaacgtcctttgaagatcttcatcattggtggcccaggcaaggccgccgacaaagcaccggtactcaacttcagacatttttttttggggaaaagaagagaaattagggtttcaaaatgtaagagagagacttatgtgatttgaggtgataagacgcagccttaatttatagaacaggtgtgacgtaataactagggttaaacatgttttctagggtttgctgaaagatttgtttcaacttactctgattaagatgtgtggttaattgggttagtggttaggcccacatcatgtgagcattttcgataactaatgattttttctcctcgtttcgagcaaaaaatatctttgtaagaatatcttttattccttaaatgacaattttgtccttcgtctcgtcgtcattatgtcatacaatagttgggtctgagtttcgtttattgggcctatctaatttaattggaaagattataacttccggcccaatgaatctgacggcgaaattagtaaaacaataaaatgaaataatatgcaaagactatgacgataatgtgctatggatttacatatttgttttgtcattaattatgacatgcaataaattcatatgaaaagattcttatcgcaatagcatcgtggacatgttacagtctgtaatatccaaactttagcatagacgttttttgttgtacaaatattttggtatgttaagtgatattcaaatgaaagctagatgtgcagatatgtgaacatataaatctttcaatggaattcaattttcaatcattgaatatttggatacactcgctctgtacttgaaatattttgactgtctgaatattatttttttacaggattaattattttgtataccaaaattagacggatgaagaatgaagatgtagtagttatacaaagtcaattacaaatggttcagtatcttgatttcgatttttgtgctgaaaatgctgactaaagcgtgtagaagagctttttcaacaagaaataacctggctaagatttttttaagaaatctgattattaatatatcgcaggtaatatgaaaaagtatcgtcgactttttataagagtgacaactaaatcattttgctcataataaagccacaattattattagtatattttggtcgttttaatacgaggaaaaataattgtcatacaaaatttacagaaatggagtagcatcgtagctcctaggaattcaattatttatttgcaaaactactaaaatggtggttatcatattaaacgtcagcagaaactttaagtatttttgaaatgatattaatttaagagttcgttaagctgtcttgggcgggatcgttgagagtcaaactcctcaaacgacgccgtattcagaacttcactttcaattactgtatctgcgtctcggtcacgagatcgaaccataaatcttgggaacgtgcacgtatacaacgaaagatccaccttctctcactttttttattttcttatactttcttctcttttcttcgaacggccgctgttcttgaccagtctgaagctttctctgtccagaacagttctgtaagaagaagtttttatcaaatattatataaaaatatctgtttcgtattatatcagactttccatctttctctctctaaatctaggacaaaaaaaaacatggaagagttagagagagagagaggcagcagaaaatgattggtaaacaacaatgaatcgtttttgattctgaagtgcacagagaaaagtaattgccagagaaagtcgcagaggtaacagagtgaagaaccttttttagtatatatctttgttgaataatcacaaaaagaaagtttcctttattgatcggattcgaaggaaacccaaaaaaaaaagagatttgattatttccataaatcgcgaagcttttttccaattgaatcttaggcaatgaatggctttaagtttttcgaagtactagtcgtcaccagggtttagagaaacc

SEQ ID NO: 4556 - DNA, 3000 bp, Unknown
  misc_feature (1)..( 3000): cDNA_ID_3073627_gDNA_ID_1620714_Annot_ID_165576 3000 nt of promoter + ATG
acaaagtcaggaattttaccttcaaaatagttttctgacaggtcaacaacttggaaccttgtcagtaaaagtgtgagattgccgtaaaacatgttcccggatatgttaagcatggagacagtagaatcaaaactgacagtggtattaggcagcatgtcagagaagtgatttccagaaatatctagaaacttgagctccggtaacgaccataacctggacggtaaagcgcctatgaaaccactgcctctgaagtcaatgatctgaagtttactcagcaaactaaacagatcaggaggtagggatcctgaaaggcgatttcccgcaattaccaatgtctgcaagttccttagccctttcaaatctgatggaaccgaacctgacattccgttgaagctgagatcaaggtcaattaaaacagagaggtctccgagtgatggaggtattgaagaagtcaaggtgttacgcgaaagattcagacgctggagctttgagagtgccccaatattagcaggaatcgaaccaaacaccgagtttgaggaaagatcaaggattgatagattctgaagagaggtaagagacagaggaatatccccattgatcgcattctttgaaagatcaagaactttgagatgtgataaccgagtcaaactttcagggatggttcctgtgattgaacaggagctaaggtccaacacctctaaagtcaacagactcgatccaaacaaagccgggattggacctggaagatagaaccttgaggcgttgaaggaagctagacgggtgagattgacgagagaaccaactgagaattccgggttttgattcccaatccttgtccttctgaaccctgaaatgttgatcttagttactctaccattctgatcacatttgatgccgttccagttcagacaaggattgccttttacaggccaatctctgcttcgtaacccaagagaagaccttaacagcagaagcgccgatttctcattcagagaacttgtctgttgctcaaacgttgactctaacaacaagaggaggaataagaagaagaccaacaaggatgtcttcctcagaaccaccatggtttctctaaaccctggtgacgactagtacttcgaaaaacttaaagccattcattgcctaagattcaattggaaaaaagcttcgcgatttatggaaataatcaaatctcttttttttttgggtttccttcgaatccgatcaataaaggaaactttctttttgtgattattcaacaaagatatatactaaaaaaggttcttcactctgttacctctgcgactttctctggcaattacttttctctgtgcacttcagaatcaaaaacgattcattgttgtttaccaatcattttctgctgcctctctctctctctaactcttccatgtttttttttgtcctagatttagagagagaaagatggaaagtctgatataatacgaaacagatatttttatataatatttgataaaaacttcttcttacagaactgttctggacagagaaagcttcagactggtcaagaacagcggccgttcgaagaaaagagaagaaagtataagaaaataaaaaaagtgagagaaggtggatctttcgttgtatacgtgcacgttcccaagatttatggttcgatctcgtgaccgagacgcagatacagtaattgaaagtgaagttctgaatacggcgtcgtttgaggagtttgactctcaacgatcccgcccaagacagcttaacgaactcttaaattaatatcatttcaaaaatacttaaagtttctgctgacgtttaatatgataaccaccattttagtagttttgcaaataaataattgaattcctaggagctacgatgctactccatttctgtaaattttgtatgacaattatttttcctcgtattaaaacgaccaaaatatactaataataattgtggctttattatgagcaaaatgatttagttgtcactcttataaaaagtcgacgatactttttcatattacctgcgatatattaataatcagatttcttaaaaaaatcttagccaggttatttcttgttgaaaaagctcttctacacgctttagtcagcattttcagcacaaaaatcgaaatcaagatactgaaccatttgtaattgactttgtataactactacatcttcattcttcatccgtctaattttggtatacaaaataattaatcctgtaaaaaaataatattcagacagtcaaaatatttcaagtacagagcgagtgtatccaaatattcaatgattgaaaattgaattccattgaaagatttatatgttcacatatctgcacatctagctttcatttgaatatcacttaacataccaaaatatttgtacaacaaaaaacgtctatgctaaagtttggatattacagactgtaacatgtccacgatgctattgcgataagaatcttttcatatgaatttattgcatgtcataattaatgacaaaacaaatatgtaaatccatagcacattatcgtcatagtctttgcatattatttcattttattgttttactaatttcgccgtcagattcattgggccggaagttataatctttccaattaaattagataggcccaataaacgaaactcagacccaactattgtatgacataatgacgacgagacgaaggacaaaattgtcatttaaggaataaaagatattcttacaaagatattttttgctcgaaacgaggagaaaaaatcattagttatcgaaaatgctcacatgatgtgggcctaaccactaacccaattaaccacacatcttaatcagagtaagttgaaacaaatctttcagcaaaccctagaaaacatgtttaaccctagttattacgtcacacctgttctataaattaaggctgcgtcttatcacctcaaatcacataagtctctctcttacattttgaaaccctaatttctcttcttttccccaaaaaaaaatg

SEQ ID NO: 4557 - DNA, 3000 bp, Unknown
  misc_feature (1)..( 3000): cDNA_ID_1824713_gDNA_ID_1620714_Annot_ID_165570 3000 nt of promoter + ATG
ccgtatagatattgacctcaaacttagggaaaccctaatataagagcaaaccctagcagcgctatctccctcagcctcatctttcacccactactattcgccgttcgcttttccctcgccgtcgaaatcaacatggtatcgttttctatcatccttttctctaactaatcacctgtattcattttcttctttctcttgtctgaatcgttactttcgttgtcatggttacaggcgccgaagaaggataaggttccgccaccgtcatcgaagccggcgaaatccggaggtggaaagcagaagaagaaggttcgtttccgaatataatttaggtttaattggaatgtgtagagagatctggtttgtagtttctgaaattgtgttgtttaagtgaagcttgtaaatggatttgttttgcgattgatgttagattagtgttggagtttgcattgtctttgtacttaaatcgttgctctctttgtttgatggtaaacaaaaaaacagaagtggagcaagggaaagcaaaaggagaaggtgaacaacatggtgctgtttgatcaagctacttatgacaagcttctcactgaagctcccaagttcaagctcatcaccccttccattctctctgaccgtatgagggtatattatcaatctatcaactccttgtttcctcaattactaatccagatctagaaaatgatagttatatcatctggcagtgaattggtttgagcttctattgaatctagtagagaatattgtgaggtgttgataacttgatctactttacctaaaagctgtctgatgttgttggtatgcttgttcaggatatggttctttactttcacataggcttactgtgtgtctaagtagatactcatgtgttatataatgtcaatttggagcttgtcctcaacgtcaagcttattttattctctgtttctcctccctgttttttttttttttctttccataacttaacagatccaaacttgatgtgtttgatgttgttgaaaattcagatcaatgggtcgctagcaaggagagcgattagggagctaatggccaaaggtgtgatcaggatggtcgctgctcactcgagccagcagatctacactcgtgccaccaacacctaagatgtttggtttctttatccacctaagatgtttggcttctttttcttatctcttgttgtttgattcttcaggaacttgttagaatcttttgtttcgtattccgtttttttgagatatatggttatttaaaacgcatcaagacttctaaaattgagtcaatcctttgatatatccgttctagaattcggtaatggagttgttccggtttagttatgcatcaaataatttaaaccgtagttctttattatagggatttgaactaattgaacgaattcattcaaaatattatttgaatgcttggatttattttataaaggaggttatgtaatgtagacatttagattgatggactaatatgaatgaatatgatgaaatgaaaataacgcctacagcccatttgacaagtttcagtgtcccttaatattttgttaataaatacatttacttttcttatttttgtcttctaactaaagaattttagtgtttataattatgctaattggttttgcacttaaagagtaggatttattcaaataatttcccgacataatccatgcgtgatatgtcctttcaatttcgtcttctcacccgttaatcaaatgggcccagcttttcaatccatttgctaatctgatcaaattttcctataacgcttacaaataacaatttgcaaaacatcgtcgtcgatcacaggaaaacttccctttagacatttatttcgccatctcggaagcttagacgttggaatatatatctattttcttaactaaccgctgatttttgtattttcattacaaaaaaaaaaactattgtaatgccatattcaaaatagtatatgctttggtacagtagaaataatatcaaccaattaggataaattttctttccattatataattagtctccctagcttagaggcaaatttgtagtttgtgttacgacgtgtacggactatatagcacctcaaagttgggccaatgagatgaaaatgggcctgggtccacatgcaagcagacaaaagaaatcgacgtgtcccatatgagtctcgtagcaagagtatgggagaaaccagagtcgtccattttttgggttcagtgactgtcattgtcagatatctatagctttgttggtaaaatttcacatgaaaaaattacataataaatagagaagagattttggaagagagaaaatgcaatttagctcctcacgtattagcaatttaagttcttgtcttggtcttccctcgatttcaaacgacattaaccaaaaccagagaactacgaattattcggtgagttctctcattgatacgatcctcttctatatatctccgtgttcttctagcttgaaagcattttaaaagtttttacttttggaggtttcacattctctccctgaacgattttgctttattttgttcagcttcggttctcgtcgaatcttctgtttctctgtcgattcattgatctgaaaatctaaaaatggattcattctgatttaacttttatcttgttcaaactcatttatgatcccaaatttgttcgtttcattctttataaattagaatccttttttgttcttgtggcaattatcttcctccttttctctgttttgaaagatttgttacctgcagaagttaattccattgatttcttgaagatgcagtatctcttgctacttaaaagagttagattttttgtctgatacgttaaaattatgagaggctcgttcgttctttaatctgtgtggtcaaagtttcctactttccgagaatttctttattgttgtgttgttcactttgcatttataatagtttttactaacgagctttacgattctgttcttgtctcattccagctaaaaaaag

SEQ ID NO: 4558 - DNA, 3000 bp, Unknown; identical to SEQ ID NO: 4552
  misc_feature (1)..( 3000): cDNA_ID_3073652_gDNA_ID_1620714_Annot_ID_165556 3000 nt of promoter + ATG

SEQ ID NO: 4559 - DNA, 3000 bp, Unknown; identical to SEQ ID NO: 4551
  misc_feature (1)..( 3000): cDNA_ID_1020484_gDNA_ID_1620714_Annot_ID_165555 3000 nt of promoter + ATG

SEQ ID NO: 4560 - DNA, 3000 bp, Unknown; identical to SEQ ID NO: 4550
  misc_feature (1)..( 3000): cDNA_ID_1824733_gDNA_ID_1620714_Annot_ID_165554 3000 nt of promoter + ATG

SEQ ID NO: 4561 - DNA, 3000 bp, Unknown
  misc_feature (1)..( 3000): cDNA_ID_3073590_gDNA_ID_1620714_Annot_ID_165584 3000 nt of promoter + ATG
tatctttttttttttttccacatatattggtatctatatatcttatcttacactttaccaatattttcatacttaatcctatgaaattctagtttttctggttatggcactaacttaacatatatattttatattttcaatgtttttaagaaaatgaaaatagtaaataataaacaagagtaaataaaagaaagcaaacaaaaaaagaaaatagcaactgaaatgagaaacaagagccaagaataattaaagaaaagtacgtaaaagtggtaaaaattaaaatagagttcaaaaagaagtgactaaaacccatactacaactctataacctcgtttgggtctcgctagttggaactttgacttttgatggctcaatcattaggatttatgcctaaccttaattagttaactcctatgattggatgatctaattataattaatcggtaaaggcacttttatcattggaattttaattaaataactgcgtacctatattagtcgttacatgtgattactgtatcagactatcagtgataaacataggtttttcttttttcttaacataacaacatggaaagaggttaagcgccaaaaataaaaaagactttctaatcgtaaaatagctagtagctaccgacagattgtgagtgcgaaacacacataacacagtagataaaataattgaaaagtagttaaaatagttctcttctgttttttttttgaaccagttttaacacgaaagaaaaagacaccagtcattgacctatcataataatatacacaagatttggcttatttaaatgtaatcccgaagagcgaatattaaatactcctctggatagcacaataattcgattctaacaataaattagaatatattgggaaaagtttaacaataaattagtactaactttttcctgtggatagcacaataattcgatcctaacaacaatgcctgtctattttagtcgccagtttcaaaatactgcaatacagtgaaaacattttaaaacacatgcttcatcttatctttttggctattcttcacagtggtaagtttccgtcggtgccgatattatatgtttgtgctattaattaatcatgaattgtataaatttccagatttgttggtggagccttgtaggccatcaaaagcttttgatttttgaacaaataatggcccatatatcgaccgacgaatatttgtactcccatgaatacaacaatctagtttcaagtaaaaagtgttcaaaatatttcagatttttgtatcgtagttttaaaagactaaaccaattgtataattacatttctattttccagctgcttggccggctgatatggcaatttttagcaacatttatataggagcgtattgtatatttttgttcacctgtggctatcttgtattcattttgatagaaagactaactttgtaccattcaaataatgattcggttatcatttcgccatcaaataatcgatttatacctaatactgcgaagatagagacattttaacaatactatttacgatagttcggtagaatatagtaatctatgcattgatgacatcgtcggctctaatcagcttttataatgcttattaacatcattatggcatattcataatttaatcgaagtaacctagtttattttaatgcatttagatcaattagatgggggaaaaactatgtgatctttcaaatgttgtttgttcaaagcagaatgatttatgtgttacgaattcgccagaataattttaatttagccaaccaaaaaaaacataatttgtaaactttttccacgttttaaactatttgtgaaatgtctccaaaatgaaagaaaaaggttatgccaccgacaatattttctaccttgtacaaagaaacaaattgtttattcaaagttggtttggaaaagatactgatccaacggtcacggatttgaataacattgtttagttaatacaaccaaattattcttatgctatgtgtacctacttagaagcttacacagaaaaaaaaaaaaaaaaaaaaacttctaaactttggttttcttttttttcccatcatttataatattcacgtgttacataataatttggatgtatataataaatgatccaataattaacaaaataaatctgatcatccaatcataataaagttgcgcatactaaacaatattttattttcctaaacacaacttctttgatatatggattggtcgataagaataataagatatgggttttaatagaagacaatcaatcttcaggggctttcttgaaattacagcgtggtaaaaaacaatgacatcaatctggacccgatcacgaggacccggatccgtatcgataaacagtgtagctttcactaccccattttcccagaaacacctctcaaaaatttctcaagaacttgtataaatatctcagtttcgttcacgcagtgtcttttttatttttgtatttcttttttcattgttcaccaactcctcttgaaggtgggacagagtccagctccaccaccaccatagccatcgcgtcgttttctccgggacccacttatttcgtgacgtttctctctttgtatatacatacaattgttttcagtctcaatttgctgtccacattttaacacaactctatctcaggggtggtgtctgaatctcgtctctctcattcctatttatcccaatctaatctatcacaaacccttccacattgcttttgtcagtctgtaaaattctctttgaatcagtgaatcactcacttaaatccaaaacagtttttttttctttctttctttatttgcttgttgtggaatcaatagctgtctccgggaaaattcgttttttttctccttcgggatctctttttttttttttttggttttatttaataattatccccgagccaacatttattgtcgattcggtttatttcgtctccttcgtcttccactcttactagtgcatgctctgaatctgtatgta

SEQ ID NO: 4562 - DNA, 3000 bp, Unknown
  misc_feature (1)..( 3000): cDNA_ID_1580932_gDNA_ID_1620714_Annot_ID_49074 3000 nt of promoter + ATG
atggattaggattagcttatattattgtaagaaaatattattactttttctaaagtacattttttgtatttcatgagaaaattataaattcaattccttcttcactaagagatggaaaaatggcttgtaggtcaacaaatttttgttatttctttaatgtcttgtctctttctaaccaaaagcatacaagaggtggtctcatgatttcaaatttaaattttcattattggatacactttgacaaaagccccacttcttttctgtaaaaagttgaaatgaagattcattattggtgtatcataatattattcagaacatccacaagcgaaacgtgtcttcatattttgatcggaactttcgtattaatgccgcagtagtaagaaacaaaaataaaatttgatcacttagacaaaaatgagttcgctacatacgctttagttatagtcatcactcatcatgtatatctaaaataacaatttaaaaaaatgtaagaatttgactcaaaaaaataaaaagggaacaaagtccgacctgccggaatcgaaccagcgacctaaagattacagcaactactacagtcttccgctctaccaactgagctaaggtcggataattattagtatactcacactatagaaatatagcgcttatactttaatatgggcccctaatgggcttgattagaaggcaaattatatgcgtcagcacaatttgaaaagaaccaaattagtcaagtgatgatggagttcgaccctaattaggactcccataaacaaaaatccagctagcggactacatacatcgttaaaagactattggcttgatagttgatactgaacaacaatatgaatttttaatttatttattttttgattaaaacttatatattaatatttaaagacccatccctaatatgctattttatgatgctgctaacttatttaaactaaccaatttagactaatggatgaacaccaagaatttggacttggaccacaaaacaatgcatagtatatttggattcttgattaatcaataaatttgaagttacatgcatgatgattatttatttttcgtcacatgcatgatgattaattaagatggcaaactccacgtgattaattaagaacttggtgcgtcataaatttttttaaaaaatatcaggggtgattcgactaacaaaatacgacgaaccagacatgttttgtttttttttacatttggaatttcgaagttaacttttaagaacccacttgataaatcatatgtacaaattaatgagaaattgtagaatgccaataaaaattgtgatatccaagaaaactaagcaaaatatatttattttctaagcaaaacatgtacactttttgagcaaaatatgttgaaacagcagccaagcgtaggactttgatttcagctgatggagaaggaaattcaaagtcatatccaatttattatgattatcacataattttagctgtaggattttcagataaaattttaccgaaattctcggcatataaattttttagaaatctacaatctgttgtaaagattttataaatacttatctgaccaagtcactagctcgtcaaggagatttcctcttcatattcattttcaaagacaagtgttttgttttctcatcgccacctaagatgtagataaaacaacatattttatttattttttctaaaaccgcgtacaacatgacatgcctagggagttctaacaatgggaaatgagcattcatgggggatggttgaagacattcctcctcattctcctacatgtgatgagatgtgcatcaatggtattttgtattatggagcttttattgacacaaattctaactgaacctgcaatcatgagttttgatgttaggtctgaaaagtttcttcttatcaagggactcgtcaatgccggtgttaactttcttacttcttaagagctaagaagatcttatgaggggcagctagctgtacttttttttgaaaattgagttatttgtatgtttgccttgtgggttttagaagatgttgtgaatgaggaatggtcatacatgagttttgatttctctagtttagctgggttgacaagagacttggaacttcaactgtttagtgcagccaacgcatgaaaagttgtttacgcaccattttgtgtgtatgcattgacatatcatgttgtttattatgatccaaaaaatgaatttacttttgaaaatttgagagagaaagaattatagaaaaacttgttcctaaaaactctcaacctagattgaataagtattattttccacttttagcaaaacacacttacaaattgaaacatcttaggtggataagaaaccaaacaaatagtcacaaaaatatcaaacaaattttttaagaataaaaagactacttttatgtaaatagacgttagactcaattaaaataaagggaagacacaaatttatatggatttcaactttcaataacgttaaatgtgatatgatatgctcatggcaactaggatcagaattccagttgtggcaaccacacaaatttctgagcttcgcagaatccgaatcggtgtttcacctcgtaacttagtcttgaacgcctagaagcaaaccaaatcaatttaagttgtaatattatatttattttgtgtagattgctttaatctgtgtatcttgtaatctttatatttctgtcaaaaaaaaaaaaatagtactatttaaccttttactaaaaaatgaaaatgtgatatgggaaatttcaattgtaatattactattgtagagaaagaagtcagaaattcaaaagaaaaaccaacgtaatgcccaacttaataaacatgggctttgtttttgaaagaggcccgtatagatattgacctcaaacttagggaaaccctaatataagagcaaaccctagcagcgctatctccctcagcctcatctttcacccactactattcgccgttcgcttttccctcgccgtcgaaatcaac

SEQ ID NO: 4563 - DNA, 3000 bp, Unknown; identical to SEQ ID NO: 4557
  misc_feature (1)..( 3000): cDNA_ID_1824713_gDNA_ID_1620714_Annot_ID_49075 3000 nt of promoter + ATG

SEQ ID NO: 4564 - DNA, 3000 bp, Unknown; identical to SEQ ID NO: 4556
  misc_feature (1)..( 3000): cDNA_ID_1808757_gDNA_ID_1620714_Annot_ID_49080 3000 nt of promoter + ATG

SEQ ID NO: 4565 - DNA, 3000 bp, Unknown; identical to SEQ ID NO: 4555
  misc_feature (1)..( 3000): cDNA_ID_1824700_gDNA_ID_1620714_Annot_ID_49081 3000 nt of promoter + ATG

SEQ ID NO: 4566 - DNA, 3000 bp, Unknown; identical to SEQ ID NO: 4554
  misc_feature (1)..( 3000): cDNA_ID_1824697_gDNA_ID_1620714_Annot_ID_49082 3000 nt of promoter + ATG

SEQ ID NO: 4567 - DNA, 3000 bp, Unknown; identical to SEQ ID NO: 4553
  misc_feature (1)..( 3000): cDNA_ID_2998684_gDNA_ID_1620714_Annot_ID_49087 3000 nt of promoter + ATG

SEQ ID NO: 4568 - DNA, 3000 bp, Unknown
  misc_feature (1)..( 3000): cDNA_ID_3073590_gDNA_ID_1620714_Annot_ID_49089 3000 nt of promoter + ATG
tggttatggcactaacttaacatatatattttatattttcaatgtttttaagaaaatgaaaatagtaaataataaacaagagtaaataaaagaaagcaaacaaaaaaagaaaatagcaactgaaatgagaaacaagagccaagaataattaaagaaaagtacgtaaaagtggtaaaaattaaaatagagttcaaaaagaagtgactaaaacccatactacaactctataacctcgtttgggtctcgctagttggaactttgacttttgatggctcaatcattaggatttatgcctaaccttaattagttaactcctatgattggatgatctaattataattaatcggtaaaggcacttttatcattggaattttaattaaataactgcgtacctatattagtcgttacatgtgattactgtatcagactatcagtgataaacataggtttttcttttttcttaacataacaacatggaaagaggttaagcgccaaaaataaaaaagactttctaatcgtaaaatagctagtagctaccgacagattgtgagtgcgaaacacacataacacagtagataaaataattgaaaagtagttaaaatagttctcttctgttttttttttgaaccagttttaacacgaaagaaaaagacaccagtcattgacctatcataataatatacacaagatttggcttatttaaatgtaatcccgaagagcgaatattaaatactcctctggatagcacaataattcgattctaacaataaattagaatatattgggaaaagtttaacaataaattagtactaactttttcctgtggatagcacaataattcgatcctaacaacaatgcctgtctattttagtcgccagtttcaaaatactgcaatacagtgaaaacattttaaaacacatgcttcatcttatctttttggctattcttcacagtggtaagtttccgtcggtgccgatattatatgtttgtgctattaattaatcatgaattgtataaatttccagatttgttggtggagccttgtaggccatcaaaagcttttgatttttgaacaaataatggcccatatatcgaccgacgaatatttgtactcccatgaatacaacaatctagtttcaagtaaaaagtgttcaaaatatttcagatttttgtatcgtagttttaaaagactaaaccaattgtataattacatttctattttccagctgcttggccggctgatatggcaatttttagcaacatttatataggagcgtattgtatatttttgttcacctgtggctatcttgtattcattttgatagaaagactaactttgtaccattcaaataatgattcggttatcatttcgccatcaaataatcgatttatacctaatactgcgaagatagagacattttaacaatactatttacgatagttcggtagaatatagtaatctatgcattgatgacatcgtcggctctaatcagcttttataatgcttattaacatcattatggcatattcataatttaatcgaagtaacctagtttattttaatgcatttagatcaattagatgggggaaaaactatgtgatctttcaaatgttgtttgttcaaagcagaatgatttatgtgttacgaattcgccagaataattttaatttagccaaccaaaaaaaacataatttgtaaactttttccacgttttaaactatttgtgaaatgtctccaaaatgaaagaaaaaggttatgccaccgacaatattttctaccttgtacaaagaaacaaattgtttattcaaagttggtttggaaaagatactgatccaacggtcacggatttgaataacattgtttagttaatacaaccaaattattcttatgctatgtgtacctacttagaagcttacacagaaaaaaaaaaaaaaaaaaaaacttctaaactttggttttcttttttttcccatcatttataatattcacgtgttacataataatttggatgtatataataaatgatccaataattaacaaaataaatctgatcatccaatcataataaagttgcgcatactaaacaatattttattttcctaaacacaacttctttgatatatggattggtcgataagaataataagatatgggttttaatagaagacaatcaatcttcaggggctttcttgaaattacagcgtggtaaaaaacaatgacatcaatctggacccgatcacgaggacccggatccgtatcgataaacagtgtagctttcactaccccattttcccagaaacacctctcaaaaatttctcaagaacttgtataaatatctcagtttcgttcacgcagtgtcttttttatttttgtatttcttttttcattgttcaccaactcctcttgaaggtgggacagagtccagctccaccaccaccatagccatcgcgtcgttttctccgggacccacttatttcgtgacgtttctctctttgtatatacatacaattgttttcagtctcaatttgctgtccacattttaacacaactctatctcaggggtggtgtctgaatctcgtctctctcattcctatttatcccaatctaatctatcacaaacccttccacattgcttttgtcagtctgtaaaattctctttgaatcagtgaatcactcacttaaatccaaaacagtttttttttctttctttctttatttgcttgttgtggaatcaatagctgtctccgggaaaattcgttttttttctccttcgggatctctttttttttttttttggttttatttaataattatccccgagccaacatttattgtcgattcggtttatttcgtctccttcgtcttccactcttactagtgcatgctctgaatctgtatgtaatgggagttcaacagtctggatccattatcctagccgggtcgggtcaaggtctttgagtaagagagacaattcgttttgattcggtgtagaagacatc

SEQ ID NO: 4569 - DNA, 3000 bp, Unknown
  misc_feature (1)..( 3000): cDNA_ID_1824798_gDNA_ID_1620715_Annot_ID_49092 3000 nt of promoter + ATG
gaggttcatgaagcttgatccatgactatatggatccatagactagttctctggttggtgtaagaaggagcgggaaagattgtttttggtgtgtgtttctagtgtgtttctggttaggtgtttaaataacaagaacaagagttaatagtgtctggtaataatatctggttggtgtttaaaagttaatggtgtctgttttaagtgtgacatgacaatcaactaccaagtatcaaccacataccgacaacaagcattcaataaaagccatatatagtcatctaatataattcatgaaaagtcagaggttcaaagatataaggttaagattgttttaccttctatgagccttccattcggtaattgtatccaattcttacacaacagacatcaatcattctagcaactgtatccacttctccatttaacctcaacaaaaacagcataacaaaaacaagtgttatgtcatgaacgtaagacacaataaatctacaatcaaatacaaaacaagtctgtaatcaaatacaaaacaaatctgcaatcaaacataagataaatttacgataacaagcaaacatatatgtacttaaccaacataaaactgtaatcaatcaaaataaatctgtaagcaaattgataaaattaaatctgagtgtactaataaacaaaattgcaaacaaatccaacgacaaaatcctagttctacgaacggcaaacgacggcaaatcccaagaaatagcagcaatcaaaggaagacaagacaaaataaaattgtaacaaaaaaaaatacagattcgttggaaaagacaactccatgagaacagagaattggacagcaacctatgagaactaattttcctatcatcaattcccaattgtgaaaacccctaatttctgaaacaaatataaaccctaatttactatctacaactgaaaacaaagagaaataacacagatttgtaccatttatcatgcagatgatgataatagcggctcaaacaagtaattatgacttgcaactctctcaattcgaaggatgaaatgttggagagattttgccggcagaagcgagagataaatatcatgatggagaagaacaagaaagagagagagagagatgaatatcacgatggagaagaacaagaaagagagagatcgtcggattacaatggtcgccggcgtcttgagagagatggagagaaagagagaggaaaaacagaaagagaaacacgagtgtttttttgtttcctccttttatttattttttctacccactcaaaacacaacatgtgtactcttcttagttttaagaaaatatcttaattaagatgtttatcttagctaagatttgttgatctcattaaatttaatcacttttatacttaagaattagctaagaattgtctaagaaccaaggttggagttgctctaaagtcacaacgtatttctgacttccacgtcttctatctatttacaatttacaaaatcaatcaagcttttcaaatgcggtttaaaattgattaaatcatagttttagatcacataatctaaatcaaatttatgcttgtattttcatttgattttgacagaaaccaaaattttggaaatgaaaattgcaaacaacaattacataacaaaagaactgttatggttttgctgttctttttgggcaaactagttatattgatagaagaacaaacttgaagtagcagacaagtagagagtgcagttttagccaaaacgttagctaaccgattagacttgcaggaaacaaaagagaacttgatatgaaaaaaaaaacgactaagaaaggcaatatcgtggagaatcccttgtagattgttcgtagaggtctttgtatttagcagagatataaagacttgagagtcggagaaaacgttgatggaggtcaattccattctagtcgctgcgatcaacactgatttcatagctaaagccgaggtgagtgtgtgcgtgttgcagctccatggtggaagactcgattgttctaagttttgaaaagccaccccattccgcacaaacctgcatttgcagtctagaccgtatcaataaagcaagaaacaacctctctaggagataagatatgtatggaatcctccgtacaaggaagaaagatcaaagaaaccttagtaataaaaaaactgcatggatctggatttttggtgtcaacatcctccattacatgtattctgtatatttctcaacaaccttgaaataatgaaattttcaaattggattttattaatttgagtgaaagactactaacaaaaagttcttatccacctttatcaaattttctccattgttatgtaatccaaataaacattgtcctgcgtacaacgcatcaagaacgtatgaaatcaatattgcaatttgcaattgtattagcttaatgaaaaccaaatttggtgaggattatattttgaaatattgtggtttaatgaaaacccgtaaatcttgacaaaaaaacaaaacaaaaaaatgagaacccgtaaataaacgttgtataagtaaacgtggcattatattttagtagatttacgggtttgagatattttggttgaggtttactatatcatttaaattgggattctatactaaatttggtgatttgaatttaaaaatctttcaagaaatctatcaaaaatattctcatataatatgagtatttgtttttttttgtaaaagtgttggtcatatagaattaaataattaaaaattggccatctttccagttgccgttgccagccgtttcctacttgtgctttttcacttttccgttctctcaaaccttttttctctgcttccgtttcgtttctccgttcaaaacaagatcgaatcataaaaagtttcctcctttttttcttctcgaaacaaaagagaattcttgacgtcttctactccattttccatcaatacccatttcttctatcgctctcgtttccaagaaaaaagagggttttagagagaagcaaaactcaa

SEQ ID NO: 4570 - DNA, 3000 bp, Unknown; identical to SEQ ID NO: 4569
  misc_feature (1)..( 3000): cDNA_ID_2166753_gDNA_ID_1620715_Annot_ID_165608 3000 nt of promoter + ATG

SEQ ID NO: 4571 - DNA, 3000 bp, Unknown
  misc_feature (1)..( 3000): cDNA_ID_1824794_gDNA_ID_1620715_Annot_ID_49093 3000 nt of promoter + ATG
tccattttgagtgtaccttagtttggtctttcttccatttttatttgtataccatgggcatcaatcagttgattaatatattgcaaatttggaataatcaatcaagcgctcgattatttatccatttagatctgacaattttatcactatatctcaagaatttctaatcaatggaaatgattcctataaataattttatagtctacagacagaaatttgtctaggtatcaaactatatggtaacccgtctctcttcccatcatgtaatatctttatatttagataataaataacattcgttttattgaagtaattaatattttctccaaaaaattccattagttaattatggttacaccaacaattgagaaaaaatatatttttaatttaattcattaaataaattgtaaactaaaagtttgttttttaattaagaagttagaagagaaaattggactttgattccaaattccgaacacgtattgtctatttttaaatcgttattagatttaatctagtaatagatttttttttcatatgtggattgttttacatttttttattattttattttacattttcatttgattttatttacagttttaagaaaataaacgatttcttttttgtattattcaaaaaaattgctttctttttatgtttacaccagaatacttaagttatgaatctttagatcaaaaaacaaaataaaaaatcacatggactcatgactcattagtatatcattacccgataaaatatgtttaatcatttgtgtaacaattattaaaattgtttttttttttttttgataaggtgaaacaataaataaaagttatacatgtacattacatccgtatatgagtgttcataattttggaaataaattagagacaattcctcttttgacagatcaaaacaagcacatcttgcaaactatgtgattaaattaaattttttggtcgtctcaacttgtgtgattaaatatgtatatgtgtactttcaaactactaacttaaggtattgttttggttttttataatccgtaattaaaaatccgaggattaaaagaaactataaaatgtaacccaaaaatatccaaataataatatttgtgaattgtgattaactaatcaatatacggtactattgcgtggtcagcttggatctcagctctcgtcggggcacatgagtttttggaatatacagcgaagaatcacgatgtgtactctcttttaatttagtttttatttctttggtttaacttttctaatataatattaatttttagcgtacggtatacacactcaattgattacaagttctcaagtctacttctcattgtaataatcagttctgaaatttttcaaatgtaaacagaaactttttttttttttaacagaaacttgtttcttgctaaatgtcattgctccacttttttcattccaaataatatcattagatgattaagattatgtattacaaaaagtagagaacctaaaacagagatgatccgtgccaaacaaaattataagaaatacaaaggacattagaaatacacaaactaagaatccttgggaaattagaatttttagcccacactaacacccaaccaattttcgatgttgtgtgttttttatatccaaccaagtttagaggttgtacacaaaaagaaaacacatgaaatattgtttttgaaagtgtgaagaaacccaagttgaaggagtctttaaaatattgatagaactttattagattttagtacgatagaattccaagaaagattacggagatctctttgccatatggtttctgtctcaatgattcgcttctatgttattgtgtaagatgatttatatatacaaatatgtacgagactcaatactacacatttccttagacaactcgaaatttattgtttattttaggaatcatatgtacttaaatatacatgcgcgtgtacatcacactctcggttttatatgaaatgcatgcaaaatactaatcctgagtttgctggtgcgattccattgattaattatcctaatttggcttaaaagaatggaaacaatgtcatcaaaatcctcaaattgtttaaaacgttaatttaaatcctcaattttccacgaaacaaaataaatatcaaatttctgtcgatttttcaaatactgtaaaataccaaacttttattgactttccaaataaataataaaattttgttgatatagccatattagacataccgttaagtgggataacaaatcctgctatcaaagttcattttctcttaatagactcgttaattgaaaatgacaacgttctctctaagaataaaacatcgtctttttgtcataacgggtcaattaaatttttaatttcaagtcatataggaatttaaggttaaagattttgctcgatttggggatccatgattgattgaatttggagattttgctcgacgtcactttgttttttttttgtttttttttcgctttgttgttatagaaaacaataacgttttgttgttatagaaagcaataatgttttgaattaacgggtatgttaataaaaaattaattttgttaacggaatctgttaatctacttaacatcatgtctaatatgaccattagcaaatattttgtatttattaagaaagtcacataagtttgatatttattagaaaaatcaacataaatttgatatttatttcgtttcgttggatgttgagaatttaaacaaatgttttcaaataaaagttggagattttagtgataattttccgataaaagaatgtcatttctttgagaatgccattacagttttaatttacttgatatgttaaaaacatttttgtgggcttaaccagggcccattaatccgagttaccaaaactcgcaactcgttaacactccgagtcattgactcagtatcttcttccaacgaaatttcaatttttcattgttcttgatgaaactgaggccacgacgaatcgcaaatg

SEQ ID NO: 4572 - DNA, 3000 bp, Unknown
  misc_feature (1)..( 3000): cDNA_ID_1824787_gDNA_ID_1620715_Annot_ID_49095 3000 nt of promoter + ATG
tggattaattaagatatcatacaaactaatcataatttgtagtctagtaccaaagtttgtattatcaccaattccagaatttatgcaagtttgccgataagtatgacaaacatgcatacatattctctttgtcttataaacccaaaatgttttagtatactctattcgtgccaaaaaaaaatatgaaagaaggtatcctccaactataatcaaacatcaccttttaaatgatttactaaaatggcacaagatcactcttgttctgaagttggttactagtgaaacatatatagaaaaatgaaaactggattagcaaaaaaaataatgtggaattaaaatgaattttaatcttctattttataatgaattgtaattggataaatggaaatgtttttcctatataagtttaaaaacataacgagacgaaaattttctaccgttaacaacaaagatgttcttgcaaataagataagcgtttttttattgcacaaatatatctataaattttagataaaatataaattcttacccattgagatttgcataatactattcagagtgttttttttccctttcgttaaagactactagtcagagtgttaatctagtaattcaccaattaatttaactatacttaaaaatattacagtttttaggaaacatgctagaaaaaacatatataattttgcaattatattattccatgcatacacatgtagagccaaaaacggagaaaaatcttctatataaacacaagttgaaaccattcatgtttattttaagcagttgcagtagactcttccacttctgtattcaattcttccttcttttttctcttataatataaataacatacaaagaaaatacttgcactcacaaatattgattaaagttaattagtgaaccctaagatttataaatctctagctatactctaccatatcatatatattacataatgtctagcagaaaatcacgttcaagacaaactggagcttccatgatcacggatgaacaaatcaacgatcttgtcctccagcttcatcggcttctccccgaacttgctaacaacagacgctctggaaaggtacaacgttctaatcaatttttcattatgattccttttaaaaaatttaatttcctctttcaaaccttaaatcttttctaaacctttttaaatcttccttggattagtagtgggtacttaaaagaacaaacctccggtttaaaaaaaataaaaataataactaatatatatcctccatcaaagtttaacagtaattctttcatctttctgttgttgcaaacaaacgagagtctttagttagaattataaataaatattaaactaatattccatatattccaatattgcatgtatgtattgattcatttgattgtgatgcattttgtgacgagtgctaaattttaatttccaaactaatcgacaataaatagcatgctgcatgcatgataattaaattgttaattatatataagatccttcttcttatcaatatattggttactttcaggtttcagcatcaagggtattacaagagacatgcagttacataaggaacttgagcaaagaagtggatgatcttagtgaaagattgtctcaacttttggaatcaactgattcagctcaagctgcactaatccgaagtttgcttatgcagtagaattagtgcaataaacgaaggatatttttttcttttcttttttttgaaaaaatgtcttctcagttttaattccccttcttattgtatttataatgtctggcagcttgtgtcccctgttaattatgcaatgttttatttttaatatatgtagggttttgtttttgtcagttgttgaacgaagcaaatggtttgggtttacgttcacattatttaaggcaacacactcaatatatgggcttaggtatttcttagattctaggcattccaaccaaatccatcacattttagtagcaaaaacattgattaaattttgaatttacgagaagaacaatgttttctagtgtcatgcatatacgattataacggtgtttttgtagttaatatcgataggaactaaactaacgcaagtcaaattttctgatcaaaattagtcgttaatttcgcttaatggtataaagtatattttaagaaggaataaaatatgctaataagcccccacggtttccatttctggtaacaagaataccattcaacgtctcgatcagcagcaacgttgaatcgttgatatctatatatagaagtatagaaccaaggggtaatttggtcattccagttctaacccacttctattacaagagcagtttactacgtaaaaacgaccggccttccactttcccgaaaacagccagcgcccgcacgtagagatttactgcatattcagttttcagtaaataaatagtccacaaaattagtggccttgcgtgtaaaaaattaaatttcgagatgctgtttaataaatgtatttattgcaaataagaaatcagatagcctttaatagttgacaaaaaatagccttttatatttacaagttcgtgtatttgttaataacgtgggattaatgagtttaatgtaatcgtgacaaaaacaaaagtgggattagtgtaatcgtgtgaatgtggacacttctccttcacggcaaaaggcacaagacgcaacaaatattttaatagaaaagaaaaaaaacgaaaacagacaacaaaacccaaaacaggaagacttaaacaaatcagaacacagtgtaagaaaaatcttttccataactgtatttttaactattcatatatatatgtttagtctctctgcagtttgaattcaaacatttgtgctctctcatctcaaaaactacactaaagctataaatcatcaatcatctaaaatcttcaaaaaggttttgattctgacttcttggttttcttttttgtaacgaattcatgatttttgagtctgattctgtgtttccttttgtttctcagca

SEQ ID NO: 4573 - DNA, 3000 bp, Unknown
  misc_feature (1)..( 3000): cDNA_ID_1824783_gDNA_ID_1620715_Annot_ID_49096 3000 nt of promoter + ATG
tttatgataaccttcgaaaagctcaagattcacctcaatggagttatttctccaaagattcaatccttgaacacatctcatatctggttccggtacaaaaactaagttaatatcacaacaagagtaaaatatcctatagcataaagtaaagtatgcatctcaagtgatgtctaaaggattaaaacctttatacctttcgtaaaattgagaggtgattgtccgattgagattgaaaagttagaatttggaggacaccgaggttgaatattgtatatgctaccatctgagacaatccctgcatcaagataatttgttgcacttcccttaaatgttgtagcctgaaaaaacacaagttaaaaaagtataagacagagagatttcacacactttcataatgcagacattgaactagaacatgaaacttaccaaaacattattcgctaaactaaacaaaaggtcagaggagttcattgcaaaaggcctccttagaagatttcttgataaaactagagaaaacataaacattagttccaatgagaaaacaatgtagaattatatgcttcatgataaagagaaaaatacctgctccaagagaatgattattcccagtgaaaagtatagttacagggcaagagttttttcgtctgcacgagtcattagtgaaattagcatcaagagcacgatactcaggacgtggaattagaatcaatggaggccatggttgtggttttgggatagcacaaaagaatccttgatcccgagtcgaatattctaaaccacaggtcatttggcatttaccatctccgagtttgtcaatgcattgacaaccacattgattatctaaagagttattgacttgtgaatcaaacaaagcttgaataaacacaagaactatgcagaggtagaaaggaatcataataagtcgaacattgctccatatattccgtttctgcaaaaaaaaaaaccaccaaagaagacaacacataaaaactaatccctagagttcccaatactacagagaatttacatgtaacaaaaatcgtacatggtcgcatatttacatgtaatagtggaattactaagggaaaatgaaaatgtcgaacctgataggttaagttttttctaagtatagcattggcacgcgtccagaaactggctgggccagaatctgccattgatatgaaagctttggtagctttcccttctttgttcttctcttttaatttttaaccatcgccaaaatacttttctttaacaataataatttagtttgatgttcaaatattttcttaggttttttatttcatttgaaaaaataaataaacattggaacttcattatatatttacaagaaactgcgaatgagtgatcctcacgaccctttcgatttgccaacatgcggatttaaaatatatattttgagagttactaataaaagatattattactattatattatagctaggtgttacgtgagcgcactatcgatataattcaaaaaatctaccaaatccttcctaagttcctatgtctatgtgatggttacttgaatgacaagtaatgtacggtccaacaaaaataatagaaaatatatgatatagttggaattgcctttttagtagacgaattgcgcgaggctttgcggtttactaatttttatgatatacttttagcttaatatcatcaacttgttgaagactcaaaagtgttttttgagtaaattttcttatttaaaggacaaacaacagaagcaaatttattctcttaagaaaatagtgaaaaaaagcctggaaaaatggttcaatgctctcttttctcaagtatttgattttcatttaaaaatcttttatttatgtttggccagttttgatggtatcatgcatgatgtcacaaccatactaactctggaattatctcttcaattttagccatggttatctgttattgataacaagaaaatcagatgatccaatagttcaatttttttattttagaattacagatcaaattttaaattttcacactgcaattttaactatgaacatagtagatcataaaccttacaaaggttcatttttttattttactttttttttttgattatacgcctccatattatgtgttttatagcaatttattgtttatacaaatcttatagaaaaacagaaacaaaataaattatagaaaaagaaaaacacaagaaattaatcatttatatgtagatgaacgtgtttattttgtccacaaaaatgtcttcaattttatattttgtcttttttgataaagattattatttttgatgaatgattttttataacatatttttgtcggccatatatatataacatttttttttttcttactaagaccataaatacaacatttgtttgctaattttagtacacagaaaagtacacattaagaattggatctcttgtttgacaaaatatactgaacaacattctttgacattcaaattaaaaatgattattaagtttgaacatggctagcttgttggactgttccaattatatcaatcaaatgtcacacttcatcattttcctatgtgaaatctacgaagccaaattttaaactaatgttgaatatcaaacgattacttcgtctaacttagaaaatagctcaaaagatctacaatataataattttaattatgtttttcaactctaataataacataatagtaatgattgcttacagtcaaagcctcaaagtaataccttttcctggtacagaagtaaatacatttattactacacggtttttgtccagaagttacgtttttccaggtagtttcgcaggcaaaatacgagaggcaaattcgtaattactcacaactccagagtcataaatataaaaaaaaaatcttacgcctctcttaaatcgtcccctccaatcaaaatcagatcacagtaagattcccaaaattcgaaaaaaaagcttcccagagagaagagaaaaaacttctctgaggcggccatg

SEQ ID NO: 4574 - DNA, 3000 bp, Unknown
  misc_feature (1)..( 3000): cDNA_ID_1824771_gDNA_ID_1620715_Annot_ID_49099 3000 nt of promoter + ATG
tcgcactcattgcagcatactatatggaccgagtttcttcatccgcgaaagacccttttttattcttgaaaaatctcatcaagaaatctccttctccacaaaggcatagcttgcagagactaggatcttctgtttccgtagaaatggagaaactagatgtcgttgaggaggtataacataatgattcacaatacatcatatgttctagttgttttgataaaaaaagaaatttattctaatcagagagcaaaagtcgagcagttgatgcttgagtcgagcacaagccatgcgattgtttgtgacaagctgaaaaaggtgtatcctggtagggatgggaacccacctaaaatggccgttggagggttatctatagctgtacctccaggcgaatgttttggcatgttaggccccaacggtgcagggaagacatcattcatcaatatggtgagtacataaatggatagaaaatcagttttgctgagcttcttattgaaaaactctcatgaataatacatatttttgttaggaaaaatagtggttaaaattaataggttttagactataaaacaattaacaatgaatggacatatgctcatatcttttatatgttagtgattaatcatctccatttttgttctggaatattccaaatatttatatgagtagatgactgggctagtgaaaccaacatctggaacagctcttgttgaaagtttggacatatgccaggatatggacaaagtatacactagcatgggtgtttgcccacaacacgagtaagtattcttgaaaacatttgaatctattccattgtatatgtgtcatcattctcttgtttctgttgtgtgctagcttgctatgggaaacactaacaggaagggaacatttgctcttttacggaagacttaagaatctcaaaggctctgatctcaaccaagtatgttatcatcttacttgtttcctacattaatactccaaaagtatcaaaacgttaactcatggttactaggctatagaagagtctcttaagagtgtgaacctatcacgcgaaggggttgctgataaacctgctgggaaatatagtggaggcatgaaaaggcgactaagtgtagctatttcacttattggaagtcctaaggtacaccattttctcttatggctaacccttaattcatatgatttaattagaaagctagctttaacaaatatattttttacatttggcttaattctttaaaaggtggtttatatggatgagccaagcacaggacttgatccagcttcaagaaggagcctatggacagctatcaaaggcgcaaaaaaacacactgcaataattctcactactcactcaatggaagaagcagagtttctctgcgacagattaggcatttttgtagacggaaggttacaatgcgtagggaatccaaaagagctaaaggcaaggtatggtggatcttatgtgttaacaatgacaacatcatcagaacatgaaaaagatgtggagatgttaattcaagatgtttctccaaacgccaagaaaatatatcacatcgcagggacacaaaaatttgagatcccaaaagacgaagttcggatcgcagaattgtttcaagctgtggagaaggcaaaaggaaattttagggtgtttgcttggggacttgcagacacaactcttgaagatgttttcattaaggttgctagaactgctcaggcctctaatgtcttctcatgaattacattatcatttttttatttgttcaaagtcaatatttgattgttcatgtttgatcaaattgaccatgcataggtttgattcatgtatattatcgtaataaatcgttttcaaggttgtaaatttctttgaggttcttataacttgtttatttgtagatgatttatgtataacaaattaagtaaattcctacaaaaagagaacaacgacacggagatgttagctcacttggttacatatggtatttcaattatttacagtttgcaccattattcttaaacatatggtagatcatttggttaaagttacgttgtacccaatatataattaaacaatatacggtaagcgtatatctcacagcattgtttaactttggacacttgacgttatagagatcgacgtcgttctaacgaaaaggccctatagtcaactaaattctttagatcgtaagatcttcattattttatcatcattatgtaacgtgattacgtacagatacgagaacatattttcccataaaaaattcacgtctccccgtaatcttacagtaataattaacattataaattattctttgtaaaataaacagctcattctccacataggttgaagaatttataggtcgtgggatcattcatttacttggaaactttcttgtaaaactacttggaattatttttctttgtcgacacacttaattgaagatttcgttggttgaaattacaagtaacaaatcattaataccataattcatggacacaactttaaaaaatgcacactagtggaaataaaagcgtgtcatatggatcttattgtgaattcatcaggacccaaaacaaaaggaaagataacacagaaaaacaaacaaaatcaagattacaagattaagcttcatcaatggggaatcatgttcccgcgggtttctttacgcaggctaattccttgtttagaaagaacttaacatatcaggtttggccaaacaattcatgtgttatattttaagaataatggtgcaaataattacttgatacaaaatccattgtaaaatgtaattatatcttctttttttttttggtttaaaatgtaattatatcttgatactaaatatccataattggtttagaaacggaacatatggagcaacgttcggctcatcgtgatccctttctacctctgcgtactgctagttggcattcaagtcttgttcgatacacaagttaataactctgctgataatcgatgtggttgtcgatgcatcgacaaaa

SEQ ID NO: 4575 - DNA, 3000 bp, Unknown
  misc_feature (1)..( 3000): cDNA_ID_2993832_gDNA_ID_1620715_Annot_ID_49101 3000 nt of promoter + ATG
gaaacactgacagggaaagaacatcttctcttttatggaagacttaagaatctcaaaggccatgatctcaaccaagtatgttatcattatcaatcttacttctatcttatattagtgcaagagtcttaaacgtcaattcatggttaaatattaggccgtagaagaatcactaaagagtgtgaacctatttcatggaggagttgctgatatacctgccgggaaatatagcggaggaatgaaaaggcggcttagcgtagccatttcacttatcgggagtcctaaggtacaaaattgtatcttactcatctcctaacaaaaaacttattgaagcccttatttgaatgtgatttagagagctaaagtttttcaagctttaacaattatttttggtttttatattaaataaaaggttgtttatatggatgagccaagcacaggacttgatcctgcttcaagaataaacctatggacagtcatcaaacgcgcaaaaaaacacgcagcgataatcctaacgactcattcaatggaagaagcagagtttctctgtgaccgattgggaatttttgttgatggaaggttacaatgcatagggaacccaaaagagctgaagggcaggtatggtggatcctatgtgttaacgattacaacatcaccagaacatgaaaaagatgtggagacattggttcaagaagtttcctcaaatgcaagaaagatatatcacatcgcagggactcagaagtttgagttcccaaaggaggaggttcgaatttcagaagtctttcaggccgtggagaatgcgaaacgcaatttcactgtatttgcttggggatttgcggacacaactcttgaagatgttttcatcaaggttgctaaaaccggcctttaactaatgtcttcttttgaatacttttaagattattagttatgtctgttccacgtcaatattttgcttgttcatgtttgataaattgataatgcagaggtttgattcatgtacattgttggctcttcgcctgcaagtttgcgaattagtctgaggtcttgtattagtttgtttgtggatgatgcatgtaaccacaatttttttatttaaacgtggctatatttaattgtggataaaccactgaatatgaaattttatttcatctaccattcagatcctaaatgtatatcttaccatttaattcatatagggtttacgatttaaaatttagaatttcgaaaatagtatctatattaaaagatagtaattaggtctttttttcattgaattttacttaaacattggtaaaatttcatatgccatcgaaaaaagaaaatatcactgaaaactatgttagctgccggagacaacatttctaaaaagaaagacaatttttaaaaaagactacaaaatactctgttgttcctttttgtttgattgtttagaaaaaaaatttgtttttaagaaattaattttttaagttttccatgcaatatttattggttaatattggtgaattgtaattttcaagaaaaatagttagttatcattggtttagagttataaaaaattgtaaaacactaaaaataatacatttataatcaaaatttaatatgttttcttaatatatgtgtttttctaaacaatataaaaaaaggaacagagggagtataaatcaaaactgttaaaccaaattttttaccaattaaatcttaattatatcaattggttcttctccgaaataagaaattgtcttgatgtctatgaaaatcacaaatttcactaaaaatttatggaggattcctaattaactttagaccaggaatttttcaaaaaataaatttaaagatgacattatcatgaacacattcaaactgaaatcaaaccaaagtaaatttattttccctgtaatggaccatagagtataaagtatttaaaactgctacttattaaatcaaagacttttgtgttttttattgtgtgcaaagactttttatgtttgaaaactgaaataagactgctagtaaaaatataaactgaaataagaatttttcttaggacatcataacatttttgcttcttgtccaagtaactgccacattggaaaaaaatgtttagatttgaacaaatctttttaaaatggtcaaaaaattatcatagtcaaccaaattacccgacacttttacgtgagacattaaaatagactagtttaatcgattatgttcacacgtgattacgtctgagatgacgtatgaatcatctttatacaaatacaaatatacagtaaacaaataattgaaactcacctcttccactagtcgaagaatctattggtcgtggcatcactctccttcgcagcttcctaccaaatttacattgaaaatattctccattgtcactttctcgatttcgtaaaattacctttttgttatttgaccaaaagaataaccccaaaaaaacaatactaatatattcgagaaaaataactaattaaaggtatacttaacgagaaattaaagcgtgtgcacaagggtattactgtaatttcacattccgtatctgatctctgttcttctttcctccgcctgctataaaccaaaaggcggtgactcgatttgttccttctaagttcaaaaattgggtttccattaggattcaatttttactaaccctaaaaaacagaatctaatacacagagaaaagcgaaggttgttaccttcatcaatggcggatcctggtcctgccagtttctcaacgagagccaatgccttgcttaggaaaaacttaacctatcaggtactttttccgttttcttttcctctacgcaatccaattatacacatacaaattttcgtttaatgtgagtaagattctgttctgggattttcgtttaatagatcagtttccacaacaaaattagtggctgatttattgagtagattctgttctaattatgtctttgtgtaaattgtgtgttggtgtagaaacggaatctatggagcaatatacggctaatc

SEQ ID NO: 4576 - DNA, 3000 bp, Unknown
  misc_feature (1)..( 3000): cDNA_ID_1838776_gDNA_ID_1620715_Annot_ID_49104 3000 nt of promoter + ATG
caaatatggcaagtcctggatagaagaaaatcaaaggcaagtgctgtacacagtacataatgtttctaaaatgacgtgcagaattaaaaacaagtttgtagcaattcagcagatttgcattcgcatcataaaagttggtttgtgtgtctgagattctttagacgttcaaaaatacatgcatgttatcctagattataccaaaataaagttcaaatactttatgcttagagacaatttcctcgaatagatccgatttctatagagaaatctcattacaagcaaaaaaaacagaattttcatttttctttattgcgaaacataatcattcttacttttgctcctgcaaattttttataatcgagcttatcaaccagttcatgttctatagatatcagcgccaaaccattcaatcgctcttgagatatagtcgaacgtaaataattttttatgagttttaattttaaaaaatttatcttcgtggaagcaactgaaaccagaatggtgagtagtatacgataaacgatcaatgtgtttggataacaaccatccattcttttcaaaagttccaacacttcgactagaagatagaaaacaactagtgtaagagattaatgtggagaagaaactaaaatatattttttatagagttttgatagtgatgaacaaagaagaaaaacaaatcgttgtagaatagagagaattaatgttttgaaattaaattgtttagtaaataattatttaatttttattttgagttttcgtttttgtttaaatgccaaaataaacattataaggaggacacaccactaaaccactacactaaaggaccttctcaaatttgatgcccctaattttttttataaaatctgctgtcggaaacctttgctttttgggcttctgcttcgggccgggcttgtgcgctatagaagtaaaagagtaaaattcatgaaataaagctattagaacatatccattcaaaattccaagttaagatattcccattaaaagtaattaaattaaataaataaaactatttttcaagacaaatcttttagaactagtttttatttgagaattctatggttctacattagaaacacactctctctcatacacatttttttagtggctaacattgtttgtgataaatcaaaattttttttaatttaaaatattaattagatagtttagatatcattagttttaattctttcttttatatatcatcaaaaaaatttatctatatattcaagctccattatgcatgaatttaacttgtatattaatattatttttatttatagtattacttaagattaatgcaatattaaattaacattgtcttagtgaataaaataatataatattaaaacaacttaaattttgcgtattaaatatcaaaatgttgaagggcaattggcaaaactaacgcacaaaaatattataattaagaaaatgacatcaacaaaagagatggctgatatattttgtattttgtatactatttccaattttgcccatttctctcttttcttttcctctttcctctctctttttcgatattttttctccagtctaattgtaactctctttcttctctcttctctctctctctctctctctctctctctctctctctctctatccgtttgcatcaccgatgacgtctattaaagattccaacttctttgatttgcccagaaaatgtttctgtaattctattaacttatcctacaaacaaaccaattcattcgatttcgatttgtttgtctgtttaaactattgattaacgaatgggtaaaaaaaactgtcagaatgttaccatcgtcaacgtcaccgctacaattaatcttggttatttgggttgccaatgttgtatcttagggtatagtattttttgatcaaagcggtttaattcagtcatttggatctacgttttgttctatactatttagtttcattctatactattttatttgtctgttttatacaaaacattattcactattttaaataatttgtattaaattataaaaaatttatgtttttataaaactattttaaaatttaattagttatttttatagcactaattcaacaattaaaatcatttggagtaatattatttttttaacattggattattgtctcttcttccacacatctcatcacatcctctttagcgcgtgtctctcaatgttgtaccattttgtcttttcactacttcaatatgttagtttcttaatatttttgaatatagtgttatattattaattttatattagattttggttatacagcaaattcacgcaatgttgaaatatatgaaaaaataatttttaattctaaaatctcagtctttttaaatattgttttgcctttcctaagatcatcgagagagaagaaaagggaaaacaaaggatcttccatgggcgatcgctgagaagatccgcaagaacaaaaacatcaaattccttgaaatcaggaatcttattcgatagtctatttgagcccttgatctggtaagctctgtctgatcttctaaagtttcgctttttaacttttggggaaatcatccacctttgtatcaagtttctggcaatttcttctctgtagttagaatcattcaataagccctttaatctcttcgacgcagctagtgttgaattacatctgggttttgtctactttgtgtcaaaaccatgcttttatgtttgattttcgcgaagtatgatttaggttcgattttagtgaaagaaagacttaacagttgtagttaactgaaactatgcgatatctgattacgttggtgttatgattttattggaagggttttggaaatgattccacattgtattgtagatctcattgacttttggtttttgatctgtttctcaatccagattctttatactttagtttaacaagtgacaaactttgatctttgattggttcaccaacgtctttgaaggttttttatttggtgaaagttttgaaatg

SEQ ID NO: 4577 - DNA, 3000 bp, Unknown
  misc_feature (1)..( 3000): cDNA_ID_1824753_gDNA_ID_1620715_Annot_ID_49106 3000 nt of promoter + ATG
tagatataaaatattcgaatatcctatgatcatttctatttgacaacatatccaatgattatcataataattattaaatttactaactatgttaaagagtaagtagttaaataaatagtttggtagttagtatcagttatcaaaccagagagaatcttttagactcgatcaaacaaagaccttccattacaaaacctcaaaagttgaagtcaataaaaatctcttacaaccacaacaacttctcagattcttcttcgctttgttgttcgttctcttcttcaagctctctgtctctccaaatgggcgacaccggtagacacaaatggttctccttccaccaccaccgttcagcctccgccacaactatgccacaacacaacagccccggcgaaactccaacagagttcctctgtcccatcaccggctttttgatgtcagaccccgtcgtcgtcgcttctggtcaaacatttgaacgtatctccgtccaagtttgccggaatctcagttttgctccaaagcttcacgacggaactcaaccagatttatccaccgtaatcccaaatctcgccatgaaatcaacaattttaagctggtgcgatcggaacaaaatggaacatcctcgtcctcctgattacgcttacgtcgaaggtgttgttcgtacccgaatggattcacttcctccgggttcgggtcatcggatcgctaaatccgaaatcttaccaccggtggctgagaattcaaattcaaattcagattacgattccgtgatgggagcgattcgatctcgttcaaggacttcattatcgtcaactacttctcttccacttcaccaaacccgacccattaatcactcgacccggatccaaagctcattctctacatcggattattcatcttttcctccgatgtcaccggaagaagaagagatctacaacaaattgacaagtgttgacacaatcgatcacgagcaaggtctgattcagctaaggaagacgacgagatcaaacgagaccacgagaatctctctttgtactgatcggattctctcattactccgatctctgatcgtttcacggtacaacatcgtgcaaacaaacgccgccgcgtcgattgttaatctctcgttagagaaacctaacaaattgaaaatcgtacggtcaggattcgttcctttgttgattgatgttttgaaatcgggatcaacggaggcgcaagagcatgtaatcggagctttgtttagtttagcggttgaagaagagaacaagatggtgatcggagttcttggtgcggtggagccgcttcttcacgcgcttcgttcatcggagagtgagagagctcgtcaagacgcggcgcttgcgctttatcatttgtcgttgattccgaataaccgaagtaggctggttaaagccggtgcagtgccgatgatgctgtctatgatcagatccggtgaatcggcgagcaggattcttttattactgtgtaatctggcggcttgttcggaaggaaaaggtgcgatgcttgacgggaatgcggtgtcgatactggttgggaaattgcgagaaagtggaggagctgagtcagacgcggcggcgcgtgagaattgcgtcggggctttgttgacgttgagtgtagggaatatgaggtttagaggattggcgagtgaggcgggtgcggaggagattttgacggaaattgtggagagcgagagcggaagcgggcggttgaaggagaaagcttcaaagattctacagacattgagaggcggagggagtgaattcggtgaaggagcggaggcgcgtgagtggaaccgtatgttggaagcgagtgggctaagtcgttctcagtttcaacaaggagggcaaaaagggggttttgcttattcctctcagttttagctctattcaatttttttattttcattttcttatctcttttcttgttggtaaatttttttctcaaatatttgtttttttttcactcttttttgtgactaatattttgggagtgaatttgtaatatctgattttaatcttctttaatttgtcatttctaatgaaacgacaaacagtaaaatgttgattatttcgtttgtaaagagttgctcttgtttaatttgtgaaaacgttagacaaacaaaagtcgtctcgtggagagttactctgtttggtgtaccgtcttcagatcttttgattaaagtacgtaatataagatttggaacgaagatttagtcgttggtcaaataattctaaggtcaacgtttcaaagtgtaccaagttggaatattctacaattattttgcctgaagtcatgtaatccaatcgccaatttgccattcgtcatgcaaacacgtcatgggtacatagccacacatactctatggaccctatttatatgttacgagaatagctggacgtgttgaatcttctttctgctagagaattaaccacgagcgaattacactagtgttagacagtgtctggtacaaccgtacaagtgacaacattccactattaattagaaattaaactcttgttgcatggtaagaaacaatttgtttttaggttaacttttcaggagttatggactgagaggcccatacatctctccatggatatgaaacaatttttgatcttttgcttgatgccttaacatgccagaaataaaaatgctaggtgacattttctttcttttttatttttattatgctagatgacattatcattgaggcataaccgttgtattggtttagtattgccgttgttgcttctcctgaactcagggactttaattttattgaaccggcccctggattgaataaaaaaataaaattttgcacccaaaacccaaaacaaaaaaaaaaggaaccggatctaatttataccgagaatttagtcaaccggcccagatttcactaaattttgtgggtaagaaataaatcacttcaaaacaagaagagtaaaccgatctgaatattgcaccggtcagtcgttttcctacgag

SEQ ID NO: 4578 - DNA, 3000 bp, Unknown
  misc_feature (1)..( 3000): cDNA_ID_2992641_gDNA_ID_1620715_Annot_ID_165628 3000 nt of promoter + ATG
agataaagaaaaagaagtgaactcttccttatcgctctgaaactcctccaaatacgctgaaaatgctggccatttggttgggaaagacaccatcttcattaggtctgaacagtctgtgaaaaacctacttcttggttgtcggcaccaatcatacacttcattgtccagaataaagcgtcgacttcaaattatctgttaatgaaaacatttacactatttctttgaattttgcatttaaattattttgttaaaaaatcaaaagtcaaaaacttaaatcttttagatgataattcttgatattaaaataaaatgtcagaacaaaatttatgaaattcactcaaaattcatagaaaaaaaaaacactgaaactattcaatatattttatttgttttgagataggtgtcaaatgttttattcgaataacacgtctagttaacgtgaaaggtgaagccatgcactaatcacatcgttaatatcccctaatactatcctaatactatacactagaatttttcaaaacgacagtgtttttctgtgacaaggtaaagagaaagaaatatctcccaacctgtcaacacttaaaaaaagacataaaagtctgtggcgaccaaaagaagtgagagagaaagagagagatatgatattattaagtagtagtataagcctctcaagaccagtttcttctcaaagcttctctccacctgctgccacttcaacaaggtatggttttatgttttgaatcacaacttcattagctccgattaacctcaagatcattaatttagttataggtttaggaacaaagttacagaatcagatcctggaatggaactatcttggattatagagattcttggtttactgatctcagaaattctgttttctcttggtttcacttatgacaggagatctcattcctctgtcacagtcaagtgctgctgttcttccagaaggttgttgaagaatcctgagttaaaatgttccttggagaatctctttgaaatccaggctttgaggaagtgttttgtttcagggtttgcagctattttgcttctctctcaggcaggccaggtatgttggagccgacattgctataagcatgttcgattgcaaccacaagcggtctgaaatttctgagtttcttctggcagggtatagcgttggatctctcatctggttatcagaacatttgccaactagggagtgctgctgctgtgggagaaaacaagctgactcttccatctgatggtgactcggaatcaatgatgatgatgatgatgagaggcatgactgctaagaactttgaccctgttaggtactctggaagatggtttgaagtagcttctcttaagcgtggatttgcaggtcaaggccaagaagactgtcattgcactcaggtaattgtttcttcaagtccacaaattgtgaaaacacatcctctgctaacatagtgtgagaacctttcaactgttgcagggagtatacacgtttgatatgaaggaatcagccattagagtagatacattttgtgttcatggcagccctgatggatatataacaggaatcagagggaaagttcaatgcgtgggagcggaagacctcgagaaaagcgagactgacttagaaaagcaagagatgattaaagagaagtgtttcctacgatttcccaccattccttttatccccaagttgccttatgatgtcatagccacagactacgacaactacgcacttgtttctggagccaaagacaagggctttgttcaggtgattctaagagaaagaactcatgagtttgagaaatatctcttgcactgatctcttatataaacctaatgtgtttgatatgttaggtatactcaaggacgccaaatccaggacctgagttcatcgcaaagtacaagaactacttggcacaatttggctatgacccggaaaaaataaaggatacaccacaggactgtgaagtgactgatgctgagctagcagccatgatgtccatgccaggtatggagcaaacactgaccaaccagtttccagatcttggattaagaaagtcagtccagtttgatcccttcacaagtgtgtttgaaaccttgaagaaacttgtaccgctctatttcaaatagagcaagcttctttgctcaaattcttatgtagactataatcactgtccatatatacatatcttccagaatcaaaacactcttctgatcataacaccattgattagagaagttgcatacactccacagagaaaccaaaagtactaatcttgatgcgccaaaagacaaaaaccatcaacaacaaacacaaagatatctctttagtattagcgattttatcccacatcggatcttaagtggtatatataagatatgggtctctccacatattgtcaattggttttaggttggaagtccacaatctaatatggtaccagagcccgatccgcacatactcaacccaatccacatcggccggacccaatacttggatcggatcttaagtggtatatataagatataagcctctccacctattaccaggtaggttggaagcccaccgtctaatatttagtactcacaataccatataagtaaaccaagcaagatactcactttcggagtttggatatctaagtgagatcttcttctgcttcttcgttagatcgcactaaaataatctggagaataaatcaaaacggagaatatcaacgttgagaactaccccgtgaagcactgatacctagcactaccaaacccaaaaggtgtatcaaaattcttgaatattaaatgggctttttaaacatatattattgggtttgcaagggtgaaaggcccaaattcgtcggtagatacttaaaacaaacgacacacgtttctaacctctcagagcaaaacgtcatgcaagtcgaaatcccatcgccgtatgatcacggaagcagaaggcaacggcgaattcgacgaacggaagaaacccaaaagcagaagaagatg

SEQ ID NO: 4579 - DNA, 3000 bp, Unknown; identical to SEQ ID NO: 4576
  misc_feature (1)..( 3000): cDNA_ID_1838776_gDNA_ID_1620715_Annot_ID_165620 3000 nt of promoter + ATG

SEQ ID NO: 4580 - DNA, 3000 bp, Unknown
  misc_feature (1)..( 3000): cDNA_ID_3073689_gDNA_ID_1620715_Annot_ID_165617 3000 nt of promoter + ATG
actcataagtaacaaattaagcattcattttttttttggctagatgactggactcgtgaaaccatcatcagggtcagcttttgttcaaggtttggacatatgcaaggatatggacaaagtctacattagcatgggtgtttgcccacagcacgagtaacaaattaaattcttgtaacatatttgttgttgttgaatgaagatcattattaagtttacgtgtttcctaacaatcatatagttattttattgttctcttatagtcttattgttcgtcattgaccagcttgctctgggaaacactgacagggaaagaacatcttctcttttatggaagacttaagaatctcaaaggccatgatctcaaccaagtatgttatcattatcaatcttacttctatcttatattagtgcaagagtcttaaacgtcaattcatggttaaatattaggccgtagaagaatcactaaagagtgtgaacctatttcatggaggagttgctgatatacctgccgggaaatatagcggaggaatgaaaaggcggcttagcgtagccatttcacttatcgggagtcctaaggtacaaaattgtatcttactcatctcctaacaaaaaacttattgaagcccttatttgaatgtgatttagagagctaaagtttttcaagctttaacaattatttttggtttttatattaaataaaaggttgtttatatggatgagccaagcacaggacttgatcctgcttcaagaataaacctatggacagtcatcaaacgcgcaaaaaaacacgcagcgataatcctaacgactcattcaatggaagaagcagagtttctctgtgaccgattgggaatttttgttgatggaaggttacaatgcatagggaacccaaaagagctgaagggcaggtatggtggatcctatgtgttaacgattacaacatcaccagaacatgaaaaagatgtggagacattggttcaagaagtttcctcaaatgcaagaaagatatatcacatcgcagggactcagaagtttgagttcccaaaggaggaggttcgaatttcagaagtctttcaggccgtggagaatgcgaaacgcaatttcactgtatttgcttggggatttgcggacacaactcttgaagatgttttcatcaaggttgctaaaaccggcctttaactaatgtcttcttttgaatacttttaagattattagttatgtctgttccacgtcaatattttgcttgttcatgtttgataaattgataatgcagaggtttgattcatgtacattgttggctcttcgcctgcaagtttgcgaattagtctgaggtcttgtattagtttgtttgtggatgatgcatgtaaccacaatttttttatttaaacgtggctatatttaattgtggataaaccactgaatatgaaattttatttcatctaccattcagatcctaaatgtatatcttaccatttaattcatatagggtttacgatttaaaatttagaatttcgaaaatagtatctatattaaaagatagtaattaggtctttttttcattgaattttacttaaacattggtaaaatttcatatgccatcgaaaaaagaaaatatcactgaaaactatgttagctgccggagacaacatttctaaaaagaaagacaatttttaaaaaagactacaaaatactctgttgttcctttttgtttgattgtttagaaaaaaaatttgtttttaagaaattaattttttaagttttccatgcaatatttattggttaatattggtgaattgtaattttcaagaaaaatagttagttatcattggtttagagttataaaaaattgtaaaacactaaaaataatacatttataatcaaaatttaatatgttttcttaatatatgtgtttttctaaacaatataaaaaaaggaacagagggagtataaatcaaaactgttaaaccaaattttttaccaattaaatcttaattatatcaattggttcttctccgaaataagaaattgtcttgatgtctatgaaaatcacaaatttcactaaaaatttatggaggattcctaattaactttagaccaggaatttttcaaaaaataaatttaaagatgacattatcatgaacacattcaaactgaaatcaaaccaaagtaaatttattttccctgtaatggaccatagagtataaagtatttaaaactgctacttattaaatcaaagacttttgtgttttttattgtgtgcaaagactttttatgtttgaaaactgaaataagactgctagtaaaaatataaactgaaataagaatttttcttaggacatcataacatttttgcttcttgtccaagtaactgccacattggaaaaaaatgtttagatttgaacaaatctttttaaaatggtcaaaaaattatcatagtcaaccaaattacccgacacttttacgtgagacattaaaatagactagtttaatcgattatgttcacacgtgattacgtctgagatgacgtatgaatcatctttatacaaatacaaatatacagtaaacaaataattgaaactcacctcttccactagtcgaagaatctattggtcgtggcatcactctccttcgcagcttcctaccaaatttacattgaaaatattctccattgtcactttctcgatttcgtaaaattacctttttgttatttgaccaaaagaataaccccaaaaaaacaatactaatatattcgagaaaaataactaattaaaggtatacttaacgagaaattaaagcgtgtgcacaagggtattactgtaatttcacattccgtatctgatctctgttcttctttcctccgcctgctataaaccaaaaggcggtgactcgatttgttccttctaagttcaaaaattgggtttccattaggattcaatttttactaaccctaaaaaacagaatctaatacacagagaaaagcgaaggttgttaccttcatca

SEQ ID NO: 4581 - DNA, 3000 bp, Unknown; identical to SEQ ID NO: 4573
  misc_feature (1)..( 3000): cDNA_ID_3073693_gDNA_ID_1620715_Annot_ID_165612 3000 nt of promoter + ATG

SEQ ID NO: 4582 - DNA, 3000 bp, Unknown; identical to SEQ ID NO: 4572
  misc_feature (1)..( 3000): cDNA_ID_2166760_gDNA_ID_1620715_Annot_ID_165611 3000 nt of promoter + ATG

SEQ ID NO: 4583 - DNA, 3000 bp, Unknown; identical to SEQ ID NO: 4578
  misc_feature (1)..( 3000): cDNA_ID_2992641_gDNA_ID_1620715_Annot_ID_49108 3000 nt of promoter + ATG

SEQ ID NO: 4584 - DNA, 59 bp, Unknown
  misc_feature (1)..( 59): cDNA_ID_1824741_gDNA_ID_1620715_Annot_ID_49111 3000 nt of promoter + ATG
ctttttgttttcataaaggagcctaaacttgggcgtcatatggtggacaggctcagatg

SEQ ID NO: 4585 - DNA, 3000 bp, Unknown
  misc_feature (1)..( 3000): cDNA_ID_2157010_gDNA_ID_1620716_Annot_ID_49112 3000 nt of promoter + ATG
cacaagcaaccagaacatcaggcttcccgccccatttctccatcgcttgtttccttgtttctttaccaatcaccgcgtgaaagtctctgaccatcataggataaggatgaggacccgcaacggatcccaatatgtaatgtgtagtctccacattggtcacccaatcccttatagcttcagaagttgcgtcctttaaagtggctgttccagagtggactccccttacctacaagcatcagacttagataacaatttgaaagcattgcgattttgcaaggtttacgcagagaattcacatcacctcagcaccgagaagacgcattctgaacacattaagagcttgtctctccatgtcttgagcacccatgtagataatgcactgcaaaccgaaacgtgcacacacagtagctgtggctacaccatgttgaccagcccctgtctcagcaataattcgtttctttcctagacgcttggcgagaagagcctgagccacagcgttgttgatcttgtgagcaccggtgtggttcaagtcttcccttttgaggtatatgagcggcccttcaccgttttcacggcggtaatgctccgtgagcctctctgcaaagtaaagaggactttcccgaccaacgtagtctttcaagatctctgctaattctctctacagattcatcaaacattagttagacattgcccaacaaacgaactaaccaaaaagacttctaacttacatcacacagaagcatgtaatgctgaagaaactaagaatatgaaatgaatgtcgtttccagatttctggaaaaatacaacactttcccagaattacatcctacatcgcaaacaaatcgatttgtcccatacggcttaacattgtttggcagattattttttagaattggaacaaaaaaatccgttttttaaactttatcactagccatggcaatgacaacgcttgaatcagaaactcacaaagccaaatcatttcgaatcgattcaaaaactatgaacaagatggaaacaaaatcagcaggcatacctggaaatcttcgtcggtggcgagcgaatagaaagccgtttcgagttcagagagggcgtgcattagagtttcggggacgtacttgccgccaaacttcccgaaacgaccgaatgaatcaggtcgttgccacatagtcggatcagatccagcggccttaatcttctccgagtccgccatgacaacagctgggtccttagcgatggtgcaggagacggagaacgaagaagaggaccgtgagcgagccgatggcagaggcgtaaatttggggagtttggagggtgatctcagatgggttaattcggaagaagctgaaacggaggagggtctgaaagtagcagcggtgcttgcggtggccatttagtgaatcttttatctagctttcaaacacgaagacaaatgttttgctgacaaaaaccttgaaagtgagggttctttttatagattcgttatgtaacacttaagttttttgaccagaaattcaataaaatagtggaggaaatcggtagttcggtaccacgttaacttatttgtgaacaacagaaaatgagagaagagtcagaagaggttggtgagaatagggcggtgtacattttgggggttggagtgtttatcacatgcctaattttagtgttatctattttcttttggtaaacgtcctctttggacaaaatgacgtatagcagtttttgctaatatgattcaaaggcttctaatagtgctaatgaacgacgtactactactcgttttgtttttggtggagttgataaataaaaggattacaaagacatgtacttatggttaaattaatacaaatgaactaactatatagttttagtttaatttcatgatttttaaacgttttccaaaactttattaagtttcttgtattttttattttgtacttaaaataataaaatgtggttgatcttttaatgaccaacatgcaaatagtcaaaatgacactaatcgattacatattcgaaccaaaaaaaataaatatcaaatcggtaaggtttgtctcttatcgattttaccgtcttaacttgtcatttaggcagaccttgttggtccgatgaaccaccagcctctgatccatttatgatttacacacgtgcattaaacaccagacgaaggcctttgagtcgttgaagctaaaaaatgaatggtatatgcatgcggactcactcggaagcctctccaatgtgcattgctcgactctaactccaacaaagtgtacgtaacgtaacaatcttaacgacaacctaaacaactaatagcaatcacaattccttaaagcattcgttagtgtaccatgtaaaattccttgaaccattcattattgacttatagtaccatgtaaaaaattccttaatccatatatcaagccatgtttttgtacaagaaaccaatttgacattttgaataattagattctttatttttattttttttaacttaaattttgaaataaaaattaacaatccataatgtagaacgtgatgtctctaaatttgataatgtccgaacttatttgcatggatgtttatatattacactagaactcgtattattgattattaatttaaacgaagtatcacgaatttaaactatattttcatactttgtctttcacacccgattttccgcgacaaatgcaaaatccagatactgaaaattatgcaatattaaaatttgaaaaaattgaaaaagtgaaatactaataaaattgagcgacacatttctgattccagtcttaactgttacactttcgagtgtcagatctcgtctttcttctccaactcgtctatcttcttctccgattaatctaatctctcgtcggagatttagaaatgagcacacctacaacttccggttcggcggcgaaaccgacgagaccagcacggtcgtcgagtttagcaactaggtcatgttccaattccggttccctcacttcgttccaagcaatg

SEQ ID NO: 4586 - DNA, 3000 bp, Unknown
  misc_feature (1)..( 3000): cDNA_ID_1455932_gDNA_ID_1620716_Annot_ID_49113 3000 nt of promoter + ATG
ttcgtgagaatttcaagctacttgcttgtgcgtttcatcagcatagcaaatgaggagaaaggtccaaaagcactatcaaccactaacagatatgtctgagctgctgatgacatttacaaggaattgaagagcttatggggtttacgtttacttcactacaggaccactttagattactagaaaaatgtagctaccttgtaaaaaatgacgtgtctcaaacacgataatagtggaattagattaattagagaaagaaaagatagctaccttgtcaaaccggcaggtctcaagcacggtaatggtggaatcggttttttccttaattaaaccgcttgaatgtgatgccaatgcagtcagggtctcagccgcagcttttcgtgttacccaatctgtacttccaaggcaatcatggatgctttctagcaatgactccaagctctgaggtgcaatggctcccacctgaatcaaagtaattgctctttacttctctttttcataaacagatttaaccactaaacctactagcattgaactaccagaagtaaagagagagagagatattaaacccctcaaaatttcactgagacttgtatgctcaaatcaaacaataaacttcagcaacacctaacagaaaaagtgtcggattaagactaaaacctcaagcagtgttatttactaaaactttgtgttctacttactgacactgatattcaaaattcaccatattcttccatttgctgtctatagcatgacaaggaggagattataaggattctgggcaaacctgagagagacttgaaacaactggcaaaagggaagccttagcaaggaaactggaattgctcaatagcttgcaaattctagggcaaagcttttggaaagaagtaactggaggactagcagctgattcaaccatcctagccatacacattgaagctccagattgtaccactttgttctgctctcccattgcctcaaacaatggcttaacgaacaaacccaccgctaacgacgctgaaccagtattagtcccctcttcttttcccttgagataaatcccagacaaagcaccaatcgtatctctacaagcatccctaactccagaatcagaatccttcaaccgtttaactatctgagcgatgattttagtgagatgcgcagccgtcgaatcgcaatggagactacaaacgtaggagagaagatggagacactccttcttcactgcaggtttcggatcggagcacgaatcgtagagacaattgagaaacatcggtagggtttcgggagtgagagattgaatagttttctcgagatcctcgacggcgatctggtatgtatctcgatcggcgagcttagagattgaggtaaggatcttttgcttcagctccaccattgcttggaacgaagtgagggaaccggaattggaacatgacctagttgctaaactcgacgaccgtgctggtctcgtcggtttcgccgccgaaccggaagttgtaggtgtgctcatttctaaatctccgacgagagattagattaatcggagaagaagatagacgagttggagaagaaagacgagatctgacactcgaaagtgtaacagttaagactggaatcagaaatgtgtcgctcaattttattagtatttcactttttcaattttttcaaattttaatattgcataattttcagtatctggattttgcatttgtcgcggaaaatcgggtgtgaaagacaaagtatgaaaatatagtttaaattcgtgatacttcgtttaaattaataatcaataatacgagttctagtgtaatatataaacatccatgcaaataagttcggacattatcaaatttagagacatcacgttctacattatggattgttaatttttatttcaaaatttaagttaaaaaaaataaaaataaagaatctaattattcaaaatgtcaaattggtttcttgtacaaaaacatggcttgatatatggattaaggaattttttacatggtactataagtcaataatgaatggttcaaggaattttacatggtacactaacgaatgctttaaggaattgtgattgctattagttgtttaggttgtcgttaagattgttacgttacgtacactttgttggagttagagtcgagcaatgcacattggagaggcttccgagtgagtccgcatgcatataccattcattttttagcttcaacgactcaaaggccttcgtctggtgtttaatgcacgtgtgtaaatcataaatggatcagaggctggtggttcatcggaccaacaaggtctgcctaaatgacaagttaagacggtaaaatcgataagagacaaaccttaccgatttgatatttattttttttggttcgaatatgtaatcgattagtgtcattttgactatttgcatgttggtcattaaaagatcaaccacattttattattttaagtacaaaataaaaaatacaagaaacttaataaagttttggaaaacgtttaaaaatcatgaaattaaactaaaactatatagttagttcatttgtattaatttaaccataagtacatgtctttgtaatccttttatttatcaactccaccaaaaacaaaacgagtagtagtacgtcgttcattagcactattagaagcctttgaatcatattagcaaaaactgctatacgtcattttgtccaaagaggacgtttaccaaaagaaaatagataacactaaaattaggcatgtgataaacactccaacccccaaaatgtacaccgccctattctcaccaacctcttctgactcttctctcattttctgttgttcacaaataagttaacgtggtaccgaactaccgatttcctccactattttattgaatttctggtcaaaaaacttaagtgttacataacgaatctataaaaagaaccctcactttcaaggtttttgtcagcaaaacatttgtcttcgtgtttgaaagctagataaaagattcactaa

SEQ ID NO: 4587 - DNA, 3000 bp, Unknown
  misc_feature (1)..( 3000): cDNA_ID_1807240_gDNA_ID_1620716_Annot_ID_49114 3000 nt of promoter + ATG
atcaactccaccaaaaacaaaacgagtagtagtacgtcgttcattagcactattagaagcctttgaatcatattagcaaaaactgctatacgtcattttgtccaaagaggacgtttaccaaaagaaaatagataacactaaaattaggcatgtgataaacactccaacccccaaaatgtacaccgccctattctcaccaacctcttctgactcttctctcattttctgttgttcacaaataagttaacgtggtaccgaactaccgatttcctccactattttattgaatttctggtcaaaaaacttaagtgttacataacgaatctataaaaagaaccctcactttcaaggtttttgtcagcaaaacatttgtcttcgtgtttgaaagctagataaaagattcactaaatggccaccgcaagcaccgctgctactttcagaccctcctccgtttcagcttcttccgaattaacccatctgagatcaccctccaaactccccaaatttacgcctctgccatcggctcgctcacggtcctcttcttcgttctccgtctcctgcaccatcgctaaggacccagctgttgtcatggcggactcggagaagattaaggccgctggatctgatccgactatgtggcaacgacctgattcattcggtcgtttcgggaagtttggcggcaagtacgtccccgaaactctaatgcacgccctctctgaactcgaaacggctttctattcgctcgccaccgacgaagatttccaggtatgcctgctgattttgtttccatcttgttcatagtttttgaatcgattcgaaatgatttggctttgtgagtttctgattcaagcgttgtcattgccatggctagtgataaagtttaaaaaacggatttttttgttccaattctaaaaaataatctgccaaacaatgttaagccgtatgggacaaatcgatttgtttgcgatgtaggatgtaattctgggaaagtgttgtatttttccagaaatctggaaacgacattcatttcatattcttagtttcttcagcattacatgcttctgtgtgatgtaagttagaagtctttttggttagttcgtttgttgggcaatgtctaactaatgtttgatgaatctgtagagagaattagcagagatcttgaaagactacgttggtcgggaaagtcctctttactttgcagagaggctcacggagcattaccgccgtgaaaacggtgaagggccgctcatatacctcaaaagggaagacttgaaccacaccggtgctcacaagatcaacaacgctgtggctcaggctcttctcgccaagcgtctaggaaagaaacgaattattgctgagacaggggctggtcaacatggtgtagccacagctactgtgtgtgcacgtttcggtttgcagtgcattatctacatgggtgctcaagacatggagagacaagctcttaatgtgttcagaatgcgtcttctcggtgctgaggtgatgtgaattctctgcgtaaaccttgcaaaatcgcaatgctttcaaattgttatctaagtctgatgcttgtaggtaaggggagtccactctggaacagccactttaaaggacgcaacttctgaagctataagggattgggtgaccaatgtggagactacacattacatattgggatccgttgcgggtcctcatccttatcctatgatggtcagagactttcacgcggtgattggtaaagaaacaaggaaacaagcgatggagaaatggggcgggaagcctgatgttctggttgcttgtgtcggtggtggttcaaatgctatgggactcttccatgaatttgtcgatgacacagaggttcgaatgattggtgtggaagccgctggatttggattggacagcggcaaacatgctgccacattgacaaaaggagatgtcggtgtactccacggagctatgagttacttgctgcaagatgatgatggccaaatcattgaaccacactccatcagtgccgggtaagagattcttctctgttcaaagttggttttaagccacatgtatctggtcacctgtatctaaagagtaaaagttgatgttatcagattggactaccctggagtcggacctgagcatagtttccttaaagacgtgggaagggctgaatactttagcgttactgatgaagaagcattagaaggtacttacttgacacttcatttttctccttttagatgtttctttcacaactcatgagaacttgcattgtgtattctaatctatgcgtgtagctttcaagagagtgtctcggttggagggaataatcccggcattggagacatcgcacgcattggcccatctggagaagctttgtccgacgttacctgatggagccagagtggtattaaacttcagtgggagaggcgacaaggatgttcagactgcaatcaagtatctcgaagtttaaagagtgtagattactttcattttcacacagtgctatttcttttatgtagtttgttagttctccttgcttatggtcgggaatccaaaagtttggatcaaagggttaagaagagaataagtgttatgaatgtatcatataaataaaaatgttctatggaacgtttgatgttcttataagcaattcgaactgttttgttcttgacttagctggttttccctttcatatcttaatttcaccaatgcttagaaaaaacaactctgatcgaatgatttataaacaactctgctctttaatggtgatcattgtaaattcaaacttgtgtattgtttgtactaatttgttctgatagaaactattttgggttaaatgggaaacgggtcaaagcatagggggctagtgttgtaatttagtagattggggaggagtttcaaatctgaacgctgaagataaatcacaagggaggtgcttcgtcctcgaagcttttagaacttagccaagcagctgttgtttcttagttgactccctctccgacgaaa

SEQ ID NO: 4588 - DNA, 3000 bp, Unknown
  misc_feature (1)..( 3000): cDNA_ID_2109168_gDNA_ID_1620716_Annot_ID_49115 3000 nt of promoter + ATG
cgagggcccacatcatctgcaggaatagtgtttggcatgagatcaaatacatataagagagagtgagacaaaaaatcagtatcattacctcccaaaggtacagagagtcgcaaaatgagaattctcttcggaattgaaccattagcatccggatggcaaagagatagtcacctcccccaagtttatctgcatttatgacccagcactcgattaaccgctgaatatatacatatatgcaaagaaattgcagtagtagtagtactgtagtacctagatgttggtgaagtttggggtcaacaacctgagtaattgaagacaaatgagtaagttgagcttcaactccaacagatctcccggtactacggaaatttcctcgcttttcaattcgaaaaaataaaacatgtttaatacaacctgattgcagagagacagatgtaaacagtccataccaaaaacacaaatacattgagaatatgtgtaaggtgagtaccaatcgacgcatgagccgttcaaaacaccaaaatgcatcagcttcgtcttcaagaagaataatcattggggaacaaagatcactcattcctgatcagatcaccagtatatagataagaatttctcaagtaaaactggttttcaaacaaatgatacaatgatatatacattcggttttaccttgacaatacccgacatcgttgtctatccaggcgtaaacagacagaatatcccagagcttcgataagttctcctttttctcataaaataccaaggccctgtctgtacggttcacatcaagacctgaaaaacatacattaagcaactgagtgaaccagatattcagtatagtctagccggcgataaaggaggccatgatcagtcgctaacctatctggtgaagtgttagcagccattggataatttttttatcaagaggtccacgacttgtgagctctttaaaaaaaactgaaccatttgagtttgtacctgagaaagccacatgaaaacttcaaatgcctattacaagtttatgtaagagttcaacattaaatttccgtaatagaaaggcaaaattttacctaaatttatttcctgaagtacaagaggatcatagttgggttgaccattttcagtaattacaggtgcggtagtaaatcttccacttccaatgacaggaaacatttgcttacactcttccttccaagaagcatactgcaatctgaaagaagagaattagcggtaggattcacaaaactgaatcgatggtttatgaatgaactgaaagaaacatgtaattatgccaaatgcgatacatatatataggatatgaggacaaaattctaccttctgcgttgtcgaatttgctctctttcttcgaatgtgctcattgggtcataacaaccaagtaggaattcccatacttcgcctctaattgatggatggattccctatagattgattgtaaaggaatattaaagtaacataagttatcaaagatacagaacaaatgaaaggataaatcagtctttacaaagacttatccaaacaaacatacccctcttcggatgcgtcttagagtcttgccaatatggagagacccttcttgtacaaatacagcctgccattttcttacacttagagttttaccaggctgcacaaacatcataaatatgacccgtgttgtcagcaacatagcaaaaacttcctggcctcaacatgatgcaattattcatgatacattatgaccacaagacatggaatgatataggcttttatggcctgtaatgtaaaggttcaaaattattcaatctagttccaaattagtaccagtcaagcacataacctatcttcctatcttatgtatcttcctaaagaccctggagtcaagaagttaaaatcctttcaagcttatgtctggaaaaagtgacaatctcactaaaacaatcattcatgtgatgctactgagaaaaagatccagtgggatcaagaatatatatgagaccctgaacagctcctaagatcaatatctcctcataaggaatcagatttatgaacattacaatgtcaggaacaaattcacaacagagacaatgcattttcgaaaacatagataaccagagaatctggatgtaattggaaccgaatcagcaatcacatatcgtattcgtaatcataaaacagagacgacccaacgaagaagcaaaactagaataagcaaaaatcggagaaaatgaagaagaagggatcgaaagaagtaaccttgattttgaatctggtcttggggacatcggtgcactcaggacgaacttggtagtaagaatctgctggctcacctgcgcctccccacatctctatcaaactttcccgggaaaaaaaagaaatcaaatccaaatgctgagcaaaacagaaagagatacactttggatcggggtcccctcaaaactcagaagatcgatcaatgagcaatgatcaatgaagaaattaaaggaaatttagggagaaaaagattgagaatttaaggggacccagcttggagcttagtggattggagtctaaagacagaaacttttttttttaggtttctttctgcgtatattattttcctgtcgtctatctatcaactaagtttcttgtatcattccttttttctggagatgatgattgatgagctggtctcattacacaatagttgttgcctccacaaataacggagtttctccatcacttctctctaatttatcttcttccacatgaaagagacactgtgtctttttttttttttcccccaaaaatatccaacataaaacgacgccgttttctctctttaccatattgggcgtttaatgttgggcctttgtgatatttatttagtaaagataggcccaaaccacaaaaccctagaatgaagattatatatagtgcaaaacctaatcgattttttcctctgctgtcgctcgtctacatttacactcggagcttagaccttccaatctaccggcggcgaaaatg

SEQ ID NO: 4589 - DNA, 3000 bp, Unknown
  misc_feature (1)..( 3000): cDNA_ID_1824837_gDNA_ID_1620716_Annot_ID_49116 3000 nt of promoter + ATG
aaatagtaaagactgaggtagtgaaaagcaatggacaggcattggttgaggcgtatgagtacacagcacatagcagcgttgctcatagttactatttaccagtggccaagtttcactttgagctctcaccgatgcaggtaggcttaaacattttttgtttgctgcctttctcacatgtgttacacagattagggatggtaagatgggttggaattacactctgctcatctttctctttgtttgtttgcaggttctcataacggaaaactccaagtccttctcacatttcatcaccaacgtatgcgccattattggtggtgtcttcacggttagtaaagaagtttgaagcctcttcttcttgtaactattcattaatgtattcccatatgactcgtatttttgcctcttttcaggtggccggaatcttggattctattctccatcactccatgacactcatgaaaaagatagaacttggtaaaaacttctgaagctccctaagggttttatttcgttttcctctgtaacgagtcagaaatttttgccctagttataccagacgtcacttaaataattcggttatatatattcacaaactgttatccttttgaacatatataagtattatcgatgtctctgaagtctttgggagttttagtagaacaaattgttatcacttaaatcaggggaatttacttccaaattctccaataccaaaatacagcttcttgtgagttggttcatactgatgatggagaaatgtaatttttagccaacaaggtttcaactttcaacgtttgaaactagatttgagcacaaatatagcaatcaactttcccccatggctgcttatagcaatcatcgacggaagtcacagcagaacggagagtcctctcgttccctttggacagagttgcatcctctactagaattttacttaggtagaagtaagtatccacagtaaagaatctccttcttgttacaattttcaattttgtgttctcttcaagctaattattagtttagttagcttagcatgattcaactttagccttggtatagaatcataacatagaaccatataaacgaaaataagactaagatcaaaagaacaaaaaactttgagttttgcaaacaaggtttcaaacttgaataatgtctgataattgagcacatactgatattgatagttccaaaaacactaatttccgaatccaaaatcaaaaaagaaagacaacagaattgtagataatatttgatcaggcagtgatctccttcttgagttttgcaagctcttgcctgacaacaccagctttctgcaaacagcaaaaaaacccattaacatttcagttctgacatgaatgaacactaccacagaatttcaaacatctaacaatttaacacactgaccttgatcttggccaacatgatcttgaacctatcaaagtcgttaaggttagccctacgtttctgcacgataagcttcctaccccatgagcttttctcccacttgttcttcacatctgcaagacttttccagttaagattgaaacacttcaaaattcaaatatttacattacgcagcactcaccagccttttccattgcctcgatcaaagccttcttctttggcacacggttgatgtcaatgacaatatcggtaagagacaacctcttgaagttcatctggatcctctccatatcaggggcatccaccaaagcctaaatgacgagaacataataagaactccataaaaacaactagacaatattcagctcaatattcaccaaggaaatgcaataggctccaatcaatgatgcaaactgagttataactgtaagccaattatgcaaccaaagtctcaagctaaatcaaaattttccttaatcaaacaatttaccgaaacatacacagtagcattacggaatcaagcattaaaacagctgaaactcatcaatacatacatgataaagagatggaaatcttcataacctaagaatgaaataaacttactctgttctggtcaacaacgtcgacgataacgacgagctttccatgatcttctccgtagttcacaagtgctactctcccgatctcaacgtacctcttgaaaccctaaacaaccaatcaccagaaaatattaaatctaacaactttggactctaacctatacacaaacgtaacttgattgagaacgtcaaaagcctaatccccaaaaaaaaagatctagaagaaagaaatccgaaatgtgctatgaacatgagctaaatacaggagataatcacgtagaacacagacgaactaaccaaggtattagctcaataagagagtatatctcaccattttcgccgccggtagattggaaggtctaagctccgagtgtaaatgtagacgagcgacagcagaggaaaaaatcgattaggttttgcactatatataatcttcattctagggttttgtggtttgggcctatctttactaaataaatatcacaaaggcccaacattaaacgcccaatatggtaaagagagaaaacggcgtcgttttatgttggatatttttgggggaaaaaaaaaaaaagacacagtgtctctttcatgtggaagaagataaattagagagaagtgatggagaaactccgttatttgtggaggcaacaactattgtgtaatgagaccagctcatcaatcatcatctccagaaaaaaggaatgatacaagaaacttagttgatagatagacgacaggaaaataatatacgcagaaagaaacctaaaaaaaaaagtttctgtctttagactccaatccactaagctccaagctgggtccccttaaattctcaatctttttctccctaaatttcctttaatttcttcattgatcattgctcattgatcgatcttctgagttttgaggggaccccgatccaaagtgtatctctttctgttttgctcagcatttggatttgatttcttttttttcccgggaaagtttgatagag

SEQ ID NO: 4590 - DNA, 3000 bp, Unknown
  misc_feature (1)..( 3000): cDNA_ID_1824833_gDNA_ID_1620716_Annot_ID_49117 3000 nt of promoter + ATG
ttattcagcttcaaggcgatcagaggaagaacgtctccacgttcctagtccaggtaaaaatcacactctttcacaaacaggctaacaaaaagattgttactcgatcatgtttctcatacgtctcaatgaacaggctgggcttgtgaagaaagataacatcaagatccatggtttctgagcagcttctgttgcatttcccgtaggccgtttaagtggatcattactctatcgtgcagttacaaaacatatcttcacctttcccttcgattacttgttacttgtttctgttttagcgttggaatgatactaagagaccatcatcgttttctttcacatgttacttctgtaatacgagattgttaagcattctccattaacgtttgactctactctcagtatatcttgttaccagggtggatcacaacacttaaactattattcttgttatgtgccaattaagacaaaaaaccatcagttaaaaacacagtagtcgaaatcgaaagtcaataaagttgaccagaggcctggaagactcttaggcgtccagagtgtttcaaagtcgctgggaaattacgaaataaccgcttgtcttctctatcgagtccaaagtggagctctgcaaatcctcgggcaagacgacgatttggaaaacgaaattaggttaagagtttagactaatctgaaaccgatattctttcaatttcaatattctagttcgatttcccaaaatcccctcttcggttattttggatcacaggtaaacgatggaggagatatttgctctgatagtctcaatgattctcatagttgcggtgattcctttgttcttttggaaacgtcggagagatgctagatcacgggaggaagttgctgaaccaccacaggtaatttatcattgtttgcgaaaatggatttgaattttggtaatgtctcgttttttttttccttctgggatttgattggttgttcatgtgaaatgcaaaggttcaacctcgtgaaaacgtggcacgtgctggtggtggacggaggatgcgtaggagacctgcagcttctggtgctagctcctctacatccaatgttcaaggtttgtatttgacagcttttgtttctctttgagttttgaggattgagtttctgctatctttgtaatttgaagcaaccttatgtagatagttgtgttattggttagagtttactatagctagcgaacactcgaaaccatcatttattcaagaatactcgataactttttagtttcatttgtaatctatcttgctgtgaatgtagtttaagtttagaaaagtcttggaactaaatgaacaattggccttggaacaaaattattgggtatgtgtgaaacagaaaacggcagtgggagtgaagatgaagatgaagatgaagctggtggaactcaagccagagcatcaaagaagaaagagaagaagcgacaagagcgggaagcacaaagacaagtgagatttttctatttattctactagaatttttggcaggattaaggatgagaaattctaggaatatcagttggtaagttacattgtgatagttttagattccgacttaaggatagagcattggcagaatattacatctcttttgggacgactttcctgattaagttctgttctttttttttggtataggctgaggaagctacacgcgagtcaaggaatacaaaacaagattggtatgcagaaatgcggaggaagaaggatgaagaacgcgaggcagaagagctgaagttggtaggtcaatcatctcagatttcgttttgttatagtcttcctgcttttgaaatactgggcttggctaattgtgacattgttacgtaggaagaagaagaaaaagcgcgacaagccaaagaagaagaggcagctgcgttagagtttgacaaatggaaaggggaattttcagttgatgctgaaggtactacagaggaagtgcaaggtgggaatcaagatttgctttcagaatttgttgaatacataaaggtatatctatcttgaataaccctataccaaacactttttgatcttcgattctaatcgttattctgtgaatataaacaaacgaaaagtaaagtggagatacaaatgttgccaatagaaacacgctcacaatgaagtatagatgtaaatgttgtttcagcccatatcaatgtacccacatgttgagccttccttttgctgtgtgatgtgattgcagaaacagaaatgtgttccacttgaagatctcgctgcagaatttcatctacgtactcaggtatcatctggctacatatttatgtggaaaactaaagaataccttttgtcatggctttctagtctgattcaactgtttgtcctcttaggaatgcatcaacaggatcgcctctttggagagcattggtatttttctctctatccaattataaaaagagcatttgtctcatctggcagtctgtaatttgcgatgggtatagtaaacccgaagcaataggaataagcaggtgagacactgatgtgaaacaatgatgggacgcttaagaactgaacccattctcttttgttcagggcggctctcgggggtcatggatgatagagggaaatacatttacatatcaatggaagagatgaatgcggttgcagattacatcaaacgtcaaggaagagttagtatctcacatctagcaagcaagtcaaaccagttcatcgacttggagcccaaagtacagcatcagctgactgaagaaattagcggcatggaagagatctcagtttcttagttgtgtttctcgggtaaaatcgtttgtcaaaaacaagagttaaaagccttaggtgctcactgcaacatgatggtgtttgggtcatataccttcttgttcttattttactagtttgagatccttaggcttgcatccatatacagtacatgaaataccatatgtttaaaattgttgtttgtcttaccattagaaaataaaataaacacacaaaagaaatg

SEQ ID NO: 4591 - DNA, 3000 bp, Unknown
  misc_feature (1)..( 3000): cDNA_ID_1824809_gDNA_ID_1620716_Annot_ID_165653 3000 nt of promoter + ATG
cactaaaccattgtcaggggatcgaagcaatgatgaagaaattggtaagtgacaacaagggtttcaagaatttgaaatctctgacgattgagaacgttatcatcaatacgaattcttgggttgagatggtaagcactaacacttcaaaacaatcctctgacatactagaccttcttccaaatttggaggaacttcatctgcgtcgtgttgacttggaaaccttctcagagctacaaacacatctcgggttgaaactggaaacactgaagataatcgagatcaccatgtgtcgcaagcttcgaacactactcgacaaaagaaatttcttgactatcccaaacctggaggagatagagattagctactgcgactctttgcagaatctacacgaggctttgttataccatcaacctttcgtaccaaatctacgtgtcttgaaactgagaaatcttccaaatcttgtgagtatatgcaactggggagaggtttgggaatgcttggaacaagtggaagtgattcactgtaatcagctgaattgtttacccataagctctacctgtggaagaatcaagaagataaaaggagaattgagttggtgggagcgtttggaatgggacgatccctctgctttaaccactgttcaaccatttttcaatccagtgagggaagttcctctactcatagcggatgcaacaactcaaatgctataagagccgataatctagacacatcctaagagtgtcaccatctccgtttctctgttttgttcttttcattaattttgtttgagtctgtgaagtgtgaatgtgcaaaactaaacaactatgttatgtcaatgcataaatattgtgaatttgtgagtcagattcaagtttatgttgcattcgtttagtccccattctccaaggaccaatgtataataacctcatgcatctattgaaccaatggttctttatatcagtcgcatataacttgaaatcgttggatatatgagaactagctaacaaaaattgcaatccgatatctaactaatgtttagccacatattataaataatgatactatatgagtatcacctataaccatgctctaaagtcttgtccaaagcaaaagatcacctaactttatgcattccaaaaacccacctataaggaacttgaagcaaatgcagaaacaatacttaccatttgatcattgacccttccctgtagctgcggccatgaattgtgtgttaaagaaagtctcgtcttttcccaagctatccttcaatgtgttatcgctcaaaacatatcattgacccttccctgtagctgcccccatgaatttagaaaatgtcaatatcaagtttaacatgaaatatgaatttagaattacagagtttacctcactgcagggacctttaaagaatcagaaacaatttttgtcttcttaaatttcacatgaaacactgacacattgcgagagcctgagacagaaccgatcaaaaagagaatttggtaattcgacaattttagcccatacctttgggtgcatgaacgtgaacatcctgtgaaaatttgaaccagtgaaaagggtgatttaggtcaaagtaaaaaaatccactttttgaaaagaatctatcgtctgaaaatgccaagttgccgacgtttactgtttttaccgacacatgctttacctatttttatttttttttctggcctactcgtgaagtctttattagcttataaaaatagttcacatttatgatttgatctttgaaattaccagcgtgtatgtaagctatgaggagaattttttatacattactccatatgctcatgaataacaaagtacaacttcttgttgtaggtactagacaacataacttttcaacttttgacaaaaaaagataacttttcaactactacgtagaataaaatctactagctatagtttatttccatataatttaatgatataaaaatcgttaaaatacttcatccaaaaccgatcgatatatagtaatgtagttgtcgcctacacaagttgtgtatgagttagttaagttcagtaatattcacatctgaaattcaagatttatttagtcgcatctgaatttcaagatatatggaactcttactattgttttctttagatatagatttttaaaatttaaaattagcaaaattttcaaacttaaataaatgctataatacatgagaatcagaaaaaaaacataaatacaaaaaagtaaggggatcgtttgacttcatccgagttattcgaagaaatggtttcacttttgtacgtttcagtaacgtaaatgaaatttatatttgtattgctttcaaacatataaacaaagtaaaactgtatttgacaaatgtacaacaaacaaattcaatttatttgctgaaaaaaaggaaataaaaaaagcaacggatgggatcgcactagctcggcgaatttgagatctaatcaacggccctacactcatctctctcactctcttgaacaaaaccaaaacaacagaaatagaagtagcgagcgacgggagagcccaacggagagacatatcgccatttcaaagctaaacaaccagataataatactgaggtgttttcttcttttctcactgatttctctatgaaattgccacacccaaagtttgagtcttttatgttttgtttcctcactgatagtgtttttgttgtttagctcaaatcattgcttaattttttttctctttgtaacaactttactgtctttgaaaattgaaagaaaaaaaaacccaatgattcacgggtttcaatccttttcgatttaatctttatataagccaccattgaatcattaataaaataaagatctttgatgagaagaagaaaataaaaatcattttttttgcaggtttttatgcttataattggggtgaaagagacaaatccagagtgtgtgtaaattaggtacgagaagaatttcagctaactcttttgagagaggagaaaaaagtaatagatg

SEQ ID NO: 4592 - DNA, 3000 bp, Unknown
  misc_feature (1)..( 3000): cDNA_ID_2107235_gDNA_ID_1620716_Annot_ID_165646 3000 nt of promoter + ATG
aaactgtagtatagtcgtttatggtgtcataccattcataaacaaatcacaaatggtatactattctcagatggattcttaatctcaaatccacaattgtacatgattcgtaaatgaaacttttattttttaagtgttcatttttacatgcttcgttatagctttttttaaaagaaaaaattggacatcagttttttaaaattgtgctattagccacaactcaataattaaacacatttattacttttttttgtttgataaagacatacgtaaaccatttgttaaaaatatcaagaaagatcaaattgccaagtcataattccatttgtctctacgcatttgaagtcttaattacgatttatatctctgggtagtactagtctatgatctttccgtggaggtggagcggtactctataatttttccagttcactggagtaaagttatttttatgtaagcgtcatgactttttagagagcagcaatgtaacaaacaaaaaaaatataaacaaaactcttatttattaagtagtgcttacattaccctcaaacatccaaaagcttacatttatcataaaacacacgatgaggtgtggtatgtgtcaagtgtcaacatgtatatatcaacaaccacactctcatacgctttgagggtttgtttgagatttagtagaaagaagggaatgaagggatgttgaagggacaaacatcaacttgcgggatgtcgcaaacgttgggcaagtgcttggctgtctggtaaattttcctgacttgcattggttggtgctgtccctggagtctaacggccttggcagcttgtttcaaggtggggcaaacacaatctggctcttcctggcgaagctcgttgcagcactgctggaatagctgttgttcctgctgttgtccctgtgggttctccatgtcgtcttcgaaatcaaactcatcgctacggccttgccttgcttgctggagcatcaattgctggcaagctcttaggtgttgttctttctgaaactccttgcggcatttcctcatttttgggcctatggggttagtggcgtcatcttcttcgaactcaacgacggtgcggtagatggaagcgttggtgaggaggaagcagagagcgagagctgcgcagacgaggaacaacttgtttgccattttttgctatgtgtgtatgttttggttcgagtgaagaatgtggtgaaggtgtggttggtatttataggtgagaaaagagacttgcatggagttcacgtgtaagaatacatgcatatgtttgtttgtatgcgagagctatatgattgttgtcgtgattaggtgttggaaactcaaatgtaaaggaagtgacaagtttccgcgtctacttgcaatatgcaaccatgtgtaactcatgttctgacatgtcaattattttgaaatgactagttgagagtcaatacggaaagagtagtagtgtgtcaataaatgtttttggaggttaattctgaaatacataaaagttttagcatcttgaaaaattacttatacacgcaggtcaccggtccattggatattgtctattgatggtaagacaatatatggataaagataagcttaatgtttttcactcccaaagtaatgtatgtctaagaatgttatggacgggtgacaaaaactagtcctctcacgtttcaccgtgacaaaacatacggacacgagtagttaggatatttagaattattattccaagtgtctcttaaaatacatatgttggttattcaggtatcatatacatgaaaccactttatgaactaccactaaatcggataaaagtgagattttgattaagaaatctcatatatataacactaatttttccaaaaatgcttaaaaatcaaattttgtttttaccgaaaacgaatcttggtttaatttggtaccaaatatatatcactctaaaccgaaccaaaatccaccgcatcgtaaccaaaacaaagctctgtttcgttcaaattgataaaataaaataaaataccaaaccgcaaaattgaaattccaaaatctccaaataaccggaatgcctagctctctctatccatggaaaaaataaaataaatatctaaagaaaagctgctaaagagactgtgagacaaaaacgacgatattttcctcttcctctcattatttttgttctcgccaccgaaacaacagaagttgcagactttatccgaatttagggtttcagctcgttctctcttctccaattatcagatccacgaaactctacttttcggatcaggtaaaatcttatcttcttctgattgcgtttgtcatcttcttaagcagatttcacaaattgcgttttgctatttctttgatttcggtaatttcgaggtgaagtttgttttcattgcccgatccatataattttggagtttgttgatttgttttcgttcgtcagattggtatatcgtctttcgtatgtccctgaagattgtacgctagcttttgtttaggatctgtcgaatttgctgctgactttagaaaattggatcttcctttgatctgctgtggattgatgtaatttgtttagatcatatcctgtaattgagctggacctgcttaactaggttcctgggactaggatacagaacatacaatttatttatgaagatggcatcttgctcatttcgaatcttatgttgcaaatgataattctggagttggtttcttagctgaggttttagtttccccatctggtttatatatcactaatctctagatgaacatggcttgtatttggattgtgtgttttatcttgctatgtgtattatgcgttccctgtgttctttaactgttttctaagaccttattaatacttattttgcttttctcgattgtggtgtagcacttgtttattatttgtttatgagtgtgccaaattcttatcctccgatggccttcatgttcaggtctcagcttctctatcgtttgcccctcagatcaacaaagtttcatg

SEQ ID NO: 4593 - DNA, 3000 bp, Unknown
  misc_feature (1)..( 3000): cDNA_ID_1824833_gDNA_ID_1620716_Annot_ID_165644 3000 nt of promoter + ATG
agttaaaaacacagtagtcgaaatcgaaagtcaataaagttgaccagaggcctggaagactcttaggcgtccagagtgtttcaaagtcgctgggaaattacgaaataaccgcttgtcttctctatcgagtccaaagtggagctctgcaaatcctcgggcaagacgacgatttggaaaacgaaattaggttaagagtttagactaatctgaaaccgatattctttcaatttcaatattctagttcgatttcccaaaatcccctcttcggttattttggatcacaggtaaacgatggaggagatatttgctctgatagtctcaatgattctcatagttgcggtgattcctttgttcttttggaaacgtcggagagatgctagatcacgggaggaagttgctgaaccaccacaggtaatttatcattgtttgcgaaaatggatttgaattttggtaatgtctcgttttttttttccttctgggatttgattggttgttcatgtgaaatgcaaaggttcaacctcgtgaaaacgtggcacgtgctggtggtggacggaggatgcgtaggagacctgcagcttctggtgctagctcctctacatccaatgttcaaggtttgtatttgacagcttttgtttctctttgagttttgaggattgagtttctgctatctttgtaatttgaagcaaccttatgtagatagttgtgttattggttagagtttactatagctagcgaacactcgaaaccatcatttattcaagaatactcgataactttttagtttcatttgtaatctatcttgctgtgaatgtagtttaagtttagaaaagtcttggaactaaatgaacaattggccttggaacaaaattattgggtatgtgtgaaacagaaaacggcagtgggagtgaagatgaagatgaagatgaagctggtggaactcaagccagagcatcaaagaagaaagagaagaagcgacaagagcgggaagcacaaagacaagtgagatttttctatttattctactagaatttttggcaggattaaggatgagaaattctaggaatatcagttggtaagttacattgtgatagttttagattccgacttaaggatagagcattggcagaatattacatctcttttgggacgactttcctgattaagttctgttctttttttttggtataggctgaggaagctacacgcgagtcaaggaatacaaaacaagattggtatgcagaaatgcggaggaagaaggatgaagaacgcgaggcagaagagctgaagttggtaggtcaatcatctcagatttcgttttgttatagtcttcctgcttttgaaatactgggcttggctaattgtgacattgttacgtaggaagaagaagaaaaagcgcgacaagccaaagaagaagaggcagctgcgttagagtttgacaaatggaaaggggaattttcagttgatgctgaaggtactacagaggaagtgcaaggtgggaatcaagatttgctttcagaatttgttgaatacataaaggtatatctatcttgaataaccctataccaaacactttttgatcttcgattctaatcgttattctgtgaatataaacaaacgaaaagtaaagtggagatacaaatgttgccaatagaaacacgctcacaatgaagtatagatgtaaatgttgtttcagcccatatcaatgtacccacatgttgagccttccttttgctgtgtgatgtgattgcagaaacagaaatgtgttccacttgaagatctcgctgcagaatttcatctacgtactcaggtatcatctggctacatatttatgtggaaaactaaagaataccttttgtcatggctttctagtctgattcaactgtttgtcctcttaggaatgcatcaacaggatcgcctctttggagagcattggtatttttctctctatccaattataaaaagagcatttgtctcatctggcagtctgtaatttgcgatgggtatagtaaacccgaagcaataggaataagcaggtgagacactgatgtgaaacaatgatgggacgcttaagaactgaacccattctcttttgttcagggcggctctcgggggtcatggatgatagagggaaatacatttacatatcaatggaagagatgaatgcggttgcagattacatcaaacgtcaaggaagagttagtatctcacatctagcaagcaagtcaaaccagttcatcgacttggagcccaaagtacagcatcagctgactgaagaaattagcggcatggaagagatctcagtttcttagttgtgtttctcgggtaaaatcgtttgtcaaaaacaagagttaaaagccttaggtgctcactgcaacatgatggtgtttgggtcatataccttcttgttcttattttactagtttgagatccttaggcttgcatccatatacagtacatgaaataccatatgtttaaaattgttgtttgtcttaccattagaaaataaaataaacacacaaaagaaatggatatcatggttgctttagtaaatctttattcctcaagttaaacaatgtttgccatttatggtgctcacaaggtgttcacacaaagtcttgtgtaagaatatgatatcatggttgctttagtaaatcttaattagggttctataacttttgtaaaaagtttaataaaaaaattctaatgaactaacttagaggaatatgcggtttggatcagtctaatccagattttctatagaatatagaaaaaatgtgacaaacatacagaaattggtacttatacatttactgattaacgttattagtatattctcttttgtataatatctctgtttctccggagaaacaggggaaaactagaggaagagaaaccgttatgctctgcctctctaattcgcttaagttttattaccatctctcttttctctgttttctctttcttgcgttcctaagaaacttgggaaacacgatagagatg

SEQ ID NO: 4594 - DNA, 3000 bp, Unknown; identical to SEQ ID NO: 4588
  misc_feature (1)..( 3000): cDNA_ID_2109168_gDNA_ID_1620716_Annot_ID_165642 3000 nt of promoter + ATG

SEQ ID NO: 4595 - DNA, 3000 bp, Unknown; identical to SEQ ID NO: 4586
  misc_feature (1)..( 3000): cDNA_ID_1455932_gDNA_ID_1620716_Annot_ID_165640 3000 nt of promoter + ATG

SEQ ID NO: 4596 - DNA, 3000 bp, Unknown
  misc_feature (1)..( 3000): cDNA_ID_2157010_gDNA_ID_1620716_Annot_ID_165639 3000 nt of promoter + ATG
cagcatgtttgccgctgtccaatccaaatccagcggcttccacaccaatcattcgaacctctgtgtcatcgacaaattcatggaagagtcccatagcatttgaaccaccaccgacacaagcaaccagaacatcaggcttcccgccccatttctccatcgcttgtttccttgtttctttaccaatcaccgcgtgaaagtctctgaccatcataggataaggatgaggacccgcaacggatcccaatatgtaatgtgtagtctccacattggtcacccaatcccttatagcttcagaagttgcgtcctttaaagtggctgttccagagtggactccccttacctacaagcatcagacttagataacaatttgaaagcattgcgattttgcaaggtttacgcagagaattcacatcacctcagcaccgagaagacgcattctgaacacattaagagcttgtctctccatgtcttgagcacccatgtagataatgcactgcaaaccgaaacgtgcacacacagtagctgtggctacaccatgttgaccagcccctgtctcagcaataattcgtttctttcctagacgcttggcgagaagagcctgagccacagcgttgttgatcttgtgagcaccggtgtggttcaagtcttcccttttgaggtatatgagcggcccttcaccgttttcacggcggtaatgctccgtgagcctctctgcaaagtaaagaggactttcccgaccaacgtagtctttcaagatctctgctaattctctctacagattcatcaaacattagttagacattgcccaacaaacgaactaaccaaaaagacttctaacttacatcacacagaagcatgtaatgctgaagaaactaagaatatgaaatgaatgtcgtttccagatttctggaaaaatacaacactttcccagaattacatcctacatcgcaaacaaatcgatttgtcccatacggcttaacattgtttggcagattattttttagaattggaacaaaaaaatccgttttttaaactttatcactagccatggcaatgacaacgcttgaatcagaaactcacaaagccaaatcatttcgaatcgattcaaaaactatgaacaagatggaaacaaaatcagcaggcatacctggaaatcttcgtcggtggcgagcgaatagaaagccgtttcgagttcagagagggcgtgcattagagtttcggggacgtacttgccgccaaacttcccgaaacgaccgaatgaatcaggtcgttgccacatagtcggatcagatccagcggccttaatcttctccgagtccgccatgacaacagctgggtccttagcgatggtgcaggagacggagaacgaagaagaggaccgtgagcgagccgatggcagaggcgtaaatttggggagtttggagggtgatctcagatgggttaattcggaagaagctgaaacggaggagggtctgaaagtagcagcggtgcttgcggtggccatttagtgaatcttttatctagctttcaaacacgaagacaaatgttttgctgacaaaaaccttgaaagtgagggttctttttatagattcgttatgtaacacttaagttttttgaccagaaattcaataaaatagtggaggaaatcggtagttcggtaccacgttaacttatttgtgaacaacagaaaatgagagaagagtcagaagaggttggtgagaatagggcggtgtacattttgggggttggagtgtttatcacatgcctaattttagtgttatctattttcttttggtaaacgtcctctttggacaaaatgacgtatagcagtttttgctaatatgattcaaaggcttctaatagtgctaatgaacgacgtactactactcgttttgtttttggtggagttgataaataaaaggattacaaagacatgtacttatggttaaattaatacaaatgaactaactatatagttttagtttaatttcatgatttttaaacgttttccaaaactttattaagtttcttgtattttttattttgtacttaaaataataaaatgtggttgatcttttaatgaccaacatgcaaatagtcaaaatgacactaatcgattacatattcgaaccaaaaaaaataaatatcaaatcggtaaggtttgtctcttatcgattttaccgtcttaacttgtcatttaggcagaccttgttggtccgatgaaccaccagcctctgatccatttatgatttacacacgtgcattaaacaccagacgaaggcctttgagtcgttgaagctaaaaaatgaatggtatatgcatgcggactcactcggaagcctctccaatgtgcattgctcgactctaactccaacaaagtgtacgtaacgtaacaatcttaacgacaacctaaacaactaatagcaatcacaattccttaaagcattcgttagtgtaccatgtaaaattccttgaaccattcattattgacttatagtaccatgtaaaaaattccttaatccatatatcaagccatgtttttgtacaagaaaccaatttgacattttgaataattagattctttatttttattttttttaacttaaattttgaaataaaaattaacaatccataatgtagaacgtgatgtctctaaatttgataatgtccgaacttatttgcatggatgtttatatattacactagaactcgtattattgattattaatttaaacgaagtatcacgaatttaaactatattttcatactttgtctttcacacccgattttccgcgacaaatgcaaaatccagatactgaaaattatgcaatattaaaatttgaaaaaattgaaaaagtgaaatactaataaaattgagcgacacatttctgattccagtcttaactgttacactttcgagtgtcagatctcgtctttcttctccaactcgtctatcttcttctccgattaatctaatctctcgtcggagatttagaaatg

SEQ ID NO: 4597 - DNA, 3000 bp, Unknown; identical to SEQ ID NO: 4592
  misc_feature (1)..( 3000): cDNA_ID_2107235_gDNA_ID_1620716_Annot_ID_49119 3000 nt of promoter + ATG

SEQ ID NO: 4598 - DNA, 3000 bp, Unknown; identical to SEQ ID NO: 4591
  misc_feature (1)..( 3000): cDNA_ID_1824809_gDNA_ID_1620716_Annot_ID_49124 3000 nt of promoter + ATG

SEQ ID NO: 4599 - DNA, 3000 bp, Unknown
  misc_feature (1)..( 3000): cDNA_ID_1823660_gDNA_ID_1620716_Annot_ID_49126 3000 nt of promoter + ATG
tgtgatacgttgaggtgacttattgttagcctcctcttgtcgtgccttgtacgcaaaatgtaacgagacccaactacaagttggaatttcttcaatcttttgatccaagtgtttctcttatttaaaagaaatggagaagaatggagcctgatggaaagaacctgtaaacgctggaggcatcctatctcttcaactgttgcttgccctttttgtgtttctccctgtacgctccagcggtagtgacttgacgtcatgtcaagtgtctccaaacttgataacctcgaaacaactctagctggaatgctttcaaggtgaagtgttcgtgaaagatcaaggtgtctgaatctctttaattcttccaaccctcttggaaattcgaggatatgtgtgccacagagatcaagtagctcaagtttggcaagggtttctagtgaaggtagtttcacaagtttaaaacaatctcttaagaagagagaatggagactgaaaaggcgcaaaagagagcaactgggaaatgacttaatgcgagtcccacttagattcaagattcgaagagttggaaatgcttgcaagaatccaatgggtacttcctttagaagaaaattgccttgtagcagtaagactgaggtttttacgcagaactcttctacaagatcaggaaggctttctagtttattgttcatcaaagaaacccttcgaagagaaggagcaagcttatcttgtctaatatcttgcaaacccgttccagacatgacaagggaatgggaatcatcttgtgaggaagacatgatccatatggcgaaatcgcggacaacatcatgcatcttcaccgtgtctctacgatcaccatcttctaacaaacaataatcctttaaactctccacagttgtgattccctcgttcatggagtcctcttgggaaccgagttcctccatgaatccttcagccatccaatatcttacaacctctgtaacttcaatcgagtagtcttctggaaacaaagcacaaaggagaaaacaaaactttgccttgtcttccaagaaatcgtagctcaatttcaatggctggaagatcttctcttcaatgctcttgatccaaggtactgatttacttagcttactcaagacatgattccatagcttgacatttttctttccccgcatagctgttccgactgtgatgatagcaagaggcaatccaccacattcttgtgaaacagcttttgcaatcttcctaacatggtctgacctcacaacatcccctgcatttttgcaaaacaattcccaagcgtcttcttcaagtaagcaatccactctaacatcaagatctgtcttcatgctgcgacagacctctaaaaacctcgaagtcagaatgacttttgaacctttgttctcttcagttcgtgggatgcctaaaagatccaaatcaatgggtttccaaacgtcatcaagaatgagaagaaactttctctctttcatcagtccaacataaatccttcttgccaacttctcttcactttcttccatttgggtatcaatatccagtctctccgcaatctgcttttggacttctcttggatcaaactctttggaaactattacaaagatcaccaagccaaatggttgagtagcaccctcttcccgaagcttattgttcagcgtcctgaccaatgtcgttttacctactcctcccatgccccaaacaccaatcttttgggctttctcgcttgtcaagccatctctaattttggccaacatatttgacgccatcgtttgatgaacaactgagacccctggaacatgttcaactctttccggtgtagactccacggaaagcatgtcgacaaactctattccatccttctcaagcattttcacttcatcgagaatcttgacaagtttcctactcatcctgggtctcaaggacataccgcatgaaactcgttcctcaagttttaaccttgctttagatataacttcttccgcctctctttgccaacgcattagcttgagtctcaagggtttatctttggtcagcaaagtttcatgatcttcactcatgttacccttaagctctgtcaatctctcgagtgattcattaagagctttgacgtttgatttgaactttatggcattagcgactcttgagaacgttgactcatacatcaaacgcaaaatctcaccaatgacaggggcgcaacactccatggtgaagttttagttgaagaaagggccaacaccagcttcaaagaaacctttgagatctgcaataaagaaagacaattagttgtaagttgaaactaaacctacatgttgtctcacctactacaatccgatttgtttcgaatgttcaaagatagactaaaaaaaaaaaaatcctaatctacatgaatcgacaatcgatctccgaggatcgtgttaataagccaaaacgaaagaaagaagaataatttgtttgttgggttggcaattattttaatacagattaagaaatagcaagagatttacatttccatgatttaagtgtgtgatcgttttctatcattgtttagtgcgttataattgatgataccaaatgaaaataagaaaaaaatcgtagacgagttgcttgactcccaacttaaatctccaatatgtttactctgacaagtgacaacaaaccttcaacaacgaaacaacctagaaaacatatctgaccttattcaactacgtgacgatagagccacagaactgaccatttcgattaaaaaaaaaagtaatgatgtggttgtaaatttagtaagaggaacttgatgtgagactagtatcaacaccattcaagtgaagcctcgacaaaactttgtcgtttcatcaaactcagcaaagaagcaaatgaaagcctaatgcaggcccaagaagcccacaactcaagtttggaagcaacggtcttctgagacaaagacagaaactccagaagcttcaccaagtcacgacaagaacagagctggcacaacttcaccta

SEQ ID NO: 4600 - DNA, 3000 bp, Unknown
  misc_feature (1)..( 3000): cDNA_ID_1824891_gDNA_ID_1620717_Annot_ID_49127 3000 nt of promoter + ATG
gttttatttccgaatcttaagctggtgggttcgatcacatgcaaattacaattgtctattagtattacgtaaatacgaatatacatccatatgtaagaacacgtgtgtataactgtgtatatctccaatatacgtgcatctacatctataagtttacattgttttcgttatcttctacctaaatttattaattttcatttgggtcctattgttatgtcgattaataccctttaatttaggctgatgttctaagtccaaacatacaaacagccaatcttaacacaaaatcttaatctcagcatgcgggcaaaattgcgaccatacaactattatgctatgatggttctagtaataaaagcaggcatttagtttggaaaaaaagtaaaatctccttagagtactttaattagtaaccagtgctataaacgaattgtaaccaacacgcaatggaatcaataacactctattaacttaatatagatatgagaaactcgtgcttttaatctttgttaaaacgtcgacaaaaaaaaagtttttttctgttaattagttctcctctttttaaagttttaaatttttgatttcataactcactattaattgcgatatgtggggtcacctaagatcctccaagaacttatattcttgatgaacatatattgttcacaaattggaatcataatcttatcgtatgattgtatgtatatgtgtcacgtagttggacttttaaccactattagatctttccaaatatcctctctctttttttgcttcaaatttgttttttttgtgcacacacatcttatattattaatatataaaattggatgagctttataagagttttaattacatataggaaaaatagaactaattaataagatttagatatatgtataaacgtatttatatattgacatgtaagttttaaaataatatatcgtcatgggaaatatttttaaaaatcttaaaatacagtatggacttatatattcatactaaaacctagtggggtttttttttgtgtgtacatgaaaagtggtaaaagtattttctcttttttaattttgttagattaaaaatatgttaaggtagcttgttttgtttatcgtcatgtgttaaagtgtactatatggtaaagatttatacagtagcatgtgtaagcgggttcatgagtaggagagaattaaattctgccttaattaaacaaaggtttcgattagccgtacgtaccgccattaatagggagcataattatcacccattagggagcatactttgaccactaggggaaaattagaaacctatggtaatcgtattaattaatacggccaaaattaattctaattaacatataaaactgtttcccacaactaatttttatagatatatcaccttttagataaaatatagaaattctttcttcatatatatgttactaacaaataaaaatcataccgatgcaatgacctacaatctgaccggttagctcaacaactcagtatttgagaaatgtaattttgttcgattaccataggtttttatttgtataaatctaaatataatcatattacttctttttttatcgaaatataatcatattaactcacgcgaagaaactataataatccatctgacttctggttcgtaaatattgtcatacttaattagagacgaattgttctcatggtaatcagcaaaagatcgaatttcctaatttctaatactagtccagaaatatggtatagatttttatcataattttttttgtctagatataataaagtgtaaatggatagccacccacccactcctctcgtataatgtaaatttctcatttttttaatgatgccaaatccatataatcggaatttcaaccaccgtatttgggctatagatcataactaaagttatggaaataaatgaataaattaaaaaatgttaagtagaaaaaataagtatcaacaagagagaaggaagaagaagacataagctaacagttgtccgaaattgattttggcaaaaggtgatctttgattttgcttaaaacatcgaatcagaacatttaatttagttgtttcctcatttctttcatctatggagtttagtatacccaataaatttgattagttacttattccagctcctattattatatttaacacacataatgtaaaacagacgcgtataatttatatagaaactgtatgtagttaaaaacgacatactagtactgatgactctttgtttacgtaaatttgtattctcaaagaaaaaaagtaactaccttttgttatggtctctaagaaaaaacaaaagtactttacagttttcttagtgaccattctgtaagaatatcaaatagtgaaaaataggtaaacgagaatctttttttctgtgtaacaatattgtattagtgaaggattattaattacgagactattatctaaaacgcattagtgacccttttggatttaaatcgtagcagccgactaaaccaaaatatttagaaagttttccaaaaacaaacaacattaaaacacatttaaactcgtacacaataatagaaactaaactatttttagcagactaaagtctaaacaacattacgtttaaaaattgataatcagtgttttatagaactggcgatctcctaaagatgaaccaccgagaagtttcaagataaaaacaaaaataaaaatagccaaacactcttatctattcatccatttgcaggtcaatgacaccgtatttttccacaatcgaatcttccttattctttacacaaacttcttctctgtatgtaagtaaactaatattaaaattgaacttgtcaaagactttcctcttggtcacgtctgctatatatactccttcattcacacaaatgtttaactccaacacacttctctttctctcaacctctctccctctctctctccgattgtgtttttagagctgtcacgtgtcacgtgtcaggttcgaagctctaagaaaaaa

SEQ ID NO: 4601 - DNA, 3000 bp, Unknown
  misc_feature (1)..( 3000): cDNA_ID_1009276_gDNA_ID_1620717_Annot_ID_49128 3000 nt of promoter + ATG
ttttcatacagacagtgcaagtttaacgaatcaaatatagccttttcattcataactaatgccgaatctaatctaaacgcacgatgatgcaaaatacaatcaaaaccccacgacttctttcaagaattatgaggccatttactttctcttttgtttttctttggtacgtaaatttacaaatgtgattgatttgcctactaaacgaatttttttttatctacccttatgtattctgatagtaaatgttcaaattcaatcttacttcttagaatcaaaaatgtgaagaataaaaaacctcatccacacgtgtgtcgcggtcgttaggattttccaacccaatgctactttttgagggtcaaaggtcaattgaacagctggaagaatcttagccgtcagatcagtccccaccgcacacgcgtatcacgctgacaggctggcgcctaaaatcattggccaagtcccacgtgtgaactaatcatcaacgtcgtcattagttttactacattggtctcgtcttcgtgtcgtattacgatcgagctgcttcacaattatgttcttatggacttatctatacaacaacccgaaacctataaatctttattgtcaaaaggaaatacacattacacactatacacgtacttatattggacccaaaagtggttaggttaaaagtgtttgtatcagttctagtaattactaaattagaatattggtatagttccgttttttttctttttctaaatgataattcaataattcatatcatccattgtatgtaatctgtaaaaagtacggacagaaattcattgatcagaaactttttttttttaataaccaaattttgtggcatcatcattaattccgaacacagagattgatatatcacacttacatatatagattagttggatgattgctatatcattgctattgaaaaattgcaaaaagttcttctaattcagatgatataaaatgtgactgtacatttacttattatttaataaagtcgaatttgtagttgaaaataaatacttgtaatcaagtggtttgtactactagtagtctagtacccacgtcgtatcataacttcattcaaatttgcaagtgtatgtgttggagactttgaattatatactaaaaataaataggcaaaaaataaactgaatttccaaaaattctttaaatgatttcgtacgtgtattattgcttgtgatctttgtttttgtttagatgattttagtgagacgagaaaaaaagagaagaagataaaaatgcatgacatcacatgtcagtggatccagagtattatttgatgacaatctagtcagattaggcattcggtgtttaatcaagtacttgtatatgatagctagctaatcattaagcaaaaaaatgagatccaatgactaattaatatatttgattagcgtgtttaatgaagatgacatataattataatacggtgttgggtgagatatactttgttactcgctttgtacatacaacaagtgtttgcattattttattcctcttgaatatattgaatattacggatgagtctgattgtttctcaatagttttggaatggcaataattttatcaggaaacaaaaaaaacgaaaaacaaggtgataacaaaaagaacaataggaatatgaatgaaaaaaacaaaaaagaacaagaaaaacagaaaatgataataagtaggaaccaagagaaacatagaaatagaacaaaatgattatggtaaatggtaacaaaaaaggtgaattaatatttaatataataattactaaataatcatttatttgaattttgtttattattttcatttaaaattaaagttctgtataaatttaaaataatttatattataaatttttcttcaaaacatttatttattttatagtaaaattttcaattatattacaaagttaaaataagtttcactttaaaacatttatttatactaatttaaaataaattcataacattcattaaattgaaagtttgataaatttttttatatatatcaatatatactaaagatatgtaaaatattatatttaaatataaatattatcataaaagctattttaaatttatttaataaataaaaacgaattttatttttttgttcctcttggttcctctacaattttgttctatcatttttttttttttgaggaatgatgaggaaaaatgtaagacccatatgtataaaaatggaacaaaaataccttgcaaatggtaaaaaaaactgaggaacaaagaggaatacaaactttcctactcattcttttcctaaaaaatggttatgaataggagccaataatttagtaatttacacaaatcgaatatttctatgcgtgagaggtgagacctaacaattcaattcaaatttgacattatttgggcctccttcttaagattcgcctacgtttgatcaatctaatttcatattgggctattaagagttattaaaggctcatatgaggcctgtaatgtttttttcgccgcattatcggaaaaacctcaagaagaagagtggtgacataacaaaaccccaaaagctcccaagcctagagattctgttgttgatccgattcccgctctccttctccggtagtacaatctccgtcgccggttacatcagccaggtaagagacattagtttttattttgtttcgaagtttcatctcttttctttccactttatccccttcaaggaatttgtgctagatctacgcttttaggtcgctggcatttgattgattttggaccaacaaaagctaatttaaatgttcatgaggtcttgagatttgatgattaggcttttattttgtcgagactgatgttaggtcgaactatgttgatttaggtttgggattcgatttgattttatggaattggattccttagatagatcctttatatgcatccgttaggtcctcttttaatttgtaattctaaactgtgtcttagggaagagttttaagag

SEQ ID NO: 4602 - DNA, 3000 bp, Unknown
  misc_feature (1)..( 3000): cDNA_ID_1030940_gDNA_ID_1620717_Annot_ID_49130 3000 nt of promoter + ATG
atagctgcactttttggtctggaatgctttgcgtggtactgtgcaggagagattgtaggaaggggcttcactttcaccggctactacccttgaagaaagaaagcaaccccctcataaacaaacatgcgtttcagatccattgaataccgaaaagcctttttatatcataattagcggcttattatctatctcactgctgacattagaagcaaagttaatttctgtttctctggataatttatacacaaaagttttgaaggtgaggcatcatcactcgtgctagctctaataatatcagtcgactaatgttggccatttggttttttctttgtcattttcatttatgtgaataaccatttttcttgggtttagagtctataaaccgtttggtaagatgtatcattcgtgaaacctcagcacataccaaccttaccagagaagagtaagacggcattatattataaaccgtttggtaatatgtatcattcttcttctatcacaaaaaaggaagaaaatcctatatttttgacaattgtctgaaaatacgattaggttcagagtatttcaacgttgtctctgtcatttgtctatcgcaatttcgcataaaagcaagccttgtaggtgtagaagccatcacaccagattgtagtggatgatcggaaactaagacttcagtcatctggtattctcctctctctctctcgaccggtcctcactataagtcttctctttgtaacatttttgtgatcattttggatcgttagttttgtagttgttctttttttttatgagtgttttgatagtgaacataaacttgattcataagtcaactgtatgctcaatcaattggtttttgaagaagttagttctaagaatcaagcaattggataagataaaatcagataaaatctacacgccttttatcaaggcaaagcttatagtgtttaaagctgttttccttgaaaacttgaaagatctacactttcagaaaaaagttgtaaactgcagcaacccataatcaataaagaaccagtagtagttttcttcagttatgcaagcaaagattatatgaattagcatggctatttaatatatgcttttttccttgagcagagactttacagtgtttgaggaacgaagattgtgagacacaatggctaaggatgaagccaagggattgctgaaaagtgaagagctctataaagtttgtccttacatactcatctctacgttagttcacttctccatttctctgatacatttctgtgaaaaatgttgtagtatatactggagactagtgtgtacccacgcgagccagaggttctcagggagcttaggaacattactcataaccaccctcaagctggtatggctactgcaccagacgctggccagttgatggggatgctgctgaatctggtaaatgcaagaaagactatcgaggttggggttttcactggatactctcttctcctcactgctcttacgctaccagaagatggcaaggtatttgcatagatatgaccaaaccaaaagaaaaagtgtcatgatgtttttcgttgttttgcttctgtatcatttctgcaactgatttggtacacgagctctgcaggttatcgccattgacatgaatagagactcgtatgaaataggattgccggttataaagaaagctggtgttgaacacaaaattgatttcaaagagtctgaagctcttccagccctcgacgagcttttaaacaatgtacaacttcatacttctttgtctttcaaaaaaagaattagtatgtatcctgagatggtctttttgttttgatgtttgtgatgcagaaagtgaatgagggtggattcgacttcgcatttgtggatgcagacaagctgaattattggaactatcatgagaggcttattagattgatcaaggttggtgggatcatagtgtatgataacactctctggggaggatcagttgctgaaccggactcgtccacgcccgagtggaggatagaagtcaagaaagcaaccctcgagctgaacaagaaactctcggctgatcagcgtgtgcagatctcgcaagctgcgcttggcgatggtatcactatttgcaggaggttatattgagcgagtattgttgttctttgtgatctttagggtcatatgattgtgagccctttatattgagctattgtgatgcaagagtgttattgttctatgtgatattttggttcctgtgtgaatgtgaaccttttctatcaagtttgtggatttcttcaaatttcaagattataacagacagttacgaagaaacacaactcattttatgttttgtgtcttttggcaaaactccaaattctgaacattgctctaaaatctaatataaaaagtaaaaaaatgaatggggcgttccgagaatcgaactcgggacctctcgcacccaaagcgagaatcataccactagaccaaacgcccacattgatatatagtttgctagcttttaatacaatgtatattaaataatttagttttgtgatataaacagtaaacagaacaagatattttcacccaaagttaaaaaatccaacgtttgttcaaaaataagaaaaaaactatccaaagttaaattatcaaatgttaaaaatcgttagacgttaatcacaatataaaggaactcttttttttttttttgagttaagaaacacttagttgggccataaaaatataggtctagtagatgaaaggcccataaaatcaactagggttagttcttcttcttatagagcgccgcatataagcttcatccttctccgtcaccaccggctctgtatttcggcatttgtggagagaagaaggtactctcatccctttctctttcttatcttaatctccttttttaaaatttgtgacaaagtaaaatgagctaatctcgtctttaagatcatatgtcaaaactgaatttgagttttgatatattcaggtaaagagagaagatagaaacataaa

SEQ ID NO: 4603 - DNA, 3000 bp, Unknown
  misc_feature (1)..( 3000): cDNA_ID_1824872_gDNA_ID_1620717_Annot_ID_49134 3000 nt of promoter + ATG
ggttaaatagcagagaagagtatgccaacaaaattacccttcccgccaactattacacacaagctaaaatgaatcaattctcttatggttacgtcaaacacttaaactaacctgttaaccagcttaaaaaaaaaatatatgaaagttgcagaatgttgaacctataatctaacttagacattatcttgcgataggaatatattaaaatatttaaataattaatgctgacattgcgatgtcatgtacgtttccaatataaacactctcgattaaagtgaataagtgatgccctaagtgatatgtataggtcaggacattgtatattattgaatcatcaaatgaccattcgggcaggctgaggtacaaatagataaaaatcgatggtagataccagttggaaagtgaatggaatccttggcagcagaaaagataattttggaatctttggattttaatgtcctattatctcatagacaaagaagacagaatttttacttttaaaaatatcaagtttatagttatcgtatgctagttataggaagacatacttttcacgagtaaaagaacttttttttgtatgtattacacttctagtataaaaatacatgcactataatttctgattcataatttcataatcccctaccacgttatctctctttttgtttttgtacgtcactattgcctctcgatttttgagatacatgttcgtaataaaataaaataaatatttttaaaagtgatgtgtaaacgttttattggatcatatattttaacattttaatataaatagtgatactaggggtttgaagcaaacacagcattcaaaataagtcgctaaaagtaaaaacaaaagaaaaatggagaagtggatgaacttgagagacgaagacttaacggaagaaacaaagactctaatctcttcactttcttcagagaaagggtacctcggtcgaaacctctgcaagtaccaaggctcttggtattactacaactttctccaaggtgttctcaatttccagagaggttttaagcctcaagacactgatattatcgtcgcatcgtacccaaaatccggcaccctgtggctcaaggcactcactgtcgcgctttttgagagaacaaagaacccttctcatgatgatcctatgagccatcctcttctatccaacaatcctcacaacctcgtacctgtccttgagatgaatctttaccgggatacccaaacaccggacttgacctagctctcatcatcatctccaaggttgttctctactcacacgcctttccacacgctgcaagtagctgtcaaggactctccttgcaaggtggtttacatctgcagggacgcgaaagattcgctggtgtcacgttggcatatcgtttgcaggagtctgaataaagaagaggacagaaccattcttgagtctatgtttgagtccttttgcagcggagtctgcttgtttggtccgttttgggatcatatcctgagttactggaaagctagcttggaaaagccaaagcaagtgcttttcatgaggtatgatgagataaaaacagatcctcatggtcagctcaagaaactcgcagagtttttgggttgtccattttctaaggaagaagaaaagaacggatctctaaataagatcttggagatgtgttctctgcctaacctgagcagtttggaggttaacaagaccggaaagtcaatcaatggcatagagtacaagaaccatttccgcaaagggatagttggtgactggaagaatcatctaactccggaaatgggtagcaaaatcgacatgatcatgaaggagaaactcaaagattattccgaggtttggtttgaaaatgcattgtaataattaataagtgacccttctgatgttaaggtgcatggttttaaaattctgaattagtgatgtttatgtgttgtttgtgttttgttttcctttgaaatgcattgtaacaataagtacctgtatcctttgatcatgtaaaggttcatggtttcaaaattctgagaaataataaaccggatcggttatttcggttatcggtcggaccgtattaatgcatggcttgaccttgacttgataaccaagcccaacagttggaaaaaatcaataaaaggtaacaaaatagaaaaccaataaacaaatatcaattctagaaaaatatcgatctttctctgcaagtacttgtactagtcgtcgttactgtcaaataatctacaaagcagtgaccaaaaccaccatttccgcacatagctaagacctttaatggtttcctctctctctctatctctacctggctttgtaatttgtttaccgactacaatggtcaaaatttctctactcctataaaaatgggtcgccttgtttttgatcaacggatttgattcatctttctttttacctttcttcctgctttcgtattcaatttgtagttgaccagttcaaaagtctctataccagaaaaaaaaatcgttttttattatattataagacttttcccctgaaattgttgttcctctgtttcgagcgttcgttatgagtactgtggagagtagcaaaccgaagatcatcaatggctcttgtggttatgttctagaagatgtaccgcatctctccgattaccttcctggtcttcctgtatgtttacctctctctttttttaatctgatttgattaaagcttttgcttttgagctttaactgttgcaaaaggttgaaactttgatctatgttgatagatatttatatatcaattttttcagctgaggactgtttagtttttttgtttggaatttgagatagatgaaatgaatttcccagattctgattagtataagatagcccagggtaaagaaaaaggggtcttttgtatttgggtctcaagaattatgaacctggatcaaaatctgtagcatggtttaagagtttttgtccttttaccatgttatttttgggatcgaatgatggttaagttttgattaatg

SEQ ID NO: 4604 - DNA, 3000 bp, Unknown
  misc_feature (1)..( 3000): cDNA_ID_2051556_gDNA_ID_1620717_Annot_ID_165686 3000 nt of promoter + ATG
acctttttgagctcacacgagtaaagatgatctgtgtccatgttcgcactctgatttcttggtttgttaatttcagctaagggcaggaaatgtaattgagcgaacaggttagctttttgaagttttctccttacatctgaacgtttttggatgagtatgatttaacaaaattttgatggaccattgcacattcagggcgtacttttcgggttagtcatttggacgtttggttttataccttcagttttttttagttccaggtattgagaaacgctaattatctttttgtttgatgttgtaggttgtagaagcagagcataagcaacaaggtagaggaggagcttccatacaggtatgcatacctgaaactctttaatcaacagtctaatgttttgatcgattatttcatatttttctgttgttgatattccgtctcttagcctaaactctcttctctgtggaaaacaggttgagcttcgtgatgttgacactgggaataagcttaacttgcgttttggatctgaggagtcggttgagagtatgttgcttattccatagcttagtgttaattcatcagttacctactaaaagttgttttttttgggttctctaaccattttggtattagcatcgtaggataggtcgattactttttttgtgatattgattgattgcatcaatttactgcagaagtttttgttgaagagaaatctttcacgtgtttgtatgcagagggagatactgcatatctgattgagtgagtccatatttttttgtgtaatctcattacctgttttatatcaacttaaacactgtaggatcttgtgttgctaaagttgatttccttgattatgtaaatccaacaggcctaatacgtttgagcaagttgaagtgccattggacatatttggaaaagctgctgtatatttaaaaggttggtagcaagatgatatctttcgtggtgcatgtcatacttatttcctttgttgatggttgtctcaacaacaatatggatactcttgagtgcagacagtcattgttgagcaagttgagtgcatgtgctagaaatactaacatatttgtcatgtatctctttgtcccttctttcctcgtgattgacagaggaaatgaaagttcagttgcagctgtatgatggaagagctttatctgcatctatccctaagcatatcacatgcacagttgtagaaacacaacttccaatgaaaggcctaacatcagctcctcggtatgtcctttttctcaaaagtcaggaacgctttttctctatacggtataagcgtttaacatattattgattaacacatgtaccattttgtttaacacatgtaccattttgtttccttaacaccatgaatcaatcgtttataagttatgagaaaacgccttatttcttaaaatgcaggtacaagagagctctcctggataatggttccactattcaggtaagatgtcgttctaggaagttggagctattagtattgtttgatcttcaaatttcatgtaacaggaactagtctggttcatctaaataccaaaataactcttggttccaccttgaatacctcaggtaccatcttatctcgaggcaggtgaaaagattgtgataaacactgaggatgactcttttgttaagaggtattattaagtcaactctttgattcattactctgttcattgttgttgatatgggctttgctcacgttagtcctcttcttgctttcgctcattacagggacaacaaatgaaactattgcgtagtcgtttaatacttctcctatggaggatacatcggatatgttgagaaacgtttgatagaaagattaggggtttagtgtttatgaagctattgctattattattccagttctcataatctcggagcttctgagacttgtgtcgattgtcacaagttctatatgaagaagacttccgttgtgtacaaagatttcagaatcataaaggttaatttttatgatttattaatttttcggcccaacacctattaatgccttcaaacactaccgccgtgtccttcaaccgtatcaacggacagtgttgtgttggtcgtacttttcagatttatgtccagagctcacccaactttgctgagcttcttgaggcatgaaagcttcaacatggaaagcaaggactttcctatatattctcgcttatccagacgattttgagtcatccagagggaaaaaggtagatcaactgatattagaagacgatgctcaaatttacattagaaactccatccttgagtcagtgatgagtttttcctcatctcctcttgctgatgatgaaagtaaaggtctaatccttcaggtgctactttcttaccttaatgtcacttggtgtttatcttgcatctatatgcagttgcctcttcagtatcaataatataagcttgattctgagagtatatttgcttcatctgttcagacgaaaaccagattctgaatagccaatttgacgtaaaccgcgctttagttggtctatccgaatagtccagcccggtttaattaagtttgcaggttcgggtcgatcaaaatgtctattaccccggtggttaagagacatattcaacgaattaacaaggaaataaataatcaaaagaacccttaaaattcatcatcatatgttcattttcccaaaagacgaaaacagaagagaaactttaacgacaaagctccgtttctccgccgatcatctgacttttaccaccgtggtatgattctccatcccttcttatttatttaatcttcctcaaattcgccgttgatttgttcaactttagcctaaatgttcaacgaatcggatcgcattaataaacacagtaacctaatggcataatgggcctaatattttttcggcccaacacgaaaattacctgaacaattaaaaaaaaaaagaagataaaataaaaaaataaaaaaagggaaacaaattaaagagagagacagaaaattggaaatg

SEQ ID NO: 4605 - DNA, 3000 bp, Unknown
  misc_feature (1)..( 3000): cDNA_ID_3073751_gDNA_ID_1620717_Annot_ID_165683 3000 nt of promoter + ATG
atcagaaattgttgtgaatgctttaaaggaaattgttgtaattatggtgaccatttgaacgttattaactttatccatgttttttatgctatcaatgatgtcatgtaaataactattctcctggacatgccaacgtgttccgtgagttctaatttcgttccaacaatctagtcttcttctttagtttagcaccataatcacatctaccctaacatgttacatatggtcatctcttaatttctaaatgatggtttgaattataaatggagattttatgcattaattatggtgttgtgcaattctacgagtataaaaattgtaagctaatgataaattatatatacacgtaaattttacaaaatgttacgtaaatttgctccctcaattttgtatatttgcttatgaactgtgtcaatgtcacatccatatttgttattcaagccctggttaaatagcagagaagagtatgccaacaaaattacccttcccgccaactattacacacaagctaaaatgaatcaattctcttatggttacgtcaaacacttaaactaacctgttaaccagcttaaaaaaaaaatatatgaaagttgcagaatgttgaacctataatctaacttagacattatcttgcgataggaatatattaaaatatttaaataattaatgctgacattgcgatgtcatgtacgtttccaatataaacactctcgattaaagtgaataagtgatgccctaagtgatatgtataggtcaggacattgtatattattgaatcatcaaatgaccattcgggcaggctgaggtacaaatagataaaaatcgatggtagataccagttggaaagtgaatggaatccttggcagcagaaaagataattttggaatctttggattttaatgtcctattatctcatagacaaagaagacagaatttttacttttaaaaatatcaagtttatagttatcgtatgctagttataggaagacatacttttcacgagtaaaagaacttttttttgtatgtattacacttctagtataaaaatacatgcactataatttctgattcataatttcataatcccctaccacgttatctctctttttgtttttgtacgtcactattgcctctcgatttttgagatacatgttcgtaataaaataaaataaatatttttaaaagtgatgtgtaaacgttttattggatcatatattttaacattttaatataaatagtgatactaggggtttgaagcaaacacagcattcaaaataagtcgctaaaagtaaaaacaaaagaaaaatggagaagtggatgaacttgagagacgaagacttaacggaagaaacaaagactctaatctcttcactttcttcagagaaagggtacctcggtcgaaacctctgcaagtaccaaggctcttggtattactacaactttctccaaggtgttctcaatttccagagaggttttaagcctcaagacactgatattatcgtcgcatcgtacccaaaatccggcaccctgtggctcaaggcactcactgtcgcgctttttgagagaacaaagaacccttctcatgatgatcctatgagccatcctcttctatccaacaatcctcacaacctcgtacctgtccttgagatgaatctttaccgggatacccaaacaccggacttgacctagctctcatcatcatctccaaggttgttctctactcacacgcctttccacacgctgcaagtagctgtcaaggactctccttgcaaggtggtttacatctgcagggacgcgaaagattcgctggtgtcacgttggcatatcgtttgcaggagtctgaataaagaagaggacagaaccattcttgagtctatgtttgagtccttttgcagcggagtctgcttgtttggtccgttttgggatcatatcctgagttactggaaagctagcttggaaaagccaaagcaagtgcttttcatgaggtatgatgagataaaaacagatcctcatggtcagctcaagaaactcgcagagtttttgggttgtccattttctaaggaagaagaaaagaacggatctctaaataagatcttggagatgtgttctctgcctaacctgagcagtttggaggttaacaagaccggaaagtcaatcaatggcatagagtacaagaaccatttccgcaaagggatagttggtgactggaagaatcatctaactccggaaatgggtagcaaaatcgacatgatcatgaaggagaaactcaaagattattccgaggtttggtttgaaaatgcattgtaataattaataagtgacccttctgatgttaaggtgcatggttttaaaattctgaattagtgatgtttatgtgttgtttgtgttttgttttcctttgaaatgcattgtaacaataagtacctgtatcctttgatcatgtaaaggttcatggtttcaaaattctgagaaataataaaccggatcggttatttcggttatcggtcggaccgtattaatgcatggcttgaccttgacttgataaccaagcccaacagttggaaaaaatcaataaaaggtaacaaaatagaaaaccaataaacaaatatcaattctagaaaaatatcgatctttctctgcaagtacttgtactagtcgtcgttactgtcaaataatctacaaagcagtgaccaaaaccaccatttccgcacatagctaagacctttaatggtttcctctctctctctatctctacctggctttgtaatttgtttaccgactacaatggtcaaaatttctctactcctataaaaatgggtcgccttgtttttgatcaacggatttgattcatctttctttttacctttcttcctgctttcgtattcaatttgtagttgaccagttcaaaagtctctataccagaaaaaaaaatcgttttttattatattataagacttttcccctgaaattgttgttcctctgtttcgagcgttcgttatg

SEQ ID NO: 4606 - DNA, 3000 bp, Unknown; identical to SEQ ID NO: 4602
  misc_feature (1)..( 3000): cDNA_ID_1030940_gDNA_ID_1620717_Annot_ID_165678 3000 nt of promoter + ATG

SEQ ID NO: 4607 - DNA, 3000 bp, Unknown; identical to SEQ ID NO: 4601
  misc_feature (1)..( 3000): cDNA_ID_1009276_gDNA_ID_1620717_Annot_ID_165675 3000 nt of promoter + ATG

SEQ ID NO: 4608 - DNA, 3000 bp, Unknown
  misc_feature (1)..( 3000): cDNA_ID_1824891_gDNA_ID_1620717_Annot_ID_165672 3000 nt of promoter + ATG
aagctggtgggttcgatcacatgcaaattacaattgtctattagtattacgtaaatacgaatatacatccatatgtaagaacacgtgtgtataactgtgtatatctccaatatacgtgcatctacatctataagtttacattgttttcgttatcttctacctaaatttattaattttcatttgggtcctattgttatgtcgattaataccctttaatttaggctgatgttctaagtccaaacatacaaacagccaatcttaacacaaaatcttaatctcagcatgcgggcaaaattgcgaccatacaactattatgctatgatggttctagtaataaaagcaggcatttagtttggaaaaaaagtaaaatctccttagagtactttaattagtaaccagtgctataaacgaattgtaaccaacacgcaatggaatcaataacactctattaacttaatatagatatgagaaactcgtgcttttaatctttgttaaaacgtcgacaaaaaaaaagtttttttctgttaattagttctcctctttttaaagttttaaatttttgatttcataactcactattaattgcgatatgtggggtcacctaagatcctccaagaacttatattcttgatgaacatatattgttcacaaattggaatcataatcttatcgtatgattgtatgtatatgtgtcacgtagttggacttttaaccactattagatctttccaaatatcctctctctttttttgcttcaaatttgttttttttgtgcacacacatcttatattattaatatataaaattggatgagctttataagagttttaattacatataggaaaaatagaactaattaataagatttagatatatgtataaacgtatttatatattgacatgtaagttttaaaataatatatcgtcatgggaaatatttttaaaaatcttaaaatacagtatggacttatatattcatactaaaacctagtggggtttttttttgtgtgtacatgaaaagtggtaaaagtattttctcttttttaattttgttagattaaaaatatgttaaggtagcttgttttgtttatcgtcatgtgttaaagtgtactatatggtaaagatttatacagtagcatgtgtaagcgggttcatgagtaggagagaattaaattctgccttaattaaacaaaggtttcgattagccgtacgtaccgccattaatagggagcataattatcacccattagggagcatactttgaccactaggggaaaattagaaacctatggtaatcgtattaattaatacggccaaaattaattctaattaacatataaaactgtttcccacaactaatttttatagatatatcaccttttagataaaatatagaaattctttcttcatatatatgttactaacaaataaaaatcataccgatgcaatgacctacaatctgaccggttagctcaacaactcagtatttgagaaatgtaattttgttcgattaccataggtttttatttgtataaatctaaatataatcatattacttctttttttatcgaaatataatcatattaactcacgcgaagaaactataataatccatctgacttctggttcgtaaatattgtcatacttaattagagacgaattgttctcatggtaatcagcaaaagatcgaatttcctaatttctaatactagtccagaaatatggtatagatttttatcataattttttttgtctagatataataaagtgtaaatggatagccacccacccactcctctcgtataatgtaaatttctcatttttttaatgatgccaaatccatataatcggaatttcaaccaccgtatttgggctatagatcataactaaagttatggaaataaatgaataaattaaaaaatgttaagtagaaaaaataagtatcaacaagagagaaggaagaagaagacataagctaacagttgtccgaaattgattttggcaaaaggtgatctttgattttgcttaaaacatcgaatcagaacatttaatttagttgtttcctcatttctttcatctatggagtttagtatacccaataaatttgattagttacttattccagctcctattattatatttaacacacataatgtaaaacagacgcgtataatttatatagaaactgtatgtagttaaaaacgacatactagtactgatgactctttgtttacgtaaatttgtattctcaaagaaaaaaagtaactaccttttgttatggtctctaagaaaaaacaaaagtactttacagttttcttagtgaccattctgtaagaatatcaaatagtgaaaaataggtaaacgagaatctttttttctgtgtaacaatattgtattagtgaaggattattaattacgagactattatctaaaacgcattagtgacccttttggatttaaatcgtagcagccgactaaaccaaaatatttagaaagttttccaaaaacaaacaacattaaaacacatttaaactcgtacacaataatagaaactaaactatttttagcagactaaagtctaaacaacattacgtttaaaaattgataatcagtgttttatagaactggcgatctcctaaagatgaaccaccgagaagtttcaagataaaaacaaaaataaaaatagccaaacactcttatctattcatccatttgcaggtcaatgacaccgtatttttccacaatcgaatcttccttattctttacacaaacttcttctctgtatgtaagtaaactaatattaaaattgaacttgtcaaagactttcctcttggtcacgtctgctatatatactccttcattcacacaaatgtttaactccaacacacttctctttctctcaacctctctccctctctctctccgattgtgtttttagagctgtcacgtgtcacgtgtcaggttcgaagctctaagaaaaaaatgggtcttcctctaatg

SEQ ID NO: 4609 - DNA, 3000 bp, Unknown
  misc_feature (1)..( 3000): cDNA_ID_3073773_gDNA_ID_1620717_Annot_ID_165667 3000 nt of promoter + ATG
aaatttgaagaaaattagatcaattgtctcttaagacaattgatctaattttcttcaaatttaagagacttatctaatatttaaatcatataaaatatttattatttgtttagagttttactaagagtccactattgtggatgctcttaatccttacacattaaaatccctacattaaaataataattatttatttaattttgaagataataaaaaaattaaactaattaataaaaatatatagtaattggcagtatataactatatatatagaaaaacataacaaaaaacaaattaatacttgagaagataaagtaattcactggcagaaaacataacaaaaacaaattaatacttgagaagataaagtaacactggcagtggagaacttgtgttgcagagtacggcaacgtgttcgtacaaacacgtttgaaatattcttgcatgtcataacgcgttttgcaatattatactgtactactattgttttgggttctcattgaattcaagaattaagaaattaaaaatgccaatatataaatgcaaagtttgaaatacgtatttggtaactcgtttattggtatacgattaaatattatttagtatggtgattgatctgtatacacacacacgcacacggaaaactaatgattgtatactaaagtttgttctccattttgatatcaatatgaagagaaataaacttagagcagcaaatagtggtttgtgttcgtgttcttgatgtgtcattgctttgctacaattatgtatagtactgcatgtttgctaaccaaaacaattagagaagccaaatcattaatagttcccttcttagtatagggtttccaacataaaatttgatgttaacacttgcattatcagtccaaactgaagcaattgattagaattattatactcatcatatatatggtgttggaacttgtgaaaaatggatttgtatatacaattggggacttcattaatttttcgacagatatggctgtgtttttttatatgtataaatggctgtataataattgttgattagttgtaaatataatcaagaacacaaaagtgcctcgagaattaaaaacacacatggagtatggtcaagttgtaaattttgtaataatatcttataattaaggagtacactttattacaatcttcaatcattgctgaataatgcatgaatgggtcacatatatatgaagctttacatttgcacatatacaaaatgaattatcaaccaacatagctaatagcttccacttggacactgattctcatgcccaaaatataaataaaaaaatacgaacgaaagaaaaacaaacactttcgtgtaagaaggtaaaatacgacagtcagtctattctcacgtatgtatgtataatctactcactgattgagcaattaacttttattgaacgattaattagattgatataaagctttagaaatgagaagaatcaccaaaacgttacaattagctgtgtcaagtagtttaagaacaccaagccgttatgattagctccaatttgcccaattgtgttaaaatgtgcttattgtacaaatgcagataaagcatgtgatagatggaaattgttgctacgcgtgcaacttagtttttttctataaagttcaagttgctttacaggtttattggcagataatttcaaataccgagttatacaataaacccattgtgatacttaaagaaaacatgtgttttggttttggagcatttctatatagagataaggtatgttgctacctttcttttacagatttactgaagactcgaaagcaataatctatagacttgagaacacaacactgatcaaaatcttcaggggtctctcttttagtcaaatatacagtatgggttttattggtcaaagagatgcaaggagcttaaatccaaaactttgacggttacaaaaagataaaactagtactttgcagttcttaaatcattttttgcatgcttcgtttacaaaaaaaaaaaaaagtaccatttacttgtatgaattaaacgtgagtcacgaactttagtatgactttgaattttgatgatcaatatgatgagtaaatttcttgatttgatgaacagaatcaaaatagatatataaatgggccacatatatgggcctaattagttgggtttaaattaaaacatttcagttgtgattcacaaaccaaaaaacctggttatttggagtcatgcttgtaaacctgaatggttattgataatgttttggttttcaatataaaccggaagttttaacacaaacgaagattcagttaacccttgctatcgaattcgccgcgcctcttcgtctccttcacagagatactcttcgtcaatttgaaaacttccaggtaatctcatctttttcttcttcttcttctccttctatttgtattaagcgtagcctgagaaatctcctggtcggttttgagacagtgccctgtgctctaatttcggttgataccttgacatgtccgtctcttcttcgagggtgatttttgtttttcaaattcagatttaagatgtgacccagttactaaaacttctggttttaaggttgccatcatttatgtggaatatcctcagctcgattgaatctggcagtttttcgtttttctcttgttaatggtttttgttaagaagcgttttggtgttttagtgaataagaacactgccaatcatcatttcacgaacaatggtattagaaagtgcataattttctggatggctgcttctttggttggaattgtttgattcacatttaatacatagtctctattgctcagtttccaatcacttaagagctccgtgttgggttttctagagctaccgtttgatggatttatgtgaggcatcttaatttatccgttctttgtgaatcatcacttcacttgtgctaaacttgagaaaacgtttcccttgatagttttgaactgcagctgatttccgactaaattaaaggagtaatg

SEQ ID NO: 4610 - DNA, 1882 bp, Unknown
  misc_feature (1)..( 1882): cDNA_ID_3091862_gDNA_ID_1620717_Annot_ID_165665 3000 nt of promoter + ATG
aagcgttagctgctgaaaccgaacagccaaaatggtgggagaggaaagcagggccaaacatgattgacattacctcagctgagcagtttctcaacgcgttaaaagatgcgggagatagattagttatcgtagatttttacggaacttggtgtggttcttgccgtgcaatgttcccaaaggtaactttcccgttagctacttaacgattgtatctcttcgtgtatactcgatcatctctcatttcattcagttcgcgagtcttgaaccattatgtttcttaagcttgctcaaattatcggcttgcttattctaaagctgagactcttttcttattcttttccagctctgcaaaacggcgaaagaacaccctaacatcttgttccttaaagtaaactttgacgagaacaagtctctctgcaaaagcttaaacgtcaaggtgttaccgtatttccacttctaccgcggtgctgatggccaagtcgaatccttctcatgctctcttgccaaggttagttcttcttgtcccagctttctttaatttcaaacgtcacttgtctatcacgaaaccagagaatagttactgcattgtatagtcttgatggcgacctctaagtctaataagcgtctgcaaacatttatgcagttccagaaactgagagaggcgatagagagacacaatgtaggaagtatcagtaacatctcttcttcagcttctgagaaagttgaagattcaagtgaataatcaatgcctggttcagattgatcacagattattttgttaaatcgcttccctgtatatatgttgactgcattttccatgtggtgcatcataatttttgtacataaataaatgagtctgacttcgagttcatcgcctatcaagtatcagcttccctaaaccgagtaaaaccgggaagtgttgggtttcaaaattaacttggtgagttaacagttaacacacacatccaccgtttttagatagataagaggatgccctaataaaaccactgctttgtcttgggtaagaagaaacgttaacatgttagttgtcctacaaattcattcatctataaacgttaaagtctgtattaacgaatgaaagtaatcaaaagctacatatttattacacaaacaaaaatgcatcagttgcatctcgtctaagaaagcattttttcttcactcgaagaaaaataacaagaagttgaagccttaggctcacgagccaactcctttaacatgtcgagtttctaatccgagtaaaggatttgtatttcgtcgagaaagttgccgcttcttcaaatgtttggcatttgttaagttgcaacttgtctctcttcttcacgttgtccattgtatccttcccactggaatctttgtaggtggaataacaaacaaggaggaacagaaatcggtttgctaattggcgggttaatagttttgtaaaatggtagattaaacatgcgctctatcctgtaacatttctgagcttgagaacttgtagttgaggagaattcagtagcaaattcgttagtagcttccaccgctcgtttttcctagtattgtagctccaaatgtacatcattaatagatcatataaaagaaaattataatttcaaaaaaggctcaagttgaagtatccaacggtggtcaatttaagactataccaacgcctgtacttcaaaagtttctgcaagtattcattagcagtgacgaattcaaatttgaaaaaaaaaacttttatctgtaaattctccatccttaacggtcaaatttagtcgggcagcagacaaactctcaagtccgatcaggaaacgaaacgagaacaaaagaaaagagattggattttggtgacggcgtttccttcgccgtcgtgttcaccatg

SEQ ID NO: 4611 - DNA, 62 bp, Unknown
  misc_feature (1)..( 62): cDNA_ID_2051606_gDNA_ID_1620717_Annot_ID_165663 3000 nt of promoter + ATG
aagcgttagctgctgaaaccgaacagccaaaatggtgggagaggaaagcagggccaaacatg

SEQ ID NO: 4612 - DNA, 3000 bp, Unknown
  misc_feature (1)..( 3000): cDNA_ID_1815332_gDNA_ID_1620717_Annot_ID_165696 3000 nt of promoter + ATG
ccgattttcgattctttttcatcatggcgcacaagctcatcttcttcttcttttgtttctgttttaactgggggtcctccaaagctcatgtggttgtattccaacaaagaactcttgtcaaactcgtatccaggctctgtacaaaccgaacaatatgcattgaagttatatcacaagcagttaaatcacgaagaatcaagcaaatgatccacagaagttacaatgagattcctacattcatgactgtgttgcagatggaaacagaacatgataacaaaaaatacgtttggttgatacttacctcttcttgcgtttattctcttctcaaagagacgaattgggtcagagccttctaagcatgcggcataaagtattacactgtcaatatcatccagcaacatgatcagagagggtagatacatcattcatattgataggagataatcatatcaaagttcaattttttggctgaaatcaagtaaaaagagagaactaatggcttaatacttctaccctcgagaaaaattgactgttgagtgaggcaaggttctgggtttagggttttaggttaaaccttaaaacccagacaatggaacactaagttgagacttattcttgtcacaccaagccgcatagatgactgaatcgtttccaattctagtaaaggcgaattttcatttgcagctaaaatttccaatttttttcaaatcaacgaaacgattacgatttcagaaacgcttaaagtgagaaaacgaagcttacagagcgagctcgcgtgcggctcgaggactgcttaatcggccgctcttatcaatcttcggcatcgggacatctttcacctcctccgcggaaatagtcggcgtacggagagcgcttctagtcggagagagaaatagccgtagtgaagacgatgacgaacgtttatttcccgttcgcagggaaaccaagttcgttggccggagcgaatcaaccaatgtaaatcctatagaacggtgagaatctggtgaaacattactggagaagtaacagaggttcgaagaagaacgtaagcaaagcggcgagaaggttccctccatttttgtttcgagctctttttctgcttcgccgtgttagtgtgagaagcagataacgatatccgtaaaattgaaaaaaaaaacaaaatatctccggaaaaaaggattaaaaaaaaaaaaaaaaaaaaaaagaagctgaaacacacgacaacgttttagtctgatcaaaatgaaagccaaaaaatgtggcctatacagggatcgaacctgtgaccttcgcgttattagcacgacgctctaaccaactgagctaataggccactacgtttctaagtggtgcacttagatatttctctcggaatttcgtagattgtgattctgtgacagttttctttcaagacaagtatcaagtgcaacaaaaaaacatcggatatgggactcgtactcgtgttcatgaagataataaactctcatataactacttgactaaaacgatatattcgtatgcattagaaaaaacaattgtatataactaataaacatcacatgattaagttttaactgcaaataacgattttgttaccactgttaacgctcgttaattcggatgtctgattttgtcaaaaaaaataaaaaataaaaatatttaaaagacataaaaactaatttaggtattttggacaaatttagtagcacggatattaaataggcaaattaaaattaaatggagatttttcagcttttttcccataaaccgacctaaataactcgaatataaattgtcatgaccttttaacatcgtttaggtttctaatctttaaatccttcattgactttgcgctcgcctgtaaactttaagatgatctcatgcttttggttttagtaatcatctcaaattaagcattacaccaagacaaaatccacaagctacgggaacaatattatagaactcaaaagttgatatatgcgattgaacaaatatcaagtattcctccacttggaagattattgtttaatgtttactaaagaaccgttttaaaattaacacttgtcgcgtattagtcacgaaactgctgtaattctacacattgtggttgttgaaagtggttttgatttggtctttcgttagatgaagtcaatgtctactgttaactaattatttcaaacctttgttgagctgtttctttaccacataatcagattccatgatctttaatatcactagcagaaatcgacatgcaaaagtgtttgtttgacgatttctctactttaccgctggttcactgtaactgcttgatcaaacatattagtattatcctttgttaatgatatatattaccatttcgttaatcataacttcttcaataaaaatgtgaaaggtgcacaggccgacctaacggtaatatacgtatgagcttaattaatgtagtctagaaactcgaaaaatataaattgttaattagaggatctttatctctaaaaatcgatcattgacttttcgttcgaacgacgtgactaaattgtaatgccgtactgcttcaattatttccagttatgtataataaagaaagacccgcaagctacgttcggtaaaaaaatagacctatgtcacactatgtggaaaaccctaagtttaacgttcatgacgctatcaaaattcagagtttatcgtttaaatgatttgaccaaaactaaaaacagtacacgatcattaataaggcaatcctgttttcgaataaaatatgaaataagataggcccaccttgcctcacatctgatgctaaatttctagtcgttatataattgagatattattatctctctataaattgatggcttgacttagtattcggacagctttgaggttttgtcacgtgatccgacaagctacgagttctatatatacatacagagagcagtaagtttcttatactcaaaataatcatctctcataccactcatcaatattcaaacaatccctttctct

SEQ ID NO: 4613 - DNA, 3000 bp, Unknown
  misc_feature (1)..( 3000): cDNA_ID_3091954_gDNA_ID_1620717_Annot_ID_165695 3000 nt of promoter + ATG
accagatagatgattcgaataatgagagatatgatcttggggtccattcctgaataaaaactccaagagttgatgtgagacattagttgagtgatgcttgatatgagccttgactctggctttcgtccctcctctgcgtcaacgaggtcgtgtatttgattaatgagtgatgccatctccgaatcctccgaatcctttatttccttgaggatacgagatattttataagtgactgacgtgagcctccattgtgactccgtgggatccaagtctgtagagctggtgatagagataattcgagtcacgagtgataccaactgtgactctggtccagaaacaaccttgctgagagagattatttgcctaacgagtgatgtgatcttcggctcctgcttcggctctgaattcgaatccatatccagtgattcgatgagaggaataagttgattagcgtatgctatgaaatctcttgccacctcttgacacatatcctcacctcttaatgtagatatcattttagaaatgatatagaacatgagctccgactcccaattcatatcatctgtatagccgtagataagatcatctttttcttcttcttcggtggtgagaggcggcacttgttggttattgatgagcttctgttcctccgtctggacgagactggccacctcagaaaggagtgaaaagagctccgattcctcgtccattgccatgatgagagcgaatatttgagaagtgagtgacatgagctccggctctgactccttgagatcaaaatctatagagccgatgatagagatcattttagtcaccactgataccgactgcgactctggtcctggttctgaaacagagttgctgacataaattatctgcttaattagtgatttgagcttcgactccggctccggctgcgaatccaaatccagagagttgaccagagagattagttgacaagtaagtgctatcaactttgacttcagctgtggtgtatgtgtgtcttccccaccgcctaagatagataacagttgagaaataagagatatcatgagctccgactcggaatccatagagaaagggattgtttgaatattgatgagtggtatgagagatgattattttgagtataagaaacttactgctctctgtatgtatatatagaactcgtagcttgtcggatcacgtgacaaaacctcaaagctgtccgaatactaagtcaagccatcaatttatagagagataataatatctcaattatataacgactagaaatttagcatcagatgtgaggcaaggtgggcctatcttatttcatattttattcgaaaacaggattgccttattaatgatcgtgtactgtttttagttttggtcaaatcatttaaacgataaactctgaattttgatagcgtcatgaacgttaaacttagggttttccacatagtgtgacataggtctatttttttaccgaacgtagcttgcgggtctttctttattatacataactggaaataattgaagcagtacggcattacaatttagtcacgtcgttcgaacgaaaagtcaatgatcgatttttagagataaagatcctctaattaacaatttatatttttcgagtttctagactacattaattaagctcatacgtatattaccgttaggtcggcctgtgcacctttcacatttttattgaagaagttatgattaacgaaatggtaatatatatcattaacaaaggataatactaatatgtttgatcaagcagttacagtgaaccagcggtaaagtagagaaatcgtcaaacaaacacttttgcatgtcgatttctgctagtgatattaaagatcatggaatctgattatgtggtaaagaaacagctcaacaaaggtttgaaataattagttaacagtagacattgacttcatctaacgaaagaccaaatcaaaaccactttcaacaaccacaatgtgtagaattacagcagtttcgtgactaatacgcgacaagtgttaattttaaaacggttctttagtaaacattaaacaataatcttccaagtggaggaatacttgatatttgttcaatcgcatatatcaacttttgagttctataatattgttcccgtagcttgtggattttgtcttggtgtaatgcttaatttgagatgattactaaaaccaaaagcatgagatcatcttaaagtttacaggcgagcgcaaagtcaatgaaggatttaaagattagaaacctaaacgatgttaaaaggtcatgacaatttatattcgagttatttaggtcggtttatgggaaaaaagctgaaaaatctccatttaattttaatttgcctatttaatatccgtgctactaaatttgtccaaaatacctaaattagtttttatgtcttttaaatatttttattttttattttttttgacaaaatcagacatccgaattaacgagcgttaacagtggtaacaaaatcgttatttgcagttaaaacttaatcatgtgatgtttattagttatatacaattgttttttctaatgcatacgaatatatcgttttagtcaagtagttatatgagagtttattatcttcatgaacacgagtacgagtcccatatccgatgtttttttgttgcacttgatacttgtcttgaaagaaaactgtcacagaatcacaatctacgaaattccgagagaaatatctaagtgcaccacttagaaacgtagtggcctattagctcagttggttagagcgtcgtgctaataacgcgaaggtcacaggttcgatccctgtataggccacattttttggctttcattttgatcagactaaaacgttgtcgtgtgtttcagcttctttttttttttttttttttttttaatccttttttccggagatattttgttttttttttcaattttacggatatcgttatctgcttctcacactaacacggcgaagcagaaaaagagctcgaaacaaaaatg

SEQ ID NO: 4614 - DNA, 3000 bp, Unknown
  misc_feature (1)..( 3000): cDNA_ID_1824862_gDNA_ID_1620717_Annot_ID_49137 3000 nt of promoter + ATG
gagcgagaatcagttttccgattgcaagggttaaacggagatgagagggctgcaccatttcaagagaatctcaatctctcgatctctcttctccttctctaatgccacttctcctggggcagtaacgactaggaggtctctttattctttgagcaggtcgttgttgtcatcaaccccgtacgccgccggtggatgctgccgagaaacgcctccgcttcattctccgtggtctgctctgcaacgccgcggtgttaaggttaacgcgattcaggtaaagtttaactgcagagattaaagtttcttactcatttgactagcgaataaactattattgaacctttttgagctcacacgagtaaagatgatctgtgtccatgttcgcactctgatttcttggtttgttaatttcagctaagggcaggaaatgtaattgagcgaacaggttagctttttgaagttttctccttacatctgaacgtttttggatgagtatgatttaacaaaattttgatggaccattgcacattcagggcgtacttttcgggttagtcatttggacgtttggttttataccttcagttttttttagttccaggtattgagaaacgctaattatctttttgtttgatgttgtaggttgtagaagcagagcataagcaacaaggtagaggaggagcttccatacaggtatgcatacctgaaactctttaatcaacagtctaatgttttgatcgattatttcatatttttctgttgttgatattccgtctcttagcctaaactctcttctctgtggaaaacaggttgagcttcgtgatgttgacactgggaataagcttaacttgcgttttggatctgaggagtcggttgagagtatgttgcttattccatagcttagtgttaattcatcagttacctactaaaagttgttttttttgggttctctaaccattttggtattagcatcgtaggataggtcgattactttttttgtgatattgattgattgcatcaatttactgcagaagtttttgttgaagagaaatctttcacgtgtttgtatgcagagggagatactgcatatctgattgagtgagtccatatttttttgtgtaatctcattacctgttttatatcaacttaaacactgtaggatcttgtgttgctaaagttgatttccttgattatgtaaatccaacaggcctaatacgtttgagcaagttgaagtgccattggacatatttggaaaagctgctgtatatttaaaaggttggtagcaagatgatatctttcgtggtgcatgtcatacttatttcctttgttgatggttgtctcaacaacaatatggatactcttgagtgcagacagtcattgttgagcaagttgagtgcatgtgctagaaatactaacatatttgtcatgtatctctttgtcccttctttcctcgtgattgacagaggaaatgaaagttcagttgcagctgtatgatggaagagctttatctgcatctatccctaagcatatcacatgcacagttgtagaaacacaacttccaatgaaaggcctaacatcagctcctcggtatgtcctttttctcaaaagtcaggaacgctttttctctatacggtataagcgtttaacatattattgattaacacatgtaccattttgtttaacacatgtaccattttgtttccttaacaccatgaatcaatcgtttataagttatgagaaaacgccttatttcttaaaatgcaggtacaagagagctctcctggataatggttccactattcaggtaagatgtcgttctaggaagttggagctattagtattgtttgatcttcaaatttcatgtaacaggaactagtctggttcatctaaataccaaaataactcttggttccaccttgaatacctcaggtaccatcttatctcgaggcaggtgaaaagattgtgataaacactgaggatgactcttttgttaagaggtattattaagtcaactctttgattcattactctgttcattgttgttgatatgggctttgctcacgttagtcctcttcttgctttcgctcattacagggacaacaaatgaaactattgcgtagtcgtttaatacttctcctatggaggatacatcggatatgttgagaaacgtttgatagaaagattaggggtttagtgtttatgaagctattgctattattattccagttctcataatctcggagcttctgagacttgtgtcgattgtcacaagttctatatgaagaagacttccgttgtgtacaaagatttcagaatcataaaggttaatttttatgatttattaatttttcggcccaacacctattaatgccttcaaacactaccgccgtgtccttcaaccgtatcaacggacagtgttgtgttggtcgtacttttcagatttatgtccagagctcacccaactttgctgagcttcttgaggcatgaaagcttcaacatggaaagcaaggactttcctatatattctcgcttatccagacgattttgagtcatccagagggaaaaaggtagatcaactgatattagaagacgatgctcaaatttacattagaaactccatccttgagtcagtgatgagtttttcctcatctcctcttgctgatgatgaaagtaaaggtctaatccttcaggtgctactttcttaccttaatgtcacttggtgtttatcttgcatctatatgcagttgcctcttcagtatcaataatataagcttgattctgagagtatatttgcttcatctgttcagacgaaaaccagattctgaatagccaatttgacgtaaaccgcgctttagttggtctatccgaatagtccagcccggtttaattaagtttgcaggttcgggtcgatcaaaatgtctattaccccggtggttaagagacatattcaacgaattaacaaggaaataaataatcaaaagaacccttaaaattcatcatcatatg

SEQ ID NO: 4615 - DNA, 3000 bp, Unknown
  misc_feature (1)..( 3000): cDNA_ID_1824941_gDNA_ID_1620718_Annot_ID_49143 3000 nt of promoter + ATG
agattaaaaatgatatatttggtaatgatgttaaatatttgtcatttgttaaaattataacatgggcattttagtcatttttattagaatgagaatgtagatgaattacaaaatgatcaaacaaaaaaacattcagttaaatgcatcatttagataaaataccaaatcatcaaacaaacatcattcaaatgcatcatctaaatggatcatttggatgtaaatgccaaatgatcaaacaaacaggactagaagagaagaaattgattcgtatgtagttggatggaggggttaatgactgtgcagcttaattaaatgtaatgtgcaaagcccaaagacattgcatgtgttttgagtgtatcaatttttgcaatttcttttacctaacgcgtttatctcttgactcacacatactcacattacgtgttactctcttattttgacatgctttaatctaatctttatcccccccaattagtttgctatagaagtttcagtttcaaagaagtcttactattgttttcgtcaacacaagtcatttattattttgccaacaacaagattttgtattttataaaccacacgtcaataaatcaagtcacctgaccaatcatattttgacacgtctcatttttataaaagtattgttattgatacacctcaatagattatataaatacttacattgcttccattacaagttgtataaaaatgtacacacaaattatcttgtaatgaattgaatctcgcagaaaaaaaagattcggacattttgaagatagcaacaatggaattattcgttgattccttccaataatactattttcatttattttagggaaatttacatttataacatacaaaaatattataattagataactaaccaaaaaaaaatagtccaatgatattgtgtgtatttcctatattttagacataactgaccctaagataaaaccaatcaactcgccggtaccgattacaacgtcgtcaccaccacaaagtcaccatcaccatcaccgccatcatcatcaccaccatcgtaatcaccacgtcgtcactactaaaaccaccagaccgttactatttatcacggatatcaccgacaccacggcaccaccatcattatgcccttagtccctcaccatcaccatcgcaaccaccacggcaccaccatcatccccatgaaatcaccatcatccctatgtcatcaccatcacaaagctaggttaccaccaccatcacaacgtcagcaccgccaccatcaccaccacaaagtcaccgtcaccaccacaacgtcatcaccgccaccatcgtaaccactacgtcgtcactacctaaaaccaccacacgtccacaccgttgctttatcatggatatcgccgacaccacggcaccaccatcatccccttgtcatcaccatcacaaagtcaccaccaccatcacaacatcatcactgccaccatcgtaaccaccacgtcatcactactaaaatatcgtcaaatttttgacaacagaggttaaaatcgtcattgataaagtccatatattattcttttaatttcgcaagttatagtgctatatccttaaatattttatcataaatagttattgccttaattcaccctttattttattcttatttatttaacataaaataaaaataaagctttgaacaaaaatggcgatcattttggtaaccgtctaaaaaaaaaaggaagaagagaattttcaacaattgcactataaagaaaacaaagccacgtgattcgtttctacgcctgcttgactccattaaagaagagatcattcattgatattaataatcttctcctctgtaattccaatttctcaaaaagcaattttttctttttagggttcttttgaattttggggtaagctctctcttaagcaccaccactacattgatttgactgacttcatcaattagagaattcgatttatttgatttagctggaaacagagatttaccttgattcgtttcttcttcggtccgattctccgctgcgtaaaggtatggtttttatcgattctcgagttcaataaagtcttgggctttgaaattggattgtgtttgcatgttactgattttcaaaatcttaatttattgcgattggttttcgtttttgatgggttactattgaatttaagatcatctaatgatgtaagttttatttttttcccatttttgggattctgcaacaaaagagtcacagggttgccaattctggtttgttctttagctttctctatggagttagttgtgtgttcttagtgattctgtatgatttgtatgaagatagttacttgttcagttcttagttgaagtgttttcaccatttcctttgataaaaccgaggagcttaagtaacttcagggttgttgacaaaaattgtgtaattgggaatatgttgattagatataactggcatacaagaattatgaggaaatttgagttcttggctaacaatttgggttgctttatgctgttttcttcgttatggtttctagtatgtttcttcatcttcgtgggtgttgtacagtggctagtagctgttctagtatcagtgacgaacttttggaattaacggatcaagagtatcttcatttcagatagcagttcagcttctctttaagtgaaatttgatgccaagtatctttgttgttagtgttggcactagtgtaattcaggatttcattgaatttgtagctgttttctccatcattattaatttgttgcatcatggatactgtattactgttaatattactgaatcacactgctgactttattcttttctttttcttgtttcattaggcacaaggttttgtcaaaccggaagctcaaatttattcattaacctttccttgccctgtcaagatttttactgtcatcaagaaattcaaggccgaaacttataggaatcacatgctatggtctctgaaaggcattctgctcgtttatataattccctcccaatg

SEQ ID NO: 4616 - DNA, 3000 bp, Unknown
  misc_feature (1)..( 3000): cDNA_ID_1824937_gDNA_ID_1620718_Annot_ID_49144 3000 nt of promoter + ATG
ggttctaccaagtccatccaaatgagtttcacaaattagcctaaatttacaaagtcattcacatggaacatccaaatgattcatctaaatgatctgttaatttgtaaaaaacaaacatcatttttcatctccatctagatgatccatatggatggagaaacaaacaaggcctagtaactttttggatttgagctctcactttttatttttgtcaatatcttttagatttcgattatgttttcatggattcaaatcatttgaatgagatgttaacaatgtttaaaaaggtttcttaattatatcatcaactattcaactttattcttagttagttatatctgtaactttatattttagggaactttatacattattggctttagaaaacaaaacaaaagtcttacgagttttaaagttatattaagctatcttctaatccacgtgggtgcattgctcaaacaaagaacagaagaacttattattggcttattaatttactactacttttgatatctttttcatcacatgactgatcactagtcattgtttttgttaccaccgatattgcgaatcgtggaattgtcagagtaacatgtaggatcattatatcaatatctaatactgatagctcgaatatattgtgtttcttctggttgttcgaattttttttgtacataacacaattcgagattcaaatgatcagattttagatttctagttactcctaagaaaaaaaaaatgcttagcaaatcagattttataacattactactataccttttttgttttaatgattacttcgaatgattactttcgctgatataaaaaaataaatcgtgatctaaactttcatatatctactggaattttacaaaagctacgtaacaaaattgataaagtgatgagcatgttacgttgccacgtttcattttttctataataaatagaactgttcattcgacaatgggttagtggttgtacgtatatatatatatgctcgctaattggacggtgcgcaacttcaagcgttttaaattatgtggcacttaacttgtctgtcgaattagtaattactttcgctgatatatatcactctccgagcataattaatttcatgctatcaaacaaaaaaagattcatgttatacttggtttggttgaatagaaactgcgtggactttaaattgatagataactttaagtataaaaataagaaaattaaactgctgatgtctccaaaaagacaaagtaacacatctaaaatctacgtatgtggatgtcatttgatacacgtataaacaaggtgtagttaatccaattaattaaaggaggagaaagtggtacaatggaccaatatggatatattttatgctttacaacgattgatgcaaaggtatcttcgtgttacacttcattattacatttatagattggacttgggcctttgctgattgtgaggactgatgactgatgagaagcatattggttgggttttatttgaatcataaagaaattaaaagagactagaatatgacccgcggtatatcgttatattctgtagtaaaaatataacgattaaaagagattacatataattgcattttggtaaacaagaaaaaatattataattgtaacttgttatttagatttctgtataatgtcttataaatatttgaatactgtaatttactcgatataatattgtaacgaaccttaattttttgtagctataatatttttgacaccgatacatagaatttaagaaactataatcgataagttaacattacatggtagttaaatttaagttacctttttaacaatgcttgtccaatattactacctaagaagatattcaacgaaaaatagattgttacaaatctaaagtttaattttgaaaattttcttctcaatatatacacaaaaagatacttattcaacaaaaactcatatctctcctatctcaaaaaggaaataaaaataaaaggataacgacacaaacatgaatctctatccgaatctatctgtcccgtttataaattaccccacagagctcagggccattgttttttttttcttggtgaaaatagggttaagagaaaacccgaaatattagcgttattgataactaagcaacagagaaaatctggggctctctttctctctgggcttttgctatataacttttgaggtatatagtctcttgatttttttttctgtgcatgaaaaaaatgatgagtttttcagtaatctttcgaagccgaatttgaattctttgaagattgtgacatttattgtagttcctcctccatttaaagctggtaaacaaaagtgctcttcgttgtttgcattttggttttccccattttgctgccggagataacgagggaaattataactcactaggatacatatttttttttggttttattgaattctttcatttgttttcttgttgcttattttattttataattttgtttttcctctggaatctgttgtatatgctgagaaaacactggaagatgccaataaaatagaaaaatctcgtttctttttgttaaaagtcgtcgttattacttatcacgagtattatgtgatgctagacactcattatcaaatagccgttttcttaaaagttacaatttgtttaaagctgtgtatttaatcgaaattttcaatttatttctctttgtgtactaatttcttctgcttttttcagaatctaaattcaccaaaaatacgaagaagaacgagaacaacaagaggtaccacacatttgtgattttgcttaacttttgtttgattataagttgactctttaattaaagaaaatcaacaatcaagttaataacttttgacttgaaaattttaagtccaaattgatacaaaggtataaacaaagaagtttgtagtatatatatacttgtataacaagtttagtcttaatgtaactagtctttctctagacatgtctctgattcttgttttgttgtagaaa

SEQ ID NO: 4617 - DNA, 3000 bp, Unknown
  misc_feature (1)..( 3000): cDNA_ID_3000039_gDNA_ID_1620718_Annot_ID_49145 3000 nt of promoter + ATG
gccactctcacatcaaagagctcgtagtaaaaaaatggtgacattttttgagtccatcatcttttagtaatgccacacatctacttcttttttcacttctttttcctttggtaagttattttaaaatcttatctctaattaaattggcgtgattaaccaacaaccacatagatgaatatagatgatcttgaagattttcaatatttattgcaatatttcaattgatctatcatagtgtgttttggatatatattttttggtttaaactgctacttccggtctgattatttgtttacaaaaaaaattatttttattttcaatagattaattttaaatttaaatttgtttctatataaaatgaaatttatttaaattagttttatctattgattaagtaaaaaatattaaaaattgtttcaaaataatatttactcaagcatcaagatatatcaatgtgaaatttaagacatattgtttcgagatgattaagacgtcataaactcttgaatattggcaggcttccccaacctaaaagatgaattttattagctttgaaatagatttcttaaaattttatttttaatcgtatgaaatttgggactaattatttagtttgttactttgtttagccataaacccataaccaattttaagggggcaaatgttatgggccttcggcccgataacaaccgttggtaatatatttgttaaagtgtgtatctttcttttaagcgaagatagtgaaatagtatcgaacctacctaccccgctcacgtgtataaccacgagttttgtgcaaccatcgatcgtgtcatcacttttatgtcccacaaaatcgtgacgtcagcgtaatccgactcatctctcagagacggtctgaaattggtacattctttaatgatgtttgaccatttttagtaaccaagtcggacggtcaggatgataatgagatctcaatcggacggtggcggagattccaaggtcttagggagattgttgttagctttaggaaaacgacaatgttttcacatgtttcaaagtccaaactcattgattccaaatcacaccatgttctgtctgatctagttaacagctaatcaccaaaatattactgtatcatgtataaatttttcgaattatctgaaaggaatcgatctctgtcctacacttacataaaacaatttacacctaaaatgggaaccactaatctataaaacttaagttttatttatttaattttttggttgagttttttttgttgttaataatattttgtttttacgtgatgtttccacttttcatgttgttgaggactataacatttcaaaatctccctattaataaactagattacaaagagaatcaatactagtgttagaatataaaaaacaaaattagttaaggaagtttattgatagtgtgaattaatgtataactcatgactttttcatggtgttgagttggttcggagttaatctaatcaattaatggtatcggacacattagcaatccaccaggtcgtaggtttaatttaccgaatatcatatcttaaattacttctattttttcagaaaaaatcaatatttctaatcgcatgtaaaatgagtgtatttaattaagagagaaaaaaaaacatatctaatcgcatggaaaatgagtgtattaattaatcctcttctttaaatcatattcttttttttttacaaaatctttttccatttaatttaccgaatatcatatcttaaattacttctatttttttagaagaaatcaatatttctaatcgcatgaaaaatgagtgtatttaattaagagaagaaaacaaaaacatatctaatcgtatggaaaatgagtgtattaattaatctccttctttaaatcatattctttttcttttacaaaatctttttttatttaaatgaaagttgaagttcctaacaaaattaaactataatttaaatctatttttctctttctaatttatgatttcttaaatatgaaacaaaaaagaaaagataaaaagcaacgaaaagaaattcaaatacagacttataagtaaaattatactatatttctaccaaaaaaaaaaagtaatttatactatattttttaattatctttaatacttttttatccattttatttattcaaaaacaatccttaattccaaatagattgaacttaactccaagttatctcaccaagttacatcagaaagctactctatcatacttatcaacaaaccaattgaatccaaaacataaaccaaaccaaaaaccataacaagaaaaccaaaaccaaaatttaggagtagcgaattggtaaattaacgaataagaaaagggtaaaaaaggaaacaaaaagaagcacgagggagagctaactcacgaagtctgcgttgtccagattccggactgcaccaatctctcacaagtcacaacatatccattttccaggtaattattatttgacacctttttttttttttgttcttgttttttttttggtaggcttttttgtttgttcacatgtagttgtccccagaaaaatataaaataggttaattttgaaccaaaaagtttctttaattacacaccaaaaattttataattaagtattgattccaccaataaatatatctggcatgtttcagttagtttaaacaaaaccatcaaatttgaaatttaaaatttataactaaaaaaatgaagaacaactgtacaagtattttgttgaccaaatttaaaaaaaattcacaactaattataaattaaatttttttattaggaaaataaaaaataaagaaagaaaatctgctaatttttctcgtggacttgtttattaaaaacaaattgagttttcatcatcaaccgattcatatctttcttcttcttcctctacagcttcttcataaatctctctctcttctcctctcttctcaaagatcgaacctttcgatttcagtctcttcagagttctttcgttttcatcgaaacaatg

SEQ ID NO: 4618 - DNA, 3000 bp, Unknown
  misc_feature (1)..( 3000): cDNA_ID_1824933_gDNA_ID_1620718_Annot_ID_49146 3000 nt of promoter + ATG
atatcaaccagagatccttggaaggaactagagacactgaaatcgctatgggagggtatcagccacaccattcatgggctaagaaaggttctcgtcctcgtggtcaggtaaataagactttcagagacttctacttctcaatctaggatagcattctaagacgaaaatctagaaacccaccaatgtatgttctctttaacatgtctgaaccctggtttgtctcaatttcttgcagatctttggatatagaatgtcgttatgggcagaacatctagggtttctagagcaagaattcgaggaaccagagaacatggaatgcgtgagacgagttaggcaattgagtgagctgaattggagacaatatgcagcggaagaagtcacagagatgccaggtcatcttcttaagtatccagttcaagttgatagaacaggcaaagtgagttctcttcctggatacgagacattcccagatctcggtggcaagatcataggatcgttccttgtagtagaagaaaacctcaccatatgaaacttaccttgtaggcttgtagtgatcaacatttgttctttatttccttcacttcaagaaatctatctgagtgtgatctgattgaaagtgtgcctttagggtctagtttttcaaatttatgagctgtaaatctatttattacaatatttcaattgatctatcaaagtgtgtgttgtggatttttactatatgatttaatttagtaatgttgtcatatctttagtactatatgattacaatatcacattggcttgtagaaaatgaaaaatgtcatcctgaaagagcttttgccaaatcattcataagatcatgcatcacaaagcttgtcatggtgatatccaatctctgaaaaaaagatttgagcaaactaaatcaccaaggtaatttttccaatcttgtgctgctccttggttggtataagaggtctattgccatccatagcagcagtaattgagcagagggcaaagcatcgcttaagttgaggaggaagagagtcatagcttggtttaagtactggaaggatactgttagtgtagcttgagaaattctttgatgcaatggctcgttcaagaccttacactgttctgcaatccttttcccaattccttctagttcttggttgattatatttccaaaaggaaatctagagatcagctcccaacattcttcatttggtagattttttcatcctttgctactgtggagacaatttcacttgatgtggttagaacaatcttgcttccttcctcaagaaactttcccattctgaatctcagaccaaaaatcatccagagcaacaggtaaaagtcttctgtttgccaaaagaatctctaagagacgggtgacgtgtcgttgtgtgagtgggtgaagggaaaatatataaagagaaaataaaaatcgactcccgtgtttctctctctctttcacgcgtttctcttcaaaggctacaccggaggcgatttggagtttaatcggaaccactcggacgagtctccgatgtagaaacgaggaagattacttcaattgagattaagaggcatagagagagagatttgtgtattcgatcgaatcaagcttgggtttgttagtaatggcgagaatagctatagttttagatctactgaagaaatctcaatccaagcacagtcttcactcatcttccttctcttccgccgccactgctccctttgcgtctaggtttctattcgggtatgtattctctctctctctctgatttgcatttgtttgactttcactggatcgtggtggatataattattggattgattactagttttctgattttgttcgagaaattagggtttagaaattcataattgatcatcttctattgctcagttgaataagaaaggttgcagatttatagtttttatttgattggaatgtgtcacactaattcaaggctatgtcagttactagtaaaggtgaatattttgcgatccagtttgaaatgtagtttatcaatgaatagttttacaagctctgtttttattctaaatagatcttttgataggtttcattcatgtgtcttttcgatactctcggtgattagcacttcatagaggactagttggcatgatttgttgtgttacgacattgactacacgtttcagttataacctattatcaatgactcagattgtttatgttacagttctttcgagcctcgagtttcgtatcgtggtgttgctgctggaatagacgatgattaccttggtgctatacggaaaatgtctgcggatggaaacttctaaagggtaacatcatctttaatatgatttcatttaaagaaaatgtcatgctttatttattaattacactactaaatgatataatttagtgattatgtagaatgtttaatttcttgttgatatataagaatagtaatatcaccaatcaaaatgaagttgcatcaaaaaagggccagagagaaagagctttgtgagcagccaaaaaccaaagtgggcaagtcttctttcttagtcgtcgttactaaaacacaaattgtttattcggcatttgtgtttaattaagttctttaattaatgattaaagatcttaaatttgtgttattaatggctaaagttaaacgattcaacaacggcatccaaaatctttaaatttttccgattcttccgttgcaagtcaacgttttccttcgcttcctcctaccttcttcttcttcttcacaaaaatctgaactttaaatttgaatttgcccatatttttagacccacatttattcatatagatttgatctgagtttgtattatctcaaagttttatccttttgttgaatcttgatctttcgattagtccccaccaagcaccaagtgatcgatcttttgtctcactgaacttggttatgcttgaaatttgatctgacaactaaaagtttcctgctttggaggtttttgattttgtatcatccagtttataacgagactatg

SEQ ID NO: 4619 - DNA, 3000 bp, Unknown
  misc_feature (1)..( 3000): cDNA_ID_1824929_gDNA_ID_1620718_Annot_ID_49147 3000 nt of promoter + ATG
caaagcatcgcttaagttgaggaggaagagagtcatagcttagtttaagtagtaactactggaaggagttcgctatgttttccctcgtaacttgttggagccaaggagttgcaacaagtcagacaggaaaaactcaatacaattattagaatagggaagcagataaggatttgttgacttgctcttctctatgcaatttgtcagcaaatgataataatgtcaagattcttgagattttcttcttccatttgatcatgagtagattcataagtttgcagacatttttccgaattttttttacttacatccccattttctgaaagtgttattacattttcttgcagtggccatggagcattcaacgcgtcacaccatcttttttcctttctatcttctctgatctatctatattatctctaaaagatttgagagatggtgttgaattcaccacaattctgcattccaacctaaatcaacagatcaaaaaaaaaaaaaaaaaaattgaataaaaattatcttttatacaatatctttttggtcatgacatatatccctatttacaagttttgttcctttataagaactaagaagtgtgtgtctttttttttttgtgtgcaaccaggtgtgtgtgtctttaggttagagttatttggtatgttaagaggcgatgacgtgtcgatacaccattggtgggattataatgacaaaacccaaaaaaaaaagtactcacgtgacaaattttgtttgtttccccatttcatcgtctctctctttttgtcgaccttcaacgcgaaatcactcgatccgatgaattatgaggagatatgcgtcggatccgatctgtcgttatattcatttcaacgtcggtggagaccctcgacgatttcaaatcggagagtatgctccaatctatttcccatggtacgtatctctctgttttcatttttttcagttccttttagccgagattgatgattggaattgaaaccatcaaatttcgaaactgggttttcttagatcttgtcaattggaattaattttagtgagtctggtagttaacgatagatttgggtgatggtttgtgtttgaacgttctccttttcctgcttaagcatgaaccttacttaatcaagctctgtaatgctggcatttattttggtgaatatattgattcaatgtttctttatctctctgagtgatctgtatttgaagtcgtaaaattttgtttatctttcatcggtttttaggatgggaatcccaggttgtcttgctttggactcatgaaaagtagcagagatgggaagagttatatagcactaacttggcatttactcctacagagaaatttgctaacgggtaaaactctctctgcttcatgtttatatatgtccaaaatatttcagggcacaaagttcccaaagctaaatccactttcttcatcttgtgtcaggtagagttacaccagagagtgtattatgttttcagttttggaaccgttttgctcgatctcattagtggaaaacatattccaccgagccatgtaagttctctactaatagaagatatataaactttagatgtaatgtaggacctggctctttgtttcttgctggatagttcttggaaggaatctctagttcagtccttactaaaatctaaatgatgatcatcatcgtttttcctgcctcattctttctcagacatcctttggtgatgatgcatgcttaagagtgaatcttacagccatacaggaaatactgcttaagaatggatcttacagccatacaggaaatacttagtaagattggatacaaggaattgccattgaggtgttaatctattccttcctctcgcttactacttagtcttttgcattagggacttgttttgaatatgattttatttaccttcttctgcagctctcgtttcaaatgtggacaacccagatgcaggaatctctcttttcaaagaagcaaggggacttagctttccgatccaaagattttacaaccgcaatcgattgctacactcaggtaatatctctaaatgcaacatacctctttaattacatgccaagagccatcatagggctagacattcagtcatcatagggctacacataactggaatgattcatgggccgaaaaggatgaaaaaagtttgtatggttccttgtattgaaagacatctaaatacaaaaatttgatttttgtcccttatgaaccttaaccattggaggactatttttataagatactctcattttgttcttagcttagaaataacaaaactttaatagaaataattgttaagatccaaggttaaccattagagatgctcttagtttacatgtctaatctgggatccaaaaagacatagtagcaaaaaaaaaatttaaagcttgtaactgatttcatttaaagaaaatttcatgctttatttattaattacactactatatgatttaatttaataattatgtcaatcaaattgaagttacatcaaaagagggaccagagagaaagagtttcgtgagcagctaaaaaccaaagtggggaagtcttctttcttagtcgtcgttactaaaacacaaatagtttatttggcatttgtgtttaagtaaagatgaaacatcttatatatgtgtcattaatggctaaagttagacgattccacaacggcagccaaaaatccttgaaattttccgattcttccgtttcaagtcaacgttttccttcgctccctctcaccttcttcttcacaaaaacctgaactttaatttgaatttgcccatatttttagatccacatttattcattgatttgctctgagtttgtattatctcaaagttttatccttttgttgaatcttgatctctcgattattccccaccaagcaccaagtgatcgatcttttgtctcactgaactgggttatgcttgagatttgatctgacaactaagagtttcctacttttgcgttttgagttttgtttttcatg

SEQ ID NO: 4620 - DNA, 3000 bp, Unknown
  misc_feature (1)..( 3000): cDNA_ID_1824925_gDNA_ID_1620718_Annot_ID_49148 3000 nt of promoter + ATG
gaagggagggctacggatgggctcacagcagaagaaggtaaattatactgtgtctgatctacttgtgatacacttgaaatacattttcggaaactcatacatgcatgccattgtggttagagctgctctctttgctctagttcacatttttccatatattcttgcaattattaaatagttgttcttgagtttttccaggtgaactaatcaggaactttatgaagaatagtgcaagtcaattaaccttttgtgggtgcgtgatcttattcatagttaggaagttatattttaaattgactgctcatgtattatcttacattgattattgatcatatcttacagactctttcgcttgcaagaaggcctcaaagaacgtgaactctgtgtttttttccggaacaatcatttctgcaccatgttcaaggtttgtttagtttgcggttatttccatctttgaattgcaacaggttaatcccaactaaattcttcttgttgctgtcatattttcagtatgaaggtgaactttatcttttggctacagatcaaggttacctgaatcagcctgatttggtttgggaaaaactaaacgaggtatcagcaaaagttacttactcaccatttgtcttatctgctaattttggcttcttaggagatatctctatatccacaatctctttagagctatggctgttgtgaccactattgacatgcaatctggtttcaggttaatggtgacactgcattcatgactgctaccttcaaggacttcacgatcgacagcagcacaggtggtgcaagtggcacatgggatgaacgaaacgcagtcacaaatactgctgtatgttctcctcataatatagtcactaatccacattagatctccttcttttacctttttaatcattttttttcttttggttctccctacacaggattatcttgccagcatcaacaatgtagcggatgcaggcatagatgtcaagtaaatatttcatacctttctttgaccactaacccattggttctcaccagagacacatttatgcatttgttataactgtcctcttaaaaacatatttatgattgtttaattttaattcccatggtactatgcagttctgatctgcaactagcaatagctttgcaacaacaagagtttgaggaccagagcccacgtagtaacccaactccacaaccaactagcgttgctgcctcacgattggtcactggtccacaggtatttcattcctactcataacactatattcttaaaaagcaggaatcgacacaaatggttaacaatgattataagaaaaggtaaattaccgtgtgacctgcacattgcaacaatatacaacactgattattaaaatagtaagagagtatagccttaacaagcacatctgcaagtcctgtttagtacatttgttttctgtccatatactttaccgactaagatgagtttacaagtaccaattgcgagtgtaaaacatcgataatgatcatacaccgtaatcagaagctcattgaatataatgcagccttgcttcttgtggtgtttggatgaatgttaatgatcagatattgtactgaccattgcaggtaccaaggagcagccacaggccatcatcagctgcgtcttcgagacacgacggcaaatcccctaaagataaagatagcaaatgtagaatcatgtaaatcctcatttcacttatgtaaatttccaactttttcttattccctaactaattttaatccttaaaagctttttggttttaacaaaaaataaactgtaattgcgctttgactaaactattttttgttgctcataaaaaatcagagcttttctttatccttttgagaagtgggagacgaattagagtttgtgttcacgttttggctttcgttctgttaagttactctgatcgccgttacttttttgacggagtaacggctattgtccgtgatgccttttataataattctgcttagccggctcggtttgactaatcgccaactttttcaagttgtaatcggagaatgtgattattaatccctaattaaaatactttttatctgcattagctaatcattttgactagttataaacttaaaataataaataaattatatcctaatccctcaattcgaatttcaaactagtttgtatttctttacaagttcaacttttttcttttcactataagataatgatgtgctaagaccacgactgatagataatatgaatccactagagctgttgaaaattatagttcaaaattgaggaagacttcaacaatgaaaatgtcttctccattgaagaaaatgtcttgatttattattcaatacgcaattatatggtttaatttagtgatttttcgaatgtttacttcttgttgataataaatattaaatagtaatatgatttcatttcaagaaaatgtcatgcttaattattacttacactattaagtcgaatgtttaatttctagttgatatataaaaatagtaacatcaccactcaaatgaagttgcatcaaaagagggaccagagagaaagagtttcgtgagcagccaacaaccaaagtggaagtcctcttagtcgtcgttactaaaaacaaataatttattagtttaattgaagattaatttgtgttattaatggctaaagttagaacgattcaacaacggcagccaatatctttaaaatgttccgattcttccgtttcaagtcaacgttcccttcgtttcctcccaccttcttcttcacaaaaatctgagatttcatataaatttgcccatatttttagatctccatttgatctgagtttgtattatcacaaagttttatcttcttttttttcactcttcagtcttgatctctcgattattgcccaccaagtgatcgatcttttgtctcactgaactcggttacgcttgagatttgatctaacagctgaaagtttctgactttttgggtttttgatttcgattttcatg

SEQ ID NO: 4621 - DNA, 3000 bp, Unknown
  misc_feature (1)..( 3000): cDNA_ID_1824921_gDNA_ID_1620718_Annot_ID_49149 3000 nt of promoter + ATG
ttttatatctgtaattattgttctactagcacttagcaggtgcttagccactattggatgccttaattttttcaattaattagcatttattctgattcatctttttaaatctcgatacaggtgttgcacgctgtgaggaccacaagcattagccaaaatatatactgtattaaagtgttgttatatattgtttctttctcataattatttagaattttggaaattggtatgtgcatatgtattacaagcgaacggatctaatttttacttgcttcgttttcttatgtgaacatatcccaaatttcagttgtaaacttaagtcgttgttgttattatttttttgtttgttaagggttgttattatttttaatgagatattattattgttaatttttccactttatcgagtcagcaagccttatttcgaacttcgtgtaagaggttactgtggctttggaccactatgccatatgtgattaatgaatgagtcttttttttaatgtctactgtatacatcttatttttcaattaaagaaagcgttagtgtaagaaaaaatttataacatatttacagtaaataattaagaaaataacactatatatgtatcaattaactaactaatctaaagggtttattaaatgattataggtggtggcggtgactctggcgactgcagcggctccggcgacggcggtgacttcggtgatggctccggcgacggcggcgactccggcgcgacggtgattccagcggtgactccaacaacgacggtggttccagcgataacttcggcgacaacgacggtgacagctccgacgatggcagtgactccagtgacaatgggaaccccaacaatggagtaatggctcaggtgatggcattcattccggtaaggacggtaacggcggcagtggcggcagcggcggcggtgacgtcgaaggtggcggcagtggcagcagcaacagtggtggtggtggtgataattattgtgggggtgaggacaaacttgtaatattatatattacataattattatagtgtaagttttttgcaatagattagtttcttaattaataagttttttttaggttatacatgcaaatttcgcttataaaaataaaatgatcaaaaagaaaagaaaagaatgaattagatataatgaatactgagaacaaacgaagatatatgaacaaaaaagttaaaaatgttaagttttatggtttctaattcgaaactagttaacaatgaataaagagatttatattttttatacactagtcaagtctattctatatttttaatgtggaattttttctatacgcttcttggaaataatgtttttctagttatttcgacagaatttagtttttttttgaactattaattagtaaagatgaccagaccactttccggactggattagtgaatcatgtgtttttggactctgataccatgttaagttttattggtttttaactcaaaattaattgacaataaatggaaaggtctatatctcttatatacaactcaaatctattagattgtgcggtttcaactcaaaactaattgacaataagtggaaaaactcataacttatatatataccacttaaaattatactcaacttctaatgtggaacaatattcctaatatgcctcattgagatcgatggtttttctagccattgatcacgatatatttggtatagatcgatggaccaactactaaaccggaccgatgtgtattgggttgaatatcggctgactcaaaatgatgcaaaagccatatgcctcgaagttttataattggatttcatcatctatacgcgtgatagtataacaattaggtttcaaatggcctgttgggcttttaactattcaattacagcccatatatatagtcaacattaaaaataccaacacattgtcattgacatgtttgtacaagcgtggtcaaacagaaatgatgttattctgctgcttcatcaatttatctcccttgtgaattgagattgatggttataatgttatgttactaacatcttaatatataaagtttggtttctcaaaattagtcattaatgtgataatttataaaacataatttctacagtattttcatgtttttaataaaaatacatgcttatatattgaagtgaaataattactaaacggaaaacaattaaagtgaaaaaacacaccattgtttagacgcaggccacacttttattttggttctgtttttcgatttaaacctcaaacctcataattctttaaacattcaaattgtcccaccgtttttatagattccttctagatcgtcaaacacttatattcttccttttctttttgtcaacacattctgacattcatataacttttcgtgtaaaactataatataaataaatgtgataaatacacttctaattctttcgtaaatgatatatcaagaaatttcccaaaattttttaaaatgttacgtgttataaagaaattaattaggaataaaaaaactattaaaagatgacttttaaggaaatgaaatgacggtgttatgataagaaatgaagaattttatcatttaaattgacctttccccgagaagatacgcactaaagatacccaattggtttatcaaaaccgtaataatcgaaccataattcttctcatacatcaaataccggaataaatttgaaaaattggtcgttactatatttggttcaatagcaatttaaacaataccggaatttcgatttggtacgtaccggtttggttatgtgacacatttcaatatcaaccttcccataaaagttctttctcgtaatataaattaaatcctctttgctctctcgctcgcttcctcttttcgatttggatcagaaaaaataaaatttcttcggaatttccaataatctgtctctcttcttcttcgatcgaaaatttgactttttttcgaatttgttttttcattagctttggttgatatcatcatcgtcaatg

SEQ ID NO: 4622 - DNA, 3000 bp, Unknown
  misc_feature (1)..( 3000): cDNA_ID_3073792_gDNA_ID_1620718_Annot_ID_165726 3000 nt of promoter + ATG
tatttcattttgcagataaagaagatgggccagctaggcctacttgtaataacttaacgcttgaattcagatttgggcttgaggagaattggctgaggcccttaaatttagcatttatatatgccttttacttatacctagtttggaagaatggagtaaaatagagaagatgtattttgagttttgactgataagagtgggagtaacagagagacaaagagaagcagaagtaaaaccatggaggcattgttgatatgttgtgtgtatataaagaaaaaataagtaatgataagaaggagaattaccaaaagtaataaaaatggatggttaatgagaaataagaatgagactacattgaaataactaacgaccaagaggagataattgtaataataaataataataaagatttgatatttcagacaagaaaatttaataccagaagaagaagatgtaacacaaacgatatcaaaaaaatgaaattacaaccacaaatttgtttttttttttttttggtataacaatcttgtccctatttttgcttcttcctcaatgggacaaatttcactttccttccatcaactatgcgcactttcgctgttctagccattgagataatatctcggcccacgtattcctcatcctcgtcatcagaaatcacaacaacctcatcgtcaggtcccggaccaacgttacgtttctccgggacaaacgaagtgtctttcgatggaacttcattgtttttctcctccacgggcaagggactctcttccgtttcctgaaactctttcaagttctctaatgctggcaaatcagaaaaaatgagactctccgcctttcgttttcttgtgtccacttcaccttcgctaccctctccgcaaagaggaacaccatcggttatgtcaccggtttggtcttcgattacaaggttgtcctcgctggaaatagacttatcgtacttcgccttagaggttggatcagacagaaacgaccaagctaacgaggctttaacacgagcttcctggcaaaacgggaaaggattgttactcgagttcaagagattcatcaacttctcgaagtcctcccctacaatcggtcccggctgtttcattcgaatgatgccgtaccaatcagtcgccccgttgggaagcggggtctctgcggccgagagaacatccgagatagctgccgctttctcaaacgtatctagccgttcactgattactgccttgttcgtgttgacgatgtctcgaactcccctaaaatctccaaaccgtagaagtaaatggcacgttcttatagcttcatcgtcgggtgttgtaaggtgtaaagctctttctccggatgacatgatgacgaacaatgttaaccgtgaaggctctggcgatggagacaagagagagagacagagaggtggtttggtgttttagacttagatatgatagttttgtgataaaagttttggagagggacacaatatgtttttatactgaatatgtgagaaaagattaaagagtgatttaatagtttgttgaagggaattaatgcaagaaatctagtcttacacaccaattaacatgtatctatttcagatgtttgtgattagattgactctcagtttttatttctattaattttttgaattaccgtttatttcgcaccaaataccgttggctgttacttttcaaaatatatatctatacgaaattgctttagttttcagaattttttattttactcagttaaaaagatactatactatgtttctaataaaaatatagactgtaattaatatggtaattatattttaaaattttgaaatatcgttgaccgttattgttctatttgttgaaatatctttctatacattgcatagtcaaaaatattttaaaattttgaccaaaatgatatttctaataacaaaattaaattattcttgaataacaaaacttggtaataagtattaaaattggtcataagtttcatatttgtaagaatatcaggtatgatttctctcttttaatttttttcctatttatatatattgggtgttcatatctataattttgttactactaagagtgtaaatttcaattatttatttatttattattattatttttgttttgatcaaaatcaattatttatttttattaatgcactttaaatggtaaaaatcctatttataaatctttctatcttatgtttcttgttttttagtggtccaatgtatctaagatagtcaaaacaatcaatatatgtctacttctggatttctatattttctaaaagttgcatttgcatatatagaaaagtatgaccttggaatctgtaaacttggccaatatacagctaagcaaatagtctttttttgctaagaagctaagcaaattatcattatctacaattactataagtctataactgtatacacaaatttgtttaaaattatgctaaaaaaggtcataattttaaaacttgcaccctctttgttgactaccttaatcatttacccaaaaaataaaatccgtttgtatcgaaatatagaaaaaaaaagaaaaaaaacccaaaaatttcgatatactctatatcttcaaaagcccaatgaaaacataatccagatccaatgaaaaagtccattaaagcccaacgtgaactaatgaaatttcactgaaatgaccatgttaatttaatacaactcctaagaatttaattaattcaacgaaaacataatttattattgggcttataacaagtttcaagcccaattaaaacagtccaataagacagtgtatctaccataaaccctaccacacatgatcgctcccttattttcgcaccaattcacttgacattttctgtttccctcaacaattttcccgggaaagaaaaaaaaaactttagtgaagaaacaaaaaaaaacagaaagatctcaacttttttcaacccaaatcttcaaatctggaggaacgaaacagtaagagattgaaatcaaacatg

SEQ ID NO: 4623 - DNA, 3000 bp, Unknown
  misc_feature (1)..( 3000): cDNA_ID_1824907_gDNA_ID_1620718_Annot_ID_165724 3000 nt of promoter + ATG
cttagatcttctagtggtgacacagagtgagctagtgctcagtttctctggaaaaactggtttcatcttcgatggtagtaacagatttgtagccaaactacacatctttgcttgttctcaaaaatatccgaaatttacagaaacaagattgaagaatttaataactaaatacagagaccctttttgcaagaactctctctaatcaagatctcgcgttattcttgcgtgttcgtaatcaaaacttgtaactttgaaacccacgaaatatcaagcttgctttcgctttcggtttactttttctttctttctcttttttgttgcgtgttgggttagataactatatatacgggtttaaacgaaggttggttctatttctagacttcttctcagttcttcaaagatctctttgaacaggtgagactgagagtgccacgaggacgtggtgttcagcttcttcactgcatgagcttagcatgtgtcgtgagattaaggttcacacgtggctttaattgcggttatagttcggtttttggataactgttcaccgtttacgaacatgataagtagtccggttttagccaaaatgttactttttgccattaccttaaatgttatccgtatgctccggttttgactggtttaaacgttaattatcggttatttctggtatgaatcggttaatttctcaaaaatacattgaattaattgagttaacaatgattgatccaactcgattaacttatctatttgcaagtaataaaatattactacagtagaattttttaaaattaatattctataaagttaataaacgttataaatgaataaattttattggttttaagttagattaatgtaaaaattaactgatattgataaaataataatataataattttattttattttaatgtaaaagtatagtttataatattataattaataataatttgtactattgataaaaaaatgaggggtagcaaattgtagaaatatctaaactaatttactaaacaaatctgtttgctcatttatttttattttaaaaagagtcacgctattgttgtaaaaaagtagtagaaaaagtaattttgcaaatctcttaatatttttcacatttttaatttagttttaaaaataaaaagctaactattataatatatactagattttaatccgcgatacaccgtggagacaattttttttttttaaattagtatatataaaattttgcaaattatatctatctataaaatatttttattttatagtttacaattgttattaagtaacgtccctccaaacccgtttcgccaaacccgtcctgtaaaaaaactgcgataccccgctaatttaaatttataattaaaacaaatattttacgggattgcaattgtgttttagtttgtcaaacaaaattttgttttaaatagttgtcgaaatctagttcaaattttggagaaataagatttagtgaattgataagaaatgtatttagttgcgttttgctcattttaagggattgcaattgtcttttgggttatcaaacattttttgttttaaatagttgccgaaatctagttcaaattttggaaaaatctgcgtgatatatgggattggaatatatttggaatgtttttcgtttgttaatcaatttattgctgaaaaaactaataattaaaagccagtggcagccattgtaaataagttccaactccaggatttatttcacaaaatggctgcaaaaatgtatatatagatgcaaattatatatatattgaatatagaatctgtttttttttattatacaacaccaaataaaaaatattaatattagtcgaccggttaacataaattctatctttacgatgttgaccacatgacgttatatatcgcgtatatatcgttatgtaatacatataggtcaggtagctcagcatcgtttagtttacttgatatatctagccatgcattttgtaacaattcaggtagctggcaattttttttcttaaaaatgactaagaaaatagaatagttcttgggttctcccctaggagtgaacttctcttattcacccccttttaagtagccaatcaaaatttcttatgtaatctaattaaatttactaaaacaaatactataatctaaataaaaactataatcttaaccattgttttataaatccaaaccgacatctaattttatttcattataaaaattaaaccactactcaatctactcttttataaatctaaaatgatatataattcgtttaattttaatatctaaatcctgattaacctcatttataaatccaaatagacatataaaccttaattactttttttataaacccaaaccagaccaacatataattttgtttaattataaaatctaaacttatcattttttgataactctaaactaacatataaatttgtttagttgtaaaatctaaatttaatctttatttataaacccaaaccgacatatagttttctttaattgtaaaaatctaaacgctaatactcgtttataaacccatgcggaatgtacttaagcttaaaagtatacatatttttttatttttttattttaatttattttatctttttatttttattttaatttatttttaattccgtggcatattgttaaaatttttttggctatgagtgaataagaatttgttgagaaaataacaaggggacatatcatctatatcaaattatcctttaatcgagatttttattatcccatttatttccctgaaatttggaagtttgctcttgacttacgctgctagtgagttgactcgagggtcaagaagactctttcattatgtaattatgttacataaacctcttttatcttcaaactatcgtgtggtgtagaaacgtggagacctgcaagaacaacttgttattcatctactctgtagtctagttgactcgtgagccaagaagactctttctgtcttttattttcaaaacaaacatg

SEQ ID NO: 4624 - DNA, 3000 bp, Unknown
  misc_feature (1)..( 3000): cDNA_ID_1824911_gDNA_ID_1620718_Annot_ID_165723 3000 nt of promoter + ATG
ttttttttgaagcaagccaagagggttaaaaatcaaaactaactataggtgttgtttacacatactgtatttacctgttaatcagtttttaattacttaattaagccatatccacatgactagaagatatctttaactcagattgcaacatttatatattatgttttagttattgatattcttacttcattataaatccaaaagatcagcagaagattgatacaatttttattagatcacaatactataagcattatcattaaattgtgagaaatctagcttagacatttgcttcttaattatttcctttaatttgacttgtttttgtttttgatatactgatttgatttttgaaattttaatttcagtatacctaaaacagtagaaagatatcaaaagcgaatacaagatctcgggtctaaccataagagaaatgataattcacaggtaaccaaacttcatagaattgttagtttatcatggttattttcatatatatacatttgctaaaaatatacttatccagagctcaagtaaaaagaaattctatatcaatatctagtacaattttatggtgtagatcctttggtgtaccacttttaaaaaattaatatacatgctaaagtgtatgctttatttatcgaacatgggtgataattttttatattaatatttgtacttacaattttggttaagaaaatatgttttgcatttctcatgatcaaaccttgttgacagcaatcgaaggacgaaacctatggcttggcgagaaagatcgaacatttggagatttcgacacggtttttgaactcaaaatacttatacgaatattttgttatgaatgtaacgtttacattgtaagcgtctatttaccatatgtttaaaaaatatatacatttgcagaaaaatgatgggagaaggacttgacgcatcttctatagaagagttacaacaattggagaaccagttggacagaagcttaatgaaaataagagccaaaaaggtaacttctagattattgtatatgtgatcatttcttagttttaaaataaaatcttcactcttatcatatggttattgtttcatcgagatttatgacaatgacgtggtggccgcctggttcgattatcacaaatgagttgattatgtaaacaatataaacatgggatcatcctataaacactccaaatacacacatacacacacacacacacacacacacacacttggaggcatgcatgcatgcatgcatatgtgttgagaaaagacttatatgttatcttcttcttcttttttgtcatcaccttatatgttatctttaatgagtcttttaccaactaatttagctatttaattccttaatttcagtaccagttattacgagaagaaactgagaaattaaaagaaaaggtaacatgtagcttttttattaatttagtacaaatgtattggtcaggtactaatcatatttcccataattaaacggttaaaccatatttcatggtttattgtcaatattttaggagaggaacctcattgcagaaaataaaatgctgatggagaaggtacaaattaatattaacttacgggctgatttatgttctcaattctcattctattattatgaaattatctgctttttttcaaaaagtgtgttttaatttgaggaaatgtgtgaatgaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaacatatatagtacaatgcttatatagatattatgtagggaattacttttttccctgaagaaaaattgatgttacttactgaatttagcagttgcataaaaaaaaagattactgcatttaagctttgctttttttttctttttgtttttttcttttgtatcgtctcacccaactttgcaatcctaaaataatttcagaataaattgtttaacaggttttttatttaacataattttttcatatctttttaaaaataattgtttagaatataactaatttgatcgatatattatatgttcgggacaagttcttggagagtgaaaacaaatccgggtgcgtagctaggtcggttccctataatggctttgcggataagatctccatgtttcatgctagacatgaagatgatgtatgatttatatacgaataatgggtcagttggaaagatttttgaatcctagtagaggtatggtcttttgaactcgggaaaagttgcattgcaccgacctcttaaagtccttttacacttggtctagacccaaaaatcgttggctttctatgatcggtctttgtcagcgtgtcatttacgtgacgtggttggtttggttcgaaatttctaagtagctgaaaattcagttccgttccttccaagaacatcatcttgaagtagaattctttgtgacaaacaaaaaaaaatggtagaattctatggttatatatatatatatatatatatatatatatatgtttattataacaacagacctaatatcttctatgttttatgtaatatctatttattttttgttatttattgaacctacatacaaataaaacaaaacaaagtaaacttctaaataatatatttttcattttcattttagttgaaatataatttgattttcaataccaaactatataatatcaatattcagaataagttaattgttacgtattaaaaacaatgcaagaacaaatgaagaagccaaaatatccaaaatgaatagtagaagtcaaggtcaacatagtggactctaacaatatcaacgaagtcaaccgttgaagaaattaaataacttgtctaataagttcttcttttttcttggattaaatacttgtttgaagcaaattcagagacactgtcttcgtcttcatctttgct

SEQ ID NO: 4625 - DNA, 3000 bp, Unknown; identical to SEQ ID NO: 4621
  misc_feature (1)..( 3000): cDNA_ID_2990691_gDNA_ID_1620718_Annot_ID_165717 3000 nt of promoter + ATG

SEQ ID NO: 4626 - DNA, 3000 bp, Unknown; identical to SEQ ID NO: 4620
  misc_feature (1)..( 3000): cDNA_ID_1824925_gDNA_ID_1620718_Annot_ID_165716 3000 nt of promoter + ATG

SEQ ID NO: 4627 - DNA, 3000 bp, Unknown
  misc_feature (1)..( 3000): cDNA_ID_3089597_gDNA_ID_1620718_Annot_ID_165713 3000 nt of promoter + ATG
tggaattagaatccgctattcttgatccatgtaaattctgtttttcttattagactactgcggatgatggaccaagagaaccatggcatgatctgcacagcaagattgatggtccagctgcatatgatgtgcttgctaattttgaggaacgctggatgaaggcttcaaaacctcgcggaattgggagactaagaacttcttctgatgattctttgcttaggttagacagaattcctgacataatgggactttccgaagcttcttctgctaatgataatgatccagagtcttggcatgttcaggtaatttagcaagtctaatttttttgctagttattgttatttgtggtggtgacaaaaagaatctcattttttctccaatgatattaatctttaggttttccgttcaattgattcgagttcagttaaagggtttccaaaggacccaaaggaagctactggaagagtaagatagcaccacaactctgagctgtttttgtttgtcatcatgttgctatctccgactgattatgtattcatgaacagaaccttctatgtgggaagaacattctcatagatatgagcatacatgcagcttatgttaaagccatacgatctgctcagcacttcatttacattgaaaaccaatattttcttggatcatcattcaattgggattcaaacaagaacttgggtaagaaactttaaagcttttgaaggaaagcttagtaatcgatgcgtacaatatgtaaacaaggagttttggcattgcaggtgcgaataatctaatcccgatggaaatcgcgctgaagattgctaacaaaattagagcaagggaaaagtttgctgcttatattgtcattccaatgtggccagaaggtgctccaacaagtaatcctattcaaagaattctctactggcaggtaaaataattttttgattctttgctaaaaacaacccgatctcaccttctttttaccggaatttttcacaacctctgcagcacaaaaccatgcaaatgatgtatcaaaccatctacaaggcacttgtggaagttggtcttgatggccagcttgagccacaagactttttgaactttttctgtcttggaaccagagaggttggaaccagagaggttcctgatggaactgttagcgtatataatagtcctcggaagccacctcagctaaatgctgcacaggtatacatatattaaatgtcttcttttgaaatcttcgattttgccttaatgggttcgcttactgattaaaacgacaaaccaatctaggtacaagctttgaagagtcggagattcatgatatatgttcattccaaaggtatggtagtggatgatgagtttgtcttaattggttccgcgaatatcaaccagagatccttggaaggaactagagacactgaaatcgctatgggagggtatcagccacaccattcatgggctaagaaaggttctcgtcctcgtggtcaggtaaataagactttcagagacttctacttctcaatctaggatagcattctaagacgaaaatctagaaacccaccaatgtatgttctctttaacatgtctgaaccctggtttgtctcaatttcttgcagatctttggatatagaatgtcgttatgggcagaacatctagggtttctagagcaagaattcgaggaaccagagaacatggaatgcgtgagacgagttaggcaattgagtgagctgaattggagacaatatgcagcggaagaagtcacagagatgccaggtcatcttcttaagtatccagttcaagttgatagaacaggcaaagtgagttctcttcctggatacgagacattcccagatctcggtggcaagatcataggatcgttccttgtagtagaagaaaacctcaccatatgaaacttaccttgtaggcttgtagtgatcaacatttgttctttatttccttcacttcaagaaatctatctgagtgtgatctgattgaaagtgtgcctttagggtctagtttttcaaatttatgagctgtaaatctatttattacaatatttcaattgatctatcaaagtgtgtgttgtggatttttactatatgatttaatttagtaatgttgtcatatctttagtactatatgattacaatatcacattggcttgtagaaaatgaaaaatgtcatcctgaaagagcttttgccaaatcattcataagatcatgcatcacaaagcttgtcatggtgatatccaatctctgaaaaaaagatttgagcaaactaaatcaccaaggtaatttttccaatcttgtgctgctccttggttggtataagaggtctattgccatccatagcagcagtaattgagcagagggcaaagcatcgcttaagttgaggaggaagagagtcatagcttggtttaagtactggaaggatactgttagtgtagcttgagaaattctttgatgcaatggctcgttcaagaccttacactgttctgcaatccttttcccaattccttctagttcttggttgattatatttccaaaaggaaatctagagatcagctcccaacattcttcatttggtagattttttcatcctttgctactgtggagacaatttcacttgatgtggttagaacaatcttgcttccttcctcaagaaactttcccattctgaatctcagaccaaaaatcatccagagcaacaggtaaaagtcttctgtttgccaaaagaatctctaagagacgggtgacgtgtcgttgtgtgagtgggtgaagggaaaatatataaagagaaaataaaaatcgactcccgtgtttctctctctctttcacgcgtttctcttcaaaggctacaccggaggcgatttggagtttaatcggaaccactcggacgagtctccgatgtagaaacgaggaagattacttcaattgagattaagaggcatagagagagagatttgtgtattcgatcgaatcaagcttgggtttgttagtaatg

SEQ ID NO: 4628 - DNA, 3000 bp, Unknown
  misc_feature (1)..( 3000): cDNA_ID_3073812_gDNA_ID_1620718_Annot_ID_165712 3000 nt of promoter + ATG
accagagatccttggaaggaactagagacactgaaatcgctatgggagggtatcagccacaccattcatgggctaagaaaggttctcgtcctcgtggtcaggtaaataagactttcagagacttctacttctcaatctaggatagcattctaagacgaaaatctagaaacccaccaatgtatgttctctttaacatgtctgaaccctggtttgtctcaatttcttgcagatctttggatatagaatgtcgttatgggcagaacatctagggtttctagagcaagaattcgaggaaccagagaacatggaatgcgtgagacgagttaggcaattgagtgagctgaattggagacaatatgcagcggaagaagtcacagagatgccaggtcatcttcttaagtatccagttcaagttgatagaacaggcaaagtgagttctcttcctggatacgagacattcccagatctcggtggcaagatcataggatcgttccttgtagtagaagaaaacctcaccatatgaaacttaccttgtaggcttgtagtgatcaacatttgttctttatttccttcacttcaagaaatctatctgagtgtgatctgattgaaagtgtgcctttagggtctagtttttcaaatttatgagctgtaaatctatttattacaatatttcaattgatctatcaaagtgtgtgttgtggatttttactatatgatttaatttagtaatgttgtcatatctttagtactatatgattacaatatcacattggcttgtagaaaatgaaaaatgtcatcctgaaagagcttttgccaaatcattcataagatcatgcatcacaaagcttgtcatggtgatatccaatctctgaaaaaaagatttgagcaaactaaatcaccaaggtaatttttccaatcttgtgctgctccttggttggtataagaggtctattgccatccatagcagcagtaattgagcagagggcaaagcatcgcttaagttgaggaggaagagagtcatagcttggtttaagtactggaaggatactgttagtgtagcttgagaaattctttgatgcaatggctcgttcaagaccttacactgttctgcaatccttttcccaattccttctagttcttggttgattatatttccaaaaggaaatctagagatcagctcccaacattcttcatttggtagattttttcatcctttgctactgtggagacaatttcacttgatgtggttagaacaatcttgcttccttcctcaagaaactttcccattctgaatctcagaccaaaaatcatccagagcaacaggtaaaagtcttctgtttgccaaaagaatctctaagagacgggtgacgtgtcgttgtgtgagtgggtgaagggaaaatatataaagagaaaataaaaatcgactcccgtgtttctctctctctttcacgcgtttctcttcaaaggctacaccggaggcgatttggagtttaatcggaaccactcggacgagtctccgatgtagaaacgaggaagattacttcaattgagattaagaggcatagagagagagatttgtgtattcgatcgaatcaagcttgggtttgttagtaatggcgagaatagctatagttttagatctactgaagaaatctcaatccaagcacagtcttcactcatcttccttctcttccgccgccactgctccctttgcgtctaggtttctattcgggtatgtattctctctctctctctgatttgcatttgtttgactttcactggatcgtggtggatataattattggattgattactagttttctgattttgttcgagaaattagggtttagaaattcataattgatcatcttctattgctcagttgaataagaaaggttgcagatttatagtttttatttgattggaatgtgtcacactaattcaaggctatgtcagttactagtaaaggtgaatattttgcgatccagtttgaaatgtagtttatcaatgaatagttttacaagctctgtttttattctaaatagatcttttgataggtttcattcatgtgtcttttcgatactctcggtgattagcacttcatagaggactagttggcatgatttgttgtgttacgacattgactacacgtttcagttataacctattatcaatgactcagattgtttatgttacagttctttcgagcctcgagtttcgtatcgtggtgttgctgctggaatagacgatgattaccttggtgctatacggaaaatgtctgcggatggaaacttctaaagggtaacatcatctttaatatgatttcatttaaagaaaatgtcatgctttatttattaattacactactaaatgatataatttagtgattatgtagaatgtttaatttcttgttgatatataagaatagtaatatcaccaatcaaaatgaagttgcatcaaaaaagggccagagagaaagagctttgtgagcagccaaaaaccaaagtgggcaagtcttctttcttagtcgtcgttactaaaacacaaattgtttattcggcatttgtgtttaattaagttctttaattaatgattaaagatcttaaatttgtgttattaatggctaaagttaaacgattcaacaacggcatccaaaatctttaaatttttccgattcttccgttgcaagtcaacgttttccttcgcttcctcctaccttcttcttcttcttcacaaaaatctgaactttaaatttgaatttgcccatatttttagacccacatttattcatatagatttgatctgagtttgtattatctcaaagttttatccttttgttgaatcttgatctttcgattagtccccaccaagcaccaagtgatcgatcttttgtctcactgaacttggttatgcttgaaatttgatctgacaactaaaagtttcctgctttggaggtttttgattttgtatcatccagtttataacgagactatgtcaatg

SEQ ID NO: 4629 - DNA, 3000 bp, Unknown; identical to SEQ ID NO: 4617
  misc_feature (1)..( 3000): cDNA_ID_3000039_gDNA_ID_1620718_Annot_ID_165710 3000 nt of promoter + ATG

SEQ ID NO: 4630 - DNA, 3000 bp, Unknown; identical to SEQ ID NO: 4616
  misc_feature (1)..( 3000): cDNA_ID_3073819_gDNA_ID_1620718_Annot_ID_165709 3000 nt of promoter + ATG

SEQ ID NO: 4631 - DNA, 3000 bp, Unknown; identical to SEQ ID NO: 4624
  misc_feature (1)..( 3000): cDNA_ID_1824911_gDNA_ID_1620718_Annot_ID_49152 3000 nt of promoter + ATG

SEQ ID NO: 4632 - DNA, 3000 bp, Unknown; identical to SEQ ID NO: 4623
  misc_feature (1)..( 3000): cDNA_ID_1824907_gDNA_ID_1620718_Annot_ID_49153 3000 nt of promoter + ATG

SEQ ID NO: 4633 - DNA, 3000 bp, Unknown; identical to SEQ ID NO: 4622
  misc_feature (1)..( 3000): cDNA_ID_1824899_gDNA_ID_1620718_Annot_ID_49155 3000 nt of promoter + ATG

SEQ ID NO: 4634 - DNA, 1973 bp, Unknown
  misc_feature (1)..( 1973): cDNA_ID_1397552_gDNA_ID_1620719_Annot_ID_49158 3000 nt of promoter + ATG
tttgtagatgcatagtgtcggttttgttgacccggatgacatgaatgttgtttctggtagacgtaagtactcaagccttataggatactcaagcagcaagcttgcccaggtgagcttacagtaatgacatctgccgtagttttcatctgccgtagtttccattttctgaaagaggcttattttcagaaactggtgagttaagtctcgctctctgatcttccatcttccagattatgtttagtagcattcttttcaaaaagcttcctctggaaacaggagtcagcgtcgtatgtctatcccctggtgttgtcctaacaaatgttgtgagtattagcttcacttcatttcgttacaagtgcaggattcctctgttttctcagaaattcattgcgttgaactgcctatttctttccgaaatttacaggccagggatctatccaggattcttcaagctctttacgcagtgataccttatttcatattttcaccccaagaaggttgtagaagttctctattctcggccacagatcctcagattccagagtactgggaaacactaaaaaacgatgattggcctgtttgcccattcatctctcaagattgccgccctgcaaatccttccgaagaagcacacaacacagaaactgcacagagagtgtggaaaaagacgttagagctggtgggtcttcctctcgatgcagttgagaagctcatagaaggggaaaatatccaatgccggtatggagcacaacacgaatagtctttcaaaattaccacaggttaagtgacccattacagatcaaagggtaggtaattgagaaaatatcttttttttttgtttccttgtattaatctacacgatacagtggggaatgaatcccccaggcatgtagtttgcttgagaatgtttgattgttggataaaagtcaagctttagctaccattccattgcttttacttacaagtcttgttcaagtatttggttagtgtgtcttggagttattaagatgttcagtagtagagtatggtagcctgggttggtgggtagtttcttgtttgagtttagggtattttcgtaattttctttattgtttgtggagtcacgttgctcatatatagttatagggatatatatcaattagagtcatcatctctcttactctcatggtgacaaagtcacaaaagtgataaactctcctttccactttctaatgtttcttgcttaaatgagtattccatgtaaaaatgattcactcactcgtatgggtgggttgggttttctcttcatgagatgctcatttgagcaagcaatgtttggaagtgggactatttaatatcatgtatgagttttatcttttgttataagaaaaaaagttgggatttcattttcgtgcccacttcacgtgaatctaatgccttcaagtttgtggtctaccttattttctcttatggatacatgtcaatttacgtgtcgtatgagtcaagcctttaatcatcccaacaccatgcacgtcttctagatttgttttcgaccacgattccaccacaaaatttgacattgttattgaattcattaacttttttacgtgttattgtgaaatatttatttaattttgttggtaaaaggagcaaaaaagattagggtacaacacgtcgacttcttccccaattagacccatatgtgatctgtcgtcactcgtcgccaagtttttttatgtgtcgtcttttaaactttgatccaattcattaaaaagtcttaacgcccacaacgaaaaggaacttctctttttgtttggtgactgaatcggtggaaaacaacacaagtttgttcctttttgtctctccagatcccttggcttccttcttcttcttcatcctcctcgtgagactctgtgttgaaatttctctagggttttaattatcggcgttggtttttcgtttttgagaatttgatttcgtttttagaaataatg

SEQ ID NO: 4635 - DNA, 3000 bp, Unknown
  misc_feature (1)..( 3000): cDNA_ID_1824977_gDNA_ID_1620719_Annot_ID_49159 3000 nt of promoter + ATG
atgggtgggttgggttttctcttcatgagatgctcatttgagcaagcaatgtttggaagtgggactatttaatatcatgtatgagttttatcttttgttataagaaaaaaagttgggatttcattttcgtgcccacttcacgtgaatctaatgccttcaagtttgtggtctaccttattttctcttatggatacatgtcaatttacgtgtcgtatgagtcaagcctttaatcatcccaacaccatgcacgtcttctagatttgttttcgaccacgattccaccacaaaatttgacattgttattgaattcattaacttttttacgtgttattgtgaaatatttatttaattttgttggtaaaaggagcaaaaaagattagggtacaacacgtcgacttcttccccaattagacccatatgtgatctgtcgtcactcgtcgccaagtttttttatgtgtcgtcttttaaactttgatccaattcattaaaaagtcttaacgcccacaacgaaaaggaacttctctttttgtttggtgactgaatcggtggaaaacaacacaagtttgttcctttttgtctctccagatcccttggcttccttcttcttcttcatcctcctcgtgagactctgtgttgaaatttctctagggttttaattatcggcgttggtttttcgtttttgagaatttgatttcgtttttagaaataatgggtgattgggctcaacttgctcagtctgtgatcctaggtttgattttctcttaccttctcgctaagctgatctcgatcgtcgtcacgtttaaagaagacaatctctctcttactcgtcacccagaggagtctcaattggaaattaaaccggaaggagttgactcgcgacgtctcgattcctcttgcggtggtttcggtggtgaggcggattcgcttgtggcggagcagggtagctcccgaagtgatagcgttgccggtgacgacagtgaggaagatgatgattgggaaggcgtcgagagcacggaactcgatgaggcttttagcgccgccactctttttgtgactaccgccgccgcagatcggctttcgcagaaggtaccgagtgatgtgcagcagcagctttacggattgtataagattgctacggaagggccgtgtactgctcctcagccatcagctctcaaaatgactgctcgtgccaagtggtatctctctctttcgttgaatctgctgtgccattaacttctatgtatcattttctggtgtttttgttcaactgtttgagatttgatttgaggtggaaatttttgaggttttaggttcttcatagacaatcacctagtttgcttcttagcttatgcaactgctggacgatgatgtggtttttactgttgtaacagttgattgtatatggaattgtggtttgttgtaagattgcaatttcattgattgggatgtgccatgatcttgttctatctcaggcaagcatggcagaaactgggagctatgccacctgaagaggcgatggagaagtatattgagattgtcactcagctttacccaacttggttagacggtggcgtggtataaagctttttccccttttctttgtttgattgcttcggtttcttcctctggcctgttcatgtgagcttcactaacagaaagccggaagtcggggtggggatgatgcagcctccaactcaagaggaaccatgggaccagtttttagctctttggtttatgatgaggagtccgaaaatgagttgtaaggttctcttcttgtattctcatgtgttttatatcctgatccttgcgttcatgtctagattagatataagtatcctgatttgtgaaagaggctcataaactcggtgaatatgtaacattactgtctcgttctagctgtagcaaattttgatggtgaaatggctacaattgtctcatggaactttgagctgttcgtttcttcctgtctatctgaatgaaacactaatcctctgctcattgaacttttgttttatctctcaggaagattgatgccatacacggatttgctagagaaggagaagtcgagaatttactgaaaagcattgaaagcggcattcctgtaaatgcaaggggttagtctctgcttgtatattccgtttcttggaagttcattctcgtgatgttggatctgcattctaattttcccataaactgcagacagtgaaggtcgcacaccattgcactgggctatagaccgtggccacctcaacatcgccaaagttctggtcgataagaacgccgatgtgaatgctaaggtgacgaaagagaaattcctacccagtcattatctgcaaagttagcaacttctttatttatgtgtttttggttcttgtgttgaacaggacaacgaaggccaaacccctttgcattatgctgttgtatgcgacagagaagctatcgccgagtttctggttaaacagaacgcaaacacagccgctaaagatgaggatggaaactctccccttgatctctgtgaatcagactggccctggatccgagattctgcaaagcaggcagactaaacaaatactaaccacgtcttctctaaatccgcaatgtatatgatcaaatgacttagtaagaagcttttctttactttaaactttctttccatccctaccacatcactgggatgttccaacactatatcacttggatgttaccaagtcttgttctttgatttctttcttcttacattttaacaatcttttgttcctttaggctttatgatatgtcgtaaccggttttgttggtttgctataaatacacacatatagacagaggaagagtcattggatcctcaacgaataaataaccgactttggcggcaaaaacggttgatagaacataatttaatgatttaaggaaagcccccaataaagcaaatacaaaaacagaattagcaatcttcgtggccctttcgtcttctctccctaccccaccttggactaccggaaa

SEQ ID NO: 4636 - DNA, 3000 bp, Unknown
  misc_feature (1)..( 3000): cDNA_ID_1840737_gDNA_ID_1620719_Annot_ID_49160 3000 nt of promoter + ATG
taaatagattaataccgtgtccaagctgaacaagaaatccaaaacttgaaaaaacttcactacacactagtcccggtcaatttcatttaccaaagctcatacgttctaaagaagactatgggtcgtagatcgtaatagttagtttggtttaatggaaaaaagtcaattcttttactttattagaggtttggttgaaatttgtaactgattattctttcagtttcaattgattatcatatattttacaatttttatacttgcacaaaagaaattaatcgaagatttttttaaaaaaaatgatatttcttggtctcttcaaataaagcaagcccttgattacggtcaaacggagcacgttacacatcatcaagtcaataatctaatcaaatacatatattcaactcacagtcctgctaattaggccatgcatggactatagatacattatcttacctttatgtgcatctcttatcaggccatgcatggactatagatgcattgaagtatctaaacttgaatgggggctcacaaggataacatgatcagcctaatatcttctaaatctgtttaattttaccgtccttttttccatgattaaatcatttcactattctcatacatatctcatgcaacgacaagagcagccttttgacctttatcgtagcacattcctcactttcacccatttttgtttaatgtatatccatcaaatacagccttgatactctctttttgtatgaaaggctatttcgttttcgttgttttgagataaagatggacaattaatcagatttacagatagcaaataatgtggactaaactagatgaaaaaactactatattacatttttgttttcagtttatatactactgcatgtattacatctttaggcataactacggtccacaacacacagattcgaggataaacctacaacgacccacctctgtttattttaagataatttatttttgtcgacgaagaagacttcttcaggatttatatacattatttattgttaccactatcgcagctctgattatcattgtttttttctttatataataataacaataaataatggtattatttataggcaataaaggctcgacatgaaatttgaaaggacccaacgttaggaaaatcgtaatgtaggaccacccacccactttgtttatattttcttctcttctttgggatcactctcgtgaataagaagcgccacaaggagcgttttgttcatttttctctttcagcttcataaaatactacacacttcctcacattattcatcctctcttttcccttttcttgtgttcatataactcaaaccaaaatataccgtctctatctatctaaatcccaacccatttcatataacgtcaaagaaagtttcttattcagaaaaacaaggcgatggattttgaatttgatgatcaagaacggttttgtgcgactcctaagcttcctttgttctcgattccatttaacagagcatgtgacactccagggctagcgacgccgcctgtgaacatcgctggatcagtaccttttctatgggaggaagctccgggaaaacctcgcgtctctgatgagaacaaaccgctggcttccaagcagaacgaaagagaaggaggaggaggaggagtcgtgcggtgccttgagcttccgccgaggctattttttccagccgatgatgagccatctccgaccacagttcttgatgggccttacgatgtacctcgccggtctttatcagtgataaggagaagcgaaagagcctctgagggtagattcgagttttcacgttccaccaatagccgctgctgcgacggtggcggcggtacaacggtgaagattagtagagttagaagaaaaggaagcctcttgaatctctctcattccaaatcgcaattcttggtaagttttgaacactcatcaccttttctaacatcttatttttagctgtctaattacacactcttaccgggtagtttactagtaactagcaagttaatcgtattcttttgtagtcaaaggtagtcgatgattcagaattgcaaacactataattttcgttatcaaaaaaaggaaaatacattattacgttgttcaaagtaccaaccgttttatcaaaaatttcaaactttattcaatgatttctaactcaaaacaaaacttcaacatttttgggatttgaataaatgtcccttttgattaaaaagtttaggttttcccttcaaaagtctttggttactctatatagtatggagtgttttttcaatatgctttgtttttttcggcttgtgcatatgaattcatttttaggctcattttgattacataataataaaatgcaggcaagggtttaccaaggatttaagcaagtgatcccatggaggcggagacaagagaatcttccacggatgagttcttccaatatttaaatcaaatctcttcgatttcttttataaatcattaaatctttagttaattttatagactaatattaatatccatctgtatacatattaccacataatttacagacatgaggaaaagtttattcttaactttttaccaaattaaaccctgaaactacactgttcctctagataaataggattattgtaattatacttgaaaaaggtaaaagaatagggaacatcttaattcttaaatgaaggaggacaagagcattatgcaaaaccaaaaatttattatacaaaacataactacatgacctttctatttgcagttgctagcgacagcaataatactttcctgaaaaggaaagctataaaagttgattgatcacgatttgggcctaagcccaaaacttataaagtggaccgttaagttagttaagaagcccgcgttgatttctcttatcctcagatatttttttacgaaaatccacggccactaaccgtaaaggacactcttttgatttttctcttcttctacttaactcgctttgcctgactcactgagtcatg

SEQ ID NO: 4637 - DNA, 3000 bp, Unknown
  misc_feature (1)..( 3000): cDNA_ID_1824971_gDNA_ID_1620719_Annot_ID_49162 3000 nt of promoter + ATG
cagtttatagcttctaattaaaattttggcaaaactattaacaggaatcgaaccacatgttacactttaccactatgatcttcctcagtctcttgaagatgagtatggaggctggatcaaccgcaaaatcatgtaaaggataaaaagaaaaaaagattctgatctagcaaagtcaatttttaaatatgaagtgtaaataaaaatggtgtttgtttttatatattgcagagaagacttcactgcttatgcagatgtatgtttcagagagtttggggaggatgtgaagttatggactacaataaacgaagctacaattttcgccattggttcttatgaccaaggaatctcgccccctggacattgttctcctaacaaattcatcaattgtactagtggaaattcttctacagaaccatatcttgcaggccataacatattgctagctcatgcctctgcttcaaagttgtataaactaaagtacaaggtatatacacacattttttgctcttaaaacctgaacctcgtatgatcatagttcattatgatggtgcagagtacgcagaaaggatccatagggcttagtatatttgcattcgggttatctccatatacaaactccaaggatgatgaaatcgcaactcaaagagctaaagctttcttctatggctggtgagcaaaaagaaagctttctttctctgtgtttcaataacttgcggacaaaatctgaagactaaaatgataattcaggatgttgaagcctttggtatttggagactatccggatgaaatgaagagaactgttggatcgagattaccggtgttttcggaggaagagtcagagcaacttaaaggatcatctgactttataggaattattcactacacgacattttatgtcacaaacaaaccctcaccttctatctttcccagcatgaatgaaggcttctttaaagacatgggagtatatatgatttgtaagattagttttctttcatcattaaccaatagaaaaatgcttctgatcaattcttaaaactaatagttcttcttctttggacagccgctgcgaattcttcatttcttctggtaaggtcctgcaaatttgcataatacatatatattttttgccaaaagctcttcttgaatcaattgtttttcttgaagtgggaggctactccatggggtcttgaaggtattcttgagtatataaagcagagctataacaatcctccaatctatattcttgaaaatggtacaacacttcattctcttttgttttcttactctgttgtgtctgcttgaaagcacactttcttgttctttaagattcttcaacttgcaattttttaaatataaaaacaggtatgccgatgggacgcgactcgacattacaagacacacaaagaattgaattcattcaagcttacattggtgctatgctcaatgccatcaagtatgattctccttctgcatcttttagtcctcatattactacattatgattcatggtctaattccagttttacttactgatcaggaatggatcggacacgagaggttactttgtatggtcgatgattgatttgtatgagttactgagtggatatacgaccagcttcggaatgtactatgtgaatttcagcgatcctggtcgcaagaggactccaaagctctctgcttcttggtacactggtttcctcaatggtacaattgatgttgctactcaagatactattcagttgcagagcaacatctctggctcttcttcattgtaatatatttaaccaaaggatccttatttggtttatttcatctatacaaagaaaaatctcagtgacttggcaaaatgaatttataagaattgcatagaaaaaaagatgtaacttttgagaccaataaatgttgcatagattcttgaagataaaaactagataacggcattcgaacacaaccacaaaagtcacaaagacattaacaacttaaatttccagtacatagagatagagttgcattggaaatttatgtcagtcacatcacaaagattacacttacaccgaaaaataaaagaagatacatttctattgccttcttcacatgtatatttgtcgcgttttgtgagtggaagaagaatgaatagaaaagatcggtcacttgatatgtacttttctttttaatggtccaagaaaaccactaaaaccctttaattatattctcttgaactcagactaaaggaggaaaaatggaaatgaatcttatgtctcttttttccatttttctggtcatagttttgacaacaagctataagtgataaatagaagatcttttatcagaaaagaaaatacaagctatagtgatagaccgctcagaatcagcttataataaacgtaactttgatgtatatccgtcatactaatgttagaaaagattagagatgaattttataatatgattttgaattcacaacgcaagatatccaagcgacttacccttcattaggaaaaaaaaagatatccaagctaccaaaggagcttcccaactttagaataaagaataaaacgccgtatgaatccgaaacctataataatcataatttgccgagaattttgtaaattttgtcgttgttgggtcaaacgtataggccttacgttatgaaatgtttgggcctatttgggccaataattaacatcatcagttatagtgattggtcgctcccctcgcatggaaccacatccacatgtgagaacaaatttatgattgtagtgtacataatataagtggaaatatatgtcggtcacatcacaaggaaaccgaaaagagatatttcttgaatctttcttcttcacatatatatatttgtcacatagagaaaaagatcgatcacttgcgcagttttgctacggtcaagagaactccaaacaccttcattttttattattattttttcttgaaaaccaaatcttcaaaactctacactaaaacgaaaggcgcaaaataaaaatg

SEQ ID NO: 4638 - DNA, 3000 bp, Unknown
  misc_feature (1)..( 3000): cDNA_ID_1824945_gDNA_ID_1620719_Annot_ID_165750 3000 nt of promoter + ATG
tatgcttgccgtaaaagtacggttacgtacgtagcgggtttgaaccaatcactaatggtaatagccaatcccaattggcagataatgttataaccgtcagattcaaattcgaattaaagggagccttggcatctgaacggttcagatttgatctttcttcttttctctctctctctctctctctctctctcagtttcagagatcaaaagagaccaacgaagaaaaaagcaccgcttttgcagaatcggtgacgatagaaagagaaagacagagagagagggagggttagagagtcaggggctatttgattcccctggaaaatttcagatatttgtttcttcatcttctttccttatttctctctttctcgtttttaccagatttgtcttacgaatcaattctcaaagatacccaaaagtggtagggaagcaaagtactgttttattttgcttttgattctatcaaaatcagcggtgaaagaaaggaattttttttattatcagagaaagagagattcttgataatcgaatagacctagatttttttttgaatttagggcttttttgatttttgagaaattgattgtggtaatggagacagatagtatggagtgcgtctcatctacgggtaatgagatccatcagaatggtaatggccaccaatcttaccaattctcttcgacgaagactcacggcggagccgctgctgccgccgtcgttaccaatattgttggcccaacagcaactgctccggccactagcgtgtatgagcttctggagtgccctgtctgtacctattctatgtatcctcctatccatcaggtgaatctccgatgctcttttggttgtttggttctcaattgattcctaatgatacgttttagctttatgtgtttgtgttcttctctgcctatatgttgtgtagcgtttaatggggatatagattatataatgtggttgttcataggttttgatgttgcttgtatcctagaattgagccaggggaagtaattgatctgaaaagtgtgtctcttttttgttattgttgttgttgcagtgtcataatggacatacattgtgctcgacctgtaaagtgagggttcataacaggtgtcccacatgtagacaagaacttggagatattagatgtttagctcttgagaaagtagccgagtcgcttgagctgccttgcaagttttacaatctgggatgtcctgagatctttccttactacagcaaactgaagcacgagtctctctgtaacttcagaccttacagttgtccttatgctggttcggagtgtggtatcgtaggggacatcccttttcttgtagcccatctcagggatgatcataaagttgacatgcacgctggttccacttttaaccaccgctatgtcaaatccaatccgcgtgaagtagagaacgctacttggatgctaaccgtgagcatatccttctttgtctaggaaaacatgattctcttcaatgttttcggtaactaaactgactgtttcttatgtgggttcaggtattccattgctttgggcagtacttctgcctccatttcgaagcgttccagcttgggatgggtccagtatacatggcattcctgagattcatgggggacgaggaagatgcacggagctacagctacagcttagaagtgggaggcagtgggaggaagctaacatgggaaggaaccccaagaagcatcagagatagccacaggaaagtaagagacagcaacgacggtctcatcatccaaagaaacatggctctctttttctccggtggagacaggaaagagcttaaacttagagtcactggtaaaatctggaaagagcaacacagtccagattctggactttccataccaaacctatcttcttcctgatcattcttttatctttttgttttttctctctttgagaaggaatgttgtatgatgattcgtttgcactcttcttctttgtctgtatctaaaacatatcatgaatgaatgtttcatcttatagtctcatattttggcagatgcattacaatttagatacatggagataggagatttgatcaagtgaaacaaaaaaaaaactaagtgattccgtggtaacaagtaacaacttgttcaaacgcaactaaaatgtgtttatgaaaaaatggaggtgcggggaatcgaaccccgtgcctctcgcatgcgaagcgagcgctctaccatatgagctacaccccctgtttgatttctgataacattaaactaattctattttttgctaacactgtgattaccataatacaatatccaaatgtatagtgtgagacaagaccatatatgtaaaatatttagtctatgttaaacaagttgcccaatcgacaaattattaggaggattgttgatgtatatatgcatttatcttaaaaataaaatctaccaatattttcaaaagtgttcaaacattaaattgatatcaaattaataaatagaaaagataaggttaaatatgaagttattcaattcatataagttttaaagattatgtaagattttctcttaacaagatttcaacaaatctttttaaaagatatacgagtatgaaaacaaatcctaagcttttttattttccaacaaacaaattcttgagctttaaaacaatttaaatgtcctaaattgtataatctaatctaatgttagtgaattgcaattattcaaattattaacttaatagataaataggaaaaaaactaaataaggaaagttaggaattgaggaaaaggaaaaatcttagaaattgaattcgagagggaattaaaggaaaaaggcctaatacaaattgaaaagggtttttaacttttaagttctgtttcttctagaactttactttttagccttcgtggctttccctataaatttcccaatctttggccatcggacgatcaaagaaactcattctgatttttaatctctgacgagcaaagaaccctacagctaaaagattaaacca

SEQ ID NO: 4639 - DNA, 3000 bp, Unknown
  misc_feature (1)..( 3000): cDNA_ID_1824949_gDNA_ID_1620719_Annot_ID_165749 3000 nt of promoter + ATG
tcaatccatttatgatttaggcattccctgcctttagtactgcaaaacggtgattcccgtctgctaaacttcagtggctacttcggtgtctaggagaattaaatttgcaatgaatctccttttgtactcactatgatgctgaaggaggtttgtaacatttcagcattagcattgaatgtatttattttgtgttgtcaaggtggggcatcatctagtgtcttggaagctaatccgccaccacgtgagtccattgtcccagtagttaatccatcgcgtggtaacctaagtcctatgcgaaaggatacgacaggctcagccgttgttcagcctgatgcagccacttcgattcaaggtacatataagcaatgtcactcttagaaagtggaacccatgttcgtgtgttgtagtttgagcttttgacgttgacaagcaactttaataaaaataaaaaacgtgatagccaatacttcttctcttatttagcttttgcgtctctcgtttgacttttaaagactccagcactattttcttaatatgatggcagttgcaaaatcaaacgatacaagcgaaattgtaaacaatggagctattgttggagacgggcaaaagtttctggctcctatggtggaggagcaaacacagcaaaagattgacaatgatgattctagtacagcagacgggaatcacacgtcagacaaaggacgtctctccccaattcaaccatctcatggcatgagtatactaaacacagtgactaacggacccgacggattgaaagtagaaactacaattcatgaagaaggtgcccctcttctgtttgaaggaaaagacactcctgacacaagcacggcagattttggtctgaccaaagtaacaggtaatcttaattctggttataatgatgcgaggaaatcatattcatagcttcagtgccaaatacgtagaataaaaccggtttctgtctctcctttgtttgaagattaacttcttaccgttctgtctagtaattcctattcataccttgcaaactttccgcttctgtttaggtgtgatggacacaggtgacagaggagttattaccggtccagcaaatcctgaaattgatatttcagcagggaatttgctggaagaagggtctctaagggaaccgttaatgagacgagttgttgttcaaggacgtaaactggaaatcttgaaaagcattgtctacggaggtctactagaagccatcacaagccttggtgttatttcatctgccgctggttctggtgcttcaatgtgtaagtaccgcttacccctagctatccattttcatttgtaaaacacaaaacacttttttcttgcttgaaaatctaaatcttgcttgaaaatctcaacacatgtttgtattgttgtggttgcagtgaatattctggtcttggggcttgcaaacttgcttggcgggcttattcttattattcataatgtgagtgatcaataaaacctttgtaatgaacttggtaatgaaccatgtaactggcaaattcaagaaacttacagagatacttcttctgcagctccaagaacttagagaggaggaacccataagaacaacaacagaagataaccagactaacggtagagaagaagaagaaggtcggtataagcgactccttggacgaagagaaaatttcacacttcacgcaacagtcgcaatcttatccttcataatcaccggaatactccctcctgtagtctactatttctcattcagtgaaaaacacaacaaagactacaaagttgcttcagttttcggggcatctctattctgcatcgtcttgctcgccatagccaaagctcatgtgaggtacccgagaggcagctacctgaagagcattctgtactacgggtcaattgctgtatcggtgtcggggatttcttatgtggttggtaactttctggaacagttgcttgagaagcatggatggtctgatggatcggaaacacctgtgggacagatgatgctttcatcacttatgggaagaaaagccggctttggatactcatcatcgtactgaaactgaatcttgcctggagaatgatccaaactgaaacttgctgcttttctcttttactctgcttttgtgagctctcgttccaaatctttgttgtcggcaaatctttgttgtgacttgtgagtgtagaagaaagtcgtttccacttgtagaataaactaaaataagcataacataataatgatggaagatctgtgccttttaataagtttaaatcatttttaaaaaatgacaaaaagaaggttctaccgagaattgaactcgggttactggattcagagtccaatgtcctaaccgctagaccatagaaccatttgatgacagtcctgatataaactagtatatactaaatattatatgcttgccgtaaaagtacggttacgtacgtagcgggtttgaaccaatcactaatggtaatagccaatcccaattggcagataatgttataaccgtcagattcaaattcgaattaaagggagccttggcatctgaacggttcagatttgatctttcttcttttctctctctctctctctctctctctctcagtttcagagatcaaaagagaccaacgaagaaaaaagcaccgcttttgcagaatcggtgacgatagaaagagaaagacagagagagagggagggttagagagtcaggggctatttgattcccctggaaaatttcagatatttgtttcttcatcttctttccttatttctctctttctcgtttttaccagatttgtcttacgaatcaattctcaaagatacccaaaagtggtagggaagcaaagtactgttttattttgcttttgattctatcaaaatcagcggtgaaagaaaggaattttttttattatcagagaaagagagattcttgataatcgaatagacctagatttttttttgaatttagggcttttttgatttttgagaaattgattgtggta

SEQ ID NO: 4640 - DNA, 3000 bp, Unknown
  misc_feature (1)..( 3000): cDNA_ID_2170372_gDNA_ID_1620719_Annot_ID_165748 3000 nt of promoter + ATG
tcgtttcgaaaaaagatggaaaagagacaagagtacaaggttttagctgtttacgcagtgtctctactctgcatcgtcttgctctcaatagcgaaagcttacgtgtcgaagaaacgcgattatgtcaagactctgtttcggtacacgacgacggcgacgacggcgtcgggattctctcaatttgtgggatacttggtgagtcaatggcttgagaaaagcgggttttatgatgattctccagaaactcaacgagtttgaaacgagttcttgttcgtcttctcttcacttcccctgttcttttcgtactctttacgtggcccaatttattttccttaaaagtggtagaattgtttgattttgaccccaagaaaaaaaactttttttgtgtgctagacttggctctctttcaagttagttttggatcaaacacttgttgttgctgagaaggttccgtgaacaagaattctgtaacatgttctagtgccaaaaataaccagttcataaggttttatagtgcatgttaattaataaatgttgttaccttatgtgtcttttaaacaatggcgattacaaacaattagacatatgcatggaaatgcaaatagcactgcgtgcgaggagaaaattagggtttatcaattagattcaattggtcggacgcctactaaaaatgtggaacttaaagattggtggtggtggcaaatacagtttcatagatatggaaaacaactgatacacgttctgagataagcaaattttgtgactaaacaagttgtataatatatggagattgaacttatgttcaccttgataccaaaaaaagaaagaaaaacttatgttcaccaaaatacataatgtatcatcagcaaaaggggaaaaaattacggtgactgaatgatgaagaatcaaagaaaataagaaaaagttgatgaaaaatggcatcacatgaaaaacgcttggttaattatttcattttaatcatggatcaaattcagggatgagtgaaaacataaacaagcaaaaattattcagcacaaaaaaattcaactacattaagcaaatgatgagagtttttggcactttgtgccattccagaagctacagtttaatatctaatttgaactaaagtttaaccaacgtgtactattttcatcttgttgattctttctactcgtatgggaccatctaatgcgaatacctaacaattattatatatgatataaaattataaatccatgtgaactcaaggttacgttcacattcatgactcatcatattgagtgagtcgatcatataattaaattcaacctacattcttacacgattctaatatagagttaagattttaattaaaaatgatgacacaaattagtttgaacacaacataagcatgttagtaacgtgcttttggggttatatatcattattttaggtggtattattgatagaatggttaagattttaggaatcatggggatttgggcaaatattgtgtaactaagtatctatgtgtcacatttcttatttcctttcaatttctcctgataaacgtaggaaaacgaatatatactaatggtgatggtgattgatcacaaccatatcatcgagaaacttcacgttcaaacgtaaaagacgagaccattatcgaaacaaactagtatgaagaagttttttttgttaatgaagaaggttttttttgtgtgtgaagaagttatatatctgaatgcaaattataatgcaaggaatgtgtatctagccaattttgttgataaaagattagccataactgaattaaatatggattttttttttttcgaaaaatgaaatatggatgttattatgttagcatgattaagttaataatgttgacatgttgtaatggtactatgtcagcaaacgtgttgcatgaaaaatttatacggaatatttctatcgagtattaatttcaagatgcgactttcttattagaatattagtatattaaaaacaactagtggtggataaacaaacattattgtaagatgtgttgttaattcttaatttgagtactattattgtcttttattaatatttttgtcaactctatgtgtttgatgtagataagaattctttggccgtattgattattttccacgtttgaggcatcgatgtagttgggacgtgatcgtgaaatgaatgcagtcagtgtctccaatctgtcatccatgtgccaataaatccctgaaaagaaggtgacaaaatcttcaactaatttgtttgttaatttttactactaagtatacaattttactagttacaatatactatttcccataatgaataatcagttgtaaatttgtaataggaaaatatagtaggtaagcatttagatggtaaatttaaataaataatttggttaagaacaatactgataaaataaactatcaaatactaaacaagttatttaaaataagctaagttattttgttgtgtattttcgaaaagtctatatatctaaaggtgtcaaataaaagtcacataatgtttcgaaaatcccataatagtaggtggtatttttagaaataatgaaatttgggaggaaaaaatcactaatactacttactttgtcaactatatgtagtaaaggtaaatattaacaaaattacaaaagaaaacaaaaagtcctacagttttagtaactaactaacaaagagctttaaacacgtgaaaagtttttgcataaaactagtactagtatattagaactaggagtagtgctcaatcaacggccaagtcaaaacaaacaaatcaccatcaataatcatataattaataagcagaatcatcatttatgtatttgataatgttcaagtgaggaagaagaaggagacaaagacgaccccaacataatatctatcaccttctctatagatagttagatctcagaatctctccttttttgtttgctttacccttatttggccattcctgtcttccactttgtcatcttttccctttctg

SEQ ID NO: 4641 - DNA, 3000 bp, Unknown
  misc_feature (1)..( 3000): cDNA_ID_3073833_gDNA_ID_1620719_Annot_ID_165745 3000 nt of promoter + ATG
gagagtgacttggtgaatccaattagttattcttgtcaacttttggctttaatacaaataaacattaatggatctcaaaatggtcatgaagaaagctcgaaaggtcgatctcccgagaaggctttggaagagatacgtaagcaagacactcatgatctctattgccctaagtgtactagtaacatcactaaaacagctctaatcgttgaaaagggagatgatttttctcccgacgaccagaaacctttcgtgctctggatccctaccttcaagttcctttcaagttctcccaaaggtatccatatgtacacgtaaacatgtatatatattgttctctatgatgatgaagataactttttttctttgaatgctgagtgaccggttttttttatctgtaggatctgtcgaaagtaaaccattgaatcctaatctcagtggtatgtgtagacacacttttttatgatggatgcacttttgctttgaactattgcttatatgatcgattttgtatctgtgtaataccagtcgagaacatttgtttgtttatgatgaaaacgtacactttcgtctttaattcctgaatgatcgatttcctattttgtaggaccagacgaagaaaactcatctcaacctgaatccagtggtatgtgcactcatatttctttatgatggacacgttatatctttgaagtactcatggttaaatggtcgattttctatatgtagaaccagtcgacaaaaactcatcgtttaatcgtagtctcagcagtttaggtatacatttccttatgatgatgaacaaaaactctattaaaaaaaattccctttgtcgtccttcatcttcaatgacacaattgccatatatatatatatagctaaaaccttggaacgattgcctactcttttacggaattcaataattattcgtagagacgaaaatagtgctactcctctacaccaagatggtgcaggtcatcaaagttctacgagcacatcaggtcattcccaatgctttcgctgcttcatttctttccaatacaatataaaacaaagacatacgatattttcaaaagaaataatcccatttttcttgtcttgacccctggaaaatatgcagtgtctgagcaacgtggacgttggaaaattagtcccggtggatggataattcatcgttaaacgcccagcaaatagacaacgaattgactatcctctcttcttaccccctaaaatgaacgagttttttgtttgattgaaacccatagtaagtgattgatgatagtgtaatgatcattttgtactgagtttaaagcatagaaatcattgcactattactggaaactaattatttcttaaactaataagtttcataaatatattgcaaaagatgcaatagagtgctagagttttggtaattaattttttattttatgaatgaaatattcttatccaaactcatgtatagcttattggatattaacggttgatgatttgaattttagtttttacttcgctggaaacaaggaaatcatattgatcaaattttccatgtatgataccttaaaaagatcgtttataattgttttgaaaaatctagaaatttaacaaataaatattatacttttgagtaaacaaaataataataattgaacttatatattatcatttttgattccaatcttgtgaatttgaaacataccaccaagaaaaaatcttgtgaatttgaaatagaaattttccctcaaaaatcaacgaaacaaacaaatctaattaactaaaagtctaaaatacaacttaatgaaataaataataaatcctaactaaaactttgacaaaaaaaatcctaactaaaataaaatattagattattgttttgataaccaactccatttatatgcacgatgatcttcggtcatttgattaaagaaagacctcatctttagaaaagtctacatataattaagaaattaatgtgacaatgtcatatttcttattatatataattaaacatggttgatagcaaaccggacagaacaaattattaaataaaacccttttataaaacttctaacgaaaatccgtaattctaatcaagccataaccaaatagaagccacataatcccaatacaggtcgtatatgtattatttttttatgactcggtctgttaaatacaagcacaacaaatttaaagttcgaaatattatgttaatagtcaactctactaatattcctcaagtcacaaaacaatgacgaaaataaaattcacataataagaatattccccaagtcataaacaatgaatgacgtaaattctagaggcattaaaatgaaaaaaaaaaaaaagaagacattttcaaactctaaaacatacagtcacattcattgtacaaaagcttttgattgaataaaattttgcattcgattcaaaaaaaaaaaaaagacattgctataacaacttcttaaaatgcgtgacttttgcacccttgactttacagggtcataaaatattacgtataattaacaaaaagaccaacaattggaataatcaatttcttcctattattgaatgttaacttttctataaacctgaatcttatgatagaatgtacatgaattgtgtcccattgcataagaacttaaagcatatgcagtaggagattttcaaagaggtacaacaatataaaaaaaagtaggatagagataaaaatcggctattattgaagaactttttagtttttagccatctccattgacagaaacgagaagattttttcaaaaagaataaaccacaagtgatatgacaactgtcaattcagttgagaaccattttctatttgagaaccatctcattcacggtatattaaaagaatacgactatgaaaaatcaaatgttagagaagtagatcagcgaaatataaaaatgagatagtaagcaggtcgtgggcatataaataagcgtccttctgttttctttgtcatcattaattcattaccctcaaca

SEQ ID NO: 4642 - DNA, 3000 bp, Unknown
  misc_feature (1)..( 3000): cDNA_ID_3073839_gDNA_ID_1620719_Annot_ID_165742 3000 nt of promoter + ATG
acctttcgagctttcttcatgaccattttgagatccattaatgtttatttgtattaaagccaaaagttgacaagaataactaattggattcaccaagtcactctcaagaatggttaaaaataaaataaaaaaaatcacaaaatcttgattcccataactaaaaagaaatgtgataacgagtacattaatctaccatgggggtgccatttcaatggaattctctagcactaaaattctatgtaagaacaatgtacatcctactcataaatcaaaaacctaaataacaataaaggaatgattagaaacgtaccatatagaccatcgtcgtcgtcaagcacttggcgtttgggcacgatggattccattgaagttgaacctggtgtgaatgatcacaaagggagaaccagagaacaattatattttatatatctaacgcgttttttaatttttaaaatcgtactattgaacccaccatgagattaaataaagaaccatggaaaggctaaacaatgaccgagttttattcttcaaataaacattatgatcttatgactttttatcttcattgtttatgacttagtgaatgttaattacagttgactaatggaattattagcatagttagtactttgaattttagtatcgaagcagtctcaaatcatagtcaacttaatatgaaattaacttagagaaatagtattattgtggcgtacatgacctgatcactaaccttgcgtaaagtattgaagatttattgattatgggtcgttggacggaaggacttgtacttgaaagtcttttctgttaatattgggcttagaggcccatcattttaaaggctaagaaattctttatatcttctattctttttttttttttcccgtcttatatcttctattcaagcgtttcctaatgttatttatccgaacagactaatcagtttgggccaaaatcgaaataacaaatcgtcacggtaccagtaatcgctagtgtatacgtgtcggtagtccagcacagggatgaacgaagcatgaactaacttttccacgtgtcatatatccattacacgatctatgaaagctggggtattcttgtaaatataaattatcctgagggcactttcaccaaggtaatcgttattctgcttcccgttttttttatctttttccggtaaatttctgctctaactttttttttttcatcatctttttggtttcgccaataatggaactcttcttccaccattttcctggaaaatctcggtatcgagaagatgaatccctagacagataaatctagaatcactcaaatctctgctcttcttccgattcagatcgtatcgaattttgaattttgtatctcgctacactgttcgattgagaattctttttttccgattgattcgaatcggattttgtttttttcctcgatatagaatgacttcgaatcaacgtatgttgttctactcctgcattgcgaaaggaacagtgattctcgcagaattcgcttcaaaggaagagccaggaatcgaagatctagctttgagatgcattgagaacgtacctccacatcattcgatgatctctcacacagtccataagagaacctacgctttgatcatcgatggattgttttcgtatttcgcgattttagatgaggtcgtagcgaaatcggagtctgtatggctattcaatcgattgaaatcagctacagagtctctaatggaagacggatctactgcggattcgttggataatccgactcaacactgtctccaatcaaagctagatccagttttcgctgagattgctgctattggtggtaatcataataaggatttggaattggagtttggatcaccgaggagtatagcgagggagattaagagtaataatcagagtttggattcgtccaagggacgaaaaggcggtgcgttgatgccgcttttaggaaagccgttgagggtgttgaagaacaagaagagattgcagacggaagcgaaaagtgaaggtcattggaatgagaagaagatggacctaggaggaggaggtaaaggagtgaggaatggtttgattcatgatcatcatcatagacaaaaggcaaaacagatatggaggaaacatgtttggattgttttgatgtttgatctctgtatctgccttgttctctttggaatctggctttggatttgtcaagggtttcaatgcatcgatgggtaattatcttcgatcatctaagttatgtgtggttgaatgtttaaaaaaaatatccgaggtgttgtttccagggtttaaaaagaaagcctggtttacacgtttgtgatgatgtttttgtttgtgtttttttgaagttgttcttcatgaggtaaaaagaaaaaaaagtgtttgtaaaaatctcttttgtaatgatatctcttcgttttctttggatgttttgattacacttgatttgttgtgtgatattgggcgaaagatgtggtctatgcagttcaacgtctacgaattttaaccccaacatgaccaaaacactcatatttgtagttcttagatgtaaatttttactgcataacccatcttttccaaaatgtttgtcaaacgtaaattagcatttttgtccgcaagatacaatgactttagcatgaaccaaaagggaaataaatctcaatcaaccaccgtattaattattttccgaaattcatatgtgaatataggagttgtttagcaattcagaaagaaatactaatcaaggtttataattacagaaatctggaaatgtatgtcggtcacatcagaaggaaaactgaaagagatatttcttgaatcttcttcttcacatatattttgtcacattgtatagaaaaagattgttcacttccgctacttaacggtcaagacaacgaccaaggccaccaggccccttcacttcttttatcttcgaaaaccaaaattttcaattatttattctctcctccactcacacgaaagtagcaaaagcaaaatg

SEQ ID NO: 4643 - DNA, 3000 bp, Unknown; identical to SEQ ID NO: 4636
  misc_feature (1)..( 3000): cDNA_ID_1840737_gDNA_ID_1620719_Annot_ID_165740 3000 nt of promoter + ATG

SEQ ID NO: 4644 - DNA, 3000 bp, Unknown; identical to SEQ ID NO: 4635
  misc_feature (1)..( 3000): cDNA_ID_1824977_gDNA_ID_1620719_Annot_ID_165739 3000 nt of promoter + ATG

SEQ ID NO: 4645 - DNA, 1973 bp, Unknown; identical to SEQ ID NO: 4634
  misc_feature (1)..( 1973): cDNA_ID_1397552_gDNA_ID_1620719_Annot_ID_165738 3000 nt of promoter + ATG

SEQ ID NO: 4646 - DNA, 3000 bp, Unknown; identical to SEQ ID NO: 4642
  misc_feature (1)..( 3000): cDNA_ID_1824967_gDNA_ID_1620719_Annot_ID_49163 3000 nt of promoter + ATG

SEQ ID NO: 4647 - DNA, 3000 bp, Unknown; identical to SEQ ID NO: 4641
  misc_feature (1)..( 3000): cDNA_ID_1824961_gDNA_ID_1620719_Annot_ID_49165 3000 nt of promoter + ATG

SEQ ID NO: 4648 - DNA, 3000 bp, Unknown; identical to SEQ ID NO: 4639
  misc_feature (1)..( 3000): cDNA_ID_1824949_gDNA_ID_1620719_Annot_ID_49168 3000 nt of promoter + ATG

SEQ ID NO: 4649 - DNA, 3000 bp, Unknown; identical to SEQ ID NO: 4638
  misc_feature (1)..( 3000): cDNA_ID_1824945_gDNA_ID_1620719_Annot_ID_49169 3000 nt of promoter + ATG

SEQ ID NO: 4650 - DNA, 3000 bp, Unknown
  misc_feature (1)..( 3000): cDNA_ID_1825011_gDNA_ID_1620720_Annot_ID_49172 3000 nt of promoter + ATG
aaaaggcaagaaaactattgtcgaaaagacataaatgacactaaaattggattattaaaaatggtatatatgtttggtggaatttataatcattaccaaaatcaaaggaaggagagagggacctcttcgtgcttatgatttccctcctaaacaactgctcccactatccttttttacttccaacaaaatcattcacacgagaaaatctgtctcgtgatcactttcatgcaaaattaaactaaattttggtattttttgtcaagttcttgctgttttaagtcgattatttggtaatactatatgtgtggatatacacatccaagctaatcaataattgatctccttctcttatcaataaattacaccacattagctaatcaagctaataaattacaccacattctcttatcaatttttatatggtataaataaaacaaccgactataggctacagagttggtattaaggcattattgccttctagtcgaaggaatttttttgttatgataacactcgtgggaaaaaaatccagcctaatatgctcatttaaaggataattgatttaaatgctttaatcattaaaataaaaggtttttgcttttaaaggttaccaccgcttaattcatcattaggagaatattaactttgatcgaaattccaaaatacttttttaacacataagaaaattttcagcatttttaaataaagggtacatttattgggttcaataaatatgtttccacgtaaagtttggaggtttaaccacatgaatgttttttgatttaaaaaacacataaattttcttagtaattacacatttttaaccgtccatccagattgtaataagtgacaaatctgaaaacatttttttttttcttgaatcttgtttaaattctctctgctgcatacttgcaggcatttgaccaacgactatacatattgaaagcaaaatatccaccagggatgatagggttagatcccacattcaatatcttttgtctttgttatttatgaaaaacaaatatttatcaggaaaaaaacgtttcttctctagtggtataagataataacaaaatttaatacttagttaatgtatttactatcttcaaacttaccatccttcaacattaatattgatcaatttttattttttttactaaactacttccactaaaaaaatgcaaaagaagagatatatatttaagtcaaagtaattaaagatggatgggtgattcttcagcaaaacggcgccgtagaggtgtcttatcctacattacagctgggttgtggcagacatcatagggcctacgtatatttgagctttactgtacgtaaagctttaacatatctagttagttctcactgtacaaacaaaacaaaatccaattcgtaacatatatacaaatactactagtactagattacgctacgtatacatcgctttttcgcaaatttctaaactaatctatacaacaaacttgaatgtttgttttgtaatttatcttaaaccaaagttttgaattgtgcattgggagctacactctagtccccttttttccccaaaataatctccttacatcgaccggttaaagtatttaaaccaacaaattttaatttgttgctgaaggtacaaacatgtcacatatatagagacagcatcgtttatacaaataatgttcgatgtattggaaatcaaatataaatacgagtagcgactcacttggtttaatagtttggaagataatgaaataaaaagatgaattcaaaggatacagagctatatatgtcgggtcatttagagccgtgaccaaaagtttcgtcgtaatttctacggtcggtcataagaaattttggacttttcttcacccttttatgaacttctgtatagtttttgtcggattatatatttgtattcgtatattttttgtttctaataatgatacgtaaattcacgataagaaagacttctttttatttaatttgatttaaaacttttgtttttggaaatgactcatacacaaggttaaagtttgatggtatccaatttacaaaaatgtttcgagagtgcgttcgagtgtcctaccaccatcgtaccaactcgtatgggtttattattaggtttttttcttctttttccaatgtctttataattgaaccactctaaatttctttttttaaattaggttaagaatcttgaattttctgttgattttaaaccaaggttttcaattcttcttagcacaaaaaaaaaaaaaaggttttcaattattaaagaatctaaattttttgagttcaagagtttaatgatagctgaaaagttatgaatgattgcaagtttgcaacagaatggtcgatgtagtacatatcaaaaacatgcatcaaaataaatattcgtgcttagcaagagaaacgattgaaataaacagaacaatcgttaaccacttaaaaatcttagaataattttgtagtgataattttctgtaagagagaggtatcatatcttacaaaaaaaaactcatttcagataaaataatgttgtccaatcgttaccaagtatgtttttgctgtcatcagttgtattgtaactcgtctcttagccatatagttctaagttttaaatgttttcaaagactttacaaaaataaaataataataaggtggaatttgtagggctaaaagcgaaaaataaaaataaaataaaagtaaagaaacgtctttctcaataagaacacagatcccaacggattcaaacagcaaatttgtgctttgctcttctctcttattataatatcctctcaaaaaccctctcctatatcctcctaaagccccccttccttgtttctctaccgcaacaaagaaaaaacaaaagtttgagaaaaatggtgtgttcgttgtgtaaccaatgattgggttttagcttactacttcgagagattataagaaagaaagagtgaagatacattatagaaagaagagaagcagaaaccaaaaaaagaaacc

SEQ ID NO: 4651 - DNA, 3000 bp, Unknown
  misc_feature (1)..( 3000): cDNA_ID_1825007_gDNA_ID_1620720_Annot_ID_49173 3000 nt of promoter + ATG
atttgatgatcttcttctcagtttatctgggtaagtacacacttcaatcttcatggattcatgatttccccctcaaatttctcgggaaaataatgatggattttgacttctttatttttgtttgattaaatctttattaggaggttatgatatggaggagaaagctgctcgagcatatgatcttgctgcactcaagtactggggtccctctactcacaccaatttctctgtaaatcatcttttctaaactttatgtctctttgaccttgttgtatgatttatttatataatatgataatggatatttgaaggcggagaattatcagaaagagattgaagacatgaagaacatgactagacaagaatatgttgcacatttgagaaggaagagcagtggtttctctaggggtgcttccatctatagaggagtcacaaggtccttttaaattacatttatataactttatataatacatagtttaataatgtgaatattgactttgtgtgagttttttgtactagacatcaccagcatggaaggtggcaagcacggattggtagagtcgctggaaacaaagatctctaccttggaacttttggtaattcatcatgccgatgattttgattgttaaaacttaacattttcaattgcttgtgtcttacgaaatcttttgacactatcataggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgaatctcctttgctaagtccttctctcttcgttacgtattttcgatatattatacttattcatgtgctaaaaaaggtgaaaacaagggaaatatgttggaacaacacaaaaggttgcatgaatatatctaaactatgcgaactattatggctattgatagaaacatgaacatttagtagttgattttatggctttgatagttttggcaattgattagaatgttaatctctttatagagaaatagtaagaaaatatgtaaagagaatgtgcatggagctgaaatgacccatatctaataattaggtttcttgtcactttatttatctttttgaaacacattgttcttttaagtacagagaaataataagatgaataatggtaaatatgtaatgtctctccaataatgcgatatgctttattgaccatatcgttccacaacaatccaacataccttcaccacctcatttctaaattccctccttttgtctctttttcacacccccaccgtatcagcttttccctaaagtttcaccaaaattttaaaatattccctcctccatcatatttagtgattttttttctttttgatatttattaaagttagtttatactgtatctaaaaaatggagaatttattggttggaacttttaagagccatttactatgtcccaaaataaatatgggggcagcaaatttactgtaacccatacgtggggtaaatgaagtgagtagttcaaagttgaaacttgaaaacctttgatctttaaacataatgtccttcgcacgtgttttccacacgcgtggagtagtttgcagaaactcggaagcgaaagatggttattgggccttggaccattataatcacaaatctggcccacttttatcttttattcgaagcacgtttgcaggacattaatttgatcgtgcttttcactcgtgaggaagagttggtttagaatccggagagaaacgtagttattgggctccggcccaagtttaatttcaaaactcacttctcataaacccaaattttgggcatatgatttgagttggacaggatgtgattctttttttttttgtttctctaacaatataatgtcttgggttattttgtggtgaatatgttgtagggttcaaaacattatagtccacatgaaatcatatttttgggccttgatattttcatatcaatcaatcgaattaataacacattaattgcatcgaaaatgtggtttttgtttgttataccaaaatacgaaggcaaaactcttccacgcaaaaaactcttccacgcatgcctctaacttcatccagttctgttcgttatgataaaaaaaaaaaatataacaaaatctataagatttctaatttgatcagaactttataaaagtctaataacttttgtcacattataagcttttaggaaaaaataaaacgaccgaccttatttaattgcattgtcctaacttcccaaacgttttaatgagattttgcgtaatagagaaacaagccacgagttcgattcacagccacaataatctttctctaccaaataaagacttgatctttctcttctccttctatatccacgcgtcaattcgtaaaaccaacggcttgaaccaccggcaatagccgcgggattgcggcggaggattaatcaaaaaacgcaccacctgaaatctctctgtgtacgcta

SEQ ID NO: 4652 - DNA, 3000 bp, Unknown
  misc_feature (1)..( 3000): cDNA_ID_1825003_gDNA_ID_1620720_Annot_ID_49174 3000 nt of promoter + ATG
aaaaaaaaaagttttccctctctcataaaacattatacataatctaacacaatctgtaatttgtagagaatgggaagatcatgtctccaaggtaaattatctcaatgactacatttaatataattaaacataccaaagaaacatactttcaaagatcagttcattaattaaggctaagtatattctttgggatttgcactccttttggaattatacagcaacttgtctttacttggtgttgttgagcttaaaggtcgcaaagcgcatcaaaaaatcagatcaaagtaagttcgtgtcggaagataaacatatggacccatttttgttgcatcttaagaaaatataaggaccctattataatcctttggtgtttcttgttaattttggtcgagcttttgttatttacttactattttacgaatatggaaccatttgcaactaaaaattctagttgaaagaaatggagaggctaccagattataaataaataaaaatcatgaaagtatggttggatacatgaaaaggaaaatttagtttatatttgaaatatcataaaaactatttataatatgtatgaagaataaatatataagaactggttatatatatatgtgtgtgtgtattaaattaatatggtgtaaatttttgttttactgctgtattcgaaattggagagttttatttcttaaaattatgtgaaatatcaagtgatagcatcatattttttagattttttctgctgactttattaaagcataaaaaattaaccagagtatgactttgttgtgtcatttttaggtgataatggtaatgttttagtcgttatatgagaaattatactgaagaaacgaaaatatccatattatagtgatgtggtttgaaaaaatataagtatctcaagctgaagaagattttatggcaagctattaattctgaccatagtttttcttaaaagtaatcctcaccatagtttgactacaaatctacctataatcaatgaatatcaaactaaacatacacacatttggtaattccggtcgttcaaattatacaagagtattgttcaaatagtcaaaagtctgtcgctaaataattattaaaaatctataaattatgaacgtcaaaaaggcagagaacgaagcaactctgaacattcgtatgaaaacacacaacatttaaaagctgagaacacaacaaaaataatatatatatccctttttcttatatgtatatttttatcttactttttcgtccgtgtaagtttttttagtttgtgaaaatagtacttatttttgtaaaatgtttatgtattcgttaaaaagagaaaaagaagtctaaaaaaacgggtgtgtagaactggtgatcacgacgacgtgcttacaatgggacactctcattaatcagggagctataaactaagggcaagttactggaccggtttagtaagttgttgaacaattaataactgttgtcccaatttatttatttattttcattattatttttagcattttaccagctgggacaacatatatacaaacagaaatacttaagtagtatcaaagttacaaaattaattgaacaaaaagcaataggcaatcgttgagccgacatgtgtgttaaactttaaactgaaaaacacgttgttagtttatatgattcggtatcataagatggaaacatttttcagtttcgggaaatacaaatcgagaatgagaaatgaaagaagagtatgatgaatttcatacctctaaaaagttaattaattattggttccatgtcaactatttttattttgcctgaaataggcactttggcatttattattaataaattaatactatatataagtgagtggtcatcattatgccaaaagaagaagaaaaaaacacgaattgaacttggtaatggtatgttccgacacgtttccggcgagaactaactacatctttcgttcaaagatttcatcttgttcttgttcccattggttattaaaacattttaaacacgtcataaagcatatggtaattttaatatggttagagaaaacattcattcggatttttctgattctttttctcatacgatgtcaacaaccttttatttgcactatatattgtccaaaaatcatataaaaacatgttgaaacatggaagttagtcttacaaaaataaaaattatgtttgtgaatactcttacatacacagagagactattagctgagctagaaatgaaaaaaacagccgacacggttaacaatatgtttagattatggagcagcgtggtggaccaaacattacattaagacggtccaaagagtcccgaattgtaacaatgacaatttcacatattcaatttttttttgtaatttacttattattgtttatttttattttttaatttacttattattatttgttgccgatatagtttttgttagatttttaaaaacatttctttaattctctgtgggtcgcattatatcccatttacatggagatttcctgtcggtatgccatctcattactattatgtactaaatatttttgtttactaaccaaaataatatttataatctgacagtagtaataagtaaataactttaatctcacgtaatccacacaactttagagacaggcataaaccgttgtgttaactgcgataataactctttaagctgagctcaattttgagtgtgtttcagggtcggtgtggacggaaacgcgtgaattcattaatattcttaattaattaatacaaaagaatcgaattaaaaaatcgaatacctgactggtcaaatttctgtcgtgggcttggcatgaaaactatatataaacagccacacatgcctagagacctctcgatcgtagcttacctacaaacaacactcacaatccaatcaaaacaaaacactttttattctctctcaaaatcttcatatctactttattctcctactcatccatctctgtctctctatctctagagctaattaagaaa

SEQ ID NO: 4653 - DNA, 3000 bp, Unknown
  misc_feature (1)..( 3000): cDNA_ID_1016268_gDNA_ID_1620720_Annot_ID_49176 3000 nt of promoter + ATG
agaagtcgtttattcagaaatgattctggtaatcgcacgaagcttattattcatcatcgttatctttcatactataagataataattaagaagatcctagtaaaatttggtctttgaatctgacctcttttctacgttctatattttgtcatgtaatgcgattattttgatatgatcatgcgtcatagaacacacgctccataagacaaaatgtgataacatattaaattcgataacaataaataagacagaaacaaaactaatcatgacgacgtctagttacaggaagatcgcctaaatgactaaattaaataaattatcgggtcaatacaattactaatttgtcttctcgttctaactttgaaatatttagatattgggtctttgttgaaaaaatatgatttaatcatgtcatgatttttctaatcttgacacctcgagttttaaatacaacactaggactatgtaattattaaataatacatgtagttaataaatacatgtgtcgtcgtgttcatgagtttgcctcacctttcctcttaggagactggtctggccgtcggggaccaatgctctgagatacaaaattatttttatactaataatttatagtataataatacgtattctttgtatgcaattcaaattgttttcatgcatccctctctttaaatgaattgcagcttgtccaaatggttaaaagttctcgttagttggaatcaaatatctatatcttcaacattctcagaactatatatattctaaagtttcaataatttttgttccaaacaacaaaattgactctttaaataaagtcaggaagattttggtaatggcgattgcaatctttttagtcaaaagacaccagcaaaatgatcaaaaggcgaatttaaataacttcatttgtaacttctgacgccccgactattctagctgttacaagtgaccaaaatggctaacaatgtacacgttaaacttttgattttcacactaccatattttataaaaatcatgatgttctaattgattatataaataaaatgctttacatatgcatgtagttcacattttttttttttggtttgcaattgtttcttaaataaataaataaaaaacctaatttaaaacaaatcagaagaaaaaaaaattgcaaaccaaagtaatccaaataagctagtattttaatcggattgtgagtactttctccacttctccttcgaggccacgcttatatattaatttgtacaatatgggtaacctaacttggttggaaaatagaaagtgccaaaaaaaacaaaatatgtatggctaaaaccaataaaacgtcccacgtcgactttcaagttaagtccctcaacaatattatttctgtttgacgaatcacattccaccaccaccatgattaccaatcttcttctcccacccgtttctaattcaggccattcacaatatttgatacagaataatgaaacttaatgttgaactattccgccattttactgtttcaattaattaaatatttatctaaacgaggtgctgttagtaaaaaaagttccaatatttttctagctaattctataaaaagacactttgtactgtaagagcagagacgataaaaacagaaaatgtaacgataatttgttacgtcctgtaatgaattgtttaaattcgagtaatgatatttatgcattttctacatatatgctactagtaatcaataaaagcatagtattatcaaaactagaatgcggtggaaataaatagatagaaatcattggataaataagtcccaacacaatctggccagatcaagagaaccgaacctaaaacaagaaagtggagatcacaatccgaaaccctaaataataatacaagaaaggggaatataaaaagaaattagaagaaattaattaaaaacccaatgtgtagtgtgaggaagttgaagattggtaggcaagctgacatgttacccatatctaccttcttcaagcaaagcatggagtgggagacaattcatgtggtctcttatttaattaaagttgcctcttaattactctctattgacaacttattatgatactcctacttagataagttaaatgtatcatttgattataatctaatttattttaaggaagtcttcagttctgttagttatatttaacgcttcagtggtatattacaagaatatctgtactcgagtaaatattttaaaatatcaatcacagaacattggatctttgaatgtgggcatgggaggatatagaatcgtttcgtcatgtgctagtaattgtattgttgacttgaattgaatttgtggatatatatcccgattaacaaattgaaacaaacatgtaaagcaatgtataaatggtaaaagatagaagtaagtttatcaggaaatgcaaaccatcaattcggatataggagtttaaaagtctaatcgaaagttttggagagactaaaatctattacacccaaaaaaaaattgcgttgaaccgttttttttttttttttgggtttttaaaactaatttaattttcataccacgtcataaaaattatattctcagagtataaatttgtatactatgaataaacatactgaaaatttatgaagtgggaataatagttgcaagtggggtgcgcatttggtcaacctttgtaagtaagaaaatacaaaggagagagaattgtgctatcataattttccacattctttttttcgaaaattccatataaaaaagtaagcaaaataaatacattccttgattaattctaattattagccacccacccacccacccatcaaaaattaaaaataaaaattaaaaagacaaaataaaaactctcttccccttcttaagaagaagccatcttggtttcatttcgtcccataatcttccaaacttcaccagaagaaattcttaacaaacaattttcttcataatattaattctcaagatcttaaagattatattaatacgaagagaaaattcaa

SEQ ID NO: 4654 - DNA, 3000 bp, Unknown
  misc_feature (1)..( 3000): cDNA_ID_2990556_gDNA_ID_1620720_Annot_ID_165789 3000 nt of promoter + ATG
aacatttgtgttaaattttaaaactatgaaaataaactgaatttgacatttagtctttaaaattttgtttgcttttatgaaaaattataagttaattctgcttacacgtaatgtaaatttaaaatttcaatttctgattattattattttaattttttttttttaacttttgaataaagccacgaaaattaagatacaaaaaaagacaatagtttataaaaacgtccaagtcagataatcacaagctcgtgagaactcaattccaaaatttcataatcaattagtgttgaattttcgtttctgtctataaatagtgctattaacactttaaagtgtgtatagaaaactacatcgaaaccagaattttaatgttttatgaaaccactttaaatagaaaactatgggtactagaaaccacaaaacttttcaaaaaattaagatatcaaacatgcaaaaaaaaatctgtcctcgtatgaaaaatatagttaaaactatataataatttgataaaataaaataaaaacatcttctttgaccaaaacagaaaaaaaaaaaaaaaaaaaaacgttttctcagtttgctttcatcaaatcatgtatgttatatgttatcgaagatatagactctatagtgtgttttttcgtgtgattcattttatttgtttcaatagttgttaaaatacgagaaacccaccaaaacgaatatataggagaaaataacgcgtttaaattatgacatcagtagaaactctttttgcggactgtgaattgagatatccaagaaaagggaagaggagaagagtgaatcggcctcccccacaaggtgacaaaactggaatctataatgggaatgtaaataatcaataagagaaagaaccaatgaacattcaaaagtgaaagaaattgagagtacatacatataatagtactaattaaccactcccttgcacatggttaatctacagcgttggattccattatcaagtagtacctatgtcaagattcgagaagatcttcaatgaacaactattcaactctcttttttgtagccctactcgttatttaactatatgactaatggtgttgtctaaaatggtttaccgtatggtctgaatataaaaatggttgaaacgatgatagattagaatttataaatgcaaattaattcatcttttttggaacgtgggtcattgatgtgaacatctaatcggtcacggccgagaccgacaaccaaaaaaattgtcatgaaactttcacgggggtctctcgcgtgagtcgtgatctctctccatcgcgataatatatgtgccaacggaagactttttttcttataacaaaaagactcttattcctaaaaagctacaattcagcgaaagactttaagtttgcttaaccttttctatattctttttgaattttcaaaactcataaaaccaatagtaattaaagtccatcggccgattgggtccagactattaaagttggatcggattaatttttaggcattaacaagaattatggtcataaaatgagttgtagtaaacacatctttgtgatcagaatgcaaatcccgtgagactttgtgcacgagagtacgtggtgctttatgacttgcacctttttcatattagctttaatacaaaattaattatatgacaagatttctactaaaataatatccaaaccgtcgattattgccacattttattagaaaacctctttttaaaaatgttttattaaacttttgtatatattgttgtcttcattatcctgcgcccatgctagcatgcaaattgcagagtctttctgataaaaatattctccttcacttttggattcagaaagctggagtatctaattatacataaactaattacaatctaatgatgaacataaacaataacttccaaaacaacacgtgacgaaggttcttgtaattgtgaaataacaatcatcatgttcgtaacgttccttgtagtattcttttcctgattcatactgatacatataataatatagtgtgaatattaaaaaataaaataagtatacgtatatatatgttgaacctcattgcgtgtcctctcacgaatctacttactttgagatgcgtgcccatctcctaaaatacaatcggagctatgtctatcgttttcgatattccccggccgaaaccatcaaacgaatttttatcatcatcaaacaacttgataaaataagtgacacttgcgaaaattatttgatggagatcacgaatattagaccgtaaaatcaattaccaatatgcaagttacagattttttcatttatcaagttgaataaattaggcaagttggtcgcttataacacgttgatttctttaaagatttatttcccacatctgaactattttagatgaatatttttaattcgatttaatactagttgaaaaaggaagtcaaaccttatccttgatttccaaaaaaataagctgaattatacataccattataccaactacgtagaggtagccgagctatagagtttttcaaacaaaaaaaacacgtaaaaattcacatataatatcttacaaatttacaaaattatcttacacattttcgtgtggggtctatcataattaaatggtatagtcatctttataaaccaccggttatgttaagagagaaaataaaaataaaaaaggggctcttcctaggaagatagatcttaaccatggttaacactctcacggttcattattaaccatggttctaaaaatctaacctttaaaaaaccactttcgcttctcttcacattcgcatcattttgtatcatcccttgaaaacgttaaatgatcttctcctccgatcattagtctctttaatctttctcagcctcttcttgttcgtgatctctcttcctccggtaaaatttttaacgtcgatggtaattttaatatcagtacgagtgtaatcaacttcgtaactctgtcttttttttgtgttgtggttacaggaaaaagatg

SEQ ID NO: 4655 - DNA, 3000 bp, Unknown
  misc_feature (1)..( 3000): cDNA_ID_2051633_gDNA_ID_1620720_Annot_ID_165783 3000 nt of promoter + ATG
ccgatgtacagaagcatgagattccgatccctgacgatgttttaaatggttctttcaaggtatgaatagagatacaagatttcttgattaacacgttaggttacatgaagctggagttttatttggatccaggagttgtgcgatttcatatcattggagcttgttaaatttcttgcgatgaatcccggtggagaagcagaagaagtgaagaatctcgggtttacgttgacgcgctctgttgagcagattgggtcacattcaatctcgtcgatacataggaagagtttagcaaatgacgatgatgagaaggttttgaaagatttggtgaatgatatgaatgaatcactggaaacacacggtctgaaaattcggatgaacacagcgctggtaagcaagtctaaagataatccgcaatgacgattaatctaagacttttaatgtatcttttgagaatctggtttttgaaatcaggtggataatactataggagaattggctggaggaaggtattatcacaaggacactgtggctgcagtatcattaggtatgggaaccaacgctgcttacattgaacaagctcaagagatatcgaggtggaaatctgcgatacgtgagccacaagagatcgtatgttaagatactttcaacacacttagttcaatatcatagagctttccaaagtttttatatcaagtggttgtacttggtaagattataggttgttagcacagagtggggagatttcagatcttgccatcttcctataaccgagttcgatgcttctcttgacgcggaaagcttgaatcccggacatcgagtaagaacacataccgattagtactttctatagtgtgttttgagaaatttgtctgtttctctgtttgaagatatttgagaagatggtgtcaggaagatacttaggggagatagtaagaagagtgttactaaaaatgtctgaagaatctgctctctttggagatacactacctccaaaactcacaattccttacattttatggtaccttaactatatacttctcttagactaagttatgaaactatagactaaactgcggttttccgagcatgttttaggtctccagatatggctgcaatgcatcaagatatatccgaagaacgggagactgtaaacaaaaagctcaaggaagttttcggtgtaagcttcatagagactcattcgctttagaaatttcgatagtctttttgcgtttgtattaaaaacaaacaaatcttgaatatcttgtgtgaaccatatgcagataatggattcaactcttgcggcgagagaagttgtagttgaagtatgcgatgtagtcgcggaacgagcggctcgtttagcgggagcaggaatagttgggatgataaagaagcttggaagattagagaagaaaatgagcattgtgatagttgaaggaggattgtatgatcattatagggtatttagaaactatcttcatagcagcgtttgggaaatgcttggtgatgagttatcagatcacgtcgtcattgagcattctcacggtggatctgctgccggagctctcttccttgccgcatgtggcgacggtcatcaagattctgaaagcaagtgacgatgatgattcttttttgtagttcttacaatcaaataagaactaaattttattttgtttagtcatgtctatttaattacaatttaagttaaaattacaatataaattattttttattaactagaaatgaaaataaaattccaaatttattttggtttttagaaagaaataaaacaacagaaaaaaaaactttttaaaaaatgaatgtattattcactagtgaaagtgagaatctttagtttccaagcttctttatcatcccaactattccaatctttggttcggtttacatggttttaaaatcaaaattaatttgggttcggtttgcattatataattaatacggttttgagaaaaaaaaaaaaaaaaaatgctttcgagatcacgcgttggtattttggaaacaaagcgagtagattagaaataaacatgattttgtgggtttacccctacagaaattgatgacacgcgcgaaacgcgaggtcggtgcatctggttatgaaatggagcgcgtgaggtgaagttggtgcgagtgggcgaattccggagcactctgattggctgaaaaaatagaaatagtagtgatgttgctcctcctctcctcctctattattaatttttcgtcgttcttcttctgaaagttgtgtggtttttagaggtcaccaaaaaaaatctattttgagatactaaaaatatttcgttttgcattttgttgtgcagccatttgttacacaggttgaagcttataactgaaaattggattcaaagaatcgtagatgaagaaatcgaagtgagttgaatattttctgaacatatgaaaattggaacaagttttttctcattttgctagtttcctgtttttatgttttcttgactttaggagatgacatatggaggtgaactatacaaaggttgttgcaacgataacattctccttaattcagtttttgcaactcggttacaagcactcagtggacttttggccaagacaatttttttttttttttctctctctctaaaatgttatagatacgaatcctttgttgaataaaggaaaaagttgaacatttgattacacataagactttaacataatccaacttttttttatatgaagctacaaacaagatttaaaacatcaaagattccatctaaacttcattcatcttcaatcttcaacatccttcaatgactagtatgtatgtacataagtaaaattgttgataagaaaacaaaacaatgatgggctaaaatagcccataaaaggcccattaaacttgggtttagactttagattcaacgacgccagattagtgagtcacataaccctcttggaaagagtctcaacacttgcagagaaaaagaacaaggaagatcccggaaaatg

SEQ ID NO: 4656 - DNA, 3000 bp, Unknown
  misc_feature (1)..( 3000): cDNA_ID_1824997_gDNA_ID_1620720_Annot_ID_165779 3000 nt of promoter + ATG
ttagtatatacagtttatcttgttctcattcgagatgataaatttgtaatttttttttaattttcttacatattttggcattttgctccttttccaataaattatacattattgctttaatcaatgagagtataggtgcagtatttatgattgtgcatgaactttctaatatgattttctttttttttaaatgaaaataaagatatgaaagttgttaaatgtggagaggcgtgagagtagggatgtgtctatgttaatttatgaatatgtagctttcattttgttatccacaccacacaagtcgtgttcgatgaatagttcttatccccatcttcatttatatcatttctcactcaatattagtcccagctagcaaacatcgttaaaaaaaacaaagattctatgaggcaatttcgcattctagtgtcatttgacatttgtagtacaaccatttttggttggctaaatcgctctagacaggaccatctcaagtctcaggtcccaactcttgagctatttgttacttatgtgcaaaaaaattatccaatcgtataattaggatcttagaacaaaatattttctaattataaaaataaaatttggaatcctattctaagtgaaaaatacggttttggctatggagcatataagttgattagattcctactaattaatagagccaattgtatacttcaactttgaaaaactccggcaaaaaactattgatataaatggcaaggttaaactcacacattccgttttgatgcaatatttggctatgttaagctatcatgtaataacaatgtaaaatacaccctggatttttttgcatgaaaacgatggttatcaaaagaattaagtctaattaatatagaaggagacacaacattggacaaatccacatggaagtaagaactatggataagtaattgacagactccataaatttcatgaaacaaagctctatgtttttttgattaaaaaaaaaaagaagaagaacgaagactctattcgactcaaatttaatgtcatgtctttgaatgattttaacttttgcattataatttatttaatatgatatccatctttttcatccatttgccacctttttcttgtcgtacttgtttaaaaattaaaatagtaacataacacggccgacaataaaaatgatttgagctatattggaaacaaaaaacactagtagtagttttctttttcgttaatagtagatttggtaaacatatcttaaagtttttatagatgtcaatttctgtgaatatcaatactctgcacttaatgtcgacactctgatgtatccaaataaactgaaaaaaacaatttagttttcctacggtaagttttaaagcattttagtattttacacaagattggggatttttgtgggtttagccagttttgtatgtgctgtacaaattgaagaaattgcatgtactatattatatatgtaattgctgaatctgttgggtctttagaaattgagaatatgccaatgatagacttttcgtaaatgggctttcttcggctttttatacaatcatgggctttgtatgcccaacagagacatatattactcacatatattcaaccaaaaaaccttgtttacaaatgatgcatctttgttttgaatgttaatactcacatgatacttcagtttgaatgctttttttttttgttaaatagtttatcttaaaataaagcataatatatttcaaagttaatgtgtcttgtgcctgaatttcaaattaaagtatttcaaatatctataacagatgggtttatacatttttgctagtatcatcaattaaagaaaaaatgtttaacagcggttaactggacatatccattgagcatataattgattaaatcattggaaaaagcaattgggaagagtgagcgaaacgtgttgagacagttctatataaatattttagataaaatatgacccataaattacatatataaaatatataaaagtttttggttagaagaatacgaaaaggcaaagaggcacggtattggtcggtcaggtgaagtagggtcctttctactgctccagtcagtctattaccacaagaaaccgcagaaaccagaactcaaaaagcaactttcatatttttttataacaattgtacaatacaaaattcttatagacaaaaatgtattttagcatattgcttttatttatttttgtttgtgtgtattgtattgtcacttttaaaacaagaaagaaatatttatctgacgaccaaaaaaaaaaaaatttatgtattttgtcgtcttcaaaactttgattttactattggcttgggcttaagtatttaacattagaactgttcttttacgttaaaattaattattcatcctgctcttttgtacctacgtaatttccttttcacctgattcttgttttattcgactcttgtagtcttgtagacatacgtatcaatcaatacatacacgttaaatagaatctgactacagttaattatacatcaaattatttcaagaaaattaattttccttgtacttatataacataattacataggtcccgacatatttttgtttgtttattattcaaatactgactctgtaatagttttttatttttttttatttttgactctgtaatagtttaatacatactgtgtaaatctgtgatgatacaaaaaagtgtatataaataatattcataaaaagacattactattattaatgtcaactcatatataaaagagaaacgattacgtgtataaatatgatatatccatgcgtgtagtactctttaggaaaaatttatttgcccttcatagggtagtcactttcctttttcttctttacttacaaatcttcctctacacatcaacacacagagaaagagagagagagagagacagatagagagagtgagaatagaagtgagtgagagaaagtctaattgtttctcctgtaaactgcaaaccgatctcgtgtctgaaa

SEQ ID NO: 4657 - DNA, 3000 bp, Unknown; identical to SEQ ID NO: 4653
  misc_feature (1)..( 3000): cDNA_ID_1016268_gDNA_ID_1620720_Annot_ID_165776 3000 nt of promoter + ATG

SEQ ID NO: 4658 - DNA, 3000 bp, Unknown; identical to SEQ ID NO: 4652
  misc_feature (1)..( 3000): cDNA_ID_1825003_gDNA_ID_1620720_Annot_ID_165771 3000 nt of promoter + ATG

SEQ ID NO: 4659 - DNA, 3000 bp, Unknown; identical to SEQ ID NO: 4651
  misc_feature (1)..( 3000): cDNA_ID_3093661_gDNA_ID_1620720_Annot_ID_165769 3000 nt of promoter + ATG

SEQ ID NO: 4660 - DNA, 3000 bp, Unknown
  misc_feature (1)..( 3000): cDNA_ID_1825011_gDNA_ID_1620720_Annot_ID_165768 3000 nt of promoter + ATG
tttaaattctctctgctgcatacttgcaggcatttgaccaacgactatacatattgaaagcaaaatatccaccagggatgatagggttagatcccacattcaatatcttttgtctttgttatttatgaaaaacaaatatttatcaggaaaaaaacgtttcttctctagtggtataagataataacaaaatttaatacttagttaatgtatttactatcttcaaacttaccatccttcaacattaatattgatcaatttttattttttttactaaactacttccactaaaaaaatgcaaaagaagagatatatatttaagtcaaagtaattaaagatggatgggtgattcttcagcaaaacggcgccgtagaggtgtcttatcctacattacagctgggttgtggcagacatcatagggcctacgtatatttgagctttactgtacgtaaagctttaacatatctagttagttctcactgtacaaacaaaacaaaatccaattcgtaacatatatacaaatactactagtactagattacgctacgtatacatcgctttttcgcaaatttctaaactaatctatacaacaaacttgaatgtttgttttgtaatttatcttaaaccaaagttttgaattgtgcattgggagctacactctagtccccttttttccccaaaataatctccttacatcgaccggttaaagtatttaaaccaacaaattttaatttgttgctgaaggtacaaacatgtcacatatatagagacagcatcgtttatacaaataatgttcgatgtattggaaatcaaatataaatacgagtagcgactcacttggtttaatagtttggaagataatgaaataaaaagatgaattcaaaggatacagagctatatatgtcgggtcatttagagccgtgaccaaaagtttcgtcgtaatttctacggtcggtcataagaaattttggacttttcttcacccttttatgaacttctgtatagtttttgtcggattatatatttgtattcgtatattttttgtttctaataatgatacgtaaattcacgataagaaagacttctttttatttaatttgatttaaaacttttgtttttggaaatgactcatacacaaggttaaagtttgatggtatccaatttacaaaaatgtttcgagagtgcgttcgagtgtcctaccaccatcgtaccaactcgtatgggtttattattaggtttttttcttctttttccaatgtctttataattgaaccactctaaatttctttttttaaattaggttaagaatcttgaattttctgttgattttaaaccaaggttttcaattcttcttagcacaaaaaaaaaaaaaaggttttcaattattaaagaatctaaattttttgagttcaagagtttaatgatagctgaaaagttatgaatgattgcaagtttgcaacagaatggtcgatgtagtacatatcaaaaacatgcatcaaaataaatattcgtgcttagcaagagaaacgattgaaataaacagaacaatcgttaaccacttaaaaatcttagaataattttgtagtgataattttctgtaagagagaggtatcatatcttacaaaaaaaaactcatttcagataaaataatgttgtccaatcgttaccaagtatgtttttgctgtcatcagttgtattgtaactcgtctcttagccatatagttctaagttttaaatgttttcaaagactttacaaaaataaaataataataaggtggaatttgtagggctaaaagcgaaaaataaaaataaaataaaagtaaagaaacgtctttctcaataagaacacagatcccaacggattcaaacagcaaatttgtgctttgctcttctctcttattataatatcctctcaaaaaccctctcctatatcctcctaaagccccccttccttgtttctctaccgcaacaaagaaaaaacaaaagtttgagaaaaatggtgtgttcgttgtgtaaccaatgattgggttttagcttactacttcgagagattataagaaagaaagagtgaagatacattatagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaaggtcagtagtagtaatgttggagtttttagttttcttggtgttgatgttgttgtgtcttgtttgatgggaacatgtttggttttagggatttatgttttattttttatactaaggacattttctgttttttttggttgttatttagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgaca

SEQ ID NO: 4661 - DNA, 3000 bp, Unknown
  misc_feature (1)..( 3000): cDNA_ID_2051677_gDNA_ID_1620720_Annot_ID_165764 3000 nt of promoter + ATG
ttggattaagcaaccacaccacaaatgagttgatcaaaaccccaaaactttcacaaacaagtgatcgctcaatggaaagttatgtgcaactagaaattgtgttaaagagatggagcttacaggaactaggaggcaaagatccgtaaggataaaaagacttcttgatagagatgagcaaactagaaggaacagggacattggctgtgatgtacttatagatcaacgcctgttgctctaactcagcccattgagtcaatgtaaaaggtcctttaacacctgtgaagttcccttgcatgctcatgttcatcatcattccaccagaaccatatcctcctgcattccacagcaaaaatgtaaaaaatttgattattttacacaacccatttcaccaaaatccaatcaataaagagaagacattatcaaacctgagcttctaaagtaagaaggtggaggaatctggtgaagaaacggcgagagagagttcttgttattactgctattatccaaaccgacatatttactgaaatcaagagcgtctggtttatctgagaagctaagcatttgttcttgacggcgagaatcagaggaaagaggagaagcagatctcatgagaggaatgccttggtgaaacgacatcgttttgcaataagcagctgcaacagaagaagacaagttttcttcttcttccgctctagttgtcgttcttgctagcttcaagcttcgttgcaagcaatcctcaccgatgaatccggatctatcttgtttagttcctataagctcttttagaccaagtgactcattttcattactagtaaccgacccaagaacatgaacaccaatatccataagaagtaagtaatataaaaagaaaaagaaggaaaaaaagttagataatgacttgagagatagttgccatgggaggaagatagctaaagatgagagaagagagagacagagggagaagaacgaggcttacttttgattttcttgaaagagatatatattattatgtgtttttaaaataaaatgaaaatagttgtggtgaagctttgggaggagacaagaatggtacctaaaaacacaatccggatctcggacatgttagaacatatttatccaatgctttttcattaattttgcttttagttcttcttctttgttttgtaaagttttctttgcttgctttaaaggtacaaacttagcttccaatttgtttcaagttgtgtaaatttatggtcccaaattagttgtataatatggtggtagtttctctataagaaaacgtaggctatttctgtattatttgcagtacatatttcccaatttgtaggcatttttctttatgggggttattattttagattttagtaattttcttttgttgtgatatatgtgcatatagggaaagctagctgtaacattgttaaaaaaaagggagaaactagctgtaacctgtggagttattagattatttttgtaatgttcaaaaggaaaaatattagtggttttagaaatatagcaacatttttacttatagtaatagtcttaattcatagaggaggtgaatatatattgatatattttgtaatttgtaatgcctgtttttaccagaatttgcagaagaaaacaaagggtatacttgaagtgagatttttggaatattatactatatacacatatattcacacttttagtgagatttttagtctaggaaacaaataaaagaattgtcctattcatataataaataatagtattgagtggagtaccaaatatttatcaagattcacgtggttccaatgatatttttggaccatcttcttggtcgtctccccgaggatttaagttacatatatcggatgggccaattctattcttgagtgatattacatcaacggttattgatccatgtgttcgattacatatgtaatcagtgcaagtaaaaagtagtttgggatataactttgctggattttttttttttttctttttttttcttcactggatttattttctttgttcattaaaattgctggactgatgcggttagtaagcgttatttgctttgaccataaatttagtgacactccgatttcagttatgccttcgggtaataatttgcgaattgtcttttatttatcataaaattaatctgatggttggatcattggtatgtcatataatagaaacagtaaaaccaatgaacaacaaaaggattagataatctttttttcacaatatagtatgaacttatgtgaatgatatatacagacgtcgtactcatgattttaacttgaaaaccattcaatatcattcacttccaaactttgctattgaactgtccatcacagtttctttataatttttgtataatgttgaaatatgaaaaaaaaaaaaaaaaaaaaaaacactaaaactatatcagcaaattgactagcttgtggagcaaagtgaatataataacaatggaaaaagataagagtgttactaccaataccatccaacaagaaacgtatatgttagttaaagctttgcgtaaatgtcctaaaaagaaactaactcacaaaaagtcacatgtggtgttcatgcatcgatgatgtaaataattaccactccacataatattatgtagttaaatacgacattttggtttaatttcataattacgtcagatctgattttcttttagtcatgctccattttgttcgtattatttttttctcttgtaactttaggattcgtaatattattgacgagagattaagttatagcaagttttaacttttaaagattttactgttttgcaaaatcaatggttgatagaaaccccaaagaagttagccaatgtactagctaataacattgttttacattaatttttgcgggctaccttttgtacgtttcttagtcccctctctctcgcataggtttcgacctatatcccctgcttacaaaaccaatgacaataaacaaaatcaaagataataaaaccaattatct

SEQ ID NO: 4662 - DNA, 3000 bp, Unknown; identical to SEQ ID NO: 3371
  misc_feature (1)..( 3000): cDNA_ID_2051688_gDNA_ID_1620720_Annot_ID_165759 3000 nt of promoter + ATG

SEQ ID NO: 4663 - DNA, 2193 bp, Unknown
  misc_feature (1)..( 2193): cDNA_ID_2051692_gDNA_ID_1620720_Annot_ID_165757 3000 nt of promoter + ATG
aagcttcatctgaaacaatggacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgtaagtgttgaatcatgtttcttgatgtatccttgtttaaagttcaagagccttgagtgtgtttgtgtgtgtgtgttctttgggatttgcaggcacttgattgggtttttcctgtttttggcgctcactatatacactgcaacgaaagtaccgagtgtcgtggatcttcattcgcttcaacaccgtttacccgatttgttgaggaaaacagatctccacaaacttcattctgagctcatggctcgccttccttctagtccatctagttggcatgtgatggaccttctttataactgtttgcctgaaagattttctcatggcaactacactgacatgtgtgttctggtaagaaaagactcaatctttctctctattcctgcagattactgtttcaaaatgtggccaagttcatatctttgtaattgcattgcagcattctgtgagggaagatcttgcaaacttgatagctcctttgatcttcaggccaattactcgatggccgttttatgcatttctaggtggtgctatgttctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcccggagtttcgggtggtgagggcgtctctgttctttggaatgggattctctggcttagctccgattcttcacaagctgataatcttttgggaccaacctgaagcccttcacacgacaggttatgagattttgatgggtttgctttatgggttaggagctctggtttatgcaactaggatcccagagagatggatgccgggtaaattcgatatagcaggacatagccatcagttgtttcatgttctggttgttgctggtgcgttcacgcactatagagctgggctagtgtatcttaagtggagagatattgaaggatgttgaagatgaagattgaagattagatggaatctttgaatcttgtttgtagtagcttcatataaaagttggattatgtaaagtcttatatgtaatcaaacgtttaattgtttcctttattcaacaaaggatttatattgttaatccacatatgtattactggttaaagaagctgaaggattcatatttttagatgattccagtcttgattgcagcattcaaagtatcataatccagtgtcaacctcatatagcctccttgtgaacctgacacaagcctaattgttccatggcagaggatactttgattctgatcttcttcttgaaggtttcccctgattggtatacatttcgaatgatccataagtgttgataaactacaagtacacaaaatatgaaacaaaatctatgcacatcaataaaaattcagaaatcaataaaatttactctgaaaatgcagaacatttataagtgtttgttattgttttcaatatatgagaggaggagctcccctactatttttatatttttagccaatgagagagctccacttcataccccacttttaccaatcgtgctatttcacagccactctcactcatgtcgcgttgagcgcgtgtctacgatttctaaaggggttaatccacaaaaatcatgcatttttggatccacgcacctcattctcaaaaacccatcgcgtgtcgtattttttttggttttcttctctaaaccaaattaaaccgaaccgagatcaatttgaatttcaaaaccaatgtaaacccatcgctgtgaaaacaaaaagctcggccactgtaacaacaaaaatggagacgacacaacttggaagagaaatcaactcgaaatagccaagagaatgttcgtaaaccccctcaaatccgatg

SEQ ID NO: 4664 - DNA, 3000 bp, Unknown
  misc_feature (1)..( 3000): cDNA_ID_3073882_gDNA_ID_1620720_Annot_ID_165756 3000 nt of promoter + ATG
atataaaaatagtaggggagctcctcctctcatatattgaaaacaataacaaacagtgtattttaaccactactagttatctttaactctatctcatatcaacaaaccgttgtgatatccttgagacacgtcctaacaacaacttacacatcaaccattgaacccagatgcacttcctgctgtaacctcagtctgcaatgctttgtcttacatgcaaactccaccagaacttagtaccatcatcattaacaatttccagactcaaactagagcctttgtcttctttatgattctctgatactttgaaaaaacgttcacttgactaacctgcaagtgaatttcccttgagtagttacttatgtaatcttctcatgatgcagacagctaactcaaactccttagttactgtcttctaaatgcagtttaaatttcttgcatttgcttccttctagagcttcttttcagccactgccaccagcattgagatgtgtcgtttatcaaactagatacatgacactttcacattattgaagtgagtagccttgagacagttcatgcagcacttgcacttgtctcttccattttcttcttcgaagaatcccactgaatcactccaataacctcttcttagcttactcagccctaaaaaacataataattcagaatcgtgcaacttattctaggatctgcaacttagtttcgaaaacctgcaattctctagagatctgcaattcgtttctgaatatcttaaccaatcaacgaccttcaaacaaatccgtaagagtctctttacccacagatttataacctttgaacttgttcataaccagttattcttggctttcctttcttttggtaaactcatgccagagttcaaaaacagaacaatagtatcaaagaccctgaactcaaaaacaccacgaacatgcttgaaagcagtctcaagtcttgaccactcttctgcaaaatttgcaagcagtgccctaccgttcctctccttgttaagaacttcaagaatttgaacaagcaacaagaaaggtgttttaccctttgatggtttcttagactacaactccaaaaccattagttaagaacaaccatcttatctttttctttgagtttgctgagcttcatcaacaagtagtgaagcaattccaagaataaggaacttttgtgccaaagcatatccatctgtcttgatgcagagcaagaatggagtagcaaaccaacttagaaaacatagaaaacctggtggaaatatcaaggacagccatacgaggtcacatgaaaaaacggatcttgatttgaatatgtagattggaagctatgacctctttcccaagataggtcaagaatgagggacacccgcgagcagcctactttggaaaccaattcccatcaaacaacacggaatcagacaaaaatctttgtacccttggaaagatctcgtttccaagattctagaacagctttaaatgctcaaatccaaggtccatagccaagtcaaacgaagaagacacagtcagacaaacaaaaacaacttcatccaattcacaactcttctgtcttctattaaaacactttctcctagaaatctgcttcagacttctttttctcttcttcataggtcacaaatacttctccacactgaagcatacaccatggtttgaaaagcagaactgattcatcctctcttgatatgtaaacttcatagaccacaaaagaagattcaatctgttttgatgcagaacacaaacaaagcagcaaactaacccagtaaattctaaggattggttgcagtaacaacatcaatcatacgaagccataggagaaaacggatctggatttgagtttatggtttgaaagttatggccaaaatccacgacagatccaaaaacatgtcgacctgcgagagaccaactttaagaacaatttccaaacaatccacaaggaaccagaacgcgatctttatatcattggaaagatcttgctttcaggttttcagaacatctttcagaactaaaatccaagctaaatagcaactccaaattaacaaagacagagttgataaacgccacttcatcttcttctcattcttagccaatcttcatattcatcattatgatgctagttcttttccctcatgttgattatgtgtttcatccaaggataaattgaagctaggaaacacacaatcaacacagaccaaaggtgcttattaacccaagcaaaaactccacgctcctcaactgagatcaatctcaatcatcacctcttttaaccaagcaggcattcttctaaacagagaagacaaaacacaatctatttctcgtcaaccacttgagaaacagcctcttctcttcttttgaacatgaatttcaaaccagatcaagcttcaagagtagacaacaaaaacaacaacttcctctcttatcgagaaaaccaaaattataagaaatgctttgtatctagccagagcttcttgcagaaagacgtcatcattatctacatgagctcttgaaacctgcaacaaagacacacaaacaaattcgattacaacaatgtggtttgggacaagaagctgaccatgattttacctgatagtaaaacgggccttgtctcttgacagctgaaagtctgaaacaagatcataatatttctcaagcgctgaactaacacaagtaagggaatggaagtgaatacttgttctatagaggtaccttgtaatactcctcgtttgagcagatgggcttttggaggttggaatcaaaggaagcatcggatttgagggggtttacgaacattctcttggctatttcgagttgatttctcttccaagttgtgtcgtctccatttttgttgttacagtggccgagctttttgttttcacagcgatgggtttacattggttttgaaattcaaattgatctcggttcggtttaatttggtttagagaagaaaaccaaaaaaaatacgacacgcgatgggtttttgagaatg

SEQ ID NO: 4665 - DNA, 20 bp, Unknown
  misc_feature (1)..( 20): cDNA_ID_1839219_gDNA_ID_1620720_Annot_ID_165755 3000 nt of promoter + ATG
aagcttcatctgaaacaatg

SEQ ID NO: 4666 - DNA, 3000 bp, Unknown; identical to SEQ ID NO: 4656
  misc_feature (1)..( 3000): cDNA_ID_1824997_gDNA_ID_1620720_Annot_ID_49178 3000 nt of promoter + ATG

SEQ ID NO: 4667 - DNA, 3000 bp, Unknown; identical to SEQ ID NO: 4655
  misc_feature (1)..( 3000): cDNA_ID_2051633_gDNA_ID_1620720_Annot_ID_49180 3000 nt of promoter + ATG

SEQ ID NO: 4668 - DNA, 3000 bp, Unknown
  misc_feature (1)..( 3000): cDNA_ID_1824985_gDNA_ID_1620720_Annot_ID_49182 3000 nt of promoter + ATG
gacttgaccatttattctttccctcttcttagggatcaaattgatgtcaacaagatttcaatctgaaacagggttttgaagtcttcttttggttcatttttgttcaaaactgaggattaggatgaagagtgctatcaaatccatagcaaatctacagcaaatccatcaattatagggccaattgctatatatttatcaaccaacacataatggcagagaagataataataaaaattgttcaagtctcactaaagtgtttcttacatgacataatgcaaaagcttataataaggtttctctatttttctgtatctactgtttgatctctttggtttcaattttagggttttgacttcaaaaactaattattctctcacgttacccaacgatacggatccaggaaactatttagaattagatcttgagaaatggacaataagattttaaaattaacaacctaatcatcatgtatgtgtacttggagctttagaaaaggaataatataagggcccctaatattaattattatttatttttatttttgacgccaacttatcagatttttttttttatgcagaagtaaaaaaaatacactaaattttgtttgcaagagccaagatgcttatatttcatgggatgtactgtcttggtgatgtgatatagtaatatagtgatatagatccagaaaactgttaaatatttagatgctttgataccatatcaggaatcttcaatcttctgtaacaaactcttgagagagagagtgaaagagaaagaagaaaaagatagaaacaaaataatcgtctatttgtaaatgtgtacaatgtactgtatatatactctatcacattttatactatagagtaaaatatactcatgataatattatagttaatttagtatttagatcttgagaaatgaaatactatataaaaatataaaattcgagggatttagtattaaatttttatggagatttgtaaaacactgaatttggtttgcaggcgccaagatgcttctgtcatggggcgtagtaatggaggaaaagagggagagatctagttgtaagtgaactggcttttatttctattttagtacttagattataatatcccaagtatattttgtttacctagcttaccatttctatgaagttcaacaattccgacaaatacttgacttaaaatatcaactttacataaaagagtttcatgtttgattgattatttttacctaatcgattatatattaagagtagcacgtttgcacaagacacaagacacatgagttccaggaaagtaaaaattatcttagtgtcgatcacttgtagtataatgtttgaatattctgattgaataaaatataaacttttgtgattttgtttgttcataatcgaacgtctttgacagtcatggtgattcacacatttaatcaaactgtgtataaaagatgagagcttttagaagagaacgccaatggttaaattcaaatcatactttaatcttttttttattgttgaatttacaattttcttgaaaaaaagaaaattcgtggaaataattaatgtcgtaaccaataccatataatataccataaaatcgtagcgagatctttggttggtgtcacatttttagtttacaagagaaaagtataaaactaatgggaatatgtattagattatattcaattggacccacaatttgattatggaaagtttcctgtcatcttctgtctatttttgcttatcataagttcgcttatcataagaaatttatgaaaattaatcatgaatgctttccttttattggttcttcaacaacatacatattcagatagtgagtgaaggacactttagtataaattacttgactatatatataagtttattactcagtaataatagcagaatttgaatacaagctttctatatacaaatgtttttacaattggccaacaacattttgatgcgcgtcataaggtttaatatttttatatgatgttagaaaatatttttttgaacagttttgatttttaattggtttcatattcgcataccacacctgatacataaattcatgtcaaatttggatgcattttgaaaaatgtatttatggagaaactaatatttttttaaaaataaaaccaagggaaacaagatgagtaaacatatatcaaaacaaaataaaaattgaggcgattttttttgtttctaagaagaaaccctaaaaatacacttaataatataaactcaaaaacctgatatattcaatagacgaataccctttttgtctccggcccgcaacatttttatattcattcaaataggacctcaaaatactgtatacgtcaatgagtaactttgaacaacctgtgaaatttgacaaatataaaacaatctataatataattaattagttttgacacccaaatgctgtgagaaaaaaggaatatttttagtgtgaaagttgagtagtattgcctttcacacgtgcaaattacttcatatgtgtgtccatctctatatatacatgtacatatatgcatgtgcattccactgttttcacacacaaatctctcttctctctctctcttctcctagaagctggtgagttttatttctttgtgattcaaaaaacataaatctcaacccttactaaatgtttcttgatcttgggtttttactatacgtcaaatcttgtatttgaaacccaagatgatctgctaatttatcttttttcttggttaaatacagtttcttgtttataaatcatacactaatattctttttaccattttcagattttcagaggcaacagcaatgagtatcttatccacaagatggttttctgagcaggtatatatgcgcataaacacatacactcatgtatatatgttgtcatctgggactgtttttcattgttttttgttcttttttcttttgggtgtgatgttatattttaggaaatagaagaaaatagcataattcaacagtttcacatg

SEQ ID NO: 4669 - DNA, 3000 bp, Unknown
  misc_feature (1)..( 3000): cDNA_ID_1824981_gDNA_ID_1620720_Annot_ID_49183 3000 nt of promoter + ATG
tagagcttaccattcattgtttatgcacaacatgtaagtaaaatcattattgactccttgtatgtcaatccattattgtgggtgaaagaaaacaacaaattagtaactggggagggtgtcaggtgtatccgaccaactcaggaggagcttgagagctttggtactccggattttactatatacaatgctgggcagtttccatgtaatcgttacactcattacatgacttcgtccactagcgtagaccttaatctggctaggagggaaatggttatacttggtactcagtatgctggggaaatgaagaagggtcttttcagtgtgatgcattaccttatgcctaagcgtcgtattctctcccttcattctggatgcaatatgggaaaagatggagatgttgctctcttctttggactttcaggtatagtagagacagtaccaactatggtgttgggtgatgatggaaggaacgataaatcaaatgatacaatacaattactgctgaactgacttgagaactgcttgcctctttgttgagtttagcgggtgaattgagattgatgattgtgttttttgttttctatgaatgatgattttaggtaccgggaagacaacgctgtctactgatcacaacaggtatcttattggagatgatgagcattgttggactgagactggtgtttcgaacattgagggtgggtgctatgctaagtgtgttgatctttcgagggagaaggagcctgatatctggaacgctatcaagtttggaacaggtagaaagacagtacgttggaattgtttttgagaaaaaaacataaagcagtgatataacaataagattctgatcttgttgcagttttggaaaatgttgtgtttgatgagcacaccagagaagtggattactctgataaatctgttacaggtaaaacaattgttatttctttcattctcttcgtcctcacaattaacagaatgatcattttcgattctctttggttgcagagaacacacgtgctgcctacccaattgagttcattccaaatgcgaaaataccttgtgttggtccacacccgacaaatgtgatacttctggcttgtgatgcctttggtgttctcccacctgtgagcaagctgaatctggcacaaaccatgtaccacttcatcagtggttacactgctctggtaaggccaaagtaaaagtctttattttgcacatcgtcttcataaatttcaaaagcataaccaaagatgtgcaacatatataggttgctggcacagaggatggtatcaaggagccaacagcaacattctcagcttgctttggtgcagctttcataatgttgcatcccacaaagtatgcagctatgttagctgagaagatgaagtcacaaggtgctactggttggctcgtcaacactggttggtctggtggcaggtatatatgtccttctatggaaatcgatacaacaaaacgctgccttgtaacacatgtttgtaggctattaacatgatctgtaatgttttatttcctgcagttatggtgttggaaacagaatcaagctggcatacactagaaagatcatcgatgcaatccattcgggcagtctcttgaaggcaaactacaagaaaaccgaaatctttggatttgaaatcccaactgagatcgaagggataccttcagagatcttggaccccgtcaactccgtaagtttctgcaaatctgtataatgtaattgcttaagtgatgatgaacaattttttgttgatttgggtttaatgaaaatgcagtggtctgataagaaggcacacaaagatactctggtgaaactgggaggtctgttcaagaagaacttcgaggtttttgctaaccataagattggtgtggatggtaagcttacggaggagattctcgctgctggtcctatcttttagaaaaaccaaactctgaatgatgttgtcgaaaagaaagaaagatctactattattaagaagaataaaatgagactttgtgtttttctttgctgtgataatctctctgaataatagagagaatttaatgttccaaatgtggtgcgatatggataatgatgatgactatatgtaatttattactatccatcgtcatatatttttgttgggcctttgccaacatttacatgatagaaccaagtacgaataatataaattctggtccaatctgatgatgattttcaaaatggatagaaaactttataactttattcattacaagtaaagtatagtaaattataatttatggtcgttgacaaaaagtaaattaatatatggttaatacataactccttttagcgactgaacacaaacatacatctgtatatattactttaattatttctttcgacttttgtgaaaacgaaaaaattgtagtgactgaaaaaaggaaatttgtaaaaaaaaagaaaggaaaactctatttgcgtataaaaagcgtctcagtgcctcaacgtctttttgtatttcttgatctctccattaaagtcattcccaagcaaaagcttcagagttcagactgaaaccagttttcgcttcattcgcgtgactacgtttctcaaacgtaagttatcttttctccaaatgtgtttctgtcgatttcaatgttacttcctcttaacgagggatttagtttagagattttgactaacttgaatcgtaagttaacttcaccttttagactaattcataaagattttagagttttggtttgggaattggcattagagcctgattctgtgtaagaaacagaacccgaaccctatttagttatggtaacgttctgtgaacttgattgatatgacgcagaagccctaattttgtggttgttcttgaagcagatcaatttctttttacagttgcttcttgtagatattttgacgtgttttgatgtgaatacacacatattgaattaaagatctttaaattgcaggcactaattactacgacaagttgtcttccaagaaatatg

SEQ ID NO: 4670 - DNA, 3000 bp, Unknown; identical to SEQ ID NO: 4654
  misc_feature (1)..( 3000): cDNA_ID_2990556_gDNA_ID_1620720_Annot_ID_49184 3000 nt of promoter + ATG

SEQ ID NO: 4671 - DNA, 3000 bp, Unknown; identical to SEQ ID NO: 3820
  misc_feature (1)..( 3000): cDNA_ID_2107732_gDNA_ID_1620721_Annot_ID_49186 3000 nt of promoter + ATG

SEQ ID NO: 4672 - DNA, 3000 bp, Unknown; identical to SEQ ID NO: 3818
  misc_feature (1)..( 3000): cDNA_ID_1825089_gDNA_ID_1620721_Annot_ID_49189 3000 nt of promoter + ATG

SEQ ID NO: 4673 - DNA, 3000 bp, Unknown
  misc_feature (1)..( 3000): cDNA_ID_3092031_gDNA_ID_1620721_Annot_ID_49194 3000 nt of promoter + ATG
atggcatcaacgtttcgattactctttcagggaactccatttttcttgcatttgctttttttgaggtagagtctgtgctcctatatgattccatggattcgtcgtatactttctcaactgagaatgtttgacttagagaatcttccatttttttttttgtctttctcttttcagtgttactatcattttagatcttttttttgtttttccttctctggttgactgtgtttgaggtaatgctcaaaacgtgattctttgtgctcattatcttttcatattctagtttctggaatctttctgggtattaagcatttgatgattttaaaattgtatatttgttgattttattgagttgacaccaggtttcttgttgacatatgcccaattcattctgatcgttgatgatgattgattcttgtatccgttcaatgtaggttatgtttggatgatagatacattttgactttctcatacaatgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacgtacttactttatcgctgtgttgcttaacatgttttataatttggttctagtttttttctatcactaaatgaaagcctcttgtgcagctaatggaacatctgagaggcaaaaatctacaagctgttgcttacactctaccacatcttcctgtacacaaaataatgatttttgttgcttccgctccattccaggtgtgactttgtaactttctgttttgcctcatacatatttgttcaatctactaaacaaacgctatatgcttgtttcttggtctcgcatcatgtcttactgggtttcctttcatgaagttaaaacgatgtgtgatatatagtaaaatctagttgggagaatgtgtagatgttgttatagagttctagcctctgttatcttacctcatgatgtatttgtcaactaggggaatccaattcgaagttatggaatgagtaaaatagttacaagatttgccaccttgcaataactggttgaatcgaatatctcttgtttcgttgtggcatattaccattaatttgcatcaattgggctggcaactagggaagcaggttttctccattgatggctgtgtctagtggctgaatgctaaaaacagttactagttttgttatctaccaagacctcgttaagcatagttacaagttttgtactattagatccagacctgagttatgttttctctttggaaaatctctgaatcctaatattcatgtagtccagagcaaacagtcgtgtatggatcttatcagcctttgcttctttatttttataggaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctccggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtaggtggaaaggttaggcattgtgcatacttgcgtctcttattttttttttcggttctttttcctttttcgagaaaatgaatcttagtatgtactaagaacggtggagatcaagattttcaggttctttctggctttctgctttcgtttttgaatgtcttgattctgttttttctttcaacatttggtgtaaaggtaaatagatagttgttgaagaatttaccgcgggaatagctctctactttttttttttttttattctccgtaattggtaactaacccgataattacaaacgccacgtataaggatgtgttcactagaagaattagccaattttaacacaaatgataaatagtataaacaaattttaaatttataaatagacgcaacatacattattatttttaagatacagttaaaataaaattgttagcaattatgcttattctgaaattttgggtttgaatataaataagaaatagagttttatcctaataagatttatataaataaacatataaagtcaaagtcatactttatcctctcagaggccgtctctcgggttttgctggtcttccttgctcctctcgcttttgaatggagatgtgagctttcttcattcaaagagcaaaactatctaattccatggcgttctccctcctctctccaattcctacctctgcctctctttttttcactctctccgccattaccgcttctaataatgcttcctcctcctctctctcccgtctttactctttatatcaccccaaaggaaccttacgaaccagaaccgcgacctcgtttttcggagcttctgggaacttgaggattgtttccatg

SEQ ID NO: 4674 - DNA, 3000 bp, Unknown
  misc_feature (1)..( 3000): cDNA_ID_1825073_gDNA_ID_1620721_Annot_ID_49195 3000 nt of promoter + ATG
gtacttatctggttgtttagtgcttacatgtcctagaattcgcttgtattctctatcttattggtaggttgttttgttgtgcagctaatggaacaaccgacagaggaagatttaagggctgctgcttgcattctaatgcatcaccctgtgaaaggaataatgattgttgctttcactgcactcccggtgagagtttgtgagtttgttattcttactactgaatttgcttatacataacttcacttcacatagtctcttactggggtttgattttgtggtatctttgaagtgaaaagagattttgggagatgttgtcaaatagttgaaagaatatggagatggttcttacatatttgtagcctctagtatcttgcataatgatctttgtaacccaatcaggaacaatatttgactaaagatgtctttgtaccccaatcaggattcatacttaagtagctacttacgttaatgagctggaaactatgaaggctgtagtattatcccccaatgatggcttgtgttatggcagaaaagttttgtgtgggtgttctgagagttggcttcttattttcatttatgcaggaactgagaatggggaaggaaatcatgctacaaatgagcaaatggcagagtccagtacttctctgcctcttgtgacagttcctgcttcatcatatagcaaagagagtgcagtcgtatggggatcttctcctgaccacctggaagtgccgatgaaagcataccatcaacattcgacctgctcagattctccttgcgtatctgaatccggctcagacatcttcagcaagcgagaagtaatacagaaactgaggcaacagctgaagagacgtgacgacatgatagttgaaatgcaggaacagattctagagctgcaaaactcgctaaacgcccagatgggacactctagccatatccaaacacagctagacgcaacaaacagggacctgtttgaatcagaaagagaagtccagagactgagaaaggcaatcgctgatcactgcgtgggacacacaggtagcaatggttggagtggcgatgtgaacagcgaaaacaactacgagtcaccagaaaatggaataagggatggagaaagaatagagatgttgagaaaagaagtgggtgagcttaaagaagtgatagatgggaaagagtatctacttaggagctataaggagcagaaaacagagcttttgcagaaggtaaaagagttgcagcagagactggactcgcagctcccaaacattttgtaggtgaagaaggttaggcattgtgcattcttaccactctcttttgtttccccgagtaaaaaatatgaatctttgttcaaaaatatctcaatttctccggggaaacttatcaactgactacattgttttgggtgtcaattatgattttatccaaattgtttttttctcttggtgaagtggatattcgaaagttgcaaactcatacaatatcgtgtctcaaggcttaaattgtagaattgcagttgaagttttttacaagaaagttggttacttgttcttaaggaaagagaaagaagggttgctaaaatttaatttggcacttatttcagtcaggttttgatattcataaggaagaaaatcgttagagaaggaaggaccaaatatttaattttgtagttgtcacatagtgaagaagacaaaagaaaaatgtatcatcacattagctggtagtgacttaaaatagaaaaaaaaaaataatcaacagaaagtgcaaacatttacacatggataaagatgtcaaatgttcattcatactcaaattatctattaaatttcattactaaaaaattgaaatcgtaaagaagaaaagaaagaagaaaaaaacatatgagctgagtttgttaaccaccgtgagcgtcatccatgggacgtggttgacgcgtgcgtgattttattttaataaatgaattaacagtggaaggaaaaaacaacaacggagctgtaactgtgaggcgccgtctctcttcaacctcttcccctccactttgcttctctctctcctccccgggggttttacagtcatatcatcgtcggagactctgcgattcttcacggaatcgtatttctctctcagcgatttttttcgattctcgaagctgcaaggaccacccatcaaacattgaaactcaagcgggagaaattttctggctcgggagggaaactatggagccctaatgcccattttctgctgtctatgaggttttttaaagagtcctttatactctccctgtttttgggtgcttcgctcgctcactgatttttgattcgtcggaaaatctattttcgagctcggatttatgtaattccttattctccttctgattgcgattgttgtgttcattaagggttgttgggatatcgattaacggcccctatcgaaaaaaataagggttgttattattttcatttcgcttcatgttcaaggcaagtatctatctcttcttcttgcttttgtagttttagaatctaaatcccatggcatcaacgtttcgattactctttcagggaactccatttttcttgcatttgctttttttgaggtagagtctgtgctcctatatgattccatggattcgtcgtatactttctcaactgagaatgtttgacttagagaatcttccatttttttttttgtctttctcttttcagtgttactatcattttagatcttttttttgtttttccttctctggttgactgtgtttgaggtaatgctcaaaacgtgattctttgtgctcattatcttttcatattctagtttctggaatctttctgggtattaagcatttgatgattttaaaattgtatatttgttgattttattgagttgacaccaggtttcttgttgacatatgcccaattcattctgatcgttgatgatgattgattcttgtatccgttcaatgtaggttatgtttggatgatagatacattttgactttctcatacaatg

SEQ ID NO: 4675 - DNA, 3000 bp, Unknown
  misc_feature (1)..( 3000): cDNA_ID_1825069_gDNA_ID_1620721_Annot_ID_49196 3000 nt of promoter + ATG
agtaatggtttattagatgaaaatatctcctatatctcttgtcaaatgttttgtctattgtaagtttgtaactgtgaactagtatttctaacttctctatttttcgtttgtcttatctgcagtctctacaaagtgtcgttttcaaggaggtattctcttgtccatgttttcttatacactttacaataaattcttgcagcgttatcatcatttgtttactttttacgacatggaatagtgattagcttgtttacaggcgggcacgaaagatcctgtcacgatgatgatcagcatattcttgcagttctttgatataggagtagatgcagcattgctctcacaggtttgtgtgactttggatttttgttgtatggagtagtagattcaaagaattgcaagcaggcttgttaatattctttctccttacaacatatcgtccagatgaaaagctataggattattgtttctcaattaataactctagtttcatagggcctttgatgggatgtgaattttctcatttcttagaccttgttacactagatggctttttatcttgatgcttatatggttctcaacttaccttatgtaggtctgatgctctctctttgtttattattttcagtatatttccctgttatttattgggatgttgatcgtgatatcagtgaggggattcttgacgaatctgatgaaggtgagttctgatttcagcttttaaatttctcccattcgtctttatacgatcttgtatgttatccacttgttttggagctatatagtgtcaatggaaaacttgctctggcattatcatgtttaaatattagacggaggctttcacttcttttagctggtgctaactttccttgtgacagtcacatagttacttaagcaaagtatatatgatgtatatcctaagagtggaagatgtagagtgattgaattaacgtatttgttgcagtagcattacagaacaactcaatgtaatttcagtctgatcataaaaacagaggctactttcttggttggcattagtatagtgattttacatctaagtaattgtaactcgcaatatactgaaagcttttgttttgaatactgttaaacgttttggtgattgaattggggagttttttttcaattcgcttgtacagttcttctttgcagtgtcgagggttggaagtggatcttcaagcaatgttgtgctcttcctatcagaaatcatgggaatgtactttttgtcttccattcttcttataagaaaaagcttgagaaatgagtacaggtacgtaagataatactataacaataattacaaccgttcttctgttgaaaagatgaaatgtggattataatcgaatggtgtttttgttggcacagagggataataacagatgtattaggcggagatattcagtttgatttctatcatcgatggtttgatgcaatattcgtggctagcgcttttctttctctgcttctgctttctgcgcactacacatctcgtcaaattgataagcacccaatagactaagcaagcatctgtgagttcccttgcaaatgaggtggttgattaaattttgatctagatgaaaaacttgaaacaatgaccactacttagcgttgacttatgtacattttcttgctttgaaaggatcagtcttgagttgttgtttttttttcttcctcaggtgtgtgtgattagttgtaaagagaatgagactttggggttttaccattcaataatatatatctgatataaaattcaatagatctctaccttatttatatgcatacattatttttcatgcagtactttaagaaacacatacacacacaaaaaagaaaggaaaagaaaaagaaaaagagtagtggccacaatgatttaatgaggcattaaccgaaaatgactgttttttttttttggttgattcggtgtgagagattattgtggtagagaaggagttggtacgtgtgttaggttcaatatctgcttcggttgattatatgcatgtaattgacttcaatgtcacattgtatccagtccaaggattttcaattccaaaatacattcatagaaaacaacgaagataaatctaaagaaatatatatatagaataatttacaacttcttagtgcagtagtagtgcataggttgagaacaaatttacattctctaggaatgagataacctctgtcatctgatcaccaagagtcactgccgccaataaagagaaatgtatccttcgttttgtcgtaatcttgatcctatattaatctcatttcttaatcgttactttttatttgtgaaataggttaaatcaactgttacttacattatacaaaatcatgaaggaattattcagtttaatatcaatcaaaaggcctaagtagtaatctcgattccacattattttatttcgccttttttttccgccaatttcgattcgacattcttgagaaataaaatatctagtaacagtactatacactatgaaaataagataatttgggacgcttcacggcgggtgaagaaaaaaaaaaagaagcttcaacggcctttgagtagttgtttctgcgccgcgctgtctctctaaaacagcctggtaagcttcttcgttttcccttctagagaccattgattatcataattgttctacaaactttagctttttcattagtctctcgatctacttgatcgttgtcacttagcaaccctaatttctgggagaatcgtccctgcagtattacccatcccgatgaggtttattttccgatttctgtttcctttttatcgtcacttttggtgttttgaatcgttctccgattttctttttgtcgttgagcctctgtgttcttcaattgtttgccatttttccttcgcatagggtttgattacgattaaaggcctctgttctgttactaaacttgagactgtggcttcctcttcagtgttaaggttggatgatagaagacattttttgaccttctcttacaatg

SEQ ID NO: 4676 - DNA, 3000 bp, Unknown
  misc_feature (1)..( 3000): cDNA_ID_1825061_gDNA_ID_1620721_Annot_ID_49198 3000 nt of promoter + ATG
atccaaggcattagttaacaaaattttttacatgcaatattccagaactcctcttctgtctccagtttatctcttaggcctgcatgtcagtttagtttagttcctatttatacgtggctgttgagacgaaaatgcattttttttataagattttcaagtctctaagacccttgtgtatccatcaacaagccttaacacgcctttgataaaccctccagccaatcatgcacaaacatgatttgtgacccgttaaggctttttcattttaaatagctaatgtttcagtatgtcatattgtcatgtgcttttgatctcatgttatcttccattttttcttccgggttcaaatttattgcacttgtcttatgcacagatcccgctgctagtgctgatctagctgtagttctaatgcaagaaggactggcacaaatcttccttgtgggcagaaggtactgattgcagtgacaaggtccattgtctgtgaaatttgttatttcctagtttttgttttgacaacatgtagttctcttatttcacctgggtggttttggctgaacaagtatgaaacgggtcaaagaaattcatccaattctgttcttgtttactttattgtcttgtttggcagtgtgacaagtagccgtgcacgaatagaaacatccattcctaggaagcatggacctgcaattgctggttacgagtctgtatgttccttcactgtttcgtcatatatgtgcccaaaattcgtttacatatttatcctttcaatttatgtcattttttgcttctctgtaggctttgaagaaattttttgagaatgttctgcaggtttgtcttttctcagaatgttgatgttttctttttgttgttttctaaaacataccacaaaaaagcggaaagagtttcacatatctaaaagtctattgcaatatcacaggcctttgtgaaacatgttgacttcagtgtcgttcgctgtgcagtagttgcaagtcccggcttcacaaaggttttttttttggtcactcaaagactttctaaatttacgtggtttattatttttcaaattgcagctggaccaggcttacaaatttcccatacatatatgacacagaccgtttgattgtttcatgtctccaggatcagtttcatcgccacttattgttggaagcagaaagaagacaactgagacctattattgagaataaatcacgtataatattggtgcacacaaactctggatataggtagtatttctgtgaaattgttcatgaagcctgtcaaaattttgttctgccatgctaaaatacattgagtgctcagagtcaaatgatataacatgcaatttatttattaaagttgtggaacactgatttgagatttatactgtcgatctgagttgatatctgctggataaacctaataatttctttagcaggaaacatacactttttttttaatttttgtataacaatgtccgaattgaccaggttacctactttagtaatgttatgattcatgttcatggtggctatcagtgttaacggttcactctactttgtttgtatttttttttgcttattcacttctaaactaaacagcctgagattctctgctcatgcaaattttcttcgatttctgacataatattttggtgcacagacatagcctgggtgaggttctccatgcccccaacgtgatgaatatgataaaagatacaaaagcagcaaaagaggtgatttagaatgttgcctatatttttgaattgctcattcgaaactgggttagcttgaaagtcacaattcacacgaactcaaataagtcctcactgttttgtggcttttgatctctatcatctgagttgtgctcttgaaatgtacctttgtcatctacctaactgatgtgaatttgcctatgtaggtcaaagctctcaatgattttcacaacatgctttcaactgtaggtcaaagctctcagcgattcttaatattctcatcaaattttaagaatctctcaatatgtgttgatatctttttgatttttaatccaggaaccagatcgggcatgctatggaccaaaacacgtggaagttgcaaatgaacgaatggcaattcaaacgcttctcataacggacgagcttttcaggtttagtaacggaagggaatatcccatttcaatgcgtttttttttttggtagttttaagaggcaaacgtgattgagactgacattacaaatatataaatttggtccaggaattctgacgtgaaaacaaggaagaagtatgtgaatttggtggagtcggtaaaagattcgggaggagatgcttttatattttcggcgatgcatgtgtcaggagaacgttagtgttgcttctttcttatcttagtgaatttgtgatgtgattatgttttttaatgtgctaaataagtgttgatgaactttgcagaattggcacagctgactggaatagcagctcttctcaggttccctttaccagaactcgaagacattgagatgtaaaaaaatcttcggcttatagaaaacaatacaacaaatcatacacatctctcataatttatagtttatttgtactcagtgtcataaaaagagatttgtaactcattacaaattataagataaccattcgttgctgttttgttgttaagcaatttttctacataaaattattctgttagaattttcagttccatacttaagtgaaagaaatttccgtaattgcttacaaaatttgctgttgtaagaatttggagtaaagtcaaacaacttaagtcaaaagtcaaaactccataataaagttttaccaccaaaaataataagataccgaccaatcgaaaagtgaattaaacaaaaaccctcgcaaattaaataaaagaacaaaaaataagaaaaaccctattcgctgtcttgctagttgctgctacaactagagcagcctctgtctctgcttgaggaaggaagagagatcaatcaacaaacaaactatg

SEQ ID NO: 4677 - DNA, 3000 bp, Unknown
  misc_feature (1)..( 3000): cDNA_ID_1825054_gDNA_ID_1620721_Annot_ID_49200 3000 nt of promoter + ATG
ccgtcgtaagtcgtgtaactagattgtgtcaagaagggcctttaataggccttcaattcagaatgttctaaaaccgaattaaagtactgttcggcgtccactagattttgtaggtactattgcatcatcatcatcttatatcagttcaatgtgtgtcttgttttttcttttttagtctattacatcatctgatcttattctagcagccttttgaaaatatagagaaaaatcattcaatgtttctaaaaccaaatctatacacaaaacataaagtcttttggatcattgaacatttgatcggattgcggattaatagattagagcttaaattttgtataattttataccaatcaaaattaatatagagtcatgtcatgctatttgtataatttatgtacaacaattattatataaaacgacttgaacaattctgtgataaagaaaaaaaaaaaaaaaacgacttgaacaattcaacatgctatagatagtttatacgtaagctaataagcctgtttgatactgtatatgacatacgtgtagctgatatgatcaaactagacaaaattttctaatttctcccgtagatatatatttttagtttacttgggcattccatttctcatatgtttctgcaagttagcacacataatggtgacttggtgagttgctttttttctctctctttttcaatatgatatgctttcttcgatttttttattttttttaaacaatatatcatctaatcatggttttttcgtaatcgtggtttttctaattgtagaaatctagtctttttttttcgtttattttgtttttattagttcatcacaaataaacactgattggcaagaaggaaaaaaagaagatggttcgggagaagatgagaaaacacgagaaaacgcacaaaggttaacaaatagtaaaatagatagatagaaaacaaaacgagtcgagaaacttcgtatcaaatcttcaaccttcaagacctctccttttgtcacttagagccttctcatcctcacctacatatatacactcacttctacaattgtagtagatactcaacaaactcagaactagaattttctaatcttcactcagcgatatttttggctcatactcgaaacaaatggcttctacactctcatttgctgcatcggctctatgttcacctcttgctccatctccttctgtctcatcgaagtccgctacaccgttctcggtttcgttcccacggaagatccctagccggatcagggctcaagaccagagagaaaactccattgatgttgttcagcaaggacaacaaaaagggaaccaaggatcaagtgtcgaaaaaagacctcaacaacgcttaaccatggacgtctctcctttcggtacgttcaactaactaaacggacttcacttgtataaataaaaactacatcctctgcttattacttaaaacattgctctgtttttatgaactcagcttttgtcaatcgaaaatctcttcctctgctttgaactgaaacaatgttctgttttaatctaaccacaggattgttggatcctttgtcaccaatgaggacgatgcgacaaatgttagatactatggacaggatgttcgaggacactatgcctgtctcaggaagaaacagaggaggaagtggagtgtcagagattcgtgcaccgtgggacatcaaagaggaagaacacgagatcaagatgcgtttcgacatgcctggtctctctaaagaagacgtcaaaatctctgtagaagataacgtacttgtgatcaaaggagagcagaagaaggaagacagtgatgattcttggtctggaagaagcgttagctcatatggaacacgacttcagctcccagacaactgtgagaaagacaagatcaaagctgagctcaagaacggagtcctctttatcactatccctaagaccaaagtcgaacgcaaagtcatcgatgtccagattcagtaggactcgatcaacattatcctcttgtttaatgtttcttggaggtactgtttgttgtacataagcatatgtttctctttatagcttaaagtgtgtgatgcaagtaaaaacaacaaagagagattttagagaagtcttttccacaaaagaaatgaaataatggcactaatatttggatatgtaattgctgaggagacgacactaaataatctgtgagtattttcttaaaatacaccaatcgagaaaaatctgttttgttttccaagtaaacgtgatctgataggagtaacaaccaatcagagaaaaatcttaaatcaaaaattcggttccattattttataattaaattagaaggtaatagtcaaaagaacatagaaacagtccttgacacatgttgaatccaatgaagaaatacgtcttcacacaaagccttaaaaccaaaactcatagttagtcgaacaactattcaaagccccgccatagacatgaatgtgacgtagagtaagagacaggaatattaagacacgtaatttgaagtttctacgaaaactccaaatgatgtaatagtctagatttaaaagtgttgctaaattaacttattcgggtgaatgaatgtccaaacatgattttggaatcgttcataagatatgctttggggacattcacaaacatatctccccccgatatgttcaatacctaaatgtattttgcatactttactgggctgagtcatgtctcattatttgggccaataaattgggatttagcattattacccatattgatataaaggtcttgaaaaggccttaactaattgtaaaccctaaaacactctcctctctaatcacgatttattcaaaaataaaatcaaatatttctaattcaaaaatgagatcaaatcctctgccaccgctgcttggggtgcttgtgtaggaacaacaacggtcatttgcgaatttcgaacaactctttcaataaaagcaacaaaaagatcgaaactttacagtcgtaggaaggaaaaaaatg

SEQ ID NO: 4678 - DNA, 3000 bp, Unknown
  misc_feature (1)..( 3000): cDNA_ID_1825050_gDNA_ID_1620721_Annot_ID_49201 3000 nt of promoter + ATG
ttgacgttgcaagaaccttctccaaatctaactgtgataatggcctagggtcctgcaaacgtgacaaactcataacatcagtaccttgaaactagtggatgcaacactgaacatttcagtggaccatgttttctttttaaacttaccaaacatggtttcccctttctctctgcatctaggatttctctgatagggaagtaagctgctttcttgcatagctcaaaaatgtctgatccggtatagccttcgcataagcgagctatgtgatcaaagtcaatatcaggttccaccctctctcctttcagagtcactttcaatatctcagctctctcccggcgatcaggtattccaatctcaaaggcctgaggaagacgccttaatattgcttcatcaagctctgacggtctgttagttgcagcaagaaccataacccttgcatgcgctacaaaagcaaccatttctattcataagaaacccacatactccaggttacactagtctgcatggcaaagtaagccgaacagtgaagaattcaacttacgatcagtagagaatccatcccataaagccataaactcagtcttcatgttggccatagcttcatgatctgttgaacggcgctgaccaagaaagctctcaacctcatcaataaaaatgatagcaggttggagtttgtaggccaagctaaacacagcagaaactgagagaacgaaacagaacagagcagctcatagattagaaacaccatcaacagaccaaaaaaagtgtaattgatataataaccacacacaaaaaacaaaaaactgccaacaaagttgcacaatgtgaagctgataaaagcacaggaagaaaacacgacgagcatgaagacaggcctactcaaagtgtgttcctttatcacacacaaaataataatatgcacttaccaagcttctgagcatctccaaaccacttgctcatcaggtttgaaaccctaacattaatgaaaacagctcctgactctttggcaatagccttagcaagcatagtctttccagtaccaggaggtccatagagcaagacacctttttgaggtccaagaagcttcccgtaagcaaaaagctcaggtcttttcagtggtaaaatcacaagctcatacaaagcctgcttgatggtctccaaccctccaatagaaccaaactccacatcaatgtggtctggatttatcacatcacatgcaattacatcctattcacaaaattagaaactagtgagcaatttctcgagctcatttcatgagtttgcgcaaaaagacgattggaactcaaaagtatccaaatttcaatattaaacagagagaccaatacaaattggttatcgaaaccacatatcgcattctcaggtagctaccaaccagtgaggattctaagatgcttaattcatagtagattacctcgtatggattggtctgaacaagaggacgacccaaacgtttagagatttccttcttatgctcgagagcttttttagaagcctcacgattaggatcgagatgacgaagacccgcaaagagaaccaagcagctgaaagcagcgctcgccgcgtaaagtatgagttcttgtaagatctttgtctccgacgaacctcccatgtctcttctaaaaattcaacctttcaattacagagtatctcaaatggataaataaaaccctaagttagtcaagaaattagggttcccagatgaaaaagaggatatgttagcagaagacggaaacaaatttggttgttcttgtggacgacgacagagcttttgccttggtgggggtttctcgaatacttggagatcgaggaaaggagaagctgaaattaccgaaatagccttagctgcaccgtcgtaagtcgtgtaactagattgtgtcaagaagggcctttaataggccttcaattcagaatgttctaaaaccgaattaaagtactgttcggcgtccactagattttgtaggtactattgcatcatcatcatcttatatcagttcaatgtgtgtcttgttttttcttttttagtctattacatcatctgatcttattctagcagccttttgaaaatatagagaaaaatcattcaatgtttctaaaaccaaatctatacacaaaacataaagtcttttggatcattgaacatttgatcggattgcggattaatagattagagcttaaattttgtataattttataccaatcaaaattaatatagagtcatgtcatgctatttgtataatttatgtacaacaattattatataaaacgacttgaacaattctgtgataaagaaaaaaaaaaaaaaaacgacttgaacaattcaacatgctatagatagtttatacgtaagctaataagcctgtttgatactgtatatgacatacgtgtagctgatatgatcaaactagacaaaattttctaatttctcccgtagatatatatttttagtttacttgggcattccatttctcatatgtttctgcaagttagcacacataatggtgacttggtgagttgctttttttctctctctttttcaatatgatatgctttcttcgatttttttattttttttaaacaatatatcatctaatcatggttttttcgtaatcgtggtttttctaattgtagaaatctagtctttttttttcgtttattttgtttttattagttcatcacaaataaacactgattggcaagaaggaaaaaaagaagatggttcgggagaagatgagaaaacacgagaaaacgcacaaaggttaacaaatagtaaaatagatagatagaaaacaaaacgagtcgagaaacttcgtatcaaatcttcaaccttcaagacctctccttttgtcacttagagccttctcatcctcacctacatatatacactcacttctacaattgtagtagatactcaacaaactcagaactagaattttctaatcttcactcagcgatatttttggctcatactcgaaacaaatg

SEQ ID NO: 4679 - DNA, 3000 bp, Unknown
  misc_feature (1)..( 3000): cDNA_ID_1383728_gDNA_ID_1620721_Annot_ID_49202 3000 nt of promoter + ATG
atatcaatatgggtaataatgctaaatcccaatttattggcccaaataatgagacatgactcagcccagtaaagtatgcaaaatacatttaggtattgaacatatcggggggagatatgtttgtgaatgtccccaaagcatatcttatgaacgattccaaaatcatgtttggacattcattcacccgaataagttaatttagcaacacttttaaatctagactattacatcatttggagttttcgtagaaacttcaaattacgtgtcttaatattcctgtctcttactctacgtcacattcatgtctatggcggggctttgaatagttgttcgactaactatgagttttggttttaaggctttgtgtgaagacgtatttcttcattggattcaacatgtgtcaaggactgtttctatgttcttttgactattaccttctaatttaattataaaataatggaaccgaatttttgatttaagatttttctctgattggttgttactcctatcagatcacgtttacttggaaaacaaaacagatttttctcgattggtgtattttaagaaaatactcacagattatttagtgtcgtctcctcagcaattacatatccaaatattagtgccattatttcatttcttttgtggaaaagacttctctaaaatctctctttgttgtttttacttgcatcacacactttaagctataaagagaaacatatgcttatgtacaacaaacagtacctccaagaaacattaaacaagaggataatgttgatcgagtcctactgaatctggacatcgatgactttgcgttcgactttggtcttagggatagtgataaagaggactccgttcttgagctcagctttgatcttgtctttctcacagttgtctgggagctgaagtcgtgttccatatgagctaacgcttcttccagaccaagaatcatcactgtcttccttcttctgctctcctttgatcacaagtacgttatcttctacagagattttgacgtcttctttagagagaccaggcatgtcgaaacgcatcttgatctcgtgttcttcctctttgatgtcccacggtgcacgaatctctgacactccacttcctcctctgtttcttcctgagacaggcatagtgtcctcgaacatcctgtccatagtatctaacatttgtcgcatcgtcctcattggtgacaaaggatccaacaatcctgtggttagattaaaacagaacattgtttcagttcaaagcagaggaagagattttcgattgacaaaagctgagttcataaaaacagagcaatgttttaagtaataagcagaggatgtagtttttatttatacaagtgaagtccgtttagttagttgaacgtaccgaaaggagagacgtccatggttaagcgttgttgaggtcttttttcgacacttgatccttggttccctttttgttgtccttgctgaacaacatcaatggagttttctctctggtcttgagccctgatccggctagggatcttccgtgggaacgaaaccgagaacggtgtagcggacttcgatgagacagaaggagatggagcaagaggtgaacatagagccgatgcagcaaatgagagtgtagaagccatttgtttcgagtatgagccaaaaatatcgctgagtgaagattagaaaattctagttctgagtttgttgagtatctactacaattgtagaagtgagtgtatatatgtaggtgaggatgagaaggctctaagtgacaaaaggagaggtcttgaaggttgaagatttgatacgaagtttctcgactcgttttgttttctatctatctattttactatttgttaacctttgtgcgttttctcgtgttttctcatcttctcccgaaccatcttctttttttccttcttgccaatcagtgtttatttgtgatgaactaataaaaacaaaataaacgaaaaaaaaagactagatttctacaattagaaaaaccacgattacgaaaaaaccatgattagatgatatattgtttaaaaaaaataaaaaaatcgaagaaagcatatcatattgaaaaagagagagaaaaaaagcaactcaccaagtcaccattatgtgtgctaacttgcagaaacatatgagaaatggaatgcccaagtaaactaaaaatatatatctacgggagaaattagaaaattttgtctagtttgatcatatcagctacacgtatgtcatatacagtatcaaacaggcttattagcttacgtataaactatctatagcatgttgaattgttcaagtcgttttttttttttttttctttatcacagaattgttcaagtcgttttatataataattgttgtacataaattatacaaatagcatgacatgactctatattaattttgattggtataaaattatacaaaatttaagctctaatctattaatccgcaatccgatcaaatgttcaatgatccaaaagactttatgttttgtgtatagatttggttttagaaacattgaatgatttttctctatattttcaaaaggctgctagaataagatcagatgatgtaatagactaaaaaagaaaaaacaagacacacattgaactgatataagatgatgatgatgcaatagtacctacaaaatctagtggacgccgaacagtactttaattcggttttagaacattctgaattgaaggcctattaaaggcccttcttgacacaatctagttacacgacttacgacggtgcagctaaggctatttcggtaatttcagcttctcctttcctcgatctccaagtattcgagaaacccccaccaaggcaaaagctctgtcgtcgtccacaagaacaaccaaatttgtttccgtcttctgctaacatatcctctttttcatctgggaaccctaatttcttgactaacttagggttttatttatccatttgagatactctgtaattgaaaggttgaatttttagaagagac

SEQ ID NO: 4680 - DNA, 3000 bp, Unknown
  misc_feature (1)..( 3000): cDNA_ID_1825043_gDNA_ID_1620721_Annot_ID_49204 3000 nt of promoter + ATG
actattaaattagggagaaatactttgttcaaaagcataatcaaatttagatagaatcgactatgaaaatcaagaaactaaaacaaccaccacatgttcagatttttattccttacttcactttgaatttgacttatccactattgaattatatcatctgaactttatttgtgaccaaggccaaatatagaacataacgtgaccaaatatccgttgagattcttggttttctcttcctcaccattcagaactactatccgagagggtgaagcattacgggtaggccgtattgcgggaagagatcgaagtgatcaactggcgtgtgcttatactcgggggagaggctaagctggaactgttgaaggatcatagtgagaacggtcttggcttcgaccatggcaaagtttttggcaatgcaagctcttggtccgattgagaacgggaggagagcgtttgggtgaatggtggcttgagaaatgccgttttcgaatctcaagggattgaattgttcggcgtcttcgccccatatggccttgtctctgtgcatcttcagtaacggtatgataatgcttgtgccctttgggatctccaagtgtcctaccttcatatcttgtgttgcctctcgggaaattttaatcacgggtccgtacagacgaagcgactccatcaacaccatgttcatctgcaagattaataggtgtaagaaaacccttttcttcacccgcaagtaacacaatgaaaatgaacattaccaatttgagtttagagaaggtgtctgtatctgggattttatctttaccacattcattaaaaacctcttctctgagtttctcttgccaaccttggtgcaagcttagtaacatcgtagtccatgtcaatagaatcgaagtagttccttgccctgcatagtagaaattcttgcattcctctatgatctcatccattctcatctttctctcatactcgttagatttcgcagcagtcaacatgacccctagaagatcgtccccatagccataggtcttacattttgattttagccttgaatctatgattcttttgatcgagttcttcactttcttatggagctcccatagtttaaggttggtaggcgtaggaaggtatcttgaaacacaagaaacaacgatcttcaaatctcaagaatattttagccaaacgaattaactgagagtagcagaagagtactgactaagtgactattatacttactgagttccggggatgaaaacgttagtgagagaactaatataatacttctcaagctctgtttgtgacctacacaattcgattccttcggcataactacttccaaacgcagtagttgctataatgtcagcggtcagtttatggaactctttgcttatctcaatcttgatcaacacttcaccatttcttctctgttttctccactcctcaaatatccgtaaggtgcaatctcccatcggttgtgtcatggcctgacaatttttaagcaagcaatatattagttcttttcaaatcaagctgagaagtatatagttaagagtaaaagaccttgagccgatccatggagaaagcagggttcaagattcgtctatggcgaatccaatcatcaccttggataaaggaaagtcctttaccgaaaagtatgaagacctcaggtcgtttcaccggtataatagtgaaaccgaacttgctcgacaagacctgtttcgctagctcatgatttgagatgtatatagttggttttgttccagtccagaatagaaatgtatctcctaatatatcatagacaacttatgtgtgtgttaagtaatcctcatctatgaaaagaagaaaaaaaaaacaagatggatagaaaacggtaccgtattgagacatccattggtgatactgaggaaacacacgagggaaaatatcattggaattgggatccagaacacaaaggtcagcttctttcttcatcttctttatctcgctgaggtttccgtacaagattttgtactttggtcctgagattccttgtttcttgaatctttttgatagcatcaatggacgcaaaaggaggatccaacaagctttccatatcttggaaacaacgaagagtagaagaacgattgttaagagattgattgtgcttataagttccattaaaagaaggaacacaagtagctcttttttttttctttttttttggtagcaagaacacaagtagttgacttatattttccgatctggataagcaaatctggttatagttaaaaacaaatgtatcttagtaatgtacacgaccaagttctggatcgaaagggaacaacataacatttactattgaacaatgatgtgatcggtaatacctaaaacataattaaagttgttaagaaaattgaacaacataatttaagagctcactaaagggtaagatatttttagatgaaagatagagagataaccattagtaagaagtacaataagattgatgaaaaaaaaaagtacaataagataaggcggtaaaaaaaactgaaaataacagcttttgtacgactaaatcttaccgttttaaaaattggtaaactagcaaatgggagtatgggaccattggttttgtaattgtgaaagaaaattaatcaaaaagaggtaaaccggtataaccgaaaacgtaaaaaccaggttaaccaaatctaagcgatccaatcaaaaactcaagaatggcgcaatgagaaaactaaagaagataagagaaatattttattttatgttttggtcgaaaagaagataagagaagattatgttgtgtcaacttttgatcgtttgaatacaaaagatagaaaatcgggaaaataaaataagcaccacatgttcagattttttcctaacaagaagaaaagaagtcgcagtttcatcgtctttcttccattatcgtgcaattaaattctctcattttcaagaaaatatctgaaaaaacagaaacttaacagaagcagcttcgatcaagagatg

SEQ ID NO: 4681 - DNA, 3000 bp, Unknown
  misc_feature (1)..( 3000): cDNA_ID_3073913_gDNA_ID_1620721_Annot_ID_165835 3000 nt of promoter + ATG
atatttgcagtcgcaggtccactcttcctagtttagtaccccatctaggcacatatatcgaaatagtttaataaattgaatcaaatactgaattgttactgatatatatactctgtatgtttctcgaaaatacttaaatttggtgtcatggagttgataaatttctgtaagaaattgaacgtctacagttcttatggtttagggtttctaagatggatccaaaaaaatgcaggaaccgaactatatacggcttttgagaacttaggttatcctttagacgtgactttcaaataagtatgtcgatgatttgataagacatgtcgttttatgatatgtagggacagggaaataaaagcacaatgtgaattaagactttagattcaaaaagatgcttcatgcttgtagaaatgatgacgattgcgacttgggacaatggacaagtgctatgtcattacatatactgatacacctaacctaatgaccaaataaggactctttacacgggttaactaaacaaatatatcccaactaacatttccaacaaaataagccgataaatgtaacatgtaccgaacaaaacattattaatcatcgtaacttttttttaggtttgaattaatcattataatttaaaaccctaaaaccaacttataagaaccataattgatcagaatccagtttaagtaaataacatagaaaattttgagtcagataaaaaagaggaaattgtatggttagcaacatttacattttacagaatatggatatggtaaatgagaagtgtgtggatcacaagaagtgaatgtgctttttctgctttttaaaggatgaatatgaaaacgaggctaccctcgttattttatttaatgtgaccactgtttagctggaaatcacttggagacgactttaaagtaggctccaaaatctaaagctagacaccagacaaaagactttctatattgtttgtcttaagataattctaaaaatatcagcatcgttactttattgaatgaatacttataagaattgacagtgaaaatgaaactagtgttgaaaagagatgtttggtcattaaaatcaaacaccgaccttaaactaaaaaagaatatcacttcatcggctcctccttttttcacaacttatatacaatatacacacacacaaactgagaattagaatgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcgatgaacgtggtggttggaccgaagattgggaggaaactgataaccggatcgtatgtagtggcagatgtgatgtgcagtaagtgtggtgagacgttgggttggaaatatgttgagacattcgatcttaaacagaggtataaagaaggcatgtttgtcatcgagaagctcaagttgaccaaaagatattgaaacctagtcaagaagaataatactcttggagggttaagctaataaataaatgaaggaaacttgaggattgtatatgtatatataacctttgttgtataaatgtcatcactatattggttgttctctataaagggatttgaaaacaaagtaaaaaagatttaatctaagataagattttttttttcttaaactatatagaaatttacagtaagaaattaaataattatgaaaaagtataagaaaatatgaagagattccacatttccattattcatcactgctgatacgatttactttctcaatttaccagtcataaagcaaaaacccagaaagaaagaagtcacaaggtagtcgctacacggcatatatgatcagagactaaagatcaaaactttcatccaactccaaccttattctcctctcaattttgtcttgcgtccttgttcgatctgttaaacccttgtaagatccctctgaaatttcctcagaaaaattcatttcaaagatcaaaatcgaatctttcgtctgatttttctcaatttcgttgaaccatatatcttactgcgtaatttcctctccggtaatatctcattttgtttcccttaccctaccaaatatatataatctgtggtctcttcttttgacccactcttatttgtttattattgaaattgaggtactatcgtggaatctctagtcttgcacgctaacacctgcccactgttcttatcctctatttttcagacattgacgtttgaagcttggtgaatttttggattctggtaaggtttagaaaccctgatttctggttttccatgtgggttctggatatattgatggatttttatgtttttggtgaaaaggtgagaacttggttggagcaattgatcacgccttgaaagtgtttgataaa

SEQ ID NO: 4682 - DNA, 3000 bp, Unknown
  misc_feature (1)..( 3000): cDNA_ID_1379043_gDNA_ID_1620721_Annot_ID_165832 3000 nt of promoter + ATG
tacttcttactaatggttatctctctatctttcatctaaaaatatcttaccctttagtgagctcttaaattatgttgttcaattttcttaacaactttaattatgttttaggtattaccgatcacatcattgttcaatagtaaatgttatgttgttccctttcgatccagaacttggtcgtgtacattactaagatacatttgtttttaactataaccagatttgcttatccagatcggaaaatataagtcaactacttgtgttcttgctaccaaaaaaaaagaaaaaaaaaagagctacttgtgttccttcttttaatggaacttataagcacaatcaatctcttaacaatcgttcttctactcttcgttgtttccaagatatggaaagcttgttggatcctccttttgcgtccattgatgctatcaaaaagattcaagaaacaaggaatctcaggaccaaagtacaaaatcttgtacggaaacctcagcgagataaagaagatgaagaaagaagctgacctttgtgttctggatcccaattccaatgatattttccctcgtgtgtttcctcagtatcaccaatggatgtctcaatacggtaccgttttctatccatcttgttttttttttcttcttttcatagatgaggattacttaacacacacataagttgtctatgatatattaggagatacatttctattctggactggaacaaaaccaactatatacatctcaaatcatgagctagcgaaacaggtcttgtcgagcaagttcggtttcactattataccggtgaaacgacctgaggtcttcatacttttcggtaaaggactttcctttatccaaggtgatgattggattcgccatagacgaatcttgaaccctgctttctccatggatcggctcaaggtcttttactcttaactatatacttctcagcttgatttgaaaagaactaatatattgcttgcttaaaaattgtcaggccatgacacaaccgatgggagattgcaccttacggatatttgaggagtggagaaaacagagaagaaatggtgaagtgttgatcaagattgagataagcaaagagttccataaactgaccgctgacattatagcaactactgcgtttggaagtagttatgccgaaggaatcgaattgtgtaggtcacaaacagagcttgagaagtattatattagttctctcactaacgttttcatccccggaactcagtaagtataatagtcacttagtcagtactcttctgctactctcagttaattcgtttggctaaaatattcttgagatttgaagatcgttgtttcttgtgtttcaagataccttcctacgcctaccaaccttaaactatgggagctccataagaaagtgaagaactcgatcaaaagaatcatagattcaaggctaaaatcaaaatgtaagacctatggctatggggacgatcttctaggggtcatgttgactgctgcgaaatctaacgagtatgagagaaagatgagaatggatgagatcatagaggaatgcaagaatttctactatgcagggcaaggaactacttcgattctattgacatggactacgatgttactaagcttgcaccaaggttggcaagagaaactcagagaagaggtttttaatgaatgtggtaaagataaaatcccagatacagacaccttctctaaactcaaattggtaatgttcattttcattgtgttacttgcgggtgaagaaaagggttttcttacacctattaatcttgcagatgaacatggtgttgatggagtcgcttcgtctgtacggacccgtgattaaaatttcccgagaggcaacacaagatatgaaggtaggacacttggagatcccaaagggcacaagcattatcataccgttactgaagatgcacagagacaaggccatatggggcgaagacgccgaacaattcaatcccttgagattcgaaaacggcatttctcaagccaccattcacccaaacgctctcctcccgttctcaatcggaccaagagcttgcattgccaaaaactttgccatggtcgaagccaagaccgttctcactatgatccttcaacagttccagcttagcctctcccccgagtataagcacacgccagttgatcacttcgatctcttcccgcaatacggcctacccgtaatgcttcaccctctcggatagtagttctgaatggtgaggaagagaaaaccaagaatctcaacggatatttggtcacgttatgttctatatttggccttggtcacaaataaagttcagatgatataattcaatagtggataagtcaaattcaaagtgaagtaaggaataaaaatctgaacatgtggtggttgttttagtttcttgattttcatagtcgattctatctaaatttgattatgcttttgaacaaagtatttctccctaatttaatagtgggaggtcgaccatattccgaagtatacaacagaacctagtggattaaaaaccaaatcactcgttgaaaatttcgactctttgggttgttcccacttccactacaattaaatcaaatactaggcgtacaactaaatcaacggcatcagccccattccttcaacgtatggggtcctctgtgtgtctgtctctccaccgacactctctttatcgttgatcactccaacggaccgtcaggataatgccacgtatatttcttctattatcctctgcacttaacacacggtggactacgtactctcacgctgcttcagattcgtacattgcgatttggaatgtttattatatacccaaagagcaaaactttaggtgggccttaaactaattaatggcatttacgcgtcagtgagagtggagtatataacaatctgaagctgaagaagaagaattgagagataacagagagatagtttcttcttcatccaaaagaatccaatcttttcctcaaaagatagtttctggatcgaacgaca

SEQ ID NO: 4683 - DNA, 3000 bp, Unknown
  misc_feature (1)..( 3000): cDNA_ID_3409406_gDNA_ID_1620721_Annot_ID_165831 3000 nt of promoter + ATG
gttcctttttccctacttactttaagagatgtcaataggcttccttatttactactcagagcgttcttaagctcatacaagattaaggcttaaatcagtaggatcatttgaggcacaatgttgaatcttactttttgtacagatggaagttggaattgaggattgcctgcacatcgagtttgagtacaataaaagcaagtaagacaaaatccgtttcatgatttaaggatttgactgattgattgggaaataagacagatatactctatgcctctggttgcaggtatcacctaaaagatgtcatccttgggaaaatatattttcttcttgtgagaatcaagatgaagaatatggatcttgagatcagacggcgggaatcaacaggtgcaggtgctaatactcatgtcgagacagaaactcttgcaaaatttgagttgatggatggaactccagttagaggtatatttggaatctgatgttttagtgatttctttaagatattagataactgagtgaagatttgcattacaggtgaatcgatacctgtaagactgtttctggccccatatgatcttacaccaacgcatcgcaacatcaacaacaaattcagcgtcaagtattatctgaatcttgtactggtagatgaagaggatcgccgatacttcaagcagcaagaaatcacgttgtataggttgaaggaagacgcatcatcttgatgataataactactgtaaggattctcattatccttttgagactttttttgtaaaaagctttagactttgtgtactcagattgttatttgggtcggtacttagaatgaagttttaacagtacttgtttagtttgttcatcaatcaagttccttttctctggattccggtcgagtttgctggatttcatggtaaagtctgaagttttacaaacctcaaaacactctctgaaaagccaaatctctaaatgcaactaactgaaatggacagatatacaaaactggacaactctagagtaaagaagttggttagtcttcttcaattgtttcaacaggaagaccttccttgccccatgtgtagattccaccttctaggtgaaatacgttcttatagccgttaaggaccagaagataagcagctatgagagacctgcaagaaccctaattatatgagcaccgaaacaaatgctttcttcgcacaaagttgtagacttttggcattacctcgattgttggccttcgggaagattttgtgtcggcttcattgtacccgcggatgaacaagctactatgatctttgcctctttgtcaagtttagcttctacacctgcaacatttccgaaacaaaacattcagccgctggattcaacggcattgtgtaaaaacagtccaaagcttattatctcatttcagtgcatactttgaataaactcagggttctcttctgtgccagagaagataccaaagaaagcaaagccaagacggcgagctatgtcccatgccgtccattcccttatgagtctgtacatctccacattgatagctcccggaggatgacccttcaaaaacaaaacaacaagacaaatgtcactcacatgaatttgccattaaaattacaagcgatcatgacacgacgagagagagagcatagtatcactcaccgccttgtactctgcctctggtcttacatcaagaatcacaaagttgttttctttttgtaaccgttgagcttccttcacgtccacacttctcacctacaacaacaactaaaagctaagctctatgttcacattttgatcgaaagttttagtaaattagagccaatcattgattacccttttctccaatagaagctctctcttctgtctccaatcgacttcagctaaaccctccaagagacacaaacagaagaacgagaggttaatctaaccgaactttaccattcacaagatcgatacacaagatcgctctcgctctacaagttgtatacctgcaggtttggcaggtttggttgaagtgcattgaatcttaagcgttttgtgaccggaaaccattgctgccgatcgaactccggcagagaaaagagtgtttccggaggatttcagacgcaaagcctgcgatgaagatgggtaaggcgtggctattgaagtaagtgaagccatctcttgatcgaagctgcttctgttaagtttctgttttttcagatattttcttgaaaatgagagaatttaattgcacgataatggaagaaagacgatgaaactgcgacttcttttcttcttgttaggaaaaaatctgaacatgtggtgcttattttattttcccgattttctatcttttgtattcaaacgatcaaaagttgacacaacataatcttctcttatcttcttttcgaccaaaacataaaataaaatatttctcttatcttctttagttttctcattgcgccattcttgagtttttgattggatcgcttagatttggttaacctggtttttacgttttcggttataccggtttacctctttttgattaattttctttcacaattacaaaaccaatggtcccatactcccatttgctagtttaccaatttttaaaacggtaagatttagtcgtacaaaagctgttattttcagttttttttaccgccttatcttattgtacttttttttttcatcaatcttattgtacttcttactaatggttatctctctatctttcatctaaaaatatcttaccctttagtgagctcttaaattatgttgttcaattttcttaacaactttaattatgttttaggtattaccgatcacatcattgttcaatagtaaatgttatgttgttccctttcgatccagaacttggtcgtgtacattactaagatacatttgtttttaactataaccagatttgcttatccagatcggaaaatataagtcaactacttgtgttcttgctaccaaaaaaaaagaaaaaaaaaagagctacttgtgttccttctttta

SEQ ID NO: 4684 - DNA, 3000 bp, Unknown; identical to SEQ ID NO: 4680
  misc_feature (1)..( 3000): cDNA_ID_3092028_gDNA_ID_1620721_Annot_ID_165830 3000 nt of promoter + ATG

SEQ ID NO: 4685 - DNA, 3000 bp, Unknown; identical to SEQ ID NO: 4679
  misc_feature (1)..( 3000): cDNA_ID_1383728_gDNA_ID_1620721_Annot_ID_165828 3000 nt of promoter + ATG

SEQ ID NO: 4686 - DNA, 3000 bp, Unknown; identical to SEQ ID NO: 4678
  misc_feature (1)..( 3000): cDNA_ID_1825050_gDNA_ID_1620721_Annot_ID_165827 3000 nt of promoter + ATG

SEQ ID NO: 4687 - DNA, 3000 bp, Unknown; identical to SEQ ID NO: 4676
  misc_feature (1)..( 3000): cDNA_ID_3073925_gDNA_ID_1620721_Annot_ID_165820 3000 nt of promoter + ATG

SEQ ID NO: 4688 - DNA, 3000 bp, Unknown; identical to SEQ ID NO: 4675
  misc_feature (1)..( 3000): cDNA_ID_3073929_gDNA_ID_1620721_Annot_ID_165818 3000 nt of promoter + ATG

SEQ ID NO: 4689 - DNA, 3000 bp, Unknown
  misc_feature (1)..( 3000): cDNA_ID_3092031_gDNA_ID_1620721_Annot_ID_165817 3000 nt of promoter + ATG
aggtagagtctgtgctcctatatgattccatggattcgtcgtatactttctcaactgagaatgtttgacttagagaatcttccatttttttttttgtctttctcttttcagtgttactatcattttagatcttttttttgtttttccttctctggttgactgtgtttgaggtaatgctcaaaacgtgattctttgtgctcattatcttttcatattctagtttctggaatctttctgggtattaagcatttgatgattttaaaattgtatatttgttgattttattgagttgacaccaggtttcttgttgacatatgcccaattcattctgatcgttgatgatgattgattcttgtatccgttcaatgtaggttatgtttggatgatagatacattttgactttctcatacaatgagtacacgaagaaatggcatttccaagcatcagcgaggtgataaattttgtggtgaagggccaaactggatactaattgcagggggtgcattgttgagcacattgtccattcgctttggatacaagctaaagcagtcgcttgattcgaaacctcaatcaaatggctctgctggattaaaacgtacttactttatcgctgtgttgcttaacatgttttataatttggttctagtttttttctatcactaaatgaaagcctcttgtgcagctaatggaacatctgagaggcaaaaatctacaagctgttgcttacactctaccacatcttcctgtacacaaaataatgatttttgttgcttccgctccattccaggtgtgactttgtaactttctgttttgcctcatacatatttgttcaatctactaaacaaacgctatatgcttgtttcttggtctcgcatcatgtcttactgggtttcctttcatgaagttaaaacgatgtgtgatatatagtaaaatctagttgggagaatgtgtagatgttgttatagagttctagcctctgttatcttacctcatgatgtatttgtcaactaggggaatccaattcgaagttatggaatgagtaaaatagttacaagatttgccaccttgcaataactggttgaatcgaatatctcttgtttcgttgtggcatattaccattaatttgcatcaattgggctggcaactagggaagcaggttttctccattgatggctgtgtctagtggctgaatgctaaaaacagttactagttttgttatctaccaagacctcgttaagcatagttacaagttttgtactattagatccagacctgagttatgttttctctttggaaaatctctgaatcctaatattcatgtagtccagagcaaacagtcgtgtatggatcttatcagcctttgcttctttatttttataggaactgagagtgtggaaggaaaagaggtgacaagcgagcaaatgatatccgcatctgacacttcactgcctcttgtgacagttcctgctccatcgagcaaagagaatggagtcatgtgggcaacttctcctgatcgcctggaacttcccccaagaccatacaatcacaattcaaactgctcagattctccttgcgtatctgaaaccagctcagacattttcagcaaacgagaagtaatacagaaactaaggcagcagctgaagagacgggatgacatgatacaggaaatgcaagaacagattctagagctgcaaaactcgtataacgcacagacggcacactcaagccatctccaggcacagctagacacactgaacagagatctgtttgaatcagaaagagaagttcaaagactgagaaaggcaattgctgatcacagcgtgggatgtggcgcggacagcaatggcaagacatctccggttggaccttggaatggcgggtttatggacagcgaaagcaattatgagtcacaagaaaagagcctaagggatggagaaagagtagagatgttgagaaaggaagtgagtgagcttaaagaagtgatagatgggaaagagtatctacttagaagctataaggagcagaagattgagctttcgcagaaggtaaaagagttgcagcagagactggactcacagctccaaaacttattgtaggtggaaaggttaggcattgtgcatacttgcgtctcttattttttttttcggttctttttcctttttcgagaaaatgaatcttagtatgtactaagaacggtggagatcaagattttcaggttctttctggctttctgctttcgtttttgaatgtcttgattctgttttttctttcaacatttggtgtaaaggtaaatagatagttgttgaagaatttaccgcgggaatagctctctactttttttttttttttattctccgtaattggtaactaacccgataattacaaacgccacgtataaggatgtgttcactagaagaattagccaattttaacacaaatgataaatagtataaacaaattttaaatttataaatagacgcaacatacattattatttttaagatacagttaaaataaaattgttagcaattatgcttattctgaaattttgggtttgaatataaataagaaatagagttttatcctaataagatttatataaataaacatataaagtcaaagtcatactttatcctctcagaggccgtctctcgggttttgctggtcttccttgctcctctcgcttttgaatggagatgtgagctttcttcattcaaagagcaaaactatctaattccatggcgttctccctcctctctccaattcctacctctgcctctctttttttcactctctccgccattaccgcttctaataatgcttcctcctcctctctctcccgtctttactctttatatcaccccaaaggaaccttacgaaccagaaccgcgacctcgtttttcggagcttctgggaacttgaggattgtttccatggcggagaataggcaattggtttgtaggattggtggcggagccggtgctgaattggatgatatg

SEQ ID NO: 4690 - DNA, 3000 bp, Unknown
  misc_feature (1)..( 3000): cDNA_ID_2156909_gDNA_ID_1620721_Annot_ID_165816 3000 nt of promoter + ATG
ttctcaagtttccctctcaacatctcaatttcagacttcagtttagacacaacctcatcatcttcattacttttcttttgttcatctgaaccaaccaatgcttttaaacggcttaactcagaagaaagaatctccgccttctcagcctgattttcagcaatcttagtcgcttcctcggcatgactgagagccttatttttagcatcagcagtcatagccaattcttgtttaatcctgtgaagctcttctgtggtagagagaagagctgagatgtccaaagcatgctggcttctaatagactcaacttctttcttccaagaaacttcctttttgtgaactgcttcaattcccgcctgttctagttcaaccgctctgaatttctcaatctcagaactcttctctgcgtgatgctgagctgccaatgcctctctcagtttctcattggcttctttagtcagtttctcagattctttaagatcatcaagagctttagctttatctttcttgagcctttctatttgctcattagctttccttaaatcctcttgagtttgttgaaccagtagcccagttcccttccctaaccgtgattgcgatttctgaaatgccatacaaatgatgatcaagaaatagtctttcaaagttgaaaatcaaaacacgtgaagcatcaagttattggatggagatggttttacttgcctcaggaggagtaggaactcttgcagtccgacgatcagaaacaggcttggagttaacagtttgcggtgaacggtctattgaaagacgagtgctctgcaccggagatggcgaattgccatcggatttagtcactgttggtttactcactcttggtgttggtggtgacggtttgctacgaggagtctccattaaaccagttctacatcatcagaaagataaaccacaatgtcacaatctcaccatttaacaataaagaaaacaaaacagaccatccatcatctccattcttcttagaatctttggattcatgattaagtaagctaggaacaggatcccatctcagtctagagatctatcaaattatcaataattaagatgaataaacatttaggtacacttcaactgtatccaaaaaatcattgttacatagtacatggactattggagaattccgttaaaagtgttgggagtctcacaaaacggaagatagagactttaaagacaaataagtctacaagtgactacagaagaagcttctgcaagatctaaaccaatttgtggaaccagaagcagggaaaatcagattaaaagtaacaaaattaatgcaaccaaaacaaaaaacagatgactgaataattccagaagaaaaaacaagggaaggagaaagtgacccacataaaaatccaacaaaacataactacatttccgacaaagaaaacagaagacagagatttcaaattgtcttctgagttaaaaactaaagtttggttaattatcctcacttggttctggacgccattgttgccgaagaagagcgtcctcaaaagaaaaaagaaaaagcgaattgttggctgctaagattcaggcattgatatgggagagactaaacagagactctacagatcgattctgtttctcttcttcttcagtgggtaggattgcttctccacaaagtcttcaacttttttaacacaacaaattcttttcatatataaatgcaaaaaaacaaaaagaaacaaaagaaagtgaaaaaataattgggtaatggggttatggtgtttcccagagtggttaccctcgttctctctctctctctcgtctttttctttctctttcccggtttattttttcaattatatttagtaaaatgataaaagtagaagaatacgtgggaagtgaaactacgaaaatggccatggcttaaagtgtttttgcattgcctgcatcaaagggaatgaatatgaatggacgttgctcattatgtggatagacaagtaactctcgtaatcttttttttgttaaaaatctttagatccatttgattttgggtcatgtggactgcatgtgccttttcaatcatttatttattttccaataattcaaccatacaactcttatagtattctgaaatcataatctgttttttttccctattgaaatcgttgaaactatattaaaattaagatttactagtatgttacatgttgctattttatgcatatgatatggatgcaatttcggctgtacacgtaaatataataaaataaaactggtggattacttcgtataccacattagtgatagaagaaacaccataatttattcatcttagtaaaaataatgacaattattttcaacttagtgttaaagtgttcaaaatgtaatcatatgaagggaagggattatatactttaatcatgggttttgtaaaggcctgggcgttttaaccgaaccgaaccgaaccgacccgacccaaccgaattcaaaccgacccaaaccaaacccaatctaagactcaaacaattcggttgtattttatctcaacccaaatgggtcggttcggtttggttttgaaccaaaccgaaccgacaatccaatgtctttatatacttaattaattaattctataaataatattacaaataactctaaatatttatttatctctaactaaaactctaaccctaaaaagtaaaaacctaaggtttacttctaacttcgtttcatttgttcttccgtcgtctctctctactctttacagccacggtatgatttttaactactctctagcaatacaattacgctcatctcaattttaattaaatattatgagtatatgatgattttttcaatctgtacgtacaccgcaaagtcatggaaaagaaaaatctgtgtttgcgttgtcttgtttcttctatttacttagattttttaatttttaagaataggtttcatgtaggttgggtgattttgtttgtttacaatatatataatatatcttagcattcataccaataatca

SEQ ID NO: 4691 - DNA, 3000 bp, Unknown
  misc_feature (1)..( 3000): cDNA_ID_1034215_gDNA_ID_1620721_Annot_ID_165813 3000 nt of promoter + ATG
agcaagcactgctcagtctcgaagatgagttctcaaagacaagtcagtcaaggttaccttcagactcaagaatctgggctctctttttacgctcagcttcagcttgcatttccatagcagctcgcactccatgagggggcataatatcccctggaaaaacatgaattagaaataggaaaaaacagatatgtaactatcaccggaaaagaaaaaacacgaacaacttacttatctcataacgaaggcactgaagaccccagtcttttgcagcaacattgatggcttcctgcaagaatatatatacatctcaaaaatccatcatatattttcttcttcaatggatatacttcctctaaccatcatgtctccttatgatttgaaaaagagacgcaaataagttcggatatccaacaaatacaacatgactaaatcccccagctgaatctaaattccatatacccaacttgtggtatacaaacacactgccagatgtgactaatttttccaactaaacagctcaagccgcaatgctcagtagggagtaacaccaacagcaatattcaagctaacgtgacttgactttgaaattgatcaacttagcggattctaaattctttgaaatgcacaggagcttaagtacggtgagtcctaacacttcaaaacagagataaagaaggctggagaacaaaccactatcttctcgttgagagtgtctcgttcctcaaaggtcttatcaagagtgatcttaccaagctcactacgcattgtggtctgagccagctgtacaacagcatagataggactctcaacgccataagaagctaacttaggatccacaatctgcaaaaaaaaattcccagatcaacaagaagaaatcagtaaagaatcacaaaagtaagaactcaaaacaaaaaaaaaaaaacaagaggaaaatggattggtgaaagaaaagaagatgaccttaacgtagagaacaccatcgatgtggatactaacgttgtctttagtaatcgcagtctgattcggaatcgggatagcttcttccttgagagaatgaacataagcaatacgatccacgaacggaatgaggaaatgaatccccgacggcaacgtcgtagcgtatttaccgaatcgctcaatcacaaacgccttcctctccggaactatccggattccccaattcgtcggcggcgtcaattgaaaactacaacgaacatccataaatcaatcctaaggttctctactctaatctaaaaccaaatgcttcaaaaacgaaatcgtaaggtgagaaacataaatgattcaaaaatcaatcctaaggttctctactctactctaatctaaaaccaaatcgtcaattgaaaactacaacgaacatccataaatcaatcctaaggttctctactctaatctaaaaccaaatgcttcaaaaacgaaatcgtaaggtgaaaaacctgttggaaggatagccggcggaagtgaactggcgaacggttgaagcggcggcggagaaaatcggaggtggagaggtaacggcagattgacggaggtacgaaacggacctcaaggcggagtaaccgacggagcttttacgaacgaggtggttcatcttcgtgggagaatcagaaaaatgatatgtgaagaaggaaaaaccccaaaacaaaacctcttataatgcgtagtcaatattcaggtactgtttcttcgccggatcacgaagatttcacgcaatatgcgtggagaggaggcaaatattttattgggctttagtggatagtttggtacctgctgttattattgggcttatctctagcccattcagacgcctgaaatatccatctgttattaatttattattcattgttttggttgttattttaaagagttttttttagttgaatccaaaattcattgtgaatcgagaaattgcaagaaaataatggctccgattggtaaccacttttgaggaaaacaatgaataggaaagtcgtgttcctttttgttcctcggtattttttaccatttgcaaggaatttttgatccattttcagacaggtggatcctacatttttcctcatcattcctcaaaaaaaaagaatgatagaacaaaattgttcctccccaaaattcctattgttcatttctttggtcaccaatcggagccaatataaaaaatttgggtaatggtttcttttagtttctaaaaatcatgtaatgatgtgagtgaattataatgaatatttatattgtaaggaataaaatacatattttatttcaagaaaataaacttatatcatgaaattttgatagttgtagatagtcattaattcattattatacgacgttttggatattgaaaaatttagacattacaaaagccatgaaggggtgttaaactttactataatggaaaaaagcggtttaaaattcagaatgcatggaaaaaacaagtctaatgggtttcacatggtgaagaactgtgtgtgagtcatcaaagatccggcgccgttcccttttagatataccgacgtcaagaaataaaatggcaacaattaaaagcttcgtaatgacgaagcgcatttcacctttcaaaagtgtcttctctttcttttgtctaatcttttctaagaaaataatttctatcttttgcttagatttcaaaagattcaatccaagttttcttttggtgggataaagtaaaagatgaacatgtaacatgggatccaaagtctaaagaaggttatattttgtgaactatatctaacaaagagaatagtggtgacacactttacactaaatccaagtcactagatcctaaaaagcttataacatgacgacttcaacaacatgcacctcatctcttctgcatgaaacccaatcactgtcgtcaatatatatatgcacacacctaagttcgtgtatctctactatatataaaggtaagtgtgcatagtttgagttagaaattggaattcgaccaaaatacatagttaaagtata

SEQ ID NO: 4692 - DNA, 3000 bp, Unknown; identical to SEQ ID NO: 3818
  misc_feature (1)..( 3000): cDNA_ID_1825089_gDNA_ID_1620721_Annot_ID_165807 3000 nt of promoter + ATG

SEQ ID NO: 4693 - DNA, 3000 bp, Unknown; identical to SEQ ID NO: 3819
  misc_feature (1)..( 3000): cDNA_ID_1380010_gDNA_ID_1620721_Annot_ID_165806 3000 nt of promoter + ATG

SEQ ID NO: 4694 - DNA, 3000 bp, Unknown; identical to SEQ ID NO: 3820
  misc_feature (1)..( 3000): cDNA_ID_2107732_gDNA_ID_1620721_Annot_ID_165804 3000 nt of promoter + ATG

SEQ ID NO: 4695 - DNA, 3000 bp, Unknown; identical to SEQ ID NO: 4683
  misc_feature (1)..( 3000): cDNA_ID_3409406_gDNA_ID_1620721_Annot_ID_49205 3000 nt of promoter + ATG

SEQ ID NO: 4696 - DNA, 3000 bp, Unknown
  misc_feature (1)..( 3000): cDNA_ID_2993806_gDNA_ID_1620721_Annot_ID_49208 3000 nt of promoter + ATG
tcatccataaccggcgtgaactctgttgctatctctcccatcgttttagaagagtgagtgttccgttctttgggggatgaatctttttttatatgtaagatcttgattgatactctatcgcaattattgaattttgatgtttatatccattaaggaagtctgtctttttccactaatatttatactattttctcactcgcatgttattactgaaataataaaaatatacatggcttgtaatgtttgaattttttgtagaagaaagagaataaatcagagtggaaaacgacaagtgatggccgatgggtcaagtgtgtaggagggaaaaaacagctaagacgatacatagttttgtaatttcaaaattagacaaaggaagccaacaaaaaaagagtcagattattattaatagattaatatacagaagcataagatatatatgaaacgtcgaaaaagaaaacaattggttttacttgttttcactcgagagtataaaaataataatgcatctggttgtaatgggtaacggagttcacggcacaaatgtggtgtatattaaatattattcaatatttaaaggtgttaaattcgaatactgatataacaacggttcaatcacattccattagattatttatgtgttctaacttctagtcaacgaaaccaatatgattatgaatttgtcatcaatggtgaagaatctaaatagactgaaataaatattttggtgatcattgccattccagctgtacacaaatttattgtcaccgaaaaccttgtatgtatctaactagaccgttaatgatatgtaattagcaatatatacattgaataattgattttagcaagtgtcaatgaaacttttattctaacggtaataacaagcaataaccttatggtcaactttggttagagatcacatcaaaactgtataaatacataagtcggatattaattcaaaacaaagacttttgggtcagtatgagtatttcgtcgtcttctaatttataaatggatcggaacacccaaattattatcgggaaaaacgtacggcaacttgtttatagaattcaagttgctactaaatcatgcgccacttgatatatttgcagtcgcaggtccactcttcctagtttagtaccccatctaggcacatatatcgaaatagtttaataaattgaatcaaatactgaattgttactgatatatatactctgtatgtttctcgaaaatacttaaatttggtgtcatggagttgataaatttctgtaagaaattgaacgtctacagttcttatggtttagggtttctaagatggatccaaaaaaatgcaggaaccgaactatatacggcttttgagaacttaggttatcctttagacgtgactttcaaataagtatgtcgatgatttgataagacatgtcgttttatgatatgtagggacagggaaataaaagcacaatgtgaattaagactttagattcaaaaagatgcttcatgcttgtagaaatgatgacgattgcgacttgggacaatggacaagtgctatgtcattacatatactgatacacctaacctaatgaccaaataaggactctttacacgggttaactaaacaaatatatcccaactaacatttccaacaaaataagccgataaatgtaacatgtaccgaacaaaacattattaatcatcgtaacttttttttaggtttgaattaatcattataatttaaaaccctaaaaccaacttataagaaccataattgatcagaatccagtttaagtaaataacatagaaaattttgagtcagataaaaaagaggaaattgtatggttagcaacatttacattttacagaatatggatatggtaaatgagaagtgtgtggatcacaagaagtgaatgtgctttttctgctttttaaaggatgaatatgaaaacgaggctaccctcgttattttatttaatgtgaccactgtttagctggaaatcacttggagacgactttaaagtaggctccaaaatctaaagctagacaccagacaaaagactttctatattgtttgtcttaagataattctaaaaatatcagcatcgttactttattgaatgaatacttataagaattgacagtgaaaatgaaactagtgttgaaaagagatgtttggtcattaaaatcaaacaccgaccttaaactaaaaaagaatatcacttcatcggctcctccttttttcacaacttatatacaatatacacacacacaaactgagaattagaatgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcg

SEQ ID NO: 4697 - DNA, 3000 bp, Unknown
  misc_feature (1)..( 3000): cDNA_ID_3073913_gDNA_ID_1620721_Annot_ID_49209 3000 nt of promoter + ATG
tgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcgatgaacgtggtggttggaccgaagattgggaggaaactgataaccggatcgtatgtagtggcagatgtgatgtgcagtaagtgtggtgagacgttgggttggaaatatgttgagacattcgatcttaaacagaggtataaagaaggcatgtttgtcatcgagaagctcaagttgaccaaaagatattgaaacctagtcaagaagaataatactcttggagggttaagctaataaataaatgaaggaaacttgaggattgtatatgtatatataacctttgttgtataaatgtcatcactatattggttgttctctataaagggatttgaaaacaaagtaaaaaagatttaatctaagataagattttttttttcttaaactatatagaaatttacagtaagaaattaaataattatgaaaaagtataagaaaatatgaagagattccacatttccattattcatcactgctgatacgatttactttctcaatttaccagtcataaagcaaaaacccagaaagaaagaagtcacaaggtagtcgctacacggcatatatgatcagagactaaagatcaaaactttcatccaactccaaccttattctcctctcaattttgtcttgcgtccttgttcgatctgttaaacccttgtaagatccctctgaaatttcctcagaaaaattcatttcaaagatcaaaatcgaatctttcgtctgatttttctcaatttcgttgaaccatatatcttactgcgtaatttcctctccggtaatatctcattttgtttcccttaccctaccaaatatatataatctgtggtctcttcttttgacccactcttatttgtttattattgaaattgaggtactatcgtggaatctctagtcttgcacgctaacacctgcccactgttcttatcctctatttttcagacattgacgtttgaagcttggtgaatttttggattctggtaaggtttagaaaccctgatttctggttttccatgtgggttctggatatattgatggatttttatgtttttggtgaaaaggtgagaacttggttggagcaattgatcacgccttgaaagtgtttgataaaatggctcaggcaattggtccaagactgtatagttgctgcaactgcagaaaccatgttggacttcacgatgatatcatctctaaggcttttcaggtgaatcaccttgatcatttcttttgttttgtttgtgtcccatatgattgatgtagaaaattaagtggagaatcgatgtaagactagctgcagctgagcttagaatctaagaaaacctgtgactttattgtctttcctgatcaacgatcgatgctactgatcatgattcagttttcctactaagttacatgttggtgttagagtcaaatcaaaacttgaaagttgatccttggaaatggaaacaaaacataagacacaaagtagcctttgactcaaattgttacaaatcacaaaagtagtcattctttgagtatgcttgtggtaggttgtggactcaattcaaaatcttatgttagacagcccggcttttgtgtttcttgattgtgaataccaaattcttaatcacggttcttcattaccacttaccagggaagaactgggcgagccttcctgttctcccacgcaatgaacattgtggtaggacctaaagaagaccggaatcttctaactggtctacacaccgtggctgatatatcttgtgttgactgtaacgaaccattgggttggaaatacgagcgagcttatgagacctcacagaagtacaaggagggcaagttcatattcgaaaaggctaagattgtcaaggaggattggtagagctgaggaacatgatgaattcattattggattggctcaaaaatgtatatagataaaatttggctttgtgatttcacaagtcatcatcagccatttttccagttcttcattgtctctctctgtatgttaattatgtcgtctcttgtgttcaaactatggatttgttcgaacaaggtttctctgttaataaagatgttaatagcttctcttgtgtttcgcctcagaaccttcctttgtaagtgtaatatgaatctccatactttgtctttgagtagcttggaagataacttactagggaaaaagaaaggtctgccgtttaaaatttagactacgtgctgctttatgtttaccaaagctaagtggttgtcgttttggcgcaataaatgtgattaccagaggagagggagagagaaaacggagcgagagag

SEQ ID NO: 4698 - DNA, 3000 bp, Unknown
  misc_feature (1)..( 3000): cDNA_ID_1825205_gDNA_ID_1620723_Annot_ID_49235 3000 nt of promoter + ATG
cttcaggtagcgttcattgagttttatcagaagcttcgacatcttaaaaactacagcttcttgaacgcttccgctgtttccaagatcatgaagaagtatgataaggtacttaatttctgttgataattttgacaagcttttacagcatttactctagtttaatatatatgctctactctttagatagccaaaagaaatgctgcgaaactgtatatggagatggtcgataaatctttcctcagtagctccgaagaagtaagtatccttcttctatctaggaaaatcgaaacatgaaactttagtttgaagctttaaacatgtgcaggttcataagttgttgctaaaggttgaatctattttcattgaacatttctccaattcaaatcggagggaagggatgagccatttaagaccaaaaataaataaagaacgtcatcttataacgttttccaccggtatatatatcaacactacaataaccaatcttttgacatgtattttcaagagtaattcatcattttgttctgttttttgttttgttttaggcttctttttcggctgtggtatttctctcattgtagctctgggtttgatcatccatgctcgtaatatcatgggtacaccgggacaaagaacttatatggaaacaatgttccctctttacaggtcagtaaaacgaccaaatataaaccaaacacactatctctgtctctgtgtaatattcttgagatatatacatttcatttgcaggttttttgggtttgtagttttgcacatggacgtgtacgctgctaatatctacttctggaggcgataccgtgtgaattactccttcatctttggattcaaacaaggcactgaacttggttatagacatgttctacttctcagctttggtcttggtacactttctttatgtgctgtcttattaaaccttgacatggaaatggatgctcaaacaaaagattacagattagtcaccgaacttatccccctctttcttctcgtagtaagttccttctatctctctctatttctcagtacattttacacaactcaatctttgtttttagtaagactcgtttctctgcatattgcagttagtgattatcattgttctctgcccctttaacattttgtatcggtcaagccgattcttcttcctctcggttctgttccgctgcattgctgcaccattttacgcggtaccaacaacatatcctcctctccattcatctgaagcataaacagaaatgttaagaagaatgtcttccatttttgcaggtgcatcttccggactttttcttgggagatcaactaacaagccaggttcgagaaaatctatactcgataagatagcttcatacttattttgatcgatgatttctgatttaaacaatcaatgctaggttcaagcactgaggagtctagagttctacatatgctactatggttttggagatttcagatatagacgacgaaacacctgcacatcaaatattggattcagaacattctacttcatcgtcgccgttataccttactggttacggtttcttcagtgcatccgaagaatggtggaagacagagatctgagtcatggctacaatggcatcaaataccttttgaccatcgttgctgcttctcttagaacagcttatactctaaaccgaggaagcaactggaatatcacagcttgggttttctcaggagttgcaacgttttacggaacttactgggacattgttcttgactggggattgcttcaaagaggatgtaagaatagtttcttgagagacaagcttcttgttcctcacaaaaccgtgtactacgctgcaatggtgagagcaaacagaaaacagcaataacctctgtttttgttttttctttatacatatatggtgaagattgttgcttcatgtacttggcaggtcctgaatgttttgttgaggttagtgtggttgcaaacagttttggatctgaaattctctttcttgcatagagaaactatggtcgcgcttatggcttgccttgagatcatacgcagaggtatctggaacttctttaggtaagctccgagactgagaagatggtgttttcatgcatgaatctacacaaaactaatgaaatgtaattgttgattaggctggagaatgagcatttgaacaacgttgggagatacagggcgttcaaaactgtcccgttaccgttcaactacgaagaagatggagatcatcataacaattagcttaacaagaaaatacttggtttcacaaaattacctaaacaacaactaaacttttcaccgctgttccggtatacaactgtaacgatcgagctttgcctctccgctgtattcttcagagagccaactcgaggctggctcactctcagggtcagacctaagcgatggtagaattatggagaaatcaagtggaaatctcttcgttccttggtaacaagagatacaaacacttaactaacttggttacatacaacaaaaagacattactttgtacacttacttcagattttgacaagaaagatagaaactcacgtcattgtacagtgtgtttaggtctcaatattgtattgttttgttgaaagataggtctcatattgttttatttaaaacaaaatttctgaatttgcgtttacatgagagaaaattatagatttttttttcaaattaactctagtaaaataatgaacacaaattaaatgttatcaaatatgaagagtatcttgacaataccatttactttacgatttatgacagaccaatatatgggcttcattggggcttcattggggcttcattgaatttcaaagtctgttaaggcccaaactgagagcgcggttgcacaaattgtcgaaatttctcgaaaccgctttaatctcgatataaagctcgtctgctaaaaaccttcgattagggttttagtctgtagaaacaaagttgccgcttcgattccaaggagtaacctagctgagaaaatg

SEQ ID NO: 4699 - DNA, 3000 bp, Unknown
  misc_feature (1)..( 3000): cDNA_ID_1825201_gDNA_ID_1620723_Annot_ID_49236 3000 nt of promoter + ATG
atttcgaattttgtaacattgctaatatttcgaattgtttgtttgtcacttcgcgttatatgacacaacgattgttgttttcacataaaaaaaaaaaccctactagtcatcatctaatgtaacactccagcatatgacaaaatcgccgaaatattatttattattatataggtaaaatagaattacaatatgctcttctatagtatatagtaatctaaaaagttgcatcataaaataaattattagaaaaagatcgaaaataggtgatatatcatatcatcattacaataggtgtgagtcgtccgtcgcctctgactggtccttcctttcgggcacgatagcaggcataagccactatcagtgcgatgatgattaatacaccgactgaaattccagaaattgcgataaacttcattggatcagtccccatgtttgttttaccacacgcacccagaaaaaagtttatttctactgtttttattttttgtcatgtcttcttgtgacacagtatgtttacatttatttacaattatttacatttctgttaataaagtccgtgaaatttgtaagttttacattttattatttaagaaaattaacaaggatgaactggaaaattacactttaaagaatattaattaggaagaaatagaaattatacatttttatggtactttgttgatcttcataccatcaaactggaaattgtacattttaatagaaaattaactatgaaagaatagaaaatttacatacgtgagcatgtagtaatttaaggctatcacaaaaattcgacattttatttcagaatattctaaaattttgatatttaggtagcacattatcaaatattgtaaaataaaataatggccaggcttatacgatttgagatttgattcgtatccatgaatgccatactcgatgagtagttactgttgtgtgtgtattatagtttttgctagttaatgttgtttttactcctaccgcataaaatgaaataatgaatcatctatatatacatttttgcagccattttgtgaaataaatcttagagttgggacttatttactaggctgccattgagtattaattattgatttttttccagcaataaattgattaataaactaaaaatattccaaatatattcagcaactatttaaaacaaaaaatgtttgacaaacaaaaatataattgcaatcccttaaaatgagcaaaacccacctaaatatattctttatctatccaataaatcttttttctccaaaatttgaactagattttggcaactattttaaacaaatatttgtttgacaaaccaaaatacaattgcaatcccgtaaaatatttcttttaattatatatttaaattagcggtgtaccgcggtttttttttacggggcggatttggcgagacgggtttggtaagacgttatttaataacaattgtaaactataaaataaaaataaatagatttaatttgcaaacttttatatatactaatttaaaaaataagttgtccgcgggttaaaatctagtcatggttattttaattaggtgaaatcagccttggataattttaaaaactaaaaccaattgtttgtaagtaaagaattaataaattagtgtaatttctaagttttcaaattattatataaataaaataaataaatatgtatttataagcacaaaaaaaggaaatggtgcgtattcctggtacaatagttacttgtcagatccccatttaaaacatctcaaattggttgaaaaaaagtcaccaaagaaaaactagattagcatcaaatgtttttaaaacttttaattcttccataactctttctaagaaataatttaaagagttaaatcaaataattcaaaagtcggttgctatttattagcgttaagtatacgtacttgttttcttatttttctacgtacttgttttctttatggacaaccgatatgtagtttgtaaaatttgtttgctaaaaatgaaaaaaattggtccgtagaatatacaatgcccaaatgactcgcttctgagctgatgcaataccagttgatgatacattgtggtcactacacagtgtagaagataccaatttgttttgtcaacgaaatgtagaagatacgggttttgcattgaataaaagacattacacattaggtggcgacaaaacagagaagctcaaaagataaaagtgtagaagataccagttttttttgtcaaccgatgtagaagatacgatttacgcgtatagagccaccaccaaggcattgaccaaaacctaatcatctcaagtgggaacgtacgttgatatatgtcatataataatttaataagcacattgacatgacatgtattgattgactacagatttaataagcacattgacatttcacatgtcacatgcagggttgattataaaaatatctaggatcctaatccataccgaaaacaggccataaattttattgaactataatcaaacttctagttatatcaataatttattggcaatggaaaattactcgatagatgtaacatgcgttttgcacaaaaacgatgtaacatgcgttgctaacgttacttttgctttaatttcatagtttttaaattttaatttacaacttataaaccttaattaagaatgatatataacaaaacgatatcttataacaatttcatatttttgttagtaattttttaagagttttgacttttgattgtctgtttttttttttgggtattttttttttattgtttaaaattgtggacgaaaacgaattcatatttttgttggctaagttaagactcaagacctggtctacctctctagaaaaactttcagcatcactcaaaacccaaaagtcaaaaagtcacattcttctttccaacttttgttccaaagacagagagaggccaagattcataatttgagattctgactgtagacttcgagcaagaaaaaaaaagatctgaaggttgaagaatcatg

SEQ ID NO: 4700 - DNA, 3000 bp, Unknown
  misc_feature (1)..( 3000): cDNA_ID_1825197_gDNA_ID_1620723_Annot_ID_49237 3000 nt of promoter + ATG
tacgcgtaaatcgtatcttctacatcggttgacaaaaaaaactggtatcttctacacttttatcttttgagcttctctgttttgtcgccacctaatgtgtaatgtcttttattcaatgcaaaacccgtatcttctacatttcgttgacaaaacaaattggtatcttctacactgtgtagtgaccacaatgtatcatcaactggtattgcatcagctcagaagcgagtcatttgggcattgtatattctacggaccaatttttttcatttttagcaaacaaattttacaaactacatatcggttgtccataaagaaaacaagtacgtagaaaaataagaaaacaagtacgtatacttaacgctaataaatagcaaccgacttttgaattatttgatttaactctttaaattatttcttagaaagagttatggaagaattaaaagttttaaaaacatttgatgctaatctagtttttctttggtgactttttttcaaccaatttgagatgttttaaatggggatctgacaagtaactattgtaccaggaatacgcaccatttcctttttttgtgcttataaatacatatttatttattttatttatataataatttgaaaacttagaaattacactaatttattaattctttacttacaaacaattggttttagtttttaaaattatccaaggctgatttcacctaattaaaataaccatgactagattttaacccgcggacaacttattttttaaattagtatatataaaagtttgcaaattaaatctatttatttttattttatagtttacaattgttattaaataacgtcttaccaaacccgtctcgccaaatccgccccgtaaaaaaaaaccgcggtacaccgctaatttaaatatataattaaaagaaatattttacgggattgcaattgtattttggtttgtcaaacaaatatttgtttaaaatagttgccaaaatctagttcaaattttggagaaaaaagatttattggatagataaagaatatatttaggtgggttttgctcattttaagggattgcaattatatttttgtttgtcaaacattttttgttttaaatagttgctgaatatatttggaatatttttagtttattaatcaatttattgctggaaaaaaatcaataattaatactcaatggcagcctagtaaataagtcccaactctaagatttatttcacaaaatggctgcaaaaatgtatatatagatgattcattatttcattttatgcggtaggagtaaaaacaacattaactagcaaaaactataatacacacacaacagtaactactcatcgagtatggcattcatggatacgaatcaaatctcaaatcgtataagcctggccattattttattttacaatatttgataatgtgctacctaaatatcaaaattttagaatattctgaaataaaatgtcgaatttttgtgatagccttaaattactacatgctcacgtatgtaaattttctattctttcatagttaattttctattaaaatgtacaatttccagtttgatggtatgaagatcaacaaagtaccataaaaatgtataatttctatttcttcctaattaatattctttaaagtgtaattttccagttcatccttgttaattttcttaaataataaaatgtaaaacttacaaatttcacggactttattaacagaaatgtaaataattgtaaataaatgtaaacatactgtgtcacaagaagacatgacaaaaaataaaaacagtagaaataaacttttttctgggtgcgtgtggtaaaacaaacatggggactgatccaatgaagtttatcgcaatttctggaatttcagtcggtgtattaatcatcatcgcactgatagtggcttatgcctgctatcgtgcccgaaaggaaggaccagtcagaggcgacggacgactcacacctattgtaatgatgatatgatatatcacctattttcgatctttttctaataatttattttatgatgcaactttttagattactatatactatagaagagcatattgtaattctattttacctatataataataaataatatttcggcgattttgtcatatgctggagtgttacattagatgatgactagtagggtttttttttttatgtgaaaacaacaatcgttgtgtcatataacgcgaagtgacaaacaaacaattcgaaatattagcaatgttacaaaattcgaaatatacgcaatgttatggtggtgttgaccgaagggtagtttcgtaactttacatcatcgcgtggtcgtatacgcgccgatgagatcacagacggcattaatgggctccggaagaagaaacaaatgattaatttaaggaataaattaccactaaattcgtttgattatttccggaaaacaattaactaataaaactataactaacctttgtttaattttttgatttcgcgtcttcactgttgtggatttcttctgaatcttctgagctcgcttcacctacaagaagacaacaaggatcattttctctaggttcgtagattctctttcttcttcttcttcgtttggatctgcttagtgaagaagataatcttctgaaaaattgtttgttttttttctgaaaatctgaatacgtaatgatttgagctgaatctgagttagattcacatttatattctggatttgtgctatttgatgatttattagatcgatcatcttgttttcttctttcgcctttaagtatgtttgctcatagtgttgctcttccagattccagatcctgaagaaggtgaaatcttatctgtgatccagtggaagattgaatcaagtaacagattcacttagttcacttgcgtattgcatgcccctgaagataacattttgaataatgttgatattgaattatcacctataagctctggttcttgttgcttgtattggttctgggtatctactagtgaagaaacc

SEQ ID NO: 4701 - DNA, 3000 bp, Unknown
  misc_feature (1)..( 3000): cDNA_ID_1825183_gDNA_ID_1620723_Annot_ID_49242 3000 nt of promoter + ATG
agatgtacgtaatctgtcgagttaggatataattaagagaatggtggaatttaattcgtacacatagaattaatggtataattaatttactattgttggtgtgagtagcatcaaatagatgatagaatagtattttgaacaaaaattctgatagatagtataagccttcaaactaaaattgtttccggacgaatacacgaaaagaaaaatgaaataatattaactttctaaaaactcatcgattgatgggtatacacaaaatggttaaaaagaaaaaaaaatgattaacagattttgagattatataatactgaaaatttgagtcggaaattgatttgcaatatgcaaaagacaagaaacatgaggcaaaggaaaaaccatttttcagagaaatctaaacatgtgaaattcgtttttctaaaagtaacaatttgcgaatttatcagcgacggatattttttaaaaataatatgtaatgtttctgttagaaagtacttttggttgacaaaaagaactgttacaaacttactttgttgtgtacgcactgttacaaaattatcaaatttgaatcttgaaaatggttaattagggttgtgtgatacgcactccagatctgtaatcacaaattagctaatgactataaagtcgatgcaaaaagtaaaacatagggaatgtatattatatgccgcttagttgaaaaccgctacatatctatgatcgatttaaatatttgaactctggaactgttgacttttctcttagacttaaattttggtaaacaatttcagcaactaaaatgagtgagaaaacttggttgttgaaaaaaaaagagagagtgagaaaactttggtttagttttctacagtgaccagctttggggttttgggcggaattaattagccaagtagggtctagaaaatgtgatcttttaacacatggccaaagtcgtttatatttggtgattctgtttaaaactcacaatttgtttttttcttttcttaaattttgaaatcatatctatttagaactaaagttcatcataaattttgatgaccctaataaataatatagcgtcaatatagagaacttagctggagatatattgtaaatatgttgttgtaacgatctattacgaataactattgaaatacaatacaattatttaaaagagcaatatataattgtataatttaccacatcattaggatacttcgccccaaacacatattttaattcgtttgaacgaacttaaataaaaaaaataaaaaaaatcattggttaaaactttttattgcagaaataattggttgttactgtagaaatagcggcttctattcgcaaccgtcagatatacaagtctaaagagatgtctttagtttagtcgtgactcctacaaggcatgtgtgtacgatcgcctgatagggaataatttaactttgcataatccatattttccgacaatcatcgagttgacatgattcgacatttggtcatacacgtaaatataacaacgtgcttctaattttaattttataagattaaaactatcagatagtactttttgggatataggaaaaatgcatctcatgtaataaaactatagcagaaacgtgtcttaaaaataatttacataataaatagttaacttgttttatcatgactataatatgcaaacattattgcggttgtacgcatgtaataatattactgtatataaactgttatataccagctcttataactttaaaactctatccattttcttaacgtaatgtatagtataagtgaatgaaatttttctctttttacaaatttatctggtttataaaagttgctaatatcaggcataatatggcttatggcgtatattgagcatatcagcatacaacacacatccctaaagaaaagactttggtcaaacatccaacgagattatcttttatagtatagtggctcttaatatgcgtatatacatatatataaaaaacaagggattcgtgacagagaagaaggatttgctttgccttgaaaggataacctttaccaaaaggattattttttaataatggaaactgtggagggatgtcatggtttttatattcaaagcatattatattgaaatagtatcttcttaagaacagtatatctttagcattatatatctgatacgcaatggatatggacgtttaataaacatgtgaaaagactagttgcagtgtgagcaggtgcaaataaaaagaaaggatcggagcccacatgcgaccatcgcaacatcatcaacggttgagatttgaggttttgttttcatgtatccgaatcttaagacatggttgcactttcacgtcgacatttgtcaaatagttatattctccagttcctcctagttgtatgagaatataattttgttttagagaaaatgtgcattatggtttttttttttttccaacagtttgcgttttagatactaattctgtatttcatggaaagagatggattcgcaatggtatttcacataaaggaaattttgtgttggatgatggtatgacaaaagctgtttggagggtataaattattaagttgacattaatttcaaaaatttataattatgtgttttaattctcttaattaaataaactgtagaggattttattttgttatgtatatatattgactataagttgtattctactagtttgttacaaatcaagcccgaggctcatcccataaatgaaataaaaaaaaactgataactatttcaattttatttaaaaaaaaaaaaagagtaattccgtaacctgcattatttggtcctcctactgtgtatctatttaatatttaaataatggtcctccctctcacctaaggagacatagagaaccatctggttctttaaggcaccatcattcaacaagtaaacaataaaggaaattaaattatcacaagacagaaccacaaaatcctttggagatctgacactggtaaagctcaaagtgtcaaact

SEQ ID NO: 4702 - DNA, 3000 bp, Unknown
  misc_feature (1)..( 3000): cDNA_ID_3073941_gDNA_ID_1620723_Annot_ID_165879 3000 nt of promoter + ATG
acaatttataaacatagacaaccatgattagtttcggaagtcaaaataaaaagcatgttaatcaattgtcttttatctcgtatccccaattttacttctcaaagtactaaaatagtctaaaaacaatcatacgtacgtaataagaaaataatttacttcctgctgtgtttaaacaaaacttctatgagatgtaaaaaaagaaaaagagtctacgatggatgatcaagcgtaattgctttgttacgtctaaaaggtgtttaacaaaactatagcgcagaaaataatcagtttaattaactaaacaaaaacatgttagtggattaagccaagaattagtccgatagaactataaaatctacaaaatatctcaaatctcaataatacgtatataatatctcaataatacctatataatatctcaactccaatcagaaagctaaataaaatatcagcataagttatattcgcttccaaaaaaagtctgcctcgttacctacctctcacactcaagtctctcacgttatttgagatatttaggagaagcaagacgacaacgagaagaaaaaagagtgggtatggtcaagaaaaagacaaattatgattttagtggaaaatagaaagtaaagagtgaagtgacgcgacacgtggtacgagactccacagcgagccacgtaaggggggacaaagaagagaaggtatggacaatggtttccgcggtcgagccacgctttcagaattctgattggcactgggttatcttgtggaacccatctgaaagatatttttggttgtcgtacggatttgtttatttcgggtttgttgaattagtttgtttcggttttatacactattttaggaaacttttttttatattctttatagtgaactgggctgaatttttttggttgctagattcgagacgagccaatttatgtaatattttgtggctttctgttgctaaattgtaagatctgtaacttacatgagatagaataaaataatgtaatgcaggttttgtggcatatttacaaacatcatccacgtgtaatgatctgtccacatattttgccttgaaagcaactacaatatgacttttaatatcttttttgttaaatatttgacttttaacttatgtgaagcaaagaagtagaaaacgatttgttttgtattgaattattttccactcgtttctacaacaataaaataaaataaaatgaaggaaccattctaaaaaaaggaactagaatattttcaaactatagtacaaaaatggaaacgactatcgaatattagtaactccaaagcgacacgtcaccatctccttcgccgtcataattatgattccattgaacagacggcggcggtaaaagcatgccttcagccatattatccaacaaagtcggcatcccaaacattgtctcctcatccatataaaacgcaccttcgctctgttccggtgtataaatagcttccaccatcgtctcctccatgtccaggccatgattcgtggtcgtcgtatcacacgtctcatcttgaaaagccaacgccgcttcagcagccgctttttggatatccttggcgcatgttgactccgggattcgtagccgccaagccgagtcagcgaagttgagacatgctgatcggccacggagggctaatgcagcgacgtcgtgagcacgagctgccatctcagcggtttggaaagtcccgagccaaatcctggttttcttgtttggctctctcacttcagaaacccacttaccggagtttctttgacgaactcctctgtaaattgggtgacgagtctcacgaaacttcttacggcccgccggtttcttcggacaactcgtggccaacgtcggacaataatctccgccttgaggctcgtaatcggagccaaacatttcagaaaaagctgaaaatgagttcattgatcagagtactctgtttcaagaaactggataaggtttaagtagtacgtagttactagagttctcagtctttttggattaataaaagatagtatatctgtcttggtaaagctatttatatctctctctcttttttttcttttcaggtagattctttttcaagtgtgtagttagtataaaaagtgagagtgagaattggtgtttatattggccggaggagagataacggatatgtggggagcacacggagtttttgtctctgtgaatgacacgtgtatagtacatagcgaagcaatcccacgatgttccactcgctgtctgacgtgtgtcctttgacccttgtaaagagacttttgactcttcactcgttaacctttatgagttctttaaattctatcgagtgtgtgcctgtgtggttggctggctgctgttgttacaatcgtttttaaattcctatgaataaacaaattgtcattaattgtcacccgtctataacataatagacataaatatctctgtgaaatgatattttaaatactcatgtagtatttgtattggaagtagatgtcctaatatttaaccaaaaataatactacaatatagaaaagcttgattttttaaaaaaattaatcagatttggtaatggataattatcaatttcgatggacggttaaaaatgagtcataaatgcatatgatgaacaaaattattcagtttaaacaaactataaccaaaaacatgtaaatggaccaggacaggactaagcgaaggattagaccaatacaaaatagcaagttatcttgaatcccaataattcccacaaaatatctcaatctcaataatagctatattgtattgacaaaaaaaaggtataaaaaatcttcacaataagatatgcatgaaatatattcgctgacaaaaatatctctctcgttacctctcgctctcacgttattgacatttaggagaaaagaagacacaacaaagagggaaaaaaagagtggtaaggtgaagaaaacaacaaaattggctttagtggaaaatagaaagtaaagcttgagagtgacgt

SEQ ID NO: 4703 - DNA, 3000 bp, Unknown
  misc_feature (1)..( 3000): cDNA_ID_2990367_gDNA_ID_1620723_Annot_ID_165876 3000 nt of promoter + ATG
agtgagaaggaagtgcgctggctggagagaaaagagagaaaagagtttcgagtgagagagagggcgttgagattgtgatcaacttaatgtaatatgttcttttattacattttctttttgtcatatactcaaaccttttactattttgtctcataaatctaacacaccccaccatttgttaatgcatgatggtagaaaatattaaatataattaactacttttatgtgatcaaaattaggtttcagactcgtttcgcgatccgatctacaattacaactgcatgcttctaattgatctaaattctaaattttttatacatattaaaaaaacaactttttgttaaattctcaatcatcatttttgtgattaacaattttttataactctaaaccaataatatttgattatttattttatatgtataatgatgattgagaattttaattagcagtctatttagggttttcctaaagttacaatatgttgttacccttctagttaaattttccaaaataccatatttcataacttttcaaactgtttattaattcaaccgtaaaaagcactaaaatgttacatttgatcattcacccaaattaaattcaaaagtttttccgccaaaactacttggtgacttacgtgcttatatacggacgactattattatgttctatacttttttatactttgttgcacaaatatctactctcccaattcatattctagaaggatgtgctataagaatgggagaaattacacaagaagagcatctttaaatatcctctcacaatctttatgtctaatacacgggtgaacaattaacgacaatttctttattcaggaatataataatgaataacggttaccctacacctagtacactaaatccttaacagccacacattcatacgcaaagagtttataaaactcataaaggtataataataacgagtgaataagtcaaaaaaagtcttctctggacacatggcagatcttaatgagtgaatccttaaactactcattttacaattgcttcgctgtgtatagtttacgtggcattaccagagacacaaactccgtcttcgccttttcttttgcctctaaaatatcttccgccattataaaacagcatgctctcactccaacttttatttatctacaaacattaaatccacctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatcttcattatgtttgtaaaactgagaaacgagtgtaaattaaattgattcagtttcagtataagtgtgggctattcttaaatgcaagtatttttagagcagtaacaaaaaaatgttgtttaaattagagtataaaaccgaaacaaccgattcagcaaaacctccaataatagaccgtacaccataaacagaaatatgggtcccacaagagagcactgtccgtagcttccccttcattggccctctacgtggctcctcttgtaaccaatgtcatgtcattttcaagttttactttctttttttatactaatatcttgtttgtcgttttctgtaccttaaggtcctaaaccactttctttcgcgcaccattccttgtcgtattatttctccgaatatgtcaataccgtgagacgacaattgatagcgagaggtagcgagagagagaaacgttcgttgtgaagatattttattgctgttgttgagatttgagatattttatagctattattggaatttgaaagtgatgtataacttgctactatatcggtctaatccttggcttaaaccagtttttatttagtaattttatgctcctgtattattattcggtggagtatttttttctcaaaaaatatatgagtcgagtttaagaaatatataagcgaaaaaacaaaaaaaatatatataagcggggttaatagatcaaccacaatcaatttaatttggactttagaattaataaaattgtttacttcgtaattattattatttttgttgttctggcaaatctgataatccagattattattagacaagtagcgaagggacggtgaacatttatgattttaatttgtatgttgtaaggaaaacaaaacaaataagttctgtaaaaaaggtttacctttctactttgccggaaaactcaactcacggtggcgtccggcgagttttcagaccaaaaagaaggttggaagaaatg

SEQ ID NO: 4704 - DNA, 3000 bp, Unknown; identical to SEQ ID NO: 4701
  misc_feature (1)..( 3000): cDNA_ID_1825183_gDNA_ID_1620723_Annot_ID_165865 3000 nt of promoter + ATG

SEQ ID NO: 4705 - DNA, 3000 bp, Unknown
  misc_feature (1)..( 3000): cDNA_ID_1021972_gDNA_ID_1620723_Annot_ID_165861 3000 nt of promoter + ATG
tctaggttcgtagattctctttcttcttcttcttcgtttggatctgcttagtgaagaagataatcttctgaaaaattgtttgttttttttctgaaaatctgaatacgtaatgatttgagctgaatctgagttagattcacatttatattctggatttgtgctatttgatgatttattagatcgatcatcttgttttcttctttcgcctttaagtatgtttgctcatagtgttgctcttccagattccagatcctgaagaaggtgaaatcttatctgtgatccagtggaagattgaatcaagtaacagattcacttagttcacttgcgtattgcatgcccctgaagataacattttgaataatgttgatattgaattatcacctataagctctggttcttgttgcttgtattggttctgggtatctactagtgaagaaaccatggcttttggttctcctaggaataattctatattagctgcggctggatttcctcggaaagtgtctacagttgcaattgctattggtggtttggcatcattctttgttttcggattgttgcttcgtctttcgtatccgaatagttcttcagttggtggcatattttatgggatagggaatcctgaacaagttcatgtccctttatctttgagcaaccatactgtcaatatccttcagaagagtagtgacatcaatgcgtttgataaaaatctgacttctgattctagctctggcttacctgttgttgttagcaaaagtataccacctccagatttcagtagtgataggaagttggagacacctttgacacaagaaaaagaggatttggtttcttcggatataactgaaaagactgatgttcaatcaggtgaacgtgaaaccaatgtttccaaggctgaagacactccaagtgcatcatctcctccagatgatgtctctgaaactgcttcagcagaaccaggtactgttgttatcttttaaacgcttatttccgtagcttttgtcgtatttggaacattttgagttatggtagcttaaatttcaataaacaaagactaagctagtgtgggaatgttatagaacatttagttttgcatttctatggaaaggcgtaagtttctgagaagttttaaagaaattcagcggctaaactcttagctatagacctactgtaattattctagccgaggactgaatatagcagattagagtaaaaacttggttagggagcagatagtgagtgctgggcttgtaaggtggtctcagcattttgttttaggggttagagtttctaggctttgtgggcatttggttgagagttctacctgttttggtgaattggaataagaagagcagtttcatagatctgttcttgtcagtttcccttgcttctcatgattctagctgttcgatgttttatatttctgttatgagtttgtcgcttactcaaatctttgattgcttgtagagtgtgatttgtatcaaggtagttggttttatgatcctgggggacctctctacacgaacaactcttgccctgtcctgacgcagatgcagaattgccagggaaatggaagacctgacaagggatatgagaactggagatggaaaccgtctcagtgtgagcttcctcggtttgatgccagaaaatttcttgaacttatgaaaggcaagacactggcctttataggagattcagtagctcgtaatcagatggagtccatgttgtgccttctttggcaggcaagtaattcaatttaatggtgaaaaccggtataagggatctattgtgttgctttattcagcttcaggagatcgtatgtattatattaaagtaggtttctgttttcaggttgaaacaccagtcaatcgtgggagccgaaagatgcagagatggtattttaagcaatcatcagtaatgattgcccgtatttggtcatcttggcttgttcatcagttcaacgaaaaattcgattatgctcctgaaggtgtcacaaaactaaagctggatcttcctgatgagcgcataatggaagctatcccgaaattcgacgtggttgtcctctcatcagggcactggtttgcaaagcagtctgtctacatattgaaagaagagatcgtgggaggccaattatggtggccagacaaatcaaaacccatgaaagtcaataacgtggatgcatttggaatatcagttgaaacaatccttaagtccatggctacacacccgaactacagcggtttgaccattgtgagaacattctcacctgatcattacgaaggtggtgcttggaacacaggtggatcatgcacggggaaagaagaacccatccttccagggaagctagtgaaaaacggattcacagagataatgcatgagaagcaagcgacaggatataaccaagccgtcgataaagtcgcggagaatttgaagctaaaactaaagctgatggatatcacagaggcatttggatatcgccatgatggtcatcctggtccattcagaagtcctgaccctaacaagatcactaaacggggaccagacggacggcctccacctcaggactgcttgcactggtgcatgccaggaccagtcgatacatggaacgaaatggtcttggagctcataaggagagacaggaaaagctcatcaacttgacttggtttgaaactcaaaggatgagagagcatattacacgacttatactattaatctgattcttggttactgataaactcaaagataaactcacttgtagatttgtgctaggcacggtgagttaggattagaatttgttccactatacttgttggttcgtttgtcctgagattgaaatttaagatttgggagttatgagttcaagtttattcatactagtcgaaatttcataaattatataaactggggggggcgcatttgcaaaatagctgagtaataatcgcctatctcactgactcacccaaagcccgaccaaaagcttttgattcctcaagagtgaaa

SEQ ID NO: 4706 - DNA, 3000 bp, Unknown; identical to SEQ ID NO: 3705
  misc_feature (1)..( 3000): cDNA_ID_1821583_gDNA_ID_1620723_Annot_ID_165855 3000 nt of promoter + ATG

SEQ ID NO: 4707 - DNA, 3000 bp, Unknown
  misc_feature (1)..( 3000): cDNA_ID_2170289_gDNA_ID_1620724_Annot_ID_49244 3000 nt of promoter + ATG
gatactcactaaaggattatgaaacccataactgtccagagtcccataaaacccataactatccacagtcccaactatagaaaacactctaaccaagatttaatctactttagtcacttagatattttctttaatatatcacatacactagtagagaatataataaccaaattttgacaaaaattggataacgcgaagacaaaatttgccagctatcttcgggtcagctattgaaacatagacataaaagcagtacaccacatgcatacaataacattttatccccgacggtcccatgatgctttggagcttggacctaccaataccaaattccatacccatagttattactacttatcaattattatacgtgcatggttccccaaatcttctttcttctttcaaaataaaaacttgatcaaaaagatgacattttgagaattcactccaattcagatccaatcaaataggcaaaaaaaaaaatgcaattctatttttagaatactatactttataaaaataataactatagtcaaaaaaatttgaaatgtaatcactcacagtatttgacagttaatcatcaaactcatttccagagagtagatatagaccactcaccaagaaagattagtaaccattaattcattaataacatttgactaatgagctaatttcaatttcaaatcagcaactaacgaattcgtcactcattactcatttcaaatcatctcataccaatccaatttcataattcaaaattcacagtgataaaccagaaaatttgaaattttacctgaacagctctaatcacagcacctttagctaagtaaagagtcatatggctagtgagattgaagctctccgtcaaatacactcccggaggtatatacaaaagcgtgcctcctctcctcttcagatgctgaatccgataaatcgccgccctaaacgccttagtattcaccgttcgaccatctccaacgcctccaaagtcggttatcgagatcttatcgtaccggtaccgtaacggaactataccggaacacgtcgcctccgaatcgcccaacgaagacgaagaaacgaagagacatgagaagaggaaaattgacacagagagtctccacattttcgatgaagagaggtttatttaggatgagagtaaaatctgcagaattggagctaagattagtatgatatagtcgacactcgacaacgttcaatagaagaaggcacgtgctgatacacgtgaatcaacgggccatataagctagaaacgtttgggctttagtggcccaataaggatgaacaactttttgttttttgtttttggcggatttttttaattctttgattttctattttatttagggtttttattcttattatataaaggttggatcggtttgtgaaatttggagctaagatcagagatttcagcgatttggagattggagatggagagtcctttggtgcgtctatgcttaaaggaagcttgtaagagcggagatgcggtggaacgatggcgacttcagcggcgtagtcttgagagtctgcctcctcaccttgctgatgctctcctccgtcgcctcctcaaaaagcggcttcttttcccttcgttactcgagtaaactcttcacttccttacatagttctgatcgtttctaatatgaatctgatttctgatctcgaaatgctgagctatatatatatatatatgcttcgatttgagatattgagtgatcgcttgggatcttagtttttaaatttgattagaattttttttttttctgtattcatgttgaaataattattcctgaagtgtttagctgtagaattgtgttggtcttggtacatcgttgcggaaaatgcaatgattgcatggacactgaactattgtatctgtatcacacaactaaacaagactcttttctgtgcagaggattcaaatattctgtagagaatatagatctccgaggcaaaagctcagttaacgcagaatggatggcttacattggaggcttcgttaatctaattactctaaatctttcagattgccagagaatcaacagttccaccctctggcctatcacaggtatgttgagtgatatactccgagttttggaatggaagtttaagagaaatttaagtgtttaatatgtgatattggattttcaggattaacaagtttgacagagttggacctttcaagatgtttcaaggttacggatgctggtatgaagcacctccaatctgttgtaaatctgaaaaagttgtggatttcacagacaggtgtcactgaagttggaatttctcttcttgcttcacttaaaaaattgtctcttttggatttgggcggcttacctgtaactgatcagaacttgatttctctccaggtattacctgtgctctttctttattgtagtcattagggttgttttaattgcatgatgtatgttattgaactgtgtagttcaatagttatcatctatctatctagttaaatttgttagagagctctgctaaaattgtaaagttctaggtactactactatgttgagtatagagtataatgtgcacagaaactatttagtcttcaggattctaaaattcaaatatcatttcctggttattaaacccattaatccctacaaatgaagttcaagtgtatgttcaatatagtttcttgcgtgaagatgtttgtatgcccgaattcacttattaaaaacatgcctatttttattttatttttgtcactgaaaaacatgcctatttgtaataacatttaatatgtagacgatcaatctttttttagtttttctgaccgccattttctttattgctgctcaggcactgacaaagctagagtaccttgacatctggggaagcaacgtaaccaaccaaggagctgtcagtattctcaaattttctaacttgagcttcctaaacctctcgtggacaagcatcacacagactccaaacattccgcaccttgaatgcttacac

SEQ ID NO: 4708 - DNA, 3000 bp, Unknown
  misc_feature (1)..( 3000): cDNA_ID_1825242_gDNA_ID_1620724_Annot_ID_49245 3000 nt of promoter + ATG
ggcccagcagactcctacaaaaccaacaacgaatcaagtctttttaaatgaagtggttcctgagaattgtaatcaaatttctttcatagatggtgacaatatataccattaaaccctggagtccgtcttggaagtctttgattccgtgaaggagctcaactttggatacgtggtctagattattcagaagatcaagtgcttcaccttcttgtttctccagtttctctgttcttttttccttcgccttcttctcgtattcaacaattgtgtcctctgcatcaagtagatagcttacctttctctgcttatacatctcaaggcacttttcgcatctgcataggatgttcctccagtttttggtcaaaaacaaaggtttcttctcaaactcaggacacgagtttagatcagtcctaataacacaaccagctgcaggaacattttcagagccatcgatcttctcagaacatttccgcacaacgaatttctcggcttcagtactgttctcaggctggccggcttcagattcatcgatcttctcagaacatttttgcacaacagatttctcggcttcagtgccgttctcaggctggccaggttctgagtcactgatcgtctcagaacattttcctacaacagatttctcagcatcagtaccgttctctggctggccgggttcagaatccatgtggtttttgtctaactcaattgtctctgaacaagcattagcagaaccagtggaatctactttagcaacaacccacaagttctcaggataaagtgtcagaaacgaacatgctggggagcagttttgacaaatgaaatcttcatagatcggctcactttcctcatcccttggaatctgttaacatcacataacaaattgcactaagcgccaacaacaaaaaaaatcaatcgtaaacaacaagattaagcactggccacaaacctggctaccaacactgtctgaaggtgtgagaccgagatgctcctcatgaaaccaatcctcacagagacaacactgaatcatctctacttgttcttccacatttgggtcagggtaaggtcggtcgcaagtgcagtacaagcctttgaaattatggttgtaagaattttcagagttttctatatctttgctcgggagaagcttacaagccaaagttccaaactttgagttcccgcaatcacatcgaaaatttctcttagtccacagctccaaaagcttcataaccagaacaatgttcaaccattaggaaaccaattaacactatgaaatcagatttcaaaatacataacctggctatatatcaaccatatttacctcatggccatcatgacaagataagcaacaagcagtgcaaattccagcattcccctctggtgtacatgtaatgcatgagaaaattgcttgccttttcatgtaaccctttgggaaagtacactcatctccttcatctccacccaacaccaaatccgctgccttaacatcaagaatcacaaaagcagttaatgaatattaaacccctaaacccaaataacataggattacagaaacagatacacactactgaaattaatagaaactaattaagagacacacactatcattactagctagccaaaacctcagagactgtacaataacaatccaacacactccactagcttcagaaaaggtagtcaatttaaggtcagaatccaatttcaagacgtttgtttacacttaaatctaaacgatttatcaccaaccaaggagtgaaaatgtggaagagtattaaactttcgtaaggatcagaaacatacataagctttaaaactgatcaagaggagaaagagaacattaccagctcttctgcgtcaagcctttcgatatattcattgatcgttatagttccttcagcttcatcctcgaaaacaccagatgccattgtcgcaattattcttcacaaattcccacctgaattcactactaaaaacatgaaattgggtaaaataaaagctattcgaaagactcaaacgagatattccctaaattccttaaaaaaaatgaaaccctagattattcgcaaaacatcaaacatgtcaatcggaccattaccaggttattgatggagttctcagacttgtaaaagccctaaagcttttcacttttcaagacatagataaacgaaggcagagagagagagaaattggggaaaacgaaggtggagcttaagggtttggaagaaagaaggatctagcggatgttaaaattcttaaatgcgagaaaatttatgtatgttatataaaggaagggactttatcgacattttcccgccattaaccctccaattctattacccttttccctccactatcagcaactaagcataagcacaagataagtattgttacttgataatgtacatgttaatattaatttgtatcgagattaaacggatatcaaaatctcaaattcttgcttatatggttttttatgaattgaaaatttatatttatttttttgttttgataactaatgtttaacaaatatcatatctgtgtgcaactagtcaaatctatccacaaacacacatactaatagagtaataagcatatttttaattatcgtagattaattgataacctctaaaaaaaaaattaaattgggggataaaatattgataaaatctaaagttatttaaatcaaaatcacacactttttgttttgtttcttgacatcttaattataaaatctaaatattggctaatataaatttcaatttggataatatgactttattgggcctaatatgatgatacgtatacggcccaataagaggttgaatatgactttgactttttcaggtttatggtcagtgagtagcaaccaatcgcagtcgtagttgaaagtctctattaacttcttctccgatctgagaaaacgcgtcagaagtttctcgttctacagatagagagagaagagaacgagaacgaagtagagagagagagagagagatcatg

SEQ ID NO: 4709 - DNA, 3000 bp, Unknown
  misc_feature (1)..( 3000): cDNA_ID_1825238_gDNA_ID_1620724_Annot_ID_49246 3000 nt of promoter + ATG
atcactccagcgattagagtcacaatgctttcgttagatatcatcactccctttgggtcaccagtggttccactcgtatacataatcgtgcaaatgtcgcttttctttttgattgggagatcatattgctttccttcaccctgggagaaatattcgcaatggaaagtataaacatgataagcatagttataagaccactggaaagaaatatcacagaatcagtatatttcaggacgagcaaatgtcaagtctcataccagcttcaaaaattcatcccaagcatatataaccaacccaaaagtttcagcttcttctttttgttcacgtgagacacccccgaagctcacaacagctgtaattataatcacgtacaattgatcataagcacactatgttaacggcctaacaggcctaacacaagaaaaaatcactcacttttcatgtactctgtcgagtttgggcatgtcttgaacaactgataatcaaaattcaaaagcaagtggtaagaagaggttacaaaaatgtaaaatttagcaacggtaatcaatgcatgaaagtgataaatatatatttcacacaaaatatatattcttactgtacctcagagatcttcttctcttccacaaagacaattgaaacctctgaatgggaaatgatgaattccacagcatcagcacctataaaattgacacgcaacaaaaatgacaaataagctagctaaaagatttgtagaagctcactggaaatctattggcgaatttatccttctagagtatattgggaaatactaaaaaaggcatacctagtgtatcatataacggtacacaatagagtccatgtgcattacaagcctacatcaaaagtgcactgtcagtcctctaacaaaacacaatcaatgacataatcatgattcagccgcaaaattacctccatgctgataatccactcaggagaatttgcaccatagataccacattttgcttcctaatatcccacatatcaggaaacacaagattaagcaagggaataatcacattgcgacaaaaaaaggaaataatgagactgaatatagatatctgaaaggaaaaagatggatcttacgtccttaactccaacacttctgagagaatttccaagtttcatgacaatgtcgtagacttcttggtatgtttgccagacatacttacccggctaagaacaatcaaaataacaagtgaattttataataacatgaaacgaaaatcacaaaatcaaaatcaataacaaacagtaacaacacctttccatctacaatctcgcggcgtcccagcattggattgtttggatacttctcaacagacatgctgcaataaacaataacagtagaaaaatgtaagtcaacaaccacaaaatatcaccaaaccacacacaaagcaaaacaaaaaatgtcaaccaaattcatgcaactgttaattaatcacatgccactcaaaacgatgttattatagacaaatggcaaaatcattaaccaacaaattatatttctatcgattagagcaacttaggtagatcttgcgatccgaaaaacttaaacaaacatgaatcaaatccagataaacactagacgaaattaaactatacgattcttactacttgagaatccataaagagcaaaaaacgcaagtcagaacaaattccatgatcagtcaacagatcaaggatcaaaatctcagcaagaatcggaaacgaggctcatgcaacacaaactccgatcggttaaacgagaaatctcaccggaaaacatcccaacaactatccattccttcgatcgggtcgggaaatccgtccttggcaaagatactccggtacactggaccaactgatggtcttccatcgctaccttctttgccttcttcaacttggaagatgtatttcttctgctgcgacatgatctctctctctctctctctacttcgttctcgttctcttctctctctatctgtagaacgagaaacttctgacgcgttttctcagatcggagaagaagttaatagagactttcaactacgactgcgattggttgctactcactgaccataaacctgaaaaagtcaaagtcatattcaacctcttattgggccgtatacgtatcatcatattaggcccaataaagtcatattatccaaattgaaatttatattagccaatatttagattttataattaagatgtcaagaaacaaaacaaaaagtgtgtgattttgatttaaataactttagattttatcaatattttatcccccaatttaattttttttttagaggttatcaattaatctacgataattaaaaatatgcttattactctattagtatgtgtgtttgtggatagatttgactagttgcacacagatatgatatttgttaaacattagttatcaaaacaaaaaaataaatataaattttcaattcataaaaaaccatataagcaagaatttgagattttgatatccgtttaatctcgatacaaattaatattaacatgtacattatcaagtaacaatacttatcttgtgcttatgcttagttgctgatagtggagggaaaagggtaatagaattggagggttaatggcgggaaaatgtcgataaagtcccttcctttatataacatacataaattttctcgcatttaagaattttaacatccgctagatccttctttcttccaaacccttaagctccaccttcgttttccccaatttctctctctctctgccttcgtttatctatgtcttgaaaagtgaaaagctttagggcttttacaagtctgagaactccatcaataacctggtaatggtccgattgacatgtttgatgttttgcgaataatctagggtttcattttttttaaggaatttagggaatatctcgtttgagtctttcgaatagcttttattttacccaatttcatgtttttagtagtgaattcaggtgggaatttgtgaagaataattgcgaca

SEQ ID NO: 4710 - DNA, 3000 bp, Unknown
  misc_feature (1)..( 3000): cDNA_ID_2999785_gDNA_ID_1620724_Annot_ID_49250 3000 nt of promoter + ATG
ctgaaccggttaatgcgtaaccggtgtttggaataatgatttaggagaaagagtaggaacatttgggctttgtcataagtttaacctggaccaagtttgaatattcttaagagatatgggcctagattaaaaacaatggtaatgtaattaaacatattgctaaatgctaataatgtggatttgtttgtttattaagaaaaaagcagcaagaagaagataaatcatttgggtcaacgacattaataattggaatcccatactcccaaatcataattagacatacacttttgtcttaggctgtcctttacactcatcggcatcaccaaatacttagttggcaactttgatcaattaatgtattaagcatgaatgaaaacaacttttacattgattcgataaattcattatattgtagataagattagtcaaaagtttacaaacattcgttaacaaattacaaaacttgtaatatctgcagcaatgcccatgtgggtagagctggctgacgcaacctaaccgggggataaaagcgtctttttggtaccaaatttaaagtttctttatgagtaaaattcccaaacccaacatcttcttcctgctgaagcagtaagcactcaaccaaaaaaccaattgcgtaaacactttcccttgaatacagagatcacattcgatcaggtaaaaacaaggtctcgatcttctcttcagtcaattttttcaaattattcgaggttcccgtcattcgattccgacttccgagcttctatttctgctcaatgtttttgtattttgttagggtttccagaaaattcgattctgttgtttttaatttgagctaataaaatctagaatgggaaaaagaaagagttcattttcgtcctctttctttttgtagaagctgaactttgtttttcttttacagcgagctgatttctcacaagggatatcaaaatttctggtgaagtgggattgtaaaattcggcgttgaaagatatataaagaggtatgtttgatcctcagtgaggaataaggatttttagtagttatatatctctccaagtgatgatacatacatacttgtggattagatctatgataagaataagcataagatagagactgagagacaagtcatttagggagattaaataatgttcatggaatgctaaagttcatataggagtttgtctcatatcagaatctagattagatcatgctcagatgacatctcttgaatggacaaaaaagtttttaactatgtgattttttcgacttcttttggggaatcaatgtactacaagctgagagttttagagtagtttcatctctggctaagctttgattcattttctagtggaaggttctggagtcgtttcaattcatggatgatggtactcctaagaagctaaacatattacctgatcactttagtgctcctagtcccacagcagaatcttctcagcacgatactccatcatcttcgcagccaaaggacgatagttctctgaggtaaattgttagcgaataaatatgctaagaagggaaattctgagctgaaatgaattgttttttcgggtggttttgtttagagtaggccttatagccagtcacggactcgcagaaacctgaaaagagcagcaactatgttgaatttgttcactcttcgccgtctgccttgggtttcagatggtcaagagaaggttccattctctcacacctttcttctttgtttttgattcacctcattgaagtttcagggttttctcctgaatcctgatcactctctcattggcaggtcgagctatcagcagcggagttagaatcacttagatcagaactttctgatatggaagaaagagaagcttacctcaaagcccagtaagtcatatactcaaatttgttccattctcagattaaaagcgcatatctcaatttcttcttgctgaactgctacataggttggaacatgtggatgaagtcttgcgctctgcccgtttatctggttatttgtttatcagaagtgtagggccttactctgaattacttatcattattgatccactaggatgttttacaaatttgccttatttttttgtttgactttagcgttgggcagctcttccgggtgaaccaccaccaatagatgatacagaagtagacgactggcttcctcggtttgtcgtccttcaaggcccttgtcttttcttctatttattgtcaacaggtgagttaaggttcagcttttacaatcctgtttcaaatttgtattcttcttgtaatgtctcttgaaattctctattgcagacttgagccctcaagattcgacattgctagcagatattgttgaaattggttcggtaccaagctacacgagagaattcgatgaaacccattattgcttttacatattaacccgtcaaggtctaagatttgagtgctcaagcacctctaaaacacaggtgaaccaaatacatatacatctttacacacagattgttgttgagagatcccacagcatttgaacgcaatgatttcgcggttttgtatggttttaggttgattcgtggttgtcggttttgcgccttgattgcaagtctgaaccagaagaaaggttatcaaatggatcagtcgaagctccagaataaattgaagagcggtcactgctctggatagttttcatttatatgtatataatgcttctttttagatgtagtagaattcacgtcaatgaaaggttcttttactgaactggtggttacaatatttttggtttacttcttttagctgctaaagacattggaatatattcgtttcttgaataggcaataattctagttggaaaacaaaagtgattagaaaggcaataaatcctgagcctttaagtccttgtctgatccgacccgatcaaaacatgttggtataaaatcttccaataggttcacatttttgaggtccctgtttgcacatcactcttctcagtcctcacgcatcgtatcagagaaa

SEQ ID NO: 4711 - DNA, 3000 bp, Unknown
  misc_feature (1)..( 3000): cDNA_ID_1825234_gDNA_ID_1620724_Annot_ID_49251 3000 nt of promoter + ATG
aggttgattcgtggttgtcggttttgcgccttgattgcaagtctgaaccagaagaaaggttatcaaatggatcagtcgaagctccagaataaattgaagagcggtcactgctctggatagttttcatttatatgtatataatgcttctttttagatgtagtagaattcacgtcaatgaaaggttcttttactgaactggtggttacaatatttttggtttacttcttttagctgctaaagacattggaatatattcgtttcttgaataggcaataattctagttggaaaacaaaagtgattagaaaggcaataaatcctgagcctttaagtccttgtctgatccgacccgatcaaaacatgttggtataaaatcttccaataggttcacatttttgaggtccctgtttgcacatcactcttctcagtcctcacgcatcgtatcagagaaaatgagctcccaaatctgcagatctgcttctagagcagccaggtctcttctttcttcagccaagaatgctcgtttcttctccggtacgtaaattttctctctgatcctcttttttcctgaaaatgtgataaacgtcatgggatgatacatctagatagacgtcaaatattttatgaatctacctgtggttttcttcgttttctagattctcgattgtattgaatcagtgatctgttgtatcgtttccaatctaaaatatttgatcgaagcttttacttgatcctacgtgtgttcccatcaagaaaataaattgtttgtttcttgtgagagaatacttcttgctaacacattttatgtgaaactattggatacacaaatttagactctcatattccggtttttgtctcatcgttgctttgcctacataagacttcttattgattttcccattaatataaagaggatgtttaagatctgttggttttattattcacatatgaacagaagtcacaaaccgtgtttcgtttacattttgctgatacgttgattattatatgttttcagaaggccgagccattggtgcagcaagtgtggtgcatgcgactggaaaagtccctcagtatgcatccaactttggaaaatcgggttctggcttcgtctctaatagctggatcaccggactccttgctcttcctgctgcaggttttacatgcataatgtttcctataaatctgtgatttactgttttatgaatatattctacaggacacattcaaatcttcacttttgtaacacagttagtgtaaattaagcctttcaacgttttgactccaaaatgatgtctaatatcagttatacgtgcaagacttatagctgatgagcttttttgtttatctatattcatgttttactttgatgtgatgattaacagagccttattatattcgccttgctttcttttttatcatttctgttatagccttcatgctccaagatcaggaagcacttgctgcagaggtaactgatcaccaaaccaaacacacatatctctatatctttctcttgtgttatccctggtttctctgtttaattggatttctctgttcgaatcagatggaacgcactttcatcgctatcaaacctgatggagtgcagcgaggactggtttgttacttgttattctcttgtaatttcatgtcttctttattcaaatgctcaaaactcttaaatctttaaactccctccagatatcagaaatcattacacggttcgaacgcaaaggatacaagcttgttggcattaaagtcatggttccttcaaagggtttcgcgcagaagcattaccatgatctaaaggagagacctttcttcaacggcttgtgtaacttccttagctcaggccctgttgttgccatggtaaagaagcaactctcacataaaaccgacttgttttagctctaatgatccaataagacattgtttttaggtatgggaaggtgaaggagtgattagatacggacgtaaactgattggagccactgatcctcagaaatcagaacctggaactatccgaggcgatctcgctgttgttgttggaaggtaccattctatttttatgacatatgtatatatgattgcttgtctgttttctcggagattatagttttgcttttgttttttgggaaattgcaggaacattatacatggaagcgatggaccagagacagctaaagacgagatcagcttgtggtttaagcctgaagaactcgtttcttacactagtaacgctgagaagtggatctacggccagaactgaactattccctctttctcccttattttcaaccgttagatcagacataaataattacttcttttgttttttcttttacccaaacactgaaaacgtaccgggaataacaaatttactgcatttgttatcaagtttgttctaatagacccaatgaaattaggccacgtgtgcgatcatgtaaccggtttaccgtaatgtggacttgaaatccgattagcaagcgtaatgttgttttaatttctcgttggaatccgccgactccattataaaatctcagagaactagttcagctgcgagttgactcgttcatcggcttcttcagaacgatactttagcttcgacctctctctccgatcatcttcttcgtcgctttccctaatcgttttctcttgcaaggttcttacttcataattcgtaagagtttcctcctttcttgacgagtcctgatataggttttgattcgtgttcaattgaattgttagggtttagtgcttctcagggattcggggaacatatacttaattgttttcatttcatgcttggattaaatttctttatcttccctggattcgattcttcctttatcttctatcttttgactctcttgactaatttctcactattgtaacggagttttgtttgatttgtgtcaaatttttaaagaacagtgtataatttcttacatatcgtataaaagtttgtgtttttttcggtaaaagaatttgctttgtttgtgcag

SEQ ID NO: 4712 - DNA, 3000 bp, Unknown
  misc_feature (1)..( 3000): cDNA_ID_3409311_gDNA_ID_1620724_Annot_ID_49252 3000 nt of promoter + ATG
tgaccaggagatctgtcaagagcatgcactttttctgtctagtttaattggaatttggagttgtgtcagtgtcttggcgcttttaacactgggaagtgaagtgttgcatccttataatgccatccttctttgttacttggataactggatttcgcttagatccttctatgtatgaagaggttcagcttttgttgctaacaactcgataacagatcattttatctgttgatgccagtaccgtctgtacgtcttttctcggttcctcagcacttcttctttgtttttttgtgcaggcttattgctccaccagttcaaaatatatctgtacaggctagagtcaacgcaaaggtaacttactcatgattatctgttaggttgcattagactagcttcttagtatctctcccttggacgagtattcgttttgatatgtttatgggggaccataagatgtgcattttagccttctgctgttctgcatccgtagctatatctgcctgttgatggtagggagtatctgaaaggtttatgaattgaatgtggttgtaaatctttatgggtttgtaaatcccagaccatggaatgtgataggggcttgatctggtaaatgcttggtgtgataactgaatcgaatatcactatatccaataactttatactgaatgtttggagggctaataacaattgatcttcttaatctgcagaggcatgaggtagatcagaaagtagaacacagaggagggaagaggaagacactggactctcgctttgcaagcatgaaagagcagagaatgacgattaacaactatggtgttacagtgcaagttccaagattaccaccatgggttagagccagaagattttcccaatgagaaaccacaaagcttttacgggttgttccagtttagaatttggcttttgggtttagaatcttgttaagcaaacactaagcaatgcaattcttttgtaaacatattgacttttagtatcatgaaagaattttttttgagtcttggttcattatatagtcgcatttccacatttctgtcaattacatgtttgcctctaagtgagtacgcgtcgtcaagaagaaagcctatcagccaagtatgtcttaactcttaaggaatgcttcctgtataatctagacaaatagagttgtaacatttaaatcttcaaaattgggggtgtagctcatatggtagagcgctcgcttcgcatgcgagaggcacggggttcgattccccgcacctccaattttgttttttgttatttctgtatcttccgttccttgtatatgtggcctcagttaattcaggcgaaagaaactcgcaactttctctgtttcctccattccactttttcgaagatgtaactaatttacttaaggaaaacaataaattatgatctttagtaaatatggcctattccaaaaactgaaccaaacaaaatatttatgtttgattttgagttaattacacattaaatttttaatcacacacccagaagcagctaaaagacttcgacctaactccatcatataattatcttttgaatttatcttgaagaccatatataattatggcccaaagactccaaactgactctttgtttttagtgtgacctaatcaatatcactttcatatgttgtccaaaaaaactatacgacatacaactcgttctcatattttacagtgtacacttaacactttggtcacacgtattacgtaccgacatatttatatgcatagcttgagtatggagactgcgtcaaaaacaataaattaactatatttaaagaaacttggcaatcatctagtataaaaatagtcgattttttttctcttgtcaatccacgttaattaatctatgctttattatcaagtgaattaaagaatttgacgtaaaactggtgtattcaatggattaacattgaagcttattcacaaagtggtcggctattgatttactccttagacttgctctaattttctttcttaagctttttaattttggtacgtcacttagtttgacaagcggagctgtttaagtgaaccacaatatattaattctctaaacgggttattgtacaatatattaaatcaaaggaagttacgatgaccaaattaactttcataagaaaggaaaacaaatattaatttggagtttcaagcaatattacatctatatacctttctattggtttcttataatgttcacgagaaatgtaggaaaactataaagtataaactgaaaacagagaaaaagttgataaaagaagaaaataaatatcacacatttcttggctcatcactcaagtcacggaaagtctttggagaagtgtagctaccatttttgttcattttattttggatagaaatttaacacacacttaatgatatggtttgaggaaatagcttatattaacttacctttccatgtatctatttatattttgcttaataataatgtaaacgcaataacatatattaaaacaaaggaaataaaatcttaatatatacctaaagttacacacaatcttagaatgctagcatactcaaatctcgtgaccccgaattttctggaaaaatcaattctacttcttctacctaaacagtttaggcttacaaatccatccaaatttatccattcgctttgttaaatcttaattgagcctaataaaataacatttgttaccaaaaaaagaagatcaactatataaatacacttccattaacaaaaacgtcaaagggtaattaagacaattcacaacattccggtatattcgcaaccaaaccaaatcctgccacgtagcaattatttcctcttcatttttctctctgtctccctcgaagaaacgtagaaatcagaaagtaaatcatacagtcaaaaccgcttcttctataaaaccctttttagctcaatcccaaaacgcaataaaaaacaaaacgctctccagaatttcgaaacttctaagatattttgttttctctcttaacg

SEQ ID NO: 4713 - DNA, 3000 bp, Unknown
  misc_feature (1)..( 3000): cDNA_ID_1830941_gDNA_ID_1620724_Annot_ID_49254 3000 nt of promoter + ATG
aagaacaaagaaatcaaatttcaatactgaaaaatcaaaattaggtaaatttaatgtaagtgaactaacaatttaaaagaacagaagacttacaaacatgatacgatcaaccggcagtaaagagatgacggtccaaacggttgcgtttgcaaacattgcaaaccctaccaagaacgacatatgttcgacgctcttagttcttacaactttcacttgcgtttatcattatttcgttgttaattttttttcgtattagtaatgcgaggatatttattaatctttgatattcataaactaaacttaccaatacagacaccggagaaaacgcaacagacgtccacaataacaaatcaccgaagacccaaagattcgatgaaacctaaagccaacgtggcaaatgtagttacagataccacctcgagtaccaaaatgataatcactaatcgctgcgtagagtgcttgcaaaatctaatatatgcggccaaatagatccccatgatcaagactccaatcccattagtgatgagggtaggagtcccaataaaaaaaaagacttacaaacataattggatccacatgtagtagatagacgatggtccaaacgattgcgtttgcaatgtttacatatttagcttgtttttgttccacatcataaaagtaattaaagaaatttttattaattaaagaacaagttctctcgaagatcacgaaggagagaagaaagtgcaatctttatagaaatatgaaaagattagatgatagtaaattataaagatatagatacatgcataacataagcaaaatatatacataacataagcaaaacataagcatattttgtttatgcgcatatcacattatatagactttgtttagcaatgtaaacatcataaaattgattcattatgtagagtaaataagaagaagacggagaaagcggtaaaaaaagatagataagaaaacataagtatatgtcttaaataagaaataataaatataggttatggtaggccttggcaaaaaaaccgtacctgaaaactcgaaccgaaaccgattcgaaaaaccggtttggggcgggtacgtatattagctatttaccctattgggttttagattgttgtacccgtggatataggataatagccgacccaaacccgatacccgaaagggtatcaacttatccgaaattacatatacttattcatagatttatacatataaaaatttattttatatttaatatttgaaccaaatacatttatatccaaatatccaataataattactaaaaactaaatgtacctatatttaaatacttaatactaaatattttatatatgcaaaatattcgtaaatgttttggatatttggacaaaatttcggttattcgggtaaaattcagatatttgggtaaaattttcgactatttgggtataatttcgggtatttgggtaaaattatcgactatttgggtacaaatttcgggtatttggtacaatttcgggtatttgggtaaatttttgggtatttggatataaaatacatgaatccgaaggatacccgtttttttcgagtatttaacggttctaaaattctatacccgaaccaacccaaacccgattagaaccgaaccaccgaagttttctatttactctattggattctagaacagtatacccgtacccgatcgggtattacccgaaccgacccgcatacccgaatacccggccctacgttatggctataagtgtatttactatacagaaaacgttaatccaaacaaagaatatggaaagcatgcatatctatgtagactaatgttaaggctattacaattggcaaccgaaaatttcgtgttaagttgtaatttagtatacgtacaaaatctaaaagtacaatagctttgtattaatatttgcaattttctaacttgatggattcagaaaagaacccaagaggtttcacttcacatacatgtatttttgaaaaataaccatgtcacttttacaattgttttttaatattaacaacggacggctacgatggaaccatcactcgaggaaatcgcgatcctacaattacatttagccgcgattcggtgagtaaacaaaccgagaacccgaacccgacccgccatctccagcttcgactctatttccactgttgacccggaccgatccgaattttgaaattgggcggcggagatttgagaactagaggccgccgcgagaggaaacgactgaacggagaaagtagctaacatacgcttggttcgacccgattcgatctcaccagcaggtacgaaggtataaccgatccggtttccatagtaaaagagctggattacattgttgtagtgtgagaaagctgcgcggttagggtttctaacggcggagaattgagaaaaggtgaaactaacggagctattagcgacggagaatgaaggaaccttgacgctagtgacggagatctcaggatctctcggtctaaagactgtgagataaacagtaagtgcggcgatgattaagaagactatgaagagcgtggcgacggcgcatgaagcgaggtttgaacaagacttcgacatttctcggtggagatgtttggtagcgatgatttaagtgttcactagttgggataaagagtttatttttggttaaagggaaagcaaaacgacgtgtaaaagcaaaaggatgttttgtttggacatagtgataacgttacaacggagtttggacttaagtgtgtgtgatgcagcgaaggtggccgactagagctaaataaattattttagtgaacaaacaatgtacccggaacagaaaccgggtttcgaagtcgggtcgaattgttgtaatttagagctaacagaacaaaaacctcctgagattgaataaacctccgattgctctattttcttatccagaacgaagagagattcaaatttcgcaatgcgattctagtgaagcttctttttcttctgtacatggttatcgtcgtaaa

SEQ ID NO: 4714 - DNA, 3000 bp, Unknown
  misc_feature (1)..( 3000): cDNA_ID_1825228_gDNA_ID_1620724_Annot_ID_49256 3000 nt of promoter + ATG
tccctgaacatctccggcgtgaatccggcgactttgtccttgttaatcactctaccgacgtcaatgctcaagtatgattccggcgtcccagagacatcaaatcactaagcttaggtttattcattgtccgtcattgtaacttcgactcaatctctgaagtttcggacagttaaatttacagaaataaagaaaaaaacttgggtcaaagacacttctttgatttgctaacaatagattagacaaacttaagtataaatttagaaacaaaaaaagttttaattccgaggaaatcgacggacaaaaagtttggttctttgtttcaaaccacacaagacagcaacaacacgagtcatgcactctctttcttaccttttttcttcttcttcatccgtcttcttttgctcttgttcctcgtgccctcttctcggtttctacagatacaggtcatagtcatacaaccaacgatctctcttgactctctccatctgtgcatgtcacacacgagtatagatctcttctctgctttatagatatggcgaggcgcggaagctgttcgacgatatgcctgaatgaaaaattgcaaaggtttcgaattgtcagaatctccgacaaggctgataattttaattccagaagcggcagcttcttcgagcgttctatctctctcgttctcttactctggtgcttcctcttcctcgtctactccaagcttggccaaagccatgatgattatggtaatgcaggtaagtgttcttccttgtttgagagagattccgttatcatttcaaatgttaattaaggaaacaaatttagggtcttttaacttggggggtatattccagagattgctatattgtgttcctctgaagaaatcaatttattttgtagatagaattgggaattacactgatggatcagtctcaaagacactgaattccacgagttctgtcttccctcaggccactgagaaagaaaacaacttttgtctcctgagaaaaggccagttacaagatgtgtatgagcatgttcttgtgaacaacgctttgttgatctgcaaagttgtgttgccagaacgaagaataagcaagaaaactctggaagctcgtgatcctagatatgtcaatcttgaagacaagagtctcaaagttaatggctcatcacagcttgtgaataatgggactcgttataggttagaaccagatggaaatgggtataactacgcttctgctatgaagggtgctaaagttgtggatcacaacaaggaagcaaaaggagctagcaatgtgcttggcaaagatcatgataagtatctaagaaatccctgttcagtgtcagataagtatgttgtgattgagctcgccgaggagacactggttgatacggtgagaattgcaaattttgagcattactcttcgaatcccaaagagtttagcttgtcagggagtctgagtttccctagtgatatgtggacacctgctgggagttttgcggctgcaaacgttaagcagatccagtcattccggctcccggaacctaaatggttgagatatctgaaacttaatttagttagtcactatgggtctgagttttactgtactctgagtgttgtggaggtatttggcattgatgctcttgagcaaatgcttgaagatctgtttgttccatcagagactcctcccagtaaaccagctatggtggaactaaaaactgcagatgaaaaacaagatggggaaataaaaagcaataggacagatcagattggcaaagaaactgaagctcagaagaagaaagatgatgttgtgaagacgattaatatcataggagacaaaaagtatgaagtcaaggagaagcataacgttttgaaagtgatgatgcagaaagtgaaattgattgagatgaatttatcgcttcttgaggattctgtaaagaaaatgaatgacaaacaaccagaggttagcttggagatgaagaaaaccctagtacttgtggagaaaagcaaagctgacatcagagagatcacagaatggaaagggaaaatggtaaattcaataatttcttatgattaagtctttgtccgttgaagaaactaccaatgaatttgatattctttgagcaggaaaaggaacttagagacctagagctatggaaaactcttgtagcttcccgtgtagaatcattggctagaggaaactctgcattgaggtcagtactcttttttattcctaaatagagaaaacagaggatttgaaatctcaagcggagagctatcccatgacttgaaacgtattcttagttgaccccatatttcttcttgtttcttgatatcagattggatgtagagaagattgtgaaagaacaagctaatctagagagtaaagagctgggagttctattgataagcctctttttcgtggtcttagcaacgattcggttagtctcaacacgactctgggcatttctggggatgtctattacggataaagctcgatcactatggccggatagtggctgggtcatgatactgctaagcagcagcatcatgattttcattcatttactctcttagatagcagagttaggcttaggtttttttttttataacagtgccttgctattaaagtttgtaaccctaggattaggagtagaaagaactttcattgataatattggacccaaactatcagtgacaactgattttctttagtgtttgatgttccaacttccataggtgtaaatgtaatctgcccggtgcttagaaaaccaaataaattgaaaaccaaaaataactaaaccgaaccgaaactgaattaaacgaatttcttcccaatttccaagagagacaacggttttgttttttagggttaaattttaaggaaccacaaaacaaaacaatccccttgatcctttgccctctttctcactattctcgactccaccaaaaaaagggtttaggaaatggtggtgtcgaagttcggtaatgataacgcggcgggaatgtcg

SEQ ID NO: 4715 - DNA, 3000 bp, Unknown
  misc_feature (1)..( 3000): cDNA_ID_1815496_gDNA_ID_1620724_Annot_ID_165914 3000 nt of promoter + ATG
aatggcttttacgccggataatgagaagctcgagtaaagtttttgaaaaaacgttagaatagtgattgacaaattgttgaatactataatattgaagttgatctttaggaattacgtcaatttagaaactggtcggtagcaaattaaaatgtgttgtattgttgtatacgtttggttacgtgagacttgtataaatttacttaattgatataactaaaaaaaaggacttggtgtggtcaaatacgtgagttaattgatgttgcgttgggttctttacacctaaagtttagccagcaaaatctgtttaaattttttaaaaaacttattaatttgtaagtaatctgtttcatggcagaacgatcatacatatatatatatacggaaatcttgaaagaaatcgagacgataattccagatcatgtgatgatggtctgatggatctcatataacttcccgaccactacttctgtattgatgtataaacgccaaagagaatggtgagggtgacatttcttgtctaaaataatttaattgaaatatttaaactcgaaattaaaagatgacatattctacaactaaaagtaaatgaggttgtgggttttctttacatttttaatcattttttatggttgaattttatgattatcataatcataatacacaaactatcgaaagtggaacccgtatcacgatttttttgcctttattttattcgttgcctattaaaattaaaaggaagactaatgatactatcgcctgttccatttagatcctacacttcatgcttttttatatttctccttttggacatctaacatgtttataattactatagcctttaacgaaattttaagaaataaagccagcctataaatgaaatacaaaacggatcatatttgaggaagaccaatgtacatatgtgttgttatttgaacaaaaatttgtttctaatttttttcgaaattaatcttaaaagaacaaatgattcttatcagactttcaacaatattgatcatagtcgaaactcaaaatttcaagccaaattagaatcttaaaacctaacaatgaaaatatatgatccctcgtttacaaaaaaataaaaaataaaaataaaatatatagatatgatccctagtccttatttccgtaccaattatgatattgagagatagttttgggataaccattttcgtttactcgagataaattcactcatcagtttaaaataaaccaaaaccattaccacataagattcttatcccaatttaactattatatttctgctaattaattgattacatgttgtgaagtataaattgggccaactatagaggaatggtgtttgtttatgttttattttggctgctagtgtggttttcttaacttgttagcaatcattttactttttgaaaaaattgttagaaaactattaatgtgaatagttatttactcaataaatcttattgttaaccactgagaatttaaagcatttaaacatctgattattttaattctatgttaattccaggcattaaattttaagcgtaatttatagaagaagaaaaaaaatctagttacattccatctaagataggggtacaaatccatacaagagtctatcttctgtaattcttagcaagttgaacatttcttaatttttattttattttatttttggtcaaacgttttctttaatacaagtggcaaagatattctataacagttataatcatttatagttagggattttttaatcattttgtagtatttgtttttctcttttttcctaacaaagtttttggaacttttgatcatctctcgattgaaagcgaacatataaataatttttactactgcaaatttttaaaaagttaatattcgactttataaaagagatgagagtcaacaaaacaaaaagcaactaattttggacgtacgaaatgctttgtaaatacattgatatcacttatgtttataatatcactcatcccaagtgttggtcaacatttctttgataaaaattaaactattcaatagaacgaaaaccacaaaaaaattataaagaattattgataacaactcttcatgttaatcttatatatttttttaaaaatatttgtttttaggttttaatacaaacaacatgattctagtttattaaactaattaacgcaacttgatggattataaaaatatagcttaactaatccatcaaattaacaagtgaatcgcactataattctaaaagaatcaggtaggtccaggatttgtcttttctccacttctcaatttcccattaataatcccgaaaaggcattacgtaataattaatattttacgctgtagtattattttatgataaacatttccaaattttccaacacttaatcataatttaaggattaaaggaaatttgattggtgcattcccaccacgagtttgcttaacgtgtcgttaaatgcagccgtcggacttgacaatgcaaaaatgctacataatctaaataattaactctcgcaataagattcactaataataacatttttaacgacgatatataattttacaataagaaaaaaaatatgaatctaatatttatttaatattaatttactccattatctgaataatctagaatatgtcaaatatccttttattattttgtagctgtcgaaactatggtgaataaaatctcgaggaatatattagaaaacaaaaaagatctagaggaataataatattttaaatatttggggcacagttgtattgtgaagcagagaatcggttctcaatatattatccgaaaatgtcttaattttaaattttgttttttgtttgattctgcgatattggaatcacacactctgccaatttgacctttctctctcgcttctctttctctatccaatcggaaagagatcaaccaacgatagaggagaagaagaacttgcatacgcaaaaaaactttcccgggaaaattccagaaactgctttggaaaa

SEQ ID NO: 4716 - DNA, 3000 bp, Unknown
  misc_feature (1)..( 3000): cDNA_ID_3073978_gDNA_ID_1620724_Annot_ID_165908 3000 nt of promoter + ATG
ggacctaactaatatatataagtgacatacacaaatccactaacgatagggtttttttttggtaaaacactaacgataggttatcgatagaaaatccataaaagttaatatggtaccagtgatatagaagtgacatgatctagatccgctcatttttaattgattttgagttgaaagtttatgaacctcaaaaccaaacaagtttcattctaggttaacttattagaattagtttttttttgttcgttccatgtaagtgaactaagaacaattagtttctctaatcttagataattatagctaatttttagaaacaaacttgatttcttgattgatacgaaacatagaaaatatcttctttcataattgatagtctaaagtaagatcattggttgtaaatcataatatatttgtttcctagtttgttataccgtataacttcattttatcattcaaaactatgcagattggattcagatatgggtctttagtagaagactactacacagggtataggctccattgtgaaggatggagatcagttttttgcagacccaaaagagcagcattttgcggagattccccaaaaagtctaattgatgtagtgagccaacaaaagagatgggccattgggcttcttgaagttgccatctcaaggtatagccccattacctatggtgtcaaatcaatgggtctagtaacgggagtaggctattgtcaatacgcatgttgggccttttggtcacttcctcttatcgtctatggattcttgccccaacttgctctcctttatcaatctagcgtctttcccaagtcatcagatccatggttttggctttacatcgttttgttcctcggtgcatatgggcaagatctactcgactttgtattagaaggaggaacttatggcggatggtggaacgatcaaagaatgtggtcgataagaggattctcttcacacctatttggcttcatagagttcactcttaaaaccctaaacctctccacgcatggattcaacgtcacaagcaaagccaacgatgacgaagaacaaagcaagaggtatgagaaagagatttttgagttcggcccctcttcgtccatgttcttgcccttgactacggttgccatcgttaacctccttgcttttgtctgggggctttatggtcttttcgcttggggagaaggactcgtccttgagctgatgctggcgagtttcgcggtggtgaactgcttgccgatctatgaggctatggtgttgaggatagacgatggaaaattaccaaaaagggtttgtttcgtagctggaatcctcacatttgtgctgattgtgtcaggttacgtcttcctcaagtaactggacccattatggttggttctgtcgtttcagttaaactaatattacatctgtattgtggtaattaggagagaataatgtgatgaatccatttctcacctcattttagaacatacatttcggtatattgcgtctgtattgtagtaattaggagagaataatgtgttgaatccatttctcacctcattttagaacatacatttcggtttattgtataagcttaaattagtaattgaaaacgacatacactatctattgatattttcactgattaatacgactgtattttttatatttcttaatggatgttttgagcacaatttagtaaatatgggccgtagagatatgctacttcgtcaaaatgttaaaacgtctttgagatattttgagatataatagacgataagacaacatttatcttgcttacttcgatctattgtatttatttgtatttataattgaagtttcaccgtacaaatactttatatttatcttaggtttataacaaattaattattccctaaagttttaaaataaaatatttccctagcgagctagtgggatattaattatcatactcaaagtagtcgattatagaaactaaatgattaaaattttacgtagtctggctctgtttttatctcaaatttctttgcaaataaaaacacaataaatcatatttacttgggagaaacttctatcacatattaatatttatcaagaaaacttcaatcatatttttcgtaaagtgttacttacctttatacaaatattccgtgtattcctcggtttacgattctttatgtctgattgtgtggaaaagtacaatcgatatttttgcaagaagttaagaagttggcacttggcagatgcgtgacgtgaatgaatcgtcaaggcagtgactctccaagccccagtcttcatccatttgacattttcgcatctttttcaagctagagaattttaacttaagttctccattgaaaatttcaaactatataaataaaactccacatatctcactaaaatctaacacgtgacaaaaatttaattacttaagtgtagtatatgttagtaattttctcaactcgcgagcaaacttcagttaacttgattttgataaaataaataacacatcaattatctgaattctttttaaaagaaacaaatatttcatagaattagtttttttttcattttagaattctaattgaatattacagaataaaaacttttacttactaccacacaataatagactttaaagttagttattgtaagtagaatgtattattttgaagttaaaatcgtgtatttatcgtgatgtaaaaatttaccgttctttcttataaactagtcaggctattctggtgttgaactacttcacttcacacgtgtcttttggagaagtagtttcattaataaacacttatctttaattttggcttcaacttttcaaaggcacataatgatcacactgtactgtatcatcttatctcataaatgagaaactcgaccataagaactgtctatagtgtgtatattcagaaaagttatcaatagttcaatactaagaaaccggcctatatatatatatttgtggtcactaatttctccaaaaaccagttgccttccgtaaaaag

SEQ ID NO: 4717 - DNA, 3000 bp, Unknown
  misc_feature (1)..( 3000): cDNA_ID_1825216_gDNA_ID_1620724_Annot_ID_165907 3000 nt of promoter + ATG
aaattgaaccgtttgtaaattcagaaaacgttcccaaatcagttatgctgaagaacaaaaggccccgtcaagttagtgaagtatctgcacttggtgaggcacaatctaaccgccactgatttgctagtacatagcttaagtttccttgctaaatctcacatgctgtgtttagatgtaggcataacagcttcaaacctttggagctctgttttgacgcaaccccatgagtttgcacaatcgtgcatcacctcacagtggagttctcctcagcaatgtcatcgtgatgcaaatgaggatgctaagaaatctgactggctaaataactcttactctgtgtcaaatgtagcaaaagactcaacactgaacgaccaaatggtttccccagtcgagcagaagaagcctgagacaaccgctaattatagattatttggaattgatctgatgagttcctccctagcggttcctgaggagaaaactgcacccatgcgaccaatcaacatatccaaaccgactatggacagccactcagacccaaaatcagagatttcaaaagtatcagaagagaaaaagcaggaacctgcggagggatcaccaaaagaggtccaaagcaagcaaagcagttctacaagaagccgtaccaaggtatatatatgcctacatggctaccgtgaagtgtatatacattgtgtaatctgtgagttgcaaaacagatacacattatgtataatgtttgcgggactgaacaggatcctgaattctttatcgctgaacaggtgcagatgcaaggcgtacctgtgggcagggctgtggatttaaatgcgctaaaggggtacaacgagctcatagatgacattgagaagctgtttgacataaaaggggaactgcggagtcgcaatcaatgggaaatagtgttcacagacgatgagggagatatgatgcttgtcggtgatgacccatggccgtaagtaacttactctttatctcttagtcaatagaatcactacacaaaactcatatctgttgacttaatttggtggtgcagtgagttctgcaacatggtgaagagaatattcatatggtcgaaagaggaagtgaagaaaatgacgcctgggaaccaactccggatgctgttaagggaagttgaaacaacactaacaacaacttccaaaacagataatcattccaactaatttttattctattctctatcagtcttcgtctccttcttatttgctttgtctttcggaattatcttgtttgtgtctgtgttttgttgcgcatggcttaaacaagaaactacatcccctgaggcaaaaaaaatggctcgtttttttggagcctcttatggagaaagggggtttatggggagagggttttctacttttaaaataggcttttggaagtttctttttcttctaggaacttgtgtgtaagagaaacaaatatgtaacgaacagaaagaaaaaaaaaaaaaaaaaaaaaaaaagagaatgagatttgtgaataacttgatgaaggacttttgggactctgggattataagagattaaagagggattatacctcatggctctcgtgttttctgattctttttcgtagttgtgttttctttgattttgtttttcatctaagttttaatgtatatataaaatttcaaacatggctttcttgtatttgtcaaatccccaaaggtacatatattatcaatatttaaaatgttaaataaacaaaactctagacctaaaactatttcaggttttcccactaaccttaacaatgattcaagattattgatgttttgtctgtgaggacatgtatgtggccgctcttgccaccatattcacaaacgtaattgtatgaagtatggaccaccttttcgctactacttctggatccccttatgtttgtaaagtgtatcattcccttatatcactattcactcacatgcattaaaatatcgaatgctgcaaaggaaaaaagagttatttttctctttagatatcatttgggttatgcatattacttggattagtccaatatgtcgtgtacaaccattctcgctgcaaaacaactacaatatgtcaacatagtataacacatgctgatctggtgagattataaattgtgaagtttgtctttataatatgtacatatagtatttctttgattatgacaagtgtgtagaaaatgttaggatattattctaaatcccacatacgaaagattagataatgattatccaacatataagttcaatctaattttaattagtgtatcatttggggaaaaaaaatcgtgcatatctggttgcttggtccaaatatctatattttctgacggtccaatatttatatacgtaccacataaatacacctatacgaatctctttactaatacgtcgataccgttcatagttaatgacgttatttactgccgagataatgaagtgatgatgtaggttatttattgccgagatttgtgaaggcagtggatctcacaatccctatcttttcctcttcttttttttctttttttctttccatatatagagaagtttaaatttaattgtaccattaaaagctcaccaaataccaacttatacatacagtcagtatctatatcaggaatttatatgtatgtgtgtataccgaataatagtaaactcattttactaataaataactttgttttattatatatttgataaacaacttgttataaattattttaatatgttaaatttgaacttattaaattttaagtaatattctagtgacggaagtatacattgtatttaaattgcatagatgtaattacttattttaaaaacttatagcactattcagtgatttacttttccaacctaaaatcgaggtgtagaatgtctactctggaaaaaaaaatcgcctataaaatatcaatatcaatggtgagttttgttctatgtaccaagtttctctaaaacaatttgtctttctattaaaaataaagagtaccacg

SEQ ID NO: 4718 - DNA, 3000 bp, Unknown
  misc_feature (1)..( 3000): cDNA_ID_1839324_gDNA_ID_1620724_Annot_ID_165905 3000 nt of promoter + ATG
tctgaacatatcatattttttttttttaaatgaacatattcattgcttctagatttttgctgtcaaatatgagtaactttctgtgacgtatgtttttatacagaggtgaaaacagggaatacgccatcaagaagcagggaatcagtaacctactattttaatagaagattcattaccttgttaatcacgaaattaccttcttgctcatgaatcaccaagtcaatgtcaatgtttttagagaaaaaaacacacatacataatcatcaagtcaatgttcttgcaatagttatacctttagtttcccccaaaaaaatattagccaattaaatcaaacaagaaagaagatattacttaaaaatctctacaaaacacatgactacatgagcgagtgaattcgataagggcttgaagaagtggtatgccgattgactattgggttaaaaatagatgaacaattgagattcttagaattagtaccactaaattgactaaaaatcagtaaatgattgaactcatttgagaccaaacatgtgggagatatatatgggaatgaatgctttctaagtggacacgaaaattctatattacagttgagattcgtttgaacaagctctggggaatatacgggggacaagataccaatttattactaaaataaatacgattaaaatagtctaaattgagaaagagaagatccggagatggtggtggtgggttttaaggcatcttgcttatttatatccttaaagggaacagaaattgtcaaaaatacgtcatacgtgacgttttctgtcataattagtaatatactaaacataattaattagaactaaacgataaagtaattagttaattggtatataaatatatggactatggagtataggctttttcatctttatattttgcttattatttattaaaaagtttggcattattcattgccaaatgactacagcaaatatacgattttgatgcagaaatttaaatttattgatcatctaaagatcgcacttagtttactatacgaaaatccatgcactacactactagtgatggtacaaatgtttaggaaataaaattattatgttaaattttgtattgaaataaatatttgggagttataatcttatcatataaaaaaactaaaataaataactaacccaacatatatgtatatctacattataaggatttgaatttatatggtaaacataactatactaacaaaaattattatattacatatcttggttaaattagtaaaatagatttatttagtgtttttcgtttgtcgcttgtcatactttttgagttccttcaatttgagtatcataagatttttaggaaacttaatcttgatgttataagtgatattaatcgcttatttataacatctacttatttatccatcatcgatcattttttaacggttcaaaagatttcacgtatattaatgttcaaaattctaaaaaaaaaacatttaatcaaaacatttttttctaagtatttaagtaatttttccggataatatttgtttggcaacgatcaacatatatcatgactcaaataaattttgatgtttctaattagtaaaatgtggagttggaaaaaagttcttgcaaaaggtgaaaagaacaaaaatcagagatggaaacacttcccacatgcttatgttagtcccaccatttagtggtagaaatgtaatttatccaaagaaggaggtcaaagctgcttcgtctctaatccaagtctagccagtattgttgcctgcataagagcaaacggtaaaagtgacggactcttaacgatgacgggtgttactgtttaatgtctcttgatcgacttttgttaccgtaacgacaacggcacgcgccctcacgctccgtaccagccttaaaagccaacacatttatgatttatccagtaactaatactaattccttcatccactaacgcaattgcatttaattgtttagtacgtatagaaaaaaagtaaaaagctatttataattataacttacaaagtctctttcaattagtacagtgtaaaacaaccaattattttctatattatacagtataaaggtgtttatcatagacccattatttatttgtttttgactaaaatatcaaagtgtattaaaacataaaccaaataaatttgaaattaaagttttttttttttttgtaaaattaaaactgatttttggtttaaatagagaagcaaagctacgcttttttttttgctagctctttttttatttaatcaaacaaaaattgaggaaaacaattattgttgtgctaagcatttctatcatatatttttttataaacaatacatttaatttcaaaataactttctactttcttcaaatcaagctatttcctagaaatttggtactgtctggataacaacatgtcttagaaagtatagtaaggaatttacaattggttatacaattaatgtatagcgtattattatatacgaaaaggtgtccaattttagacatacatataaaatcaatttattaaaaataaaagtattgaaaaaagagagagtgaaacggagataaaagcaaacggaggtgttaacttaaagacgggagagaagcgagtgagagattctttcttgtaacggcgttgtttgacgattatagtgacgaagagagacaaaaaaaaagagtttagtcttctttgtttgggagacgaagacgatagaagctggttttacgggagagaaattagagaggttacagttacagagcaggaaggattgcgttgcgttacgattcagatctctctcgatcgttacttacatgcattagagaacaagaaaacgtggagacggaatccaagggaccttcttcttcaatttaattcctcactttattacgcacccttcttttattttcgactgtttcagcttccggttcttcatcggagagagatagagagactgtgtgttttggtgtgactgatagaagatttaatcagctg

SEQ ID NO: 4719 - DNA, 3000 bp, Unknown; identical to SEQ ID NO: 4713
  misc_feature (1)..( 3000): cDNA_ID_1830941_gDNA_ID_1620724_Annot_ID_165902 3000 nt of promoter + ATG

SEQ ID NO: 4720 - DNA, 3000 bp, Unknown; identical to SEQ ID NO: 4712
  misc_feature (1)..( 3000): cDNA_ID_3409311_gDNA_ID_1620724_Annot_ID_165899 3000 nt of promoter + ATG

SEQ ID NO: 4721 - DNA, 3000 bp, Unknown; identical to SEQ ID NO: 4711
  misc_feature (1)..( 3000): cDNA_ID_1825234_gDNA_ID_1620724_Annot_ID_165898 3000 nt of promoter + ATG

SEQ ID NO: 4722 - DNA, 3000 bp, Unknown; identical to SEQ ID NO: 4710
  misc_feature (1)..( 3000): cDNA_ID_2170308_gDNA_ID_1620724_Annot_ID_165897 3000 nt of promoter + ATG

SEQ ID NO: 4723 - DNA, 3000 bp, Unknown
  misc_feature (1)..( 3000): cDNA_ID_3073985_gDNA_ID_1620724_Annot_ID_165896 3000 nt of promoter + ATG
ggcattgcagcttcagagggaaagagtcaggtggcaaatgaagctgatacattgttcttctccaatttgaacaacatccaaaagactactggcgggaaggcatcatcgcagccaaagcgcacgccagtttcaaacgaagaaatggaagccattttggtatgtaacttcattttgacatgtataacaacacttagatgaacatgtatctaacagtataatgtgtgaccaactactaagttataattatgtgaccaattacaagttgagagaacccttttcatgatttaataatattgttctgtttctaacttccttatccttttctgaattttttttacagttgggaggctgcatctgatcatttcaacatgatctgttgacaagaatggtggatcacttctcatctttaccatttacagaatatactcgatagtcaagaagaaactgatatggttgatgtttacaacaaccaatgataacaataaaactactccattgcagtttttaacttctatactgattcatcattgattgagtgcatttgaatctctattattaagtgctttatgattgaaattcatcgtttattcttttttttatatcacatgatgaagctcttttagaaccagtcagaaatattgtagcctaaaacgcaaaggtacgttacatatacattcacaggaacttacatacagagaagagaagatcacttatggtgctgcctcttccttttgcatctgttcgataagaggctcgagaatacaagactttggattcttacccggtggacctttttctcttcgttcaagctcttcaagcctgaaagtaatgagacggtcccagtttcctccttcgaacaagacaccagcttttccatcagtgatcctctgcacaattccacaatacatgtgatacggactgttctggttcttgactatagcaatcatccccggcatgagaaggggtagcttgggcgctttcggcttcttatctgtagcaaccgcggatgcatcgcttccttgttttgcaggtggtggtggtggaggaggtggtggatttttttcgataaacgtttttaaacccttttcgccaccgggaaatcctcctgtgagacccatcatctctttctcgaaaccatcttcaggtactttaaaagacaagttactgtcatcgctctctctctctgtctcgttgttctcagcctttgatgtctcttgctcgtcttcaatgttcctctggagctccttctcaatacctttctctccgttgcataatcctcttcctcccatcacttcccatagattgaatttacccatggcctttacttgatacagttttgactgctgttttggaggcgggaaaaccgaccggtttacagttgaaaattgatgtgtttggcctagaaattttgatcgatgaatcggagttctaatggtcgggatagtgatcgaagaagtcgccataactatttttgcctgcagagtagagtagaggtgactaagggagatatgaagaagatggaagaggaaggaagaagcgtgtgattgattcgcttgttataatgaccacatatcatgatttcagttagatgagttctatctatttccaaattaccagtggacctgaaccggttaatgcgtaaccggtgtttggaataatgatttaggagaaagagtaggaacatttgggctttgtcataagtttaacctggaccaagtttgaatattcttaagagatatgggcctagattaaaaacaatggtaatgtaattaaacatattgctaaatgctaataatgtggatttgtttgtttattaagaaaaaagcagcaagaagaagataaatcatttgggtcaacgacattaataattggaatcccatactcccaaatcataattagacatacacttttgtcttaggctgtcctttacactcatcggcatcaccaaatacttagttggcaactttgatcaattaatgtattaagcatgaatgaaaacaacttttacattgattcgataaattcattatattgtagataagattagtcaaaagtttacaaacattcgttaacaaattacaaaacttgtaatatctgcagcaatgcccatgtgggtagagctggctgacgcaacctaaccgggggataaaagcgtctttttggtaccaaatttaaagtttctttatgagtaaaattcccaaacccaacatcttcttcctgctgaagcagtaagcactcaaccaaaaaaccaattgcgtaaacactttcccttgaatacagagatcacattcgatcaggtaaaaacaaggtctcgatcttctcttcagtcaattttttcaaattattcgaggttcccgtcattcgattccgacttccgagcttctatttctgctcaatgtttttgtattttgttagggtttccagaaaattcgattctgttgtttttaatttgagctaataaaatctagaatgggaaaaagaaagagttcattttcgtcctctttctttttgtagaagctgaactttgtttttcttttacagcgagctgatttctcacaagggatatcaaaatttctggtgaagtgggattgtaaaattcggcgttgaaagatatataaagaggtatgtttgatcctcagtgaggaataaggatttttagtagttatatatctctccaagtgatgatacatacatacttgtggattagatctatgataagaataagcataagatagagactgagagacaagtcatttagggagattaaataatgttcatggaatgctaaagttcatataggagtttgtctcatatcagaatctagattagatcatgctcagatgacatctcttgaatggacaaaaaagtttttaactatgtgattttttcgacttcttttggggaatcaatgtactacaagctgagagttttagagtagtttcatctctggctaagctttgattcattttctagtggaaggttctggagtcgtttcaattc

SEQ ID NO: 4724 - DNA, 3000 bp, Unknown; identical to SEQ ID NO: 4708
  misc_feature (1)..( 3000): cDNA_ID_3073992_gDNA_ID_1620724_Annot_ID_165888 3000 nt of promoter + ATG

SEQ ID NO: 4725 - DNA, 3000 bp, Unknown
  misc_feature (1)..( 3000): cDNA_ID_2170289_gDNA_ID_1620724_Annot_ID_165887 3000 nt of promoter + ATG
aaatggtgagcccttaagaccttgaatagagccagcgtttcgaacgttaactccccaaacgttcttgatatgtattcccttaacaactggaagagcgttcgggttataattctcgtccggatgatctcccgtgtcgccggcgatcttgatcccatactttgcggtgtctacatagacgtctgatattttgatgtttttaatgtatcctccacgaccaatgtttgtcttgatgttgactccaactcccatattggagagagtgatatgttctgctataatgttcttgattcctcctgatgtttcgcttcctattgcgatacctgcgaacggggaagatcctgtgatgcggcggattgttatgtttgagcttggacggccataggcgattccgtactggtcccaaccgcttttgatggccactaggtcgtctcctgttgagatgtaggagtcttctatgcagacgttgtagctggaatctatcaacaaattcattttgttcagatgttaataaacagctttgattattatgcacacaaaaacatttccaagttcatatctagacatgtttgatcacagcaaccaatctagtagtctactgtggattggaaaaagagttaagagtaagatgaacctggatcgattccatcggtgttgggagaatcttgtggagctaagatcgtaacgtgatggatgacaacgttgctgccacggatcaaaacaagtaacaaagtcaataccataagaagaggaagatatattatatctacgtttgggagatctaaagggtattaactagtgttatatacctgcaatacacaggatgaatgttccagaaaggtgaattttggaaaataacattggagattatgatctccttagagtccttgaactcgattaagttcggtcttgtgtactttagcgttctactacgccacatgttccaccacacttctccttgaccgtctattgtcccattttgtcctgtgtacatagtgttgcaatttaatgtcaaaacagtgctgcaacaagaagaatatttcttgtaacaaaatatctattttgaactgtatcatctaagccatatagatatgactgaaatataagatggtcgaaactaaccagtgatgactacatcacgaagcccatcaccatgaataaagctcatataccgtccccctggtaactctctccctcttccataagacggcaaaggatcaatcaatggccaattccaggtatcctgaagtcaacacacaacaaaagccaaaaggtcacaaaacaattcacaagattcccactctgcattaatcacccaaatttcaacgaagtggccttgtcctcatttctgtctcaggacaaatgaaatggtcctgacttattaatgtttacaagctcaaaatcggtcataaggtgcacacacacacacacattgatatgcactacaatgacaagttttgtgttttttcttcactcacatgaagacaaaccaagcagaaaattaaatctgagtatttaacatagatggcagcatcctacttcattgatctgagatactcactaaaggattatgaaacccataactgtccagagtcccataaaacccataactatccacagtcccaactatagaaaacactctaaccaagatttaatctactttagtcacttagatattttctttaatatatcacatacactagtagagaatataataaccaaattttgacaaaaattggataacgcgaagacaaaatttgccagctatcttcgggtcagctattgaaacatagacataaaagcagtacaccacatgcatacaataacattttatccccgacggtcccatgatgctttggagcttggacctaccaataccaaattccatacccatagttattactacttatcaattattatacgtgcatggttccccaaatcttctttcttctttcaaaataaaaacttgatcaaaaagatgacattttgagaattcactccaattcagatccaatcaaataggcaaaaaaaaaaatgcaattctatttttagaatactatactttataaaaataataactatagtcaaaaaaatttgaaatgtaatcactcacagtatttgacagttaatcatcaaactcatttccagagagtagatatagaccactcaccaagaaagattagtaaccattaattcattaataacatttgactaatgagctaatttcaatttcaaatcagcaactaacgaattcgtcactcattactcatttcaaatcatctcataccaatccaatttcataattcaaaattcacagtgataaaccagaaaatttgaaattttacctgaacagctctaatcacagcacctttagctaagtaaagagtcatatggctagtgagattgaagctctccgtcaaatacactcccggaggtatatacaaaagcgtgcctcctctcctcttcagatgctgaatccgataaatcgccgccctaaacgccttagtattcaccgttcgaccatctccaacgcctccaaagtcggttatcgagatcttatcgtaccggtaccgtaacggaactataccggaacacgtcgcctccgaatcgcccaacgaagacgaagaaacgaagagacatgagaagaggaaaattgacacagagagtctccacattttcgatgaagagaggtttatttaggatgagagtaaaatctgcagaattggagctaagattagtatgatatagtcgacactcgacaacgttcaatagaagaaggcacgtgctgatacacgtgaatcaacgggccatataagctagaaacgtttgggctttagtggcccaataaggatgaacaactttttgttttttgtttttggcggatttttttaattctttgattttctattttatttagggtttttattcttattatataaaggttggatcggtttgtgaaatttggagctaagatcagagatttcagcgatttggagattggag
